(12) United States Patent
Harrington et al.

(10) Patent No.: US 7,420,044 B1
(45) Date of Patent: Sep. 2, 2008

(54) NUCLEIC ACID AND PROTEIN HOMOLOGS AND USES THEREOF

(75) Inventors: John J. Harrington, Mentor, OH (US); P. David Jackson, Shaker Heights, OH (US); Bruce A. Sherf, Spencer, OH (US); Scott Cain, Seven Hills, OH (US); Stephen E. Rundlett, Chagrin Falls, OH (US); Rakesh Ramachandran, Richmond Heights, OH (US)

(73) Assignee: ABT Holding Company, Cleveland, OH (US)

( * ) Notice: Subject to any disclaimer, the term of this patent is extended or adjusted under 35 U.S.C. 154(b) by 889 days.

(21) Appl. No.: 10/098,754

(22) Filed: Mar. 15, 2002

Related U.S. Application Data

(63) Continuation of application No. 09/791,539, filed on Feb. 22, 2001, now abandoned.

(51) Int. Cl.
*C07H 21/02* (2006.01)
*C12P 21/06* (2006.01)
*C12N 15/00* (2006.01)

(52) U.S. Cl. .................. 536/23.1; 435/69.1; 435/320.1

(58) Field of Classification Search .................. 435/6, 435/252.3, 320.1; 536/23.1, 24.3, 24.33
See application file for complete search history.

(56) References Cited

U.S. PATENT DOCUMENTS

| 2003/0037350 A1 | 2/2003 | Glucksmann et al. |
| 2003/0212256 A1 | 11/2003 | Edinger et al. |
| 2004/0224378 A1 | 11/2004 | Jackson et al. |

OTHER PUBLICATIONS

Cal et al., "Identification, Characterization, and Intracellular Processing of ADAM-TS12, a Novel Human Disintegrin with a Complex Structural Organization Involving Multiple Thrombospondin-1 Repeats," The Journal of Biological Chemistry, May 2001, vol. 276, No. 21, pp. 17932-17940.*
Meinkoth et al., "Hybridization of Nucleic Acids immoblized on Solid Support," Analytical Biochemistry, 1984, vol. 138, p. 269 only, specifically Equation #5.*
Exhibit A.*
Exhibit B.*
Cordes et al., "Sequence space, folding and protein design," Current Opinion in Structural Biology, 1996, vol. 6, pp. 3-10.*
Buck et al., "Design Strategies and Performance of Custom DNA Sequencing Primers," BioTechniques, 1999, vol. 27, No. 3, pp. 528-536.*
Chapman, et al. Emerging roles for cysteine proteases in human biology. Annu Rev Physiol. 1997;59:63-88.
De Strooper, et al. A presenilin-1-dependent gamma-secretase-like protease mediates release of Notch intracellular domain. Nature. Apr. 8, 1999;398(6727):518-22.
Ellerbroek, et al. Membrane associated matrix metalloproteinases in metastasis. Bioessays. Nov. 1999;21(11):940-9.
Forget et al. "Physiological roles of matrix metalloproteinases: implications for tumor growth and metastasis." Can J Physiol Pharmacol Jul. 1999;77(7):465-80.
Hengartner. Programmed cell death in the nematode *C. elegans*. Recent Prog Horm Res. 1999;54:213-22.
Kashparov, et al. Mechanism of action of aspartic proteases. Adv Exp Med Biol. 1998;436:115-21.
Lecourtois, et al. Indirect evidence for Delta-dependent intracellular processing of notch in Drosophila embryos. Curr Biol. Jun. 18, 1998;8(13):771-4.
Moon, et al. WNTs modulate cell fate and behavior during vertebrate development. Trends Genet. Apr. 1997;13(4):157-62.
Nagase et al. "Matrix Metalloproteinases." *J. Biol. Chem.* 1999;274:21491-4.
Schroeter, et al. Notch-1 signalling requires ligand-induced proteolytic release of intracellular domain. Nature. May 28, 1998;393(6683):382-6.
Struhl, et al. Nuclear access and action of notch in vivo. Cell. May 15, 1998;93(4):649-60.
Wodarz, et al. Mechanisms of Wnt signaling in development. Annu Rev Cell Dev Biol. 1998:14:59-88.
Woessner, "Matrix metalloproteinases and their inhibitors in connective tissue Remodeling", *FASEB J.* 1991;5:2145-54.
Yamamoto, et al. Activities, localizations, and roles of serine proteases and their inhibitors in human brain tumor progression. J Neurooncol. 1994;22(2):139-51.
U.S. Appl. No. 60/182,145, filed Feb. 12, 2000, Harrington et al.
U.S. Appl. No. 10/869,707, filed Jun. 15, 2004, Harrington et al.

* cited by examiner

*Primary Examiner*—Young J Kim
(74) *Attorney, Agent, or Firm*—Thompson Hine LLP

(57) ABSTRACT

The present invention relates to the identification of novel nucleic acid molecules and the proteins encoded by these nucleic acid molecules, as well as their production for use as therapeutics, diagnostics and for research purposes.

32 Claims, No Drawings

NUCLEIC ACID AND PROTEIN HOMOLOGS AND USES THEREOF

RELATED APPLICATIONS

This Application is a Continuation Application of application Ser. No. 09/791,539 filed on Feb. 22, 2001, now abandoned. This application is related to U.S. Provisional Application (Ser. No. 60/182,145), filed on Feb. 12, 2000 and entitled "Novel Nucleic Acid and Protein Homologs and Uses Thereof," and U.S. Provisional Application (Ser. No. 60/182,145 60/182,146), filed Feb. 12, 2000 and entitled "Novel Nucleic Acid and Protein Homologs and Uses Thereof. The contents of all of the aforementioned applications are hereby incorporated by reference.

FIELD OF THE INVENTION

The present invention relates to the identification of novel polynucleotides and the proteins encoded by these polynucleotides, as well as their production for use as therapeutics, diagnostics and research purposes.

BACKGROUND OF THE INVENTION

Genes are the basic unit of hereditary information contained within an organism and as such numerous mechanisms exists to ensure the stability of their sequence over many generations. These stabilizing mechanisms ensure that the sequence of nucleotides that comprises a gene is maintained in a constant form over time, and since this nucleotide sequence encodes the regulatory sequences that determines gene expression and the coding sequences that determine protein structure and function these genetic properties are also stably maintained. It follows that distinct genes can be distinguished based upon these differences in their sequence. The gene sequence determines the expression pattern and function of the gene and its protein product, so genes with distinct sequence will be expected to display distinct biological functions. The proteins that are translated from these gene sequences serve as the foundation for the construction of more complex structures and catalytic machinery that is the basis for the metabolic, developmental and physiological processes that make complex organisms and life possible. The eventual location of these structures and their corresponding functional activities are also determined by the underlying gene sequence that codes for their formation. Recent assessments of the human genome estimate that the human genome contains approximately 140,000 genes. Whereas each of these sequences has varying roles, many of these genes can be grouped into classes based on the function of the protein for which they encode. In turn, if a gene sequence is translated into a protein found to be involved in an important physiological pathway, it may be particularly relevant for both diagnostic and therapeutic uses. The identification and functional characterization of all of the genetic determinants of life is among the challenges of modern biology and medicine.

The examination for nucleotide identity establishes which trapped genes correspond to genes that are novel and the protein coding analysis identifies protein sequence motifs and domains of functional importance that the novel gene products have in common with proteins of known function. Examination of these protein similarities with known proteins implies aspects of the function of the novel genes and provides experimental approaches to test and elaborate upon knowledge of the function of these novel genes. One of the ways to establish gene function for novel genes is to use genetic manipulations to disrupt the normal expression of the novel gene in cells or experimental organisms. Observation of the phenotypic consequences of such genetic manipulations reveals the biological role and utility of a novel gene, even for those that have no identifiable sequence relationship to proteins of known function.

Identification of the timing and patterns of expression for the novel transcript and the proteins they encode also reveals biological function. Transcript expression can be mapped by RT-PCR analysis of cDNA from a variety of tissue and species sources, or by in situ hybridization to tissue samples, cells, or intact model organisms (e.g. mice, zebrafish, Drosophial or *Caenorhabditis*; Hughes S C, Krause H M, "Double labeling with fluorescence in situ hybridization in *Drosophila* whole-mount embryos", Biotechniques 1998 April; 24(4):530-2; O'Neill J W, Bier E, "Double-label in situ hybridization using biotin and digoxigenin-tagged RNA probes", Biotechniques 1994 November; 17(5):870, 874-5; Coutinho L L, Morris J, Ivarie R, "Whole mount in situ detection of low abundance transcripts of the myogenic factor qmf1 and myosin heavy chain protein in quail embryos", Biotechniques 1992 November; 13(5):722-4; Conlon R A, Herrmann B G, "Detection of messenger RNA by in situ hybridization to postimplantation embryo whole mounts", Methods Enzymol 1993; 225:373-83). The expression pattern and subcellular distribution of the novel proteins can be assayed with immunohistochemical approaches using tagged or labeled affinity reagents (e.g. antibodies or phage displayed peptides with affinity for the novel proteins and detectable tags or labels) to localize protein expression within cells and cell supernatents, tissue samples, whole model organisms or protein extracts (Paddock S W, Langeland J A, DeVries P J, Carroll SB, "Three-color immunofluorescence imaging of *Drosophila* embryos by laser scanning confocal Microscopy", Biotechniques 1993 January; 14(1):42-8).

Evidence for gene function can be obtained from the bioinformatic identification of sequence relationships between novel and known proteins, and can take advantage of the expression information to refine these implications. Molecular and classical genetics and biochemical assays are then used to establish gene function. Genetic alterations in the level or sequence of the expressed protein can be introduced into model organisms or cells in culture (U.S. patent application Ser. No. 09/276,820; Mortensen R M, "Double knockouts. Production of mutant cell lines in cardiovascular research", Hypertension 1993 October; 22(4):646-51). Detailed characterization of the phenotype that results from this altered expression furthershows how the novel protein functions. The phenotypes that can result include transcriptional changes (monitored by in situ hybridization or DNA array analysis; Eisen M B, Brown P O, "DNA arrays for analysis of gene expression", Methods Enzymol 1999; 303: 179-205; Drmanac R, Drmanac S, "cDNA screening by array hybridization", Methods Enzymol 1999; 303:165-78), alterations in protein expression or changes in cell or organismal organization, environmental responses, or viability. Proteins that interact with the novel protein to participate in the implementation of its biological function can be identified by two hybrid screens for interactions among intracellular protein domains (Niethammer M, Sheng M, "Identification of ion channel-associated proteins using the yeast two-hybrid system", Methods Enzymol 1998; 293:104-22), and by expression cloning (Nelson N, Liu Q R, "Cloning of genes or cDNAs encoding neurotransmitter transporters and their localization by immunocytochemistry", Methods Enzymol 1998; 296:52-64; Romero M F, Kanai Y, Gunshin H, Hediger M A, "Expression cloning using *Xenopus laevis* oocytes", Methods Enzymol 1998; 296:17-52; Blackwood E M, Eisenman R N, "Identification of protein-protein interactions by la~nbda gtl 1 expression cloning", Methods Enzymol 1995; 254:229-40; Miki T, Aaronson S A, "Isolation of oncogenes by expression cDNA cloning", Methods Enzymol 1995; 254: 196-206; Sparks A B, Adey N B, Quilliam L A, Thorn J M, Kay B K, "Screening phage-displayed random peptide libraries for SH3 ligands", Methods Enzymol 1995; 255:498-509; Margolis B, Skolaik E Y, Schlessinger J, "Use of tyrosine-phosphorylated proteins to screen bacterial expression libraries for SH2 domains", Methods Enzymol 1995; 255:360-9; Singh H, "Specific recognition site probes for isolating genes encoding I:)NA-binding proteins", Methods Enzy~nol 1993; 218:551-67) or modifier genetics approaches for intracellular as well as receptor and secreted novel proteins (Dove; W F, Shedlovsky; A, "METHOD FOR IDENTIFYING MUTANTS AND MOLECULES", United States U.S. Pat. No. 5,780,236, Jul. 14, 1998). The expression cloning approach can be used whenever a molecular interaction, activity or phenotype can be used to screen for protein expression, and genetic screens are applicable whenever modulation of gene activity detectably affects the biology or biochemistry of a cell or organism. A related approach to the identification of gene function is to test the ability of libraries of novel genes to transcomplement the phenotypic effects of mutations in human cells or in those of a heterologous species (e.g. Norbury C, Moreno S, "Cloning cell cycle regulatory genes by transcomplementation in yeast", Methods Enzymol 1997; 283:44s9).

In some instances, coding information present in the full length transcript for a particular gene may not be included in the sequence of the initial complementary DNA clone that was obtained. In these cases oligonucleotide primers are designed to enable the implementation of 5'-RACE to recover the missing exons (Matz M, Shagin D, Bogdanova E, Britanova O, Lukyanov S, Diatchenko L, Chenchik A, "Amplification of cDNA ends based on template-switching effect and step-out PCR", Nucleic Acids Res 1999 Mar. 15; 27(ó):1558-60). Alternatively, labeled probes prepared from the original cDNA clones can be used to screen cDNA and genomic libraries to recover the missing coding exons (Liu M, Subramanyam Y V, Baskaran N, "Preparation and analysis of cDNA from a small number of hematopoietic cells", Methods Enzymol 1999; 303:45-55; Carninci P, Hayashizaki Y, "High-efficiency fulllength cDNA cloning", Methods Enzymol 1999; 303:19-44). cDNA libraries to be screened can be preselected for those that contain cDNA copies of the transcripts of interest by PCR using primers complementary to the existing cDNA clones.

Despite the recent advances made in the field of human genetics, a large number of polynucleotides encoding receptor or other signaling proteins as well as proteins engaged in metabolic or structural roles necessary for normal cell functions and physiology have not yet been identified. Of those that have been isolated, many have been found to play a role in disease when this gene sequence is modified. In addition there is overwhelming evidence that polymorphism in genetic composition in determining the susceptibility to disease and in modifying the severity of disease manifestations. Due to the important role that these proteins play in maintaining the human condition, it is useful to identify and characterize novel human proteins and the polynucleotides that encode them. This information will enhance our ability to diagnose medical disorders that are influenced by gene expression, by giving the medical community the opportunity to ameliorate these conditions or even prevent them entirely through the development and administration of gene, protein and small molecule therapeutics designed to treat the cause and symptoms of disease.

SUMMARY OF THE INVENTION

The present invention is based, at least in part, on the discovery of novel nucleic acids, polypeptides, and the characterization of their function. The inventors have identified and disclosed the partial and complete sequence of a large number of genes whose sequence differs from that of genes whose sequence has been published in the public databases; these disclosed genes are novel based upon this sequence divergence. In addition to many examples of nucleotide sequence divergence there are also novel splice variants presented among the novel gene sequences disclosed in this application. These novel splice variants include coding exons that are found in the transcripts from known proteins that are assembled in novel arrangements with occasional exclusion of exons normally included in known versions of these transcripts and occasional inclusion of novel exons not found in the known versions of these transcripts. These novel splice variants encode proteins that differ in overall sequence from that of the known proteins, and these sequence differences are expected to be reflected in functional differences between the splice variants and the known gene products. There are cases in which the identified nucleotide sequence or protein sequence that is encoded by the disclosed gene sequence shows limited similarity to the sequence of known genes or proteins. Such structural relationships are one way to begin to define the function of novel genes.

Accordingly, in one aspect the present invention provides an isolated nucleic acid molecules that encode novel polypeptides as described herein, as well as nucleic acid fragments suitable as primers or hybridization probes for the detection of nucleic acids of the invention.

In one embodiment, the invention features an isolated nucleic acid molecule that comprises a nucleotide sequence selected from the group consisting of SEQ ID NOS:1-21062, and the complements of SEQ ID NOS: 1-21062.

In another embodiment, the isolated nucleic acid molecule of the invention is at least 50%, 60%, 65%, 70%, 75%, 80%, 85%, 90%, 95%, 98% or more homologous to a nucleotide sequence (e.g., to the entire length of the nucleotide sequence) including SEQ ID NO:1-21062, or a complement thereof.

In another embodiment, the invention provides an isolated fragment or portion of a nucleic acid molecule comprising a nucleotide sequence selected from the group consisting of SEQ ID NOS: 1-21062, and the complements of SEQ ID NOS:1-21062. In preferred embodiments, the fragment is useful as a probe or primer, and is at least 15, 18, 20-25, 30, 50, 100, 200 or more nucleotides in length.

In a related embodiment, the invention features nucleic acid molecules which specifically detect a nucleic acid molecule comprising a nucleotide sequence selected from the group consisting of SEQ ID NOS:1-21062, or a complement thereof. For example, in one embodiment, such a nucleic acid molecule is at least 20, 30, 40, 50, 100, 150, 200, 250, 300, 350, 400, 450, 500, 550, 600, 650, 700, 750, or 800 nucleotides in length and hybridizes under stringent conditions to a nucleic acid molecule comprising the nucleotide sequence shown in SEQ ID NO:1-21062, or a complement thereof.

In another embodiment, the nucleic acid molecule encodes a polypeptide that is encoded by a nucleic acid comprising a nucleotide sequence selected from the group consisting of SEQ ID NO:1-21062. In one preferred embodiment, the nucleic acid molecule encodes a polypeptide comprising an amino acid sequence selected from the group consisting of SEQ ID NO: 21063-21107.

In other preferred embodiments, the nucleic acid molecule encodes a naturally occurring allelic variant of a polypeptide encoded by a nucleic acid molecule comprising a nucleotide sequence selected from the group consisting of SEQ ID NO1-21062, wherein the nucleic acid molecule hybridizes to a nucleic acid molecule which includes SEQ ID NO:1-21062 under stringent conditions.

Another embodiment of the invention provides an isolated nucleic acid molecule which is antisense to a nucleic acid molecule, e.g., the coding strand of a nucleic acid molecule comprising a nucleotide sequences selected from the group consisting of SEQ ID NO:1-21062.

Another aspect of the invention provides a vector comprising a nucleic acid molecule of the invention. In certain embodiments, the vector is a recombinant expression vector. In another embodiment, the invention provides a host cell containing a vector of the invention. The invention also provides a method for producing a polypeptide, encoded by a nucleic acid molecule of the invention, by culturing in a suitable medium, a host cell, e.g., a mammalian host cell such as a non-human mammalian cell, of the invention containing a recombinant expression vector, such that the polypeptide is produced.

Another aspect of this invention features isolated or recombinant polypeptides and proteins encoded by the nucleic acid molecules of the invention. In one embodiment, the isolated polypeptide is encoded by a nucleic acid molecule comprising a sequence selected from the group consisting of SEQ ID NO:1-21062. In another embodiment, the polypepted comprises an amino acid sequence selected from the group consisting of SEQ ID NO:21063-21107.

In another embodiment, the isolated polypeptide is encoded by a nucleic acid molecule having a nucleotide sequence which hybridizes under stringent hybridization conditions to a nucleic acid molecule comprising the nucleotide sequence of SEQ ID NO:1-21062.

Another embodiment of the invention features an isolated polypeptide which is encoded by a nucleic acid molecule having a nucleotide sequence at least about 50%, 55%, 60%, 65%, 70%, 75%, 80%, 85%, 90%, 95%, 98% or more homologous to a nucleotide sequence (e.g., to the entire length of the nucleotide sequence) including SEQ ID NO:1-21062, or a complement thereof.

This invention further features an isolated polypeptide which is encoded by a nucleic acid molecule having a nucleotide sequence which hybridizes under stringent hybridization conditions to a nucleic acid molecule comprising the nucleotide sequence of SEQ ID NO:1-21062, or a complement thereof.

The polypeptides of the present invention can be operatively linked to a heterologous amino acid sequences to form fusion proteins. The invention further features antibodies, such as monoclonal or polyclonal antibodies, that specifically bind polypeptides of the invention. In addition, biologically active polypeptides or fragments of polypeptides can be incorporated into pharmaceutical compositions, which optionally include pharmaceutically acceptable carriers.

In another aspect, the present invention provides a method for detecting the presence of a nucleic acid molecule or polypeptide of the invention in a biological sample by contacting the biological sample with an agent capable of the nucleic acid molecule, or polypeptide such that the presence of a the nucleic acid molecule or polypeptide is detected in the biological sample.

In another aspect, the present invention provides a method for detecting the presence of polyeptide activity in a biological sample by contacting the biological sample with an agent capable of detecting an indicator of polypeptide activity such that the presence of polypeptide activity is detected in the biological sample.

In another aspect, the invention provides a method for modulating polypeptide activity comprising contacting a cell capable of expressing the polypeptide with an agent that modulates the activity such that the activity in the cell is modulated. In one embodiment, the agent inhibits polypeptide activity. In another embodiment, the agent stimulates polypeptide activity. In one embodiment, the agent is an antibody that specifically binds to a polypeptide of the invention. In another embodiment, the agent modulates expression of the polypeptide by modulating transcription of a nucleic acid encoding the polypeptide or translation of a mRNA encoding the polypeptide. In yet another embodiment, the agent is a nucleic acid molecule having a nucleotide sequence that is antisense to the coding strand of the polypeptide mRNA.

In one embodiment, the methods of the present invention are used to treat a subject having a disorder characterized by aberrant polypeptide or nucleic acid expression or activity by administering an agent which is a modulator of the polypeptide or nucleic acid to the subject.

The present invention also provides a diagnostic assay for identifying the presence or absence of a genetic alteration characterized by at least one of (i) aberrant modification or mutation of a nucleic acid molecule of the invention; (ii) mis-regulation of the gene comprising a nucleic acid molecule of the invention; and (iii) aberrant post-translational modification of a polypeptide of the invention, wherein a wild-type form of the gene encodes a polypeptide with a activity.

In another aspect the invention provides a method for identifying a compound that binds to or modulates the activity of a polypeptide of the invention. The method includes providing an indicator composition comprising the polypeptide, contacting the indicator composition with a test compound, and determining the effect of the test compound on the activity of the polypeptide in the indicator composition to identify a compound that modulates the activity of a the polypeptide.

Other features and advantages of the invention will be apparent from the following detailed description and claims.

DETAILED DESCRIPTION OF THE INVENTION

The nucleic acids and polypeptides described herein were obtained using a gene discovery method that employs random insertional mutagenesis to activate expression of transcription units throughout the human genome (as described in U.S. patent application Ser. No. 09/276,820, the contents of which are incorporated herein in their entirety by reference). Once individual activated transcripts were transformed into cDNA, cloned and the cDNA inserts sequenced, the resulting cDNA clone sequences were grouped by regions of overlapping identical sequence for each of the trapped genes, and the sequence reads were assembled into contiguous gene specific sequences.

As used herein, the term "cluster" is a group of very closely related sequence tags. The sequences in the cluster are generally considered to have arisen from the same gene. However, since individual sequences may correspond to different regions of the same gene, a single cluster may contain multiple, non-overlapping sequences. For example, two independent sequencing reads (one forward and one reverse read) of a single DNA clone may result in two apparently unrelated sequences. However, since both sequences were obtained from a single DNA clone, it can be determined that these two sequences are derived from a single gene, and therefore, belong in the same cluster. Likewise, forward and reverse sequence reads may be obtained from two different DNA clones. Since different DNA clones have different size inserts primarily due to different lengths of sequence at the 5' end, it is possible that the reverse sequence reads may be identical, whereas the forward reads may appear unrelated. In this instance, all four sequences would be said to be from the same gene since the 3' ends of both clones are identical. As a result, all four sequences would be grouped into the same cluster. In this document, cluster identifiers are the first number in the consensus sequence identifier; for example, in the sequence identifier G12.3, 12 is the cluster identifier.

By "consensus sequence," as used herein, is meant a sequence that results from assembly of multiple overlapping sequence reads from the same cluster. The consensus sequence is the sequence that most closely agrees with all of the individual sequences that contribute to it. For example, to determine a consensus sequence, all sequences in a cluster are aligned and the most common nucleotide at each position is incorporated into the consensus sequence. As discussed above, a cluster may contain more than one consensus sequence, due to sequencing reads in different portions of a given gene. In this document, a consensus sequence identifier is in the form Gx.y, where x is an integer and is the cluster identifier, and y is an integer that identifies the consensus sequence in the cluster.

The relationship of the disclosed sequences to the sequence of known genes was examined by BLASTN (an NCBI program that compares a nucleotide query sequence against a nucleotide sequence database; Altschul S F, Gish W, Miller W, Myers E W, Lipman D J, "Basic local alignment search tool", J Mol Biol 1990 Oct. 5; 215(3):403-10) to identify nucleotide sequence similarities between these sequences and the sequences contained in the human EST and NT databases at NCBI. The disclosed gene sequences were also examined by BLASTX (an NCBI program that compares a nucleotide query sequence translated in all reading frames against the NCBI non-redundant protein sequence database; Gish W, States DJ, "Identification of protein coding regions by database similarity search", Nat Genet. 1993 March; 3(3): 266-72) and ematrix (Wu T D, Nevill-Manning C G, Brutlag D L, "Minimal-risk scoring matrices for sequence analysis", J Comput Biol 1999 Summer; 6(2):219-35; Scoring matrices are derived from the BLOCKS, PRINTS, PFAM, PRODOM, and DOMO databases: S. Henikoff, S. Pietrokovski & J. G. Henikoff, "Superior performance in protein homology detection with the Blocks Database servers", Nucl. Acids Res. 26:309-312 (1998); Attwood, T. K., Beck, M. E., Bleasby, A. J., Degtyarenko, K., Michie, A. D. and ParrySmith, D. J. (1997) "Novel developments with the PR1NTS protein fingerprint database". Nucleic Acids Research, 25(1), 212-216) to identify conserved protein sequences that are encoded by these expressed transcripts.

The nucleotides and polypeptides of the invention fall into many different protein classes. These include, but are not limited to, those classes described below. These classes are a convenient tool for characterizing individual protein molecules, but it is well understood by those skilled in the art that many of these classes overlap and, thus, proteins can demonstrate characteristics of more than one protein class.

Receptor Proteins

Receptors are broadly distributed in the body and they exert very important pleiotropic functions in different systems. Receptors are composed of extracellular, intracellular, and transmembrane polypeptide domains. Receptors are incorporated into the cell's membranes to permit the detection of exogenous chemical and physical stimuli that interact with the receptor. Detection of these environmental stimuli induces a change in the receptor that can be communicated to other proteins that are associated with the cell to influence cell function. Receptor mediated signaling in response to environmental stimuli can take the form of receptor mediated alterations in the flux of ions or other small molecules across the cell membranes, receptor induced changes in the pattern or magnitude of enzymatically catalyzed covalent protein modification (e.g. phosphorylation or dephosphorylation of cellular substrates), receptor induced changes in the enzymatic generation or degradation of small molecule second messengers (e.g. cAMP, cGMP, Ca2+ or inositol triphosphate) or alteration in the association of the receptor with accessory proteins (e.g. binding of G proteins peripheral membrane proteins, cytoskeletal proteins, or other adaptor proteins). Interaction of the activated receptor with these accessory proteins activates the signaling function of the complex to implement enzymatic protein modification or altered protein associations that directly or through additional signaling intermediates serves to influence cell structure, replication, metabolism and gene expression. Combination of these signaling mechanisms is often an important aspect of signaling. For example, activated receptors can bind or covalently modify a accessory protein or protein complex (including other receptors or ion channels) to change their function (e.g. changing small molecule flux through a channel, enzymatic activity or ability of the accessory proteins to associate with other molecules) and the altered function of these signaling partners can be the mechanism by which receptor detected stimuli are transduced into signals that alter cell biochemistry. Receptors can be classified into various general categories including (a) ion channels, (b) guanine nucleotide-binding proteins (G proteins), (c) receptor protein tyrosine kinases and phosphatases, and (d) cell adhesion molecules.

Ion Channel Proteins

Ion channels in mammalian systems have been, and currently are, the subject of intensive scientific investigation because of the importance and variety of their biochemical functions. Ion channels are now understood to be polypeptide or protein structures with tertiary-quaternary structure forming interior pores embedded in cell membrane walls, that control the flow of ionic currents.

There are many types of ion channels which share both similarity of function and amino acid sequence, thus defining familial relationships between many of these channels. Current work shows there are ion channel families comprised of voltage gated sodium, potassium, and calcium channels, as well as the ligand gated acetylcholine receptors, glycine receptors, and α-aminobutyric acid receptors.

A great deal is known about voltage gated sodium channels. These are transmembrane proteins responsible for the early sodium permeability increase underlying initial depolarization of the action potential in many excitable cells such as muscle, nerve, and cardiac cells. Several brain diseases have been associated with channel abnormalities and central nervous system dysfunction. Psychiatric diseases including depression and schizophrenia, and dementias, such as Alzheimer's all have association with dysfunction of the central nervous system whose neurons are controlled and regulated by sodium channels.

Considerably more work has been accomplished with voltage dependent sodium channels. The molecular characteristics of these channels has proven quite complex with multiple isoforms, differential tissue expression and limited sequence conservation between the various families of proteins.

Recent studies have identified another family of Na+ channels whose characteristic features include Na+ selectivity, inhibition by amiloride, and a conserved primary structure (Chalfie, M., (1990) Nature 345, 410-416; Driscol, M., (1991) Nature 349, 588-593; Huang, M., (1994) Nature 367, 467-470; Canessa, C. M., (1993) Nature 361, 467-470; Canessa, C. M., (1994) Nature 367, 463-467; McDonald, F. J., (1994) Am. J. Physiol. 266, L728-L734; McDonald, F. J., (1995) Am. J. Physiol. 268, C1157-C1163; Voilley, N., (1994) Proc. Natl. Acad. Sci. U.S.A. 91, 247-251; Lingueglia, E. (1993) FEBS Lett. 318, 95-99; Waldmann, R. (1995) J. Biol Chem. 270, 27411-27414; Lingueglia, E. (1995) Nature 378, 730-733). Family members contain 500 to 800 residues. Sequence analysis and studies of topology suggest that the amino and carboxyl termini are intracellular, that there are two hydrophobic regions that traverse the membrane (M1 and M2), and that between M1 and M2 there lies a large cysteine-rich extracellular domain (Snyder, P. M. (1994) J. Biol. Chem. 269, 24379.congruent.24383; Renard, S. (1994) J. Biol. Chem. 269, 12981-12986; Canessa, C. M. (1994) Am. J. Physiol. 267, C1682-C1690).

The best characterized members of this family are the amiloride-sensitive epithelial Na+ channels (ENaC) that control Na+ and fluid absorption in the kidney, colon, and lung. ENaC channels are constructed from at least three homologous subunits (α-, β-, and γENaC) (Canessa, C. M., (1993) Nature 361, 467-470; Canessa, C. M., (1994) Nature 367, 463-467; McDonald, F. J., (1994) Am. J. Physiol. 266, L728-L734; McDonald, F. J., (1995) Am. J. Physiol. 268, C1157-C1163; Voilley, N., (1994) Proc. Natl. Acad. Sci. U.S.A. 91, 247-251; Lingueglia, E. (1993) FEBS Lett.: 318, 95-99). Mutations in this channel cause a hereditary form of hypertension called Liddle's syndrome (Shimkets, R. A., (1994) Cell 79, 407-414) and pseudohypoaldosteronism (Chang, S. S., (1996) Nature Genetics 12, 248-253). These channels may also be involved in detection of salty taste (Li, X. J. (1994) Proc. Natl. Acad. Sci. U.S.A. 91, 1814-1818). A closely related subunit, .delta.NaCh, is expressed in pancreas, testis, ovary, and brain. δ NaCh generates Na+channels when coexpressed with β- and .γ.ENaC (Waldmann, R. (1995) J. Biol Chem. 270, 27411-27414), suggesting that it may be part of the ENaC subfamily of channels. Several family members have also been discovered in *C. elegans*, including MEC-4, MEC-10, and DEG-1, which when mutated produce a touch-insensitive phenotype (Chalfie, M., (1990) Nature 345, 410-416; Driscol, M., (1991) Nature 349, 588-593; Huang, M., (1994) Nature 367, 467-470). Specific mutations in the *C-elegans* group cause neural degeneration (Chalfie, M., (1990) Nature 345, 410-416; Driscol, M., (1991) Nature 349, 588-593). Based on this ability to produce cell degeneration, family members in *C. elegans* are called "degenerins." The most recent addition to this family is a Phe-Met-Arg-Phe-NH$_2$ (FMRF-amide)-stimulated Na+ channel (FaNaCh) cloned from *Helix* (Lingueglia, E. (1995) Nature 378, 730-733).

Another important functions of ion channel proteins are import/export of compounds through the cellular membranes. Cellular membranes serve to differentiate the contents of a cell from the surrounding environment, and may also serve as effective barriers against the unregulated influx of hazardous or unwanted compounds, and the unregulated efflux of desirable compounds. Membranes are by nature impervious to the unfacilitated diffusion of hydrophilic compounds such as proteins, water molecules, and ions due to their structure: a bilayer of lipid molecules in which the polar head groups face outwards (towards the exterior and interior of the cell) and the nonpolar tails face inwards (at the center of bilayer, forming a hydrophobic core). Membranes enable a cell to maintain a relatively higher intracellular concentration of desired compounds and a relatively lower intracellular concentration of undesired compounds than are contained within the surrounding environment.

However, membranes also present a structural difficulty for cells, in that most desired compounds cannot readily enter the cell, nor can most waste products readily exit the cell through this lipid bilayer. The import and export of such compounds is facilitated by proteins which are embedded (singly or in complexes) in the cellular membrane. There are several general classes of membrane transport proteins: channels/pores, permeases, and transporters. The former are integral membrane proteins which form a regulated passage through a membrane. This regulation, or 'gating' is generally specific to the molecules to be transported by the pore or channel, rendering these transmembrane constructs selectively permeable to a specific class of substrates. For example, a calcium channel is constructed such that only ions having a like charge and size to that of calcium may pass through. Channel and pore proteins tend to have discrete hydrophobic and hydrophilic domains, such that the hydrophobic face of the protein may associate with the interior of the membrane while the hydrophilic face lines the interior of the channel, thus providing a sheltered hydrophilic environment through which the selected hydrophilic molecule may pass. This pore/channel-mediated system of facilitated diffusion is limited to ions and other very small molecules, due to the fact that pore or channels sufficiently large to permit the passage of whole proteins by facilitated diffusion would be unable to prevent the simultaneous passage of smaller hydrophilic molecules.

Transport of larger molecules takes place by the action of 'permeases' and 'transporters', two other classes of membrane-localized proteins which serve to move charged molecules from one side of a cellular membrane to the other. Unlike channel molecules, which permit diffusion-limited solute movement of a particular solute, these proteins require an energetic input, either in the form of a diffusion gradient (permeases) or through coupling to hydrolysis of an energetic molecule (e.g., ATP or GTP) (transporters). The permeases, integral membrane proteins often having between 6-14 membrane-spanning α-helices) enable the facilitated diffusion of molecules such as glucose or other sugars into the cell when the concentration of these molecules on one side of the membrane is greater than that on the other. Permeases do not form open channels through the membrane, but rather bind to the target molecule at the surface of the membrane and then undergo a conformational shift such that the target molecule is released on the opposite side of the membrane.

Transporters, in contrast, permit the movement of target molecules across membranes against the existing concentration gradient (active transport), a situation in which facilitated diffusion cannot occur. There are two general mechanisms used by cells for this type of membrane transport: symport/antiport, and energy-coupled transport, such as that mediated by the ABC transporters. Symport and antiport systems couple the movement of two different molecules across the membrane (via molecules having two separate binding sites for the two different molecules); in symport, both molecules are transported in the same direction, while in antiport, one molecule is imported while the other is exported. This is possible energetically because one of the two molecules moves in accordance with a concentration gradient, and this energetically favorable event is permitted only upon concomitant movement of a desired compound against the prevailing concentration gradient.

Single molecules may also be transported across the membrane against the concentration gradient in an energy-driven process, such as that utilized by the ABC transporters. In this ABC transporter system, the transport protein located in the membrane has an ATP-binding cassette; upon binding of the target molecule, the ATP is converted to ADP and inorganic phosphate ($P_i$), and the resulting release of energy is used to drive the movement of the target molecule to the opposite face of the membrane, facilitated by the transporter.

Transport molecules are specific for a particular target solute or class of solutes, and are also present in one or more specific membranes. Transport molecules localized to the plasma membrane permit an exchange of solutes with the surrounding environment, while transport molecules localized to intracellular membranes (e.g., membranes of the mitochondrion, peroxisome, lysosome, endoplasmic reticulum, nucleus, or vacuole) permit import and export of molecules from organelle to organelle or to the cytoplasm. For example, in the case of the mitochondrion, transporters in the inner and outer mitochondrial membranes permit the import of sugar molecules, calcium ions, and water (among other molecules) into the organelle and the export of newly synthesized ATP to the cytosol.

Membrane transport molecules (e.g., channels/pores, permeases, and transporters) play important roles in the ability of the cell to regulate homeostasis, to grow and divide, and to communicate with other cells, e.g., to secrete and receive signaling molecules, such as hormones, reactive oxygen species, ions, neurotransmitters, and cytokines. A wide variety of human diseases and disorders are associated with defects in transporter or other membrane transport molecules, including certain types of liver disorders (e.g., due to defects in transport of long-chain fatty acids (Al Odaib et al. (1998) *New Eng. J. Med.* 339: 1752-1757)), hyperlysinemia (due to a transport defect of lysine into mitochondria (Oyanagi et al. (1986) *Inherit. Metab. Dis.* 9: 313-316), and cataract (Wintour (1997) *Clin Exp Pharmacol Physiol* 24(1):1-9).

Potassium ($K^+$) channels are ubiquitous proteins which are involved in the setting of the resting membrane potential as well as in the modulation of the electrical activity of cells. In excitable cells, $K^+$ channels influence action potential waveforms, firing frequency, and neurotransmitter secretion (Rudy, B. (1988) *Neuroscience,* 25, 729-749; Hille, B. (1992) *Ionic Channels of Excitable Membranes,* 2nd Ed.). In non-excitable cells, they are involved in hormone secretion, cell volume regulation and potentially in cell proliferation and differentiation (Lewis et al. (1995) *Annu. Rev. Immunol.,* 13, 623-653). Developments in electrophysiology have allowed the identification and the characterization of an astonishing variety of $K^+$ channels that differ in their biophysical properties, pharmacology, regulation and tissue distribution (Rudy, B. (1988) *Neuroscience,* 25, 729-749; Hille, B. (1992) *Ionic Channels of Excitable Membranes,* 2nd Ed.). More recently, cloning efforts have shed considerable light on the mechanisms that determine this functional diversity. Furthermore, analyses of structure-function relationships have provided an important set of data concerning the molecular basis of the biophysical properties (selectivity, gating, assembly) and the pharmacological properties of cloned $K^+$ channels.

Functional diversity of $K^+$ channels arises mainly from the existence of a great number of genes coding for pore-forming subunits, as well as for other associated regulatory subunits. Two main structural families of pore-forming subunits have been identified. The first one consists of subunits with a conserved hydrophobic core containing six transmembrane domains (TMDs). These $K^+$ channel α subunits participate in the formation of outward rectifier voltage-gated (Kv) and $Ca^{2+}$-dependent $K^+$ channels. The fourth TMD contains repeated positive charges involved in the voltage gating of these channels and hence in their outward rectification (Logothetis et al. (1992) *Neuron,* 8, 531-540; Bezanilla et al. (1994) *Biophys. J.* 66, 1011-1021).

The second family of pore-forming subunits have only two TMDs. They are essential subunits of inward-rectifying (IRK), G-protein-coupled (GIRK) and ATP-sensitive ($K_{ATP}$) $K^+$ channels. The inward rectification results from a voltage-dependent block by cytoplasmic $Mg^{2+}$ and polyamines (Matsuda, H. (1991) *Annu. Rev. Physiol.,* 53, 289-298). A conserved domain, called the P domain, is present in all members of both families (Pongs, O. (1993) *J. Membr. Biol.,* 136, 1-8; Heginbotham et al. (1994) *Biophys. J.* 66, 1061-1067; Mackinnon, R. (1995) *Neuron,* 14, 889-892; Pascual et al., (1995) *Neuron.,* and 14, 1055-1063). This domain is an essential element of the aqueous $K^+$-selective pore. In both groups, the assembly of four subunits is necessary to form a functional $K^+$ channel (Mackinnon, R. (1991) *Nature,* 350, 232-235; Yang et al., (1995) *Neuron,* 15, 1441-1447.

In both six TMD and two TMD pore-forming subunit families, different subunits coded by different genes can associate to form heterotetramers with new channel properties (Isacoff et al., (1990) *Nature,* 345, 530-534). A selective formation of heteropolymeric channels may allow each cell to develop the best $K^+$ current repertoire suited to its function. Pore-forming α subunits of Kv channels are classified into different subfamilies according to their sequence similarity (Chandy et al. (1993) *Trends Pharmacol. Sci.,* 14: 434). Tetramerization is believed to occur preferentially between members of each subgroup (Covarrubias et al. (991) *Neuron,* 7, 763-773). The domain responsible for this selective association is localized in the N-terminal region and is conserved between members of the same subgroup. This domain is necessary for hetero-but not homo-multimeric assembly within a subfamily and prevents co-assembly between subfamilies. Recently, pore-forming subunits with two TMDs were also shown to co-assemble to form heteropolymers (Duprat et al. (1995) *Biochem. Biophys. Res. Commun.,* 212, 657-663. This heteropolymerization seems necessary to give functional GIRKs. IRKs are active as homopolymers but also form heteropolymers.

New structural types of $K^+$ channels were identified recently in both humans and yeast. These channels have two P domains in their functional subunit instead of only one (Ketchum et al. (1995) *Nature,* 376, 690-695; Lesage et al. (1996) *J. Biol. Chem.,* 271, 4183-4187; Lesage et al. (1996) *EMBO J.,* 15, 1004-1011; Reid et al. (1996) *Receptors Channels* 4, 51-62). The human channel called TWIK-1, has four TMDs. TWIK-1 is expressed widely in human tissues and is particularly abundant in the heart and the brain. TWIK-1 currents are time independent and inwardly rectifying. These properties suggest that TWIK-1 channels are involved in the control of the background $K^+$ membrane conductance (Lesage et al. (1996) *EMBO J.,* 15, 1004-1011).

Organic Cation Transporters

Cellular membranes serve to differentiate the contents of a cell from the surrounding environment, and may also serve as effective barriers against the unregulated influx of hazardous or unwanted compounds, and the unregulated efflux of desirable compounds. Membranes are by nature impervious to the unfacilitated diffusion of hydrophilic compounds such as proteins, water molecules, and ions due to their structure: a bilayer of lipid molecules in which the polar head groups face outwards (towards the exterior and interior of the cell) and the nonpolar tails face inwards (at the center of bilayer, forming a hydrophobic core). Membranes enable a cell to maintain a relatively higher intra-cellular concentration of desired compounds and a relatively lower intra-cellular concentration of undesired compounds than are contained within the surrounding environment.

Membranes also present a structural difficulty for cells, in that most desired compounds cannot readily enter the cell, nor can most waste products readily exit the cell through this lipid bilayer. The import and export of such compounds is facilitated by proteins which are embedded (singly or in complexes) in the cellular membrane. There are several general classes of membrane transport proteins: channels/pores, permeases, and transporters. The former are integral membrane proteins which form a regulated L passage through a membrane. This regulation, or "gating" is generally specific to the molecules to be transported by the pore or channel, rendering these transmembrane constructs selectively permeable to a specific class of substrates. For example, a calcium channel is constructed such that only ions having a like charge and size to that of calcium may pass through. Channel and pore proteins tend to have discrete hydrophobic and hydrophilic domains, such that the hydrophobic face of the protein may associate with the interior of the membrane while the hydrophilic face lines the interior of the channel, thus providing a sheltered hydrophilic environment through which the selected hydrophilic molecule may pass. This pore/channel-mediated system of facilitated diffusion is limited to ions and other very small molecules, due to the fact that pores or channels sufficiently large to permit the passage of whole proteins by facilitated diffusion would be unable to prevent the simultaneous passage of smaller hydrophilic molecules.

Transport of larger molecules takes place by the action of "permeases" and "transporters", two other classes of membrane-localized proteins which serve to move charged molecules from one side of a cellular membrane to the other. Unlike channel molecules, which permit diffusion-limited solute movement of a particular solute, these proteins require an energetic input, either in the form of a diffusion gradient (permeases) or through coupling to hydrolysis of an energy providing molecule (e.g., ATP or GTP) (transporters). The permeases (integral membrane proteins often having between 6-14 membrane-spanning α-helices) enable the facilitated diffusion of molecules such as glucose or other sugars into the cell when the concentration of these molecules on one side of the membrane is greater than that on the other. Permeases do not form open channels through the membrane, but rather bind to the target molecule at the surface of the membrane and then undergo a conformational shift such that the target molecule is released on the opposite side of the membrane.

Transporters, in contrast, permit the movement of target molecules across membranes against the existing concentration gradient (active transport), a situation in which facilitated diffusion cannot occur. There are two general mechanisms used by cells for this type of membrane transport: symport/antiport, and energy-coupled transport, such as that mediated by the ABC transporters. Symport and antiport systems couple the movement of two different molecules across the membrane (via molecules having two separate binding sites for the two different molecules); in symport, both molecules are transported in the same direction, while in antiport, one molecule is imported while the other is exported. This is possible energetically because one of the two molecules moves in accordance with a concentration gradient, and this energetically favorable event is permitted only upon concomitant movement of a desired compound against the prevailing concentration gradient.

Single molecules may also be transported across the membrane against the concentration gradient in an energy-driven process, such as that utilized by the ABC transporters. In this ABC transporter system, the transport protein located in the membrane has an ATP-binding cassette; upon binding of the target molecule, the ATP is converted to ADP and inorganic phosphate ($P_i$), and the resulting release of energy is used to drive the movement of the target molecule to the opposite face of the membrane, facilitated by the transporter.

Transport molecules are specific for a particular target solute or class of solutes, and are also present in one or more specific membranes. Transport molecules localized to the plasma membrane permit an exchange of solutes with the surrounding environment, while transport molecules localized to intra-cellular membranes (e.g., membranes of the mitochondrion, peroxisome, lysosome, endoplasmic reticulum, nucleus, or vacuole) permit import and export of molecules from organelle to organelle or to the cytoplasm. For example, in the case of the mitochondrion, transporters in the inner and outer mitochondrial membranes permit the import of sugar molecules, calcium ions, and water (among other molecules) into the organelle and the export of newly synthesized ATP to the cytosol.

Membrane transport molecules (e.g., channels/pores, permeases, and transporters) play important roles in the ability of the cell to regulate homeostasis, to grow and divide, and to communicate with other cells, e.g., to secrete and receive signaling molecules, such as hormones, reactive oxygen species, ions, neurotransmitters, and cytokines. A wide variety of human diseases and disorders are associated with defects in transporter or other membrane transport molecules, including certain types of liver disorders (e.g., due to defects in the transport of long-chain fatty acids (Al Odaib et al. (1998) *New Eng. J. Med.* 339: 1752-1757)), hyperlysinemia (due to a transport defect of lysine into mitochondria (Oyanagi et al. (1986) *Inherit. Metab. Dis.* 9: 313-316), and cataract (Wintour (1997) *Clin Exp Pharmacol Physiol* 24(1):1-9).

Organic cation transporters are a particular family of transporters which are specific for the transport of organic cations, which include a wide variety of drugs and xenobiotics, many of which are harmful to the body. In addition, organic ion transporters are responsible for the transport of the metabolites of most lipophilic compounds, e.g., sulfate and glucuronide conjugates (Moller, J. V. and Sheikh, M. I. (1982) *Pharmacol Rev.* 34:315-358; Pritchard, J. B. and Miller, D. S. (1993) *Physiol. Rev.* 73:765-796; Ullrich, K. J. (1997) *J. Membr. Biol.* 158:95-107; Ullrich, K. J. and Rumrich, G. (1993) *Clin. Investig.* 71:843-848; Petzinger, E. (1994) *Rev. Physiol. Biochem. Pharmacol.* 123:47-211).

Several organic cation transporter (OCT and OCTN) family members have been characterized in rats, mice, pigs and humans including OCTN1, OCTN2, OCT1, OCT2, and OCT3 (Kekuda et al. (1998) *J. Biol. Chem.* 273:15971-15979). OCT family members contain twelve transmembrane domains and may contain a sugar transport protein signature domain. Members of the family are expressed predominantly in the kidney, liver, and placenta, although they are also expressed in various other tissues in lesser amounts (Tamai et al. (1998) *J. Biol. Chem.* 273:20378-20382; Seth et al. (1999) *J. Biol. Chem.* 274:33388-33392). Defects in the OCTN2 protein are the cause of primary carnitine deficiency, which causes symptoms such as cardiomyopathy, progressive muscle weakness, non-ketotic hypoglycemia, and hyperammonemia.

Examples of transporter-associated disorders also include CNS disorders such as cognitive and neurodegenerative disorders, examples of which include, but are not limited to, Alzheimer's disease, dementias related to Alzheimer's disease (such as Pick's disease), Parkinson's and other Lewy diffuse body diseases, senile dementia, Huntington's disease, Gilles de la Tourette's syndrome, multiple sclerosis, amyotrophic lateral sclerosis, progressive supranuclear palsy, epilepsy, and Creutzfeldt-Jakob disease; autonomic function disorders such as hypertension and sleep disorders, and neuropsychiatric disorders, such as depression, schizophrenia, schizoaffective disorder, korsakoff's psychosis, mania, anxiety disorders, or phobic disorders; learning or memory disorders, e.g., amnesia or age-related memory loss, attention deficit disorder, dysthymic disorder, major depressive disorder, mania, obsessive-compulsive disorder, psychoactive substance use disorders, anxiety, phobias, panic disorder, as well as bipolar affective disorder, e.g., severe bipolar affective (mood) disorder (BP-1), and bipolar affective neurological disorders, e.g., migraine and obesity. Further CNS-related disorders include, for example, those listed in the American Psychiatric Association's Diagnostic and Statistical manual of Mental Disorders (DSM), the most current version of which is incorporated herein by reference in its entirety.

Transporter-associated disorders also include hormonal disorders, such as conditions or diseases in which the production and/or regulation of hormones in an organism is aberrant. Examples of such disorders and diseases include type I and type II diabetes mellitus, pituitary disorders (e.g., growth disorders), thyroid disorders (e.g., hypothyroidism or hyperthyroidism), and reproductive or fertility disorders (e.g., disorders which affect the organs of the reproductive system, e.g., the prostate gland, the uterus, or the vagina; disorders which involve an imbalance in the levels of a reproductive hormone in a subject; disorders affecting the ability of a subject to reproduce; and disorders affecting secondary sex characteristic development, e.g., adrenal hyperplasia).

Transporter-associated disorders also include immune disorders, such as autoimmune disorders or immune deficiency disorders, e.g., congenital X-linked infantile hypogammaglobulinemia, transient hypogammaglobulinemia, common variable immunodeficiency, selective IgA deficiency, chronic mucocutaneous candidiasis, or severe combined immunodeficiency.

Transporter-associated disorders also include disorders associated with sugar homeostasis, such as obesity, anorexia, hypoglycemia, glycogen storage disease (Von Gierke disease), type I glycogenosis, seasonal affective disorder, and cluster B personality disorders.

G-Protein Coupled Receptor Proteins

G protein coupled receptor proteins have a very important role as targets for molecules such as hormones, neurotransmitters and physiologically active substances. These molecules control, regulate or adjust the functions of living bodies. Each molecule has its own receptor protein which is specific thereto, whereby the specificities of individual physiologically active substances, including specific target cells and organs, specific pharmacological actions, specific action strength, action time, etc., are decided.

The characteristic feature of the G protein coupled receptor proteins which have been known up to now is that seven clusters of hydrophobic amino acid residues are located in the primary structure and pass through (span) the cell membrane at each region thereof. It has been known that such a structure is common among all of the known G protein coupled receptor proteins and further that the amino acid sequences corresponding to the area where the protein passes through the membrane (membrane-spanning region or transmembrane region) and the amino acid sequences near the membrane-spanning region are often highly conserved among the receptors. When an unknown protein has such a structure, it is strongly suggested that said protein is within a category of the G protein coupled receptor proteins. In addition, some amino acid residue alinements are common (homologous) and, by taking it as a characteristic feature, it is further strongly suggested that said protein is a G protein coupled receptor protein.

GPCR genes and gene-products are potential causative agents of disease (Spiegel et al., *J. Clin. Invest.* 92:1119-1125 (1993); McKusick et al., *J. Med. Genet.* 30:1-26 (1993)). Specific defects in the rhodopsin gene and the V2 vasopressin receptor gene have been shown to cause various forms of retinitis pigmentosum (Nathans et al., *Annu. Rev. Genet.* 26:403-424 (1992)), and nephrogenic diabetes insipidus (Holtzman et al., *Hum. Mol. Genet.* 2:1201-1204 (1993)). These receptors are of critical importance to both the central nervous system and peripheral physiological processes. Evolutionary analyses suggest that the ancestor of these proteins originally developed in concert with complex body plans and nervous systems.

The GPCR protein superfamily can be divided into five families: Family I, receptors typified by rhodopsin and the $\beta$2-adrenergic receptor and currently represented by over 200 unique members (Dohlman et al., *Annu. Rev. Biochem.* 60:653-688 (1991)); Family II, the parathyroid hormone/calcitonin/secretin receptor family (Juppner et al., *Science* 254: 1024-1026 (1991); Lin et al., *Science* 254:1022-1024 (1991)); Family III, the metabotropic glutamate receptor family (Nakanishi, *Science* 258 597:603 (1992)); Family IV, the cAMP receptor family, important in the chemotaxis and development of *D. discoideum* (Klein et al., *Science* 241: 1467-1472 (1988)); and Family V, the fungal mating pheromone receptors such as STE2 (Kujan, *Annu. Rev. Biochem.* 61:1097-1129 (1992))

G proteins represent a family of heterotrimeric proteins composed of $\alpha$, $\beta$ and $\gamma$ subunits, that bind guanine nucleotides. These proteins are usually linked to cell surface receptors, e.g., receptors containing seven transmembrane segments. Following ligand binding to the GPCR, a conformational change is transmitted to the G protein, which causes the $\alpha$-subunit to exchange a bound GDP molecule for a GTP molecule and to dissociate from the $\beta\gamma$-subunits. The GTP-bound form of the $\alpha$-subunit typically functions as an effector-modulating moiety, leading to the production of second messengers, such as cAMP (e.g., by activation of adenyl cyclase), diacylglycerol or inositol phosphates. Greater than 20 different types of $\alpha$-subunits are known in humans. These subunits associate with a smaller pool of $\beta$ and $\gamma$ subunits. Examples of mammalian G proteins include Gi, Go, Gq, Gs and Gt. G proteins are described extensively in Lodish et al., *Molecular Cell Biology*, (Scientific American Books Inc., New York, N.Y., 1995), the contents of which are incorporated herein by reference. GPCRs, G proteins and G protein-linked effector and second messenger systems have been reviewed in *The G-Protein Linked Receptor Fact Book*, Watson et al., eds., Academic Press (1994).

Another physiological role of G protein coupled receptors proteins is regulation of the hypothalamo-hypophysial system. The hypothalamo-hypophysial system one of the passages for controlling, regulating or adjusting the functions of organisms relying upon interactions of hormones and neurotransmitters with G protein coupled receptors. In the hypothalamo-hypophysial system, the secretion of pituitary hormones from the pituitary body (hypophysis) is regulated by hypothalamic hormones (hypophysiotropic releasing factors), and the functions of target cells and organs are controlled by pituitary hormones released into the blood. Functions; which are important for the living body are regulated through this system, such as maintenance of homeostasis and control of development and growth of a genital system and an individual organism. Representative examples of the hypothalamic hormones include TRH, LH-RH, CRF, GRF, somatostatin, galanin, etc. Representative examples of the pituitary hormones include TSH, ACTH, FSH, LH, prolactin, growth hormone, oxytocin, vasopressin, etc. In particular, the secretion of pituitary hormones is regulated according to a positive feedback mechanism or a negative feedback mechanism relied on the hypothalamic hormones and peripheral hormones secreted from the target endocrine glands. A variety of receptor proteins present in the pituitary gland play a major role for regulating the hypothalamo-hypophysial system.

It has been widely known that these hormones, factors and receptors are widely distributed in the brain instead of existing only locally in the hypothalamo-hypophysial system. This fact suggests that the substances which are called "hypothalamic hormones" are working as neurotransmitters or neuroregulators in the central nervous system. It is further considered that these substances are similarly distributed even in the peripheral tissues to play the role of important functions. The pancreas plays an important role of carrying out the carbohydrate metabolism by secreting not only a digestive fluid but also glucagon and insulin. Insulin is secreted from the β cells and its secretion is promoted chiefly by glucose. It has, however, been known that a variety of receptors exist in the β cells, and the secretion of insulin is controlled by various factors such as peptide hormones (galanin, somatostatin, gastric inhibitory polypeptide, glucagon, amylin, etc.), sugars (mannose, etc.), amino acids, and neurotransmitters in addition to glucose.

It has thus been known that in the pituitary gland and in the pancreas are present receptor proteins for many hormones and neurotransmitters, said receptor proteins; playing important roles for regulating the functions. As for the galanin and amylin, however, there has not yet been reported any discovery concerning the structure of their receptor protein cDNAs. It is not known whether there exist any unknown receptor proteins or receptor protein subtypes. For substances regulating the functions of the pituitary gland and pancreas, there exist receptor proteins specific to said substance on the surfaces of various functional cells of the pituitary gland and pancreas. The pituitary gland and the pancreas are associations of a plurality of functional cells, and the actions of the individual substances are defined by the distributions of their target receptor proteins among the functional cells. Accordingly, a substance, in many cases, exhibits an extensive variety of actions. To comprehend such complex systems, it is necessary to clarify the relations between the acting substances and the specific receptor proteins. It is further necessary to efficiently screen for receptor protein agonists and antagonists capable of regulating the pituitary gland and pancreas, to clarify the structures of genes of receptor proteins from the standpoint of investigating and developing pharmaceuticals, and further to express them in a suitable expression system.

In the central nervous system, many receptor proteins such as dopamine receptor protein, LH-RH receptor protein, neurotensin receptor protein, opioid receptor protein, CRF receptor protein, CRF receptor protein, somatostatin receptor protein, galanin receptor protein, TRH receptor protein, etc. are G protein coupled receptor proteins, and it has been clarified that ligands to these receptors exert a variety of effects in the central nervous system.

In the immune system, an α- or a β-chemokine receptor protein, an MIPI.α. receptor protein, an IL-8 receptor protein, a C5a receptor protein, etc. have been known as such G protein coupled receptor proteins, and are working as receptor proteins responsive to immunoregulating substances to play important roles for regulating the functions of the living body. There is, for example, an IL-6 receptor protein that acts both in the above-mentioned central nervous system and in the immune system. IL-6 is both a β-cell differentiating factor and a biologically active factor related to the proliferation and differentiation of nerve cells.

It has been widely known that these hormones, factors and receptor proteins are usually widely distributed up to the peripheral tissues instead of existing only locally in the central nervous system and in the immune system and are producing important functions, respectively. Agonists and antagonists for these receptor proteins are now being developed as various useful pharmaceuticals.

For substances regulating the functions of the central nervous system and the immune system, there exist receptor proteins specific to said substance on the surfaces of various functional cells of the central nervous system and the immune system. The central nervous system and the immune system are associations of a plurality of functional cells, and the actions of the individual substances are defined by the distributions of their target receptor proteins among the functional cells. Accordingly, a substance, in many cases, exhibits an extensive variety of actions. Moreover, there is an example wherein many factors play a part in a physiological phenomenon. To comprehend such complex systems, it is necessary to clarify relations between the acting substances and the specific receptor proteins.

As discussed herein above, the G protein coupled receptor protein is present on the cell surface of living body cells and organs and has a very important role as a target for molecules such as hormones, neurotransmitters and physiologically active substances, which molecules control, regulate or adjust the functions of living body cells and organs.

Protein Kinases and Phosphatases

Protein kinases and phosphatases have the ability to regulate many cellular processes through catalyzing the addition and removal of phosphate groups to proteins. These molecules are classified by the amino acid that they phosphorylate on their targets, the two major types being protein tyrosine kinases and protein serine/threonine kinases (Hunter T., "Protein kinases and phosphatases: the yin and yang of protein phosphorylation and signaling", Cell 80:225-36, 1995). These enzymes can exist as cytoplasmic proteins that can interact with receptor or adaptor proteins or with other kinase or phosphatase molecules to transduce intracellular signals or they can be an integral cytoplasmic domain of transmembrane receptors. Protein kinase and phosphatase receptors are capable of translating a signal across the cellular membrane by a ligand binding to the extracellular region of the receptor, which thereby induces activation of the enzymatic domain lying in the intracellular region. This activation then generally leads to either the modification of the phosphorylation state of a second messenger to change its biological activity, or the triggering of a cascade of kinase phosphorylation that alters multiple protein functions to affect cell biology and gene expression. The signal is potentiated from the outside of a cell, across the plasma membrane, eventually influencing intracellular events through the transfer of a phosphate groups (van der Greer et al., "Receptor proteintyrosine kinases and their signal transduction pathways", Ann. Rev. Cell. Biol. 10:251-337, 1994). The protein kinase and phosphatase receptors include many of the growth factor receptors (e.g. epidermal growth factor, fibroblast growth factor, nerve growth factor, insulin, and transforming growth factor and many cell adhesion and other receptors (Zinn K, "*Drosophila* protein tyrosine phosphatases", Semin Cell Biol 1993 December; 4(ó):397-401; Wang, H; Lian, Z; Lerch, M. M.; Chen, Z; Xie, W; Ullrich, A., "Characterization of PCP-2, a novel receptor protein tyrosine phosphatase of the MAM domain family" Oncogene 12: 2555-2562, 1996; Mourey R J, Dixon J E, "Protein tyrosine phosphatases: characterization of extracellular and intracellular Domains", Curr Opin Genet Dev 1994 February; 4(1):31-9). Signals from receptor kinases and phosphatases regulate nDerous aspects of cell physiology and differentiation, including the coupling of cell cycle regulation to environmental cues (Chernoff J, "Protein tyrosine phosphatases as negative regulators of mitogenic signaling", J Cell Physiol. 1999 August; 180(2):173-81). Non receptor kinases and phosphatases also interact with receptors and other cytoplasmic components of signaling pathways to participate in the transduction of biological signals through regulated protein and small molecule phosphorylation reactions. Other chemistries of protein modification as well as that of other macromolecules are also important in regulating macromolecular function and the enzymes that catalyze these modifications could be useful gene therapeutics or targets for small molecule agonists or antagonists as therapeutic drugs. For example covalent modification of histones and the methylation of DNA have both been shown to be important in the regulation of gene expression (Davie J R, Spencer V A, "Control of histone modifications", J Cell Biochem 1999; Suppl 32-33:141-8; Bird A P, Wolffe A P, "Methylation-induced repression—belts, braces, and chromatin", Cell 1999 Nov. 24; 99(5):451-4). Phosphate tightly associated with protein has been known since the late nineteenth century. Since then, a variety of covalent linkages of phosphate to proteins have been found. The most common involve esterification of phosphate to serine, threonine, and tyrosine with smaller amounts being linked to lysine, arginine, histidine, aspartic acid, glutamic acid, and cysteine. The occurrence of phosphorylated proteins implies the existence of one or more protein kinases capable of phosphorylating amino acid residues on proteins, and also of protein phosphatases capable of hydrolyzing phosphorylated amino acid residues on proteins.

Protein kinases and phosphatases play critical roles in the regulation of biochemical and morphological changes associated with cellular growth and division (D'Urso, G. et al. (1990) *Science* 250: 786-791; Birchmeier. C. et al. (1993) *Bioessays* 15: 185-189). They serve as growth factor receptors and signal transducers and have been implicated in cellular transformation and malignancy (Hunter, T. et al. (1992) *Cell* 70: 375-387; Posada, J. et al. (1992) *Mol. Biol. Cell* 3: 583-592; Hunter, T. et al. (1994) *Cell* 79: 573-582). For example, protein kinases and phophatases have been shown to participate in the transmission of signals from growth-factor receptors (Sturgill, T. W. et al. (1988) *Nature* 344: 715-718; Gomez, N. et al. (1991) *Nature* 353: 170-173), control of entry of cells into mitosis (Nurse, P. (1990) *Nature* 344: 503-508; Maller, J. L. (1991) *Curr. Opin. Cell Biol.* 3: 269-275) and regulation of actin bundling (Husain-Chishti, A. et al. (1988) *Nature* 334: 718-721). Protein kinases can be divided into two main groups based on either amino acid sequence similarity or specificity for either serine/threonine or tyrosine residues. A small number of dual-specificity kinases are structurally like the serine/threonine-specific group. Within the broad classification, kinases and phosphatases can be further sub-divided into families whose members share a higher degree of catalytic domain amino acid sequence identity and also have similar biochemical properties. Most protein kinase family members also share structural features outside the kinase domain that reflect their particular cellular roles. These include regulatory domains that control kinase activity or interaction with other proteins (Hanks, S. K. et al. (1988) *Science* 241: 42-52).

Protein tyrosine phosphorylation is one of the mechanisms cells use to control proliferation and differentiation groups (van der Greer et al., "Receptor proteintyrosine kinases and their signal transduction pathways", Ann. Rev. Cell. Biol. 10:251-337, 1994). The level of protein tyrosine phosphorylation is regulated by protein tyrosine kinases (PTKs) and protein tyrosine phosphatases (PTPs). PTPs represent a diverse family of enzymes, including both transmembrane and nontransmembrane types. All PTPs share highly homologous catalytic domains—PTP domains (about 230 amino acids)—that have no similarity with protein serine/threonine phosphatases. All the nontransmembrane PTPs identified so far contain only one PTP domain. Most transmembrane PTPs have two tandem PTP domains in their cytoplasmic portions, except for HPTPβ and DPTP10D which have only one PTP domain. Usually, any pair of PTP domains are 30-50% identical at the amino acid level, with a higher score within the transmembrane or non-transmembrane type (average 46%) and a lower score between these two types (average 35%). In some cases, identity between two distinct PTPs can reach as high as 74%, e.g., PTP1B and TCPTP or PTPα and PTPε

In contrast to the homologous PTP domains, the non-catalytic sequences of PTPs vary considerably in size and structure. For example, some nontransmembrane PTPs contain hydrophobic carboxyl-terminal sequences as in PTP1B and T-cell PTP (6-10); others have sequences similar to other known proteins, such as the SH2 domains of SH-PTP1 and 2, and the cytoskeletal protein domains of PTP-MEG and PTP-H1. These structural similarities appear to be involved in localization and/or regulation of these PTPs. On the other hand, transmembrane PTPs differ greatly in their extracellular portions. Some have structures similar to carbonate hydrolase, as in PTP.zeta. (or PTPβ); others have fibronectin type III (FN-III) domains and immunoglobulin (Ig)-like domains, as in LAR, PTP.delta., PTPµ, PTP.kappa., DLAR and DPTP, which are similar to cell adhesion molecules including N-CAM. Recently, the extracellular domain of PTPµ has been shown to form a homodimer in vitro.

Although little is known about the ligands of transmembrane PTPs, features in their extracellular domains may help in predicting protein properties and in searching for their physiological ligands. Yet in another perscective, the identification of several growth factor receptors and retroviral oncogenes as tyrosine-specific protein kinases indicated that protein phosphorylation on tyrosine residues plays a key role in cellular growth control. This notion has recently received support by the observation that the level of tyrosine phosphorylation of enzymes thought to play an important role in signal transduction (such as phospholipase C) correlates with their increased activity upon growth factor stimulation, thus establishing a functional role for tyrosine phosphorylation (Ullrich, A., et al., Cell 61:203-212 (1990)).

The degree and pattern of phosphorylation of tyrosine residues on cellular proteins are regulated by the opposing activities of protein-tyrosine kinases (PTKases; ATP:protein-tyrosine O-phosphotransferase, EC 2.7.1.112) and proteintyrosine-phosphatases (PTPases; protein-tyrosine-phosphate phosphohydrolase, EC 3.1.3.48). The structural characteristics and evolution of PTKases as well as their role in the regulation of cell growth have been reviewed (Hunter, T., et al., Annu. Rev. Biochem. 54:897-930 (1985); Ullrich, A., et al., supra).

It is becoming clear that dephosphorylation of tyrosine can by itself function as an important regulatory mechanism. Dephosphorylation of a C-terminal tyrosine residue stimulates tyrosine kinase activity in the src-family of tyrosine kinases (Hunter, T. (1987) Cell 49, 1-4). Tyrosine dephosphorylation has been suggested to be an obligatory step in the mitotic activation of the MPF (maturation promoting factor) kinase (Morla, A. O. et al. (1989) Cell 58, 193-203). Lastly, mutant analysis of primitive eukaryotes has established crucial roles for serine phosphatase in cellular physiology (Cyert, M. S. et al. (1989) Cell 57, 891-893). These observations point out the need in the art for increasing our understanding of the mechanisms that regulate tyrosine phosphatase activity. It is clear in the art that further analysis of structure-function relationships among these membrane receptors are needed to gain important understanding of the mechanisms of cell growth, differentiation, and oncogenesis.

Amino Acid Transporters

The uptake of amino acids in mammalian cells is mediated by energy-dependent and passive amino acid transporters with different but overlapping specificities. Different cells contain a distinct set of transport systems in their plasma membranes. Most energy-dependent transporters are coupled to the countertransport of $K^+$ or to the cotransport of $Na^+$ or $Cl^-$. Passive transporters are either facilitated transporters or channels. The transport of amino acids is important in such functions as protein synthesis, hormone metabolism, nerve transmission, cellular activation, regulation of cell growth, production of metabolic energy, synthesis of purines and pyrimidines, nitrogen metabolism, and/or biosynthesis of urea. Catagna, et al. (1997) *The Journal of Experimental Biology* 200:269-286. Examples of important amino acid transport systems and their physiological roles follow.

L-glutamate is the major mediator of excitatory neurotransmission in the mammalian central nervous system. At least four different glutamate transporters have been cloned, EAAC1, GLT-1, GLAST, and EAAT4. Catagna, et al. (1997) *The Journal of Experimental Biology* 200:269-286. L-glutamate is stored in synaptic vesicles at presynaptic terminals and released into the synaptic cleft to act on glutamate receptors. Glutamate is involved in most aspects of brain function including cognition, memory, and learning. The role of amino acid transporters in keeping the extracellular concentration of glutamate low is important for the following reasons: (1) to ensure a high signal-to-noise ratio during neurotransmission; and (2) to prevent neuronal cell death resulting from excessive activation of glutamate receptors. Glutamate transporters play a role in stroke, central nervous system ischemia, seizures, and neurodegenerative diseases such as Alzheimer's disease and amyotrophic lateral sclerosis (ALS). Seal (1999) *Annu. Rev. Pharmacol. Toxicol.* 39:431-56.

A defect in cystine transport during renal cystine reabsorption results in cystinuria, an autosomal recessive disorder and a common hereditary cause of nephrolithiasis. The low solubility of cystine in urine favors formation of cystine-containing kidney stones. At least 2 separate amino acid transporters are involved in cystine transport: one located in the proximal tubule S1 segment and the other located in the proximal tubule S3 segment. It is believed that the D2/NBAT amino acid transport system transports cystine at the proximal tubule S3 segment.

Cationic amino acid (CAT) transporters are needed for protein synthesis, urea synthesis (arginine), and as precursors of bioactive molecules. Palacin, et al. *Physiological Reviews* 78(4):969-1054. Arginine is the immediate precursor for the synthesis of nitric oxide. Nitric oxide acts as a vasodilator where it plays an important role in the regulation of blood flow and blood pressure. Nitric oxide is also important in neurotransmission. Arginine is also a precursor for the synthesis of creatine, which is a high energy phosphate source for muscle contraction. Ornithine is required for the synthesis of polyamines, which are important in cell and tissue growth.

Growth factors, cytokines, and hormones modulate amino acid transport. Kilberg, et al. (1993) *Annu. Rev. Nutr.* 13:137-65. For example, epidermal growth factor stimulates amino acid transport Systems A and L in rat kidney cells. Glucagon and glucocorticoid hormones are known to stimulate Systems A and N. Both TNF and IL-1 stimulate System ASC-mediated glutamine uptake by cultured porcine endothelial cells.

Further, TGF-β stimulates both Systems A and L in rat kidney cells. Amino acid tranporters are capable of transporting alanine, serine, proline, glutamine, and N-methyl amino acids across cellular membranes and, thus, play a role in or function in a variety of cellular processes, e.g., protein synthesis, hormone metabolism, nerve transmission, cellular activation, regulation of cell growth, production of metabolic energy, synthesis of purines and pyrimidines, nitrogen metabolism, and/or biosynthesis of urea.

Cell Adhesion Proteins

Adhesion molecules include ligands and receptors. The interaction between adhesion molecules is similar to classical receptor ligand interactions with the exception that the ligand is fixed to the surface of a cell instead of being soluble. In other words, at least one component of the receptor-ligand interaction that mediates cell adhesion is bound to the plasma membrane. The other component can be another membrane protein or a component of the extracellular matrix (e.g. collagen, fibronectin, brevican or other proteoglycan). Together they provide cells with anchorage and traction for migration, and the receptors can also mediate signals that control cell polarity, survival, growth, differentiation and gene expression. Integrins are one group of adhesion receptors that exhibit a&esive and signaling functions and they constitute a family of transmembrane receptor proteins composed of heterodimeric complexes of noncovalently linked α and β chains (Ruoslahti E, "Integrins as signaling molecules and targets for tumor therapy", Kidney Int 1997 May; 51(5):1413-7; Mizejewski G J, "Role of integrins in cancer: survey of expression patterns", Proc Soc Exp Biol Med 1999 November; 222(2):124-38). Cell adhesion molecules are a diverse group that can recognize diverse extracellular ligands. Integrins bind the RGD sequence in their extracellular matrix ligands, but are still capable of distinguishing different RGD-containing proteins, and other cell adhesion molecules and their ligands use laminin, fibronectin, immunoglobulin and EGF repeats as well as other domains in determining the a&esive binding (Edelman G M, "CAMs and Igs: cell adhesion and the evolutionary origins of immunity", Immunol Rev 1987 December; 100:11 45; Artavanis-Tsakonas S, Matsuno K, Fortini M E, "Notch signaling", Science 1995 Apr. 14; 268(5208):225-32). These adhesion molecules exist as membrane-bound glycoproteins that can determine cell-cell and cell-matrix adhesion through both homophilic and heterophilic binding activity (Cunningham, B. A.; Hemperly, J. J Murray, B. A.; Prediger, E. A.; Brackenbury, R.; Edelman, G. M., "Neural cell adhesion molecule: structure, immunoglobulin-like domains, cell surface modulation, and alternative RNA splicing", Science 236: 799-806, 1987). The signaling pathways activated by adhesion can include changes in intracellular Ca2+ and PIP2 concentrations, and the activation of protein kinase C, focal adhesion kinase and Rho family GTPases (Zipkin I D, Kindt R M, Kenyon C J, "Role of a new Rho family member in cell migration and axon guidance in *C. elegans*", Cell 1997 Sep. 5; 90(5):883-94). Signaling by cell adhesion receptors also involves participation of peripheral membrane proteins (e.g. Band 4.1, ezrin, radixin and moesin) and other adaptor molecules to couple the adhesion receptor to signals that direct the specialization of cytoskeletal structures needed for adhesion, cell polarization and directed cell migrations (Craig S W, Johnson R P, "Assembly of focal adhesions: progress, paradigms, and portents", Curr Opin Cell Biol 1996 February; 8(1):74-85). Peripheral membrane proteins have the ability to interact with signaling, cytoskeletal and membrane structures and in this coordinating role these proteins help to couple cell adhesion and signal transduction to changes in cell cycle, shape or motility. These proteins all share a conserved membrane binding domain, the FERM (Band 4.1, ezrin, radixin and moesin) domain, that is necessary and sufficient for membrane association (Cuppen E, Wijers M, Schepens J, Fransen J, Wieringa B, Hendriks W, "A FERM domain governs apical confinement of PTP-BL in epithelial cells", J Cell Sci 1999 October; 112 (Pt 19):3299-308).

Other adhesion molecules have been identified which are involved in the adherence of white blood cells to vascular endothelium and subsequent migration out of the vasculature. These include endothelial leukocyte adhesion molecule-1 (ELAM-1), vascular cell adhesion molecule-1 (VCAM-1) and granule membrane protein-140 (GMP-140) and their respective receptors. The adherence of white blood cells to vascular endothelium appears to be mediated in part if not in toto by the five cell adhesion molecules ICAM-1, ICAM-2, ELAM-1, VCAM-1 and GMP-140. Dustin and Springer, J. Cell Biol. 1987, 107, 321-331. Expression on the cell surface of ICAM-1, ELAM-1, VCAM-1 and GMP-140 adhesion molecules is induced by inflammatory stimuli. In contrast, expression of ICAM-2 appears to be constitutive and not sensitive to induction by cytokines. The identification of patients with a genetic defect in leukocyte adhesion has enabled investigators to identify a family of proteins responsible for adherence of white blood cells. Leukocyte adhesion deficiency (LAD) is a rare autosomal trait characterized by recurrent bacterial infections and impaired pus formation and wound healing.

Transporter Enzymes

The E1-E2 ATPase family is a large superfamily of transport enzymes that contains at least 80 members found in diverse organisms such as bacteria, archaea, and eukaryotes (Palmgren, M. G. and Axelsen, K. B. (1998) *Biochim. Biophys. Acta.* 1365:37-45). These enzymes are involved in ATP hydrolysis-dependent transmembrane movement of a variety of inorganic cations (e.g., $H^+$, $Na^+$, $K^+$, $Ca^{2+}$, $Cu^{2+}$, $Cd^+$, and $Mg^{2+}$ ions) across a concentration gradient, whereby the enzyme converts the free energy of ATP hydrolysis into electrochemical ion gradients. E1-E2 ATPases are also known as "P-type" ATPases, referring to the existence of a covalent high-energy phosphoryl-enzyme intermediate in the chemical reaction pathway of these transporters. Until recently, the superfamily contained four major groups: $Ca^{2+}$ transporting ATPases; $Na^+/K^+$- and gastric $H^+/K^+$ transporting ATPases; plasma membrane $H^+$ transporting ATPases of plants, fungi, and lower eukaryotes; and all bacterial P-type ATPases (Kuhlbrandt et al. (1998) *Curr. Opin. Struct. Biol.* 8:510-516).

E1-E2 ATPases are phosphorylated at a highly conserved DKTG sequence. Phosphorylation at this site is thought to control the enzyme's substrate affinity. Most E1-E2 ATPases contain ten alpha-helical transmembrane domains, although additional domains may be present. A majority of known gated-pore translocators contain twelve alpha-helices, including $Na^+/H^+$ antiporters (West (1997) *Biochim. Biophys. Acta* 1331:213-234).

Members of the E1-E2 ATPase superfamily are able to generate electrochemical ion gradients which enable a variety of processes in the cell such as absorption, secretion, transmembrane signaling, nerve impulse transmission, excitation/contraction coupling, and growth and differentiation (Scarborough (1999) *Curr. Op. Cell Biol.* 11:517-522). These molecules are thus critical to normal cell function and well-being of the organism.

Recently, a new class of E1-E2 ATPases was identified, the aminophospholipid transporters or translocators. These transporters transport not cations, but phospholipids (Tang, X. et al. (1996) *Science* 272:1495-1497; Bull, L. N. et al. (1998) *Nat. Genet.* 18:219-224; Mauro, I. et al. (1999) *Biochem. Biophys. Res. Commun.* 257:333-339). These transporters are involved in cellular functions including bile acid secretion and maintenance of the asymmetrical integrity of the plasma membrane.

Sugar Transporters

Sugar transporters are members of the major facilitator superfamily of transporters. These transporters are passive in the sense that they are driven by the substrate concentration gradient and they exhibit distinct kinetics as well as sugar substrate specificity. Members of this family share several characteristics: (1) they contain twelve transmembrane domains separated by hydrophilic loops; (2) they have intracellular N- and C-termini; and (3) they are thought to function as oscillating pores. The transport mechanism occurs via sugar binding to the exofacial binding site of the transporter, which is thought to trigger a conformational change causing the sugar binding site to re-orient to the endofacial conformation, allowing the release of substrate. These transporters are specific for various sugars and are found in both prokaryotes and eukaryotes. In mammals, sugar transporters transport various monosaccharides across the cell membrane (Walmsley et al. (1998) *Trends in Biochem. Sci.* 23:476-481; Barrett et al. (1999) *Curr. Op. Cell Biol.* 11:496-502).

At least nine mammalian glucose transporters have been identified, GLUT1-GLUT9, which are expressed in a tissue-specific manner (e.g., in brain, erythrocyte, kidney, muscle, and adipose tissues) (Shepherd et al. (1999) *N. Engl. J. Med* 341:248-257; Doege et al. (2000) *Biochem. J.* 350:771-776). Some GLUT proteins have been shown to be present in low amounts at the plasma membrane during the basal state, at which time large amounts are sequestered in intracellular vesicle stores. Stimulatory molecules specific for each GLUT (such as insulin) regulate the translocation of the GLUT-containing vesicles to the plasma membrane. The vesicles fuse at the membrane and subsequently expose the GLUT protein to the extracellular milieu to allow glucose (and other monosaccharide) transport into the cell (Walmsley et al. (1998) *Trends in Biochem. Sci.* 23:476-481; Barrett et al. (1999) *Curr. Op. Cell Biol.* 11:496-502). Other GLUT transporters play a role in constitutive sugar transport.

Sugar transport molecules are capable of, for example, modulating a transporter mediated activity (e.g., a sugar transporter mediated activity) in a cell, e.g., a liver cell, fat cell, muscle cell, or blood cell, such as an erythrocyte. They are capable of transporting molecules, e.g., hexoses such as D-glucose, D-fructose, D-galactose or mannose across biological membranes and, thus, play a role in or function in a variety of cellular processes, e.g., maintenance of sugar homeostasis (e.g., insulin and glucagon), from cells, e.g., pancreatic cells; and the participation in signal transduction pathways associated with sugar metabolism. Sugar transporter associated disorders typically result in, e.g., upregulated or downregulated, sugar levels in a cell. Examples of sugar transporter associated disorders include disorders associated with sugar homeostasis, such as obesity, anorexia, type-1 diabetes, type-2 diabetes, hypoglycemia, glycogen storage disease (Von Gierke disease), type I glycogenosis, bipolar disorder, seasonal affective disorder, and cluster B personality disorders.

Transmembrane Proteins

Cell membranes regulate the passage of materials into and out of a cell, a function which makes it possible to maintain the structural and functional integrity of the cell. It has long been recognized that the basic structure of cell membranes consist of a lipid bilayer having proteins embedded throughout. Proteins contribute to the structural strength of the membrane, act as enzymes to promote chemical reactions, act as carriers for the transport of substances through the membrane and provide breaks in the lipid bilayer so as to form pores through the membrane. Membranes of various cell types differ in biological function largely due to the different kinds of proteins embedded in the lipid bilayer.

Proteins may be embedded in the outer (exofacial) surface of the lipid bilayer, or in the inner (endofacial) surface of the lipid bilayer. Other proteins pass through the lipid bilayer and are exposed on both the inner (i.e., intracellular or cytoplasmic) surface and the outer (i.e., extracellular) surface of the membrane. Still other proteins are more loosely bound to one surface of the membrane or both, depending on the membrane. A number of protein enzymes are either dissolved in the cell membrane or are adherent to it. Many of these enzymes are present on the intracellular surface of the membrane and function at the boundary between the inner surface of the membrane and the cytoplasm to catalyze chemical reactions.

Proteins which penetrate the lipid bilayer, extending all the way through the membrane from one surface to the other, may provide direct watery passages through the interstices of the protein molecules. Such proteins act as carriers, ferrying molecules through the membrane.

Some proteins, as well as some lipids, have carbohydrates attached to their extracellular surface. The carbohydrates may be involved in the recognition and adhesion processes between, for example, cells and cells, cells and antibodies, and cells and viruses.

The human erythrocyte membrane is an accessible, pure membrane source which has provided much information upon which general understandings of membrane structure are based. The erythrocyte membrane is composed of membrane proteins which penetrate the lipid bilayer and a complex of cytoskeletal proteins known as the "membrane skeleton". Integral membrane proteins, which penetrate the lipid bilayer, are known to play roles in transport and structure. The membrane skeleton, which is located just below the intracellular surface of the lipid bilayer, provides shape and reversible deformability of the erythrocyte.

Some protein linkages between the membrane skeleton and the lipid bilayer have been identified. Ankyrin is well understood to provide major linkage between spectrin in the membrane skeleton and a site on the intracellular surface, i.e., the cytoplasmic domain, of the anion transporter channel protein (Bennett et al., 1979, Nature 280:468-473; Hargreaves et al., 1980, J. Biol. Chem. 255:11965-11972; Tyler et al., 1980 J. Biol. Chem. 255:7034-7039).

Other skeleton to bilayer linkages have been identified but are less well understood. Glycophorin C is associated with the membrane skeleton protein 4.1, but the specific linkage remains to be elucidated (Reid et al., 1987, Blood 69:1068-1072). Glycophorin A has been shown to relay stimuli from the extracellular surface of the membrane to the membrane skeleton (Anderson et al., 1981, Nature 292:158-160; Chasis et al., 1985, J. Clin. Invest. 75:1919-1926). Protein 4.1 has been shown to associate with the cytoplasmic domains of glycophorin A (Anderson et al., 1984, Nature 307:655-658; Anderson et al., 1985, Nature 318:295-298), the anion transporter (Pasternack et al., 1985, J. Biol. Chem. 260:3676-3683) and phosphatidylserine in the lipid bilayer (Cohen et al., 1988, Biochemistry 27:617-619; Ribicki et al., 1984, Blood 64:30, abstr.). The Rh polypeptide is an integral membrane protein which was found to be associated with the membrane skeleton (Gahmberg et al., 1984, J. Immunol. 133: 334-337; Ridgwell et al., 1984, FEBS Lett. 174:7-10). It has been shown that the Rh protein can be extracted from membrane skeletons with high detergent concentrations (Bloy et al., 1987, Blood 69:1491-1497) and lacks an identifiable cytoplasmic domain (Agre et al., 1987, J. Biol. Chem. 262: 17497-17503). The lack of a cytoplasmic domain suggests that the Rh polypeptide linkage with the membrane skeleton results from a side-by-side association with another skeleton-linked integral membrane protein. Various erythrocyte integral protein blood group antigens have also been identified (Rosse et al., 1989, In: Red Blood Cell Membranes (Agre et al., eds.) pp. 299-3234, Marcel Dekker Inc., New York).

It is known that mammalian red cell plasma membranes contain a water-selective channel which confers the cells with the ability to rapidly swell or shrink in response to small changes in extracellular osmolality (Macey (1984) Amer. J. Physiol. 246:C195-C203; Solomon et al., 1984, Ann. N.Y. Acad. Sci. 414:79-124), and the physiological behavior of the water channel has been extensively studied. Red cell water channels are constitutively active but can be inhibited by submillimolar concentrations of mercural compounds, such as $HgCl_2$. It has been calculated that in the order of 250,000 water channels exist in each red cell (Solomon et al., 1984, Ann. N.Y. Acad. Sci. 414:79-124), and red cell water channels are physiologically very similar to the water channel identified in proximal convoluted renal tubules.

Another class of biologically active transmembrane protein includes a group of proteins with multiple membrane spanning domains that can act individually or in multiprotein hetero or homo multimeric complexes to create variously gated channels through cell membranes for the transport of small molecules. These small molecules can be charged or uncharged organic or inorganic molecules (e.g. organic anions, Na+, Cl−, water and sugars). Additionally, transport of small molecules through the channel can be driven by facilitated diffusion down activity gradients, can be coupled to enzymatic reactions (e.g. ATP hydrolysis), or the transport of one molecule can be coupled to the transport of a distinct molecular species (e.g. Na+/H+ exchange). Ion channels permit the passage of ions across the cell membrane and into the intercellular region (Unwin, N, "The structure of ion channels in membranes of excitable cells", Neuron 3:665-676, 1989). Various ion channel receptors exist for the controlled transport of different charged molecules such as sodium, calcium, and potassium ions from the extracellular fluid (Jan, L Y and Jan Y N, "Structural elements involved in specific K+ channel function", Ann. Rev. Physiol. 54:537-55, 1992; Bean B. P., "Classes of CA channels in vertebrate cells", Ann. Rev. Physiol. 51:367-84, 1989; Stephan, M and Agnew, W B, "Voltage sensitive Na+ channels: motifs, models and modulation", Curr. Opin. Cell. Biol. 3:676-84, 1991). As different concentrations of these charged solutes are found on either side of the cellular membrane, an electrochemical gradient exists that is characteristic for each of these ions. Passage of an ion through this receptor can therefore lead to alterations of this gradient and transmission of an external signal to the inside of a cell. Ligand gated ion channels are a prime component of the molecular mechanism of synaptic transmission. Small molecular neurotransmitters interact with ligand gated channels in the postsynaptic membrane to alter ion flux through the channel and so communicate neural action potentials to the postsynaptic cell. There are numerous 5 types of ligand gated ion channels even among those responding to a single ligand. For example GABA has been shown to interact with at least three types of ligand gated channels in the CNS, and these channels exhibit distinct structure, requirements for hetero or homo oligomerization and physiological and pharmacological properties (Chebib M, Johnston G A, "The 'ABC' of GABA receptors: a brief review", Clin Exp Pharmacol Physiol 1999 November; 26(11):937-40). G protein coupled receptors (GPCR) are so named because the external signal they receive is transduced through the cell membrane by a pathway leading to the exchange of guanine diphosphate (GDP) for guanine triphosphate (GTP). In its inactive state, the G protein trimer is bound to a GDP molecule (Neer, E J, "Heterotrimeric G proteins: organization of transmembrane signals", Cell 80:249-57, 1995). When the associated receptor binds its specific ligand, or signaling molecule, the G protein complex becomes activated through the a subunit's release of GDP and subsequent acquisition of GTP. The GTP containing a subunit then disassociates, leading to the specific activation of other intracellular proteins via an effector molecule. The downstream activation of these proteins mediates the cell biological response to the initial receptor binding event in the membrane (Neer, E J and Clapham, D E, "Roles of G protein subunits in transmembrane signalling", Nature 333:129-134, 1988; Strader, C D et al., "Structure and function of G protein-coupled receptors", Annu. Rev. Biochem. 63: 101-32, 1994). Receptor activation induces signaling mechanisms that can also involve participation by the adenylate cyclase and phospholipase C effector proteins, alterations of ion channel conductance, signaling modulatory proteins, such as arrestin, phosducin, recoverin-type myristoyl switch proteins, and the pleckstrin homology domain of G-protein receptor kinase-2 (LeVine H 3rd, "Structural features of heterotrimeric G-protein-coupled receptors and their modulatory proteins", Mol Neurobiol 1999 April; 19(2): 111-49; Patel Y C, "Somatostatin and its receptor family", Front Neuroendocrinol 1999 July; 20(3): 157.

Extracellular Matrix Proteins

Many eukaryotic cells are enveloped by an extracellular matrix of proteins that provide structural support, cell and tissue identity, and autocrine, paracrine and juxtacrine properties for the cell within its environment (McGowan, S. E. (1992) FASEB J. 6:2895-2904). The diverse biochemistry of extracellular matrix proteins (ECMP) is indicative of the many, often overlapping, roles that are attributed to each distinct molecule (cf. Grant, D. S, and Kleinman, H. K. (1997) E.X.S. 79:317-333). Whilst a great number of ECMPs have been isolated, it still remains unclear how the majority interact with other ECMPs or with molecules residing within the cell membrane. Many ECMPs have been associated with tissue growth and cell proliferation, others with tissue or cell differentiation, and yet others with cell death (cf. Taipale, J. and Keski-Oja, J. (997) FASEB J. 11:51-59; Eleftheriou, C. S. et al. (1991) Mutat. Res. 256:127-138).

For example, the process of embryonic bone formation involves the creation of an extracellular matrix that mineralizes during the course of tissue maturation. During the life of an individual, this matrix is subject to constant remodeling, through the combined actions of osteoblasts (which form mineralized bone) and osteoclasts (which resorb bone). The balance of ECMP composition, and the resulting bone structure, may be perturbed by biochemical changes that result from congenital, epigenetic, or infectious diseases (Francomano, C. A. et al. (1996) Curr. Opin. Genet. Dev. 6:301-308).

ECMPs also act as important mediators and regulators during the inflammatory response. Leukocytes are primed for inflammatory mediator and cytokine production by binding to ECMPs during extravasation (Pakianathan, D. R. (1995) J. Leukoc Biol. 57:699-702). Deposition of ECMPs is also triggered by inflammation in response to lung injury (Roman, J. (1996) Immunol. Res. 15:163-178). Although the function of newly deposited matrices in injured lungs is unknown, their ability to affect the migration, proliferation, differentiation, and activation state of cells in vitro suggested an important role in the initiation and maintenance of the inflammatory response in vivo (Roman, J. supra).

Some examples of recently identified ECMPs which regulate cellular and tissue differentiation are S1-5 and Ecm1. S1-5 mRNA is overexpressed both in senescent human fibroblasts established from a subject with Werner syndrome of premature ageing and in growth-arrested normal human fibroblasts (Lecka-Czernik, B. et al. (1995) Mol. Cell. Biol. 15:120-128). The mRNA encodes a 387 amino acid residue protein containing five epidermal growth factor (EGF)-like domains. These domains matched the EGF tandem repeat consensus within several known extracellular proteins that promote cell growth, development, and cell signaling. The EGF tandem repeat is characterized by a regular distribution of single cysteines. As occurs with other members of the EGF-like family, the S1-5 gene product may represent a negative and/or positive factor whose ultimate activity is modulated by the cell environment (Lecka-Czernik, B. supra). Murine Ecm1 encodes a 559 residue protein that has been localized to one genetic locus associated with developmental disorders of the skin (Bhalerao, J. et al. (1995) J. Biol. Chem. 270:16385-16394). During embryonic development, the gene is predominantly expressed in the form of splice variants in skin or cartilage tissue. Expression of the Ecm1 gene also peaks during the late, pre-confluence phase of the murine osteogenic cell line, MN7, which proliferates and differentiates in vitro forming a mineralized matrix (Bhalerao, J. et al. (1995) supra). The murine Ecm1 gene has been localized by genetic mapping to mouse chromosome 3, a region homologous to that of human chromosome 1q21 (Bhalerao, J. et al. (1995) supra). The molecular structure of the predicted protein is characterized by a pair of domains which share internal homology, and by a regular distribution of single cysteines and cysteine doublets. The latter arrangement was predicted to generate characteristic 'double-loop' proteins in the serum albumin family of proteins (Soltysik-Espanola, M. et al. (1994) Dev. Biol. 165:73-85). These double-loop structures are involved in important ligand-binding functions (Kragh-Hansen, U. (1990) Danish Med. Bull. 37:57-84).

Extracellular matrix proteins are also involved in forming specialized intercellular junctions (e.g. tight junctions, desmosomes, and synaptic junctions; Burridge K, Molony L, Kelly T, "Adhesion plaques: sites of transmembrane interaction between the extracellular matrix and the actin cytoskeleton", J Cell Sci Suppl 1987; 8:211-29; Schneeberger E E, Lynch R D, "Tight junctions. Their structure, composition, and function", Circ Res 1984 December; 55(ó):723-33) or other extracellular matrix specializations needed to support cell differentiation and morphogenesis. It has been shown that the extracellular matrix of the central nervous system differs from that in much of the rest of the body, and elements of the CNS extracellular matrix have been shown to play roles in organizing the CNS during development (Ruoslahti E, "Brain extracellular matrix", Glycobiology 1996 July; ó(5): 489-92; Yamaguchi Y, "Brevican: a major proteoglycan in adult brain", Perspect Dev Neurobiol 1996; 3(4):307-17). It is known that extracellular matrix molecules play important roles in the development and physiology of non-neural tissues as well (Muller U, Brandli A W, "Cell adhesion molecules and extracellular-matrix constituents in kidney development and disease", J Cell Sci 1999 November; 112 (Pt 22):3855-67). Many of the extracellular matrix components are large often heavily glycosylated proteins that can participate in multiprotein complexes that make many of these proteins relatively insoluble. The size and insolubility of these proteins can make biochemical dissection of their function difficult, but binding activity often remains with fragments that have decreased size and improved solubility. In addition, genetic analysis can facilitate identification of the function and protein interactions important for the biological activity of these proteins. Identification of binding partners for structural proteins and other proteins (e.g., signal adaptors proteins, or proteins bearing SH2, SH3, PDZ, ankyrin repeat, pleckstin homology or other domains tht mediate protein interation) that interact with additional cytoplasmic proteins to funtion can take advantage of two hybrid and related screens for protein interactions (McAlister-Henn L, Gibson N, Panisko E. "applications of the yeast two-hybrid system," Methods 1999 October:19(2):330-7; Chien C T, Bartel P L, Sternglanz R., Fields S, "The two-hybrid system: a method to identify and clone genes for proteins that interact with a protein of interest," Proc Natl Acad Sci USA 1991 Nov. 1; 88(21):9578-82; Stricker N L, Schatz P, Li M, "Using the Lac repressor system to identigy interacting proteins," Methods Enzymol 1999; 303:451-68). These screens would use the novle protein as a binding target bait to identify proteins that bind and may participate in the implementation or regulation of the novel protein function. Identification of interacting proteins can yield insight into the function of the novel protein based upon the context provided by these interactions (e.g., a novel protein interacts with brevican, brevican provides adhesive cues to guide axon growth, therefore the novel protein might participate in organization of the CNS). These interactions also identify the interacting proteins as additional potential therapeutics and therapeutic targets for conditions involving novel protein dysfunction.

Secreted Proteins

Many biologically important molecules, in particular for use in therapy, are secreted proteins. For example, growth factors, interferons, erythropoietin, and insulin have been used successfully for treating various conditions and diseases. Secreted proteins are characterized by the presence of a hydrophobic signal peptide at the amino terminus of the protein. The hydrophobic signal sequence is typically from about 16 to about 30 amino acids long and contains one or more positively charged amino acid residues near its N-terminus, followed by a continuous stretch of 6-12 hydrophobic residues. Signal peptides from various secreted proteins have otherwise no sequence homology. The presence of a hydrophobic signal peptide at the amino terminus of a protein mediates its association with the rough endoplasmic reticulumn (ER), which in turn mediates its secretion from the cell.

The mechanism by which peptides or proteins having a signal peptide associate with the endoplasmic reticulumn and are secreted is as follows. Protein synthesis begins on free ribosomes. When the elongating peptide is about 70 amino acids long, the signal peptide is recognized by a particle, termed a "signal recognition particle" or "SRP", which in turn is capable of interacting with a receptor, termed "SRP receptor", located on the ER. Thus, growing peptides having a signal peptide are targeted to the ER, where peptide synthesis continues on the rough ER. At some point during the protein synthesis or after the protein synthesis is completed, the protein is translocated across the ER membrane into the ER lumen, where the signal peptide is cleaved off. There the protein can be postranslationally modified, e.g., glycosylated. Whether posttranslationally modified or not, the protein can then be directed to the appropriate cellular compartment, e.g., secreted outside the cell.

Several systems have recently been developed to isolate nucleic acids encoding secreted proteins. One system which is used frequently and of which several variations exist is a system termed "Sequence Signal Trap". One such system (such as the Genetic Institute's DiscoverEase™ program) is yeast based and uses the yeast invertase gene, which cleaves the disaccharide sucrose into monosaccharides glucose and fructose. According to the system, a library of cDNAs is cloned upstream of the gene encoding invertase and yeast cells are selected on sucrose. Since yeast cells cannot ingest sucrose, but can ingest fructose and glucose, only yeasts secreting invertase are able to grow on sucrose. Thus, only yeasts which contain a cDNA containing a signal sequence properly fused to the invertase gene will permit invertase to be secreted and will survive on sucrose.

However, such systems have several drawbacks. For example, the sequence signal trap system requires that the sequence signal be fused properly, e.g., in frame, to the gene encoding the invertase. Even where the signal sequence is in frame, this may produce a fusion protein, which may be instable. Thus, only a fraction of the cDNAs containing a signal sequence will be fused properly to the invertase gene to permit secretion of the invertase gene. Furthermore, this system requires that the protein containing the signal sequence be secreted. However, it is known that numerous proteins containing signal peptides are trapped in the endoplasmic reticulumn. Accordingly, the requirement that the fusion protein containing the signal peptide be actually secreted further reduces the efficiency of cloning secreted proteins.

Many proteins in this family are valuable as potential therapeutic agents since they are a rich source of molecules that are involved the implementation of the intercellular signaling that communicates signals that control physiological responses to the environment and the coordination of cell functions needed for development of the organism and the integrated function of cells 15 within organ systems (Vogt T F, Duboule D, "Antagonists go out on a limb", Cell 1999 Dec. 10; 99(ó):563-ó). The fact that this class of proteins is biologically active when presented extracellularly makes them particularly attractive as potential therapeutics. Secreted proteins in this gene class include growth hormone, erythropoietin, GM-CSF, insulin, and interleukin-2, all of which are currently in clinical use. Secreted proteases can influence the activity of these signaling molecules either directly (e.g. proteolytic activation of the peptide hormone, angiotensin, or cleavage of procollagen to permit its assembly into connective tissue) or indirectly (e.g. cleavage of the short gastrulation/chordin growth factor inhibitor by the tolloid/BMP-1 metalloprotease to release the active signaling molecule, the dpp/BMP-4 growth factor; Mullins M C, "Holy Tolloido: Tolloid cleaves SOG/Chordin to free DPP/BMPs", Trends Genet. 1998 April; 14(4):127-9; Dale L, Jones C M, "BMP signalling in early *Xenopus* development", Bioessays 1999 September; 21 (9):751-60). Numerous protein components of the extracellular matrix have been identified and they have been shown to play important roles in directing cell migrations and influencing cell differentiation during development and regeneration, maintaining cell viability through attachment, regulating growth factor cell interactions and providing mechanical support and lubrication needed for organ function (e.g. the collagen proteoglycan roles in the formation of articulated joints; Byers P H, "Molecular genetics of chondrodysplasias, including clues to development, structure, and function", Curr Opin Rheumatol 1994 May; 6(3):345-50). Assays can be done to ascertain that a given protein is secreted. Antibodies prepared against a given protein can be used to identify the location of the protein when that protein is expressed in cultured cells that have been transformed with a vector construct designed to express the protein of interest. Secreted proteins will appear primarily in the culture media or attached to the conditioned tissue culture vessel, while intracellular proteins will partition with the intact cells after removal from the culture vessel. Identification of the natural receptors for growth factor and hormones can proceed by using a preparation of labeled growth factor or hormone (or a labeled antibody to unlabeled growth factor or hormone) to screen a library of cells expressing potential receptors. Genetic strategies can also be used to identify genes that encode functional signal peptides (Tashiro K, Nakamura T, Honjo T, "The signal sequence trap method", Methods Enzymol 1999; 303:479-95; Jacobs K A, CollinsRacie L A, Colbert M, Duckett M, Evans C, Golden-Fleet M, Kelleher K, Kriz R, LaVallie E R, Merberg D, Spaulding V, Stover J, Williamson M J, McCoy J M, "A genetic selection for isolating cDNA clones that encode signal peptides", Methods Enzymol 1999; 303:468-79). Binding of the ligand to a cell will identify that cell as a source of receptor for that particular ligand. RAGE technology (U.S. patent application Ser. No. 09/276,820) can be used to prepare the library of receptor bearing cells by creating RAGE protein expression libraries that express all transmembrane proteins in the genome. Receptor identification can also be pursued by examination of the binding specificity of the growth factor or hormone when added to intact organisms, cultured cells or receptor preparations. Specific binding can be visualized by fluorescence or chromogenic immunohistochemical assays to localize the bound secreted protein, or by Biacore, immunoprecipitation or immunoaffinity mass spectroscopic analysis. Genetic analysis of the function of the secreted protein in the biology of a genetic model organism (e.g. mice or *Drosophila*) can be used to set up modifier screens to identify gene products that interact with the secreted protein in the implementation of its biological activity. Receptors specific for the secreted protein are among the interacting genes that are often identified in these modifier screens. Expression cloning approaches can be a powerful method for identification of the receptors that recognize novel growth factors or hormones (Claesson-Welch L, Eriksson A, Westermark B, Heldin C H, "Cloning and expression of human platelet derived growth factor □ and □ receptors", Methods Enzymol 1991; 198:72-7). Bioassays in conjunction with protein purification and characterization can be valuable adjuncts in establishing the function of novel secreted proteins (e.g. MacLaughlin D T, Epstein J, Donahoe P K, "Bioassay, purification, cloning, and expression of mullerian inhibiting substance", Methods Enzymol 1991; 198: 358-69).

Proteases

Proteases are enzymes that cleave a peptide bond found within a polypeptide chain, thereby mediating physiologically important processing events. Based on their catalytic activities and the amino acid residues essential for directing this function, these enzymes can be arranged into four mechanistic classes. These molecules are classified as serine proteases, cysteine proteases, aspartic proteases, and metallo proteases (Yamamoto, M. et al., "Activities, localization and roles of serine proteases and their inhibitors in human brain tumor progression", J. Neurooncol. 22:139-51, 1994; Chapman, H. A., "Emerging roles for cysteine proteases in human biology", Annu. Rev. Physiol. 59:63-88, 1997; Kashparov I V et al., "Mechanisms of action of aspartic proteases", Adv. Exp. Med. Biol. 436:115-21, 1998; Nagase H. and Woessner J. F. Jr., "Matrix Metalloproteinases", J. Biol. Chem. 274: 21491-4, 1999). Within the serine protease group lies thrombin, chymotrypsin, trypsin, and elastase. The cysteine family includes lysosomal cathepsins, the caspases involved in the proteolytic implementation of apoptosis (Hengartner M O, "Programmed cell death in the nematode *C. elegans*", Recent Prog Horm Res 1999; 54:213-22; discussion 222-4), and the cytosolic calpains. Examples of aspartic proteinases are digestive enzymes such as pepsin and chymosin, lysosomal cathepsins D, and the renin processing enzyme. Metallo proteinases contain a catalytically active metal atom (e.g. zinc) and include, for example, thermolysin. Physiological processes involving remodelling of the extracellular matrix, such as wound healing, embryogenesis, angiogenesis, and the female reproductive cycle, require the activity of matrix metalloproteinases (Forget M A, Desrosiers R R, Beliveau R, "Physiological roles of matrix metalloproteinases: implications for tumor growth and metastasis", Can J Physiol Pharmacol 1999 July; 77(7):465-80). In addition to these classes, a grouping also exists for categorizing proteases with novel mechanisms of activity. Protease cleavage can serve to activate or inactivate the ability of substrate proteins to function. For example, phosphorylation of β catenin in the absence of Wnt mediated receptor activation targets this protein for proteolytic degradation by proteosomes (Moon, R. T., Brown, J. D., and Torres, M. (1997) "WNTs modulate cell fate and behavior during vertebrate development", Trends Genet. 13:157-162; Wodarz, A., and Nusse, R. (1998), "Mechanisms of Wnt signaling in development", Annu Rev Cell Dev Biol 14:59-88; Dierick, H., and Bejsovec, A. (1999) "Cellular mechanisms of wingless/Wnt signal transduction", Curr Top Dev Biol 43:153-190). On the other hand many proteins are activated by proteolysis. For example proteolytic activation of the enzymatic activity of trypsinogen, the receptor binding activity of the peptide hormone precursor angiotensin, and the transcriptional regulatory activity of the transmembrane cell adhesion receptor Notch (Schroeter, E. H., Kisslinger, J. A., and Kopan, R. (1998), "Notch-1 signalling requires ligand-induced proteolytic release of intracellular domain", Nature 393:382-386; De Strooper, B., Annaert, W., Cupers, P., Saftig, P., Craessaerts, K., Mumm, J. S., Schroeter, E. H., Schrijvers, V., Wolfe, M. S., Ray, W. J., Goate, A., and Kopan, R. (1999), "A presenilin-1-dependent γ-secretase-like protease mediates release of Notch intracellular domain", Nature 398: 518-522; Lecourtois, M., and Schweisguth, F. (1998), "Indirect evidence for delta-dependent intracellular processing of Notch in *Drosophila* embryos. Curr. Biol. 8: 771-774;

Struhl, G., and Adachi, A. (1998), "Nuclear access and action of Notch in vivo", Cell 93: 649-660). Defects in proteolysis can contribute to disease e.g. osteoarthritis and the metastatic spread of cancer (Smith R L, "Degradative enzymes in osteoarthritis", Front Biosci 1999 Oct. 15; 4:D704-12; Ellerbroek S M, Stack M S, "Membrane associated matrix metalloproteinases in metastasis", Bioessays 1999 November; 21(11):940 9). The sequence requirements for protease substrate specificity can be defined by the ability of the protease to cleave members of peptide libraries or other protein substrates. Modifier genetic analysis can also be used to define natural substrates since second site mutations in substrates might be expected to show phenotypic interactions with mutations in the protease. Natural substrates for a particular protease might be enriched in cells or tissues that normally express the protease, and protein fractions from these tissues could be used to screen for the natural substrates. Protease inhibitors decrease protease function through reversible or irreversible binding to a protease, preventing substrate access via steric hindrance or by modifying a catalytically active amino acid residue on the enzyme, or by altering the structure of the protease to a conformation incompatible with enzymatic activity.

These proteins come in both synthetic and natural forms, including $\alpha$-1 antitrypsin, amastatin, chymostatin, leupeptin and pepstatin (McConnell, R. M. et al., "Inhibition studies of some serine and thiol proteinases by new leupeptin analogues", J. Med. Chem. 36:1084-1089, 1993; Delaise, J. M. et al., "The effects of inhibitors of cysteine-proteinases and collagenase on the resorptive activity of isolated osteoclasts", Bone 8:305-13, 1987; Hoegl L. et al., "Inhibitors of aspartic proteases in human disease: molecular modeling comes of age", Pharmazie 54:319-29, 1999; Woessner J. F. Jr., "Matrix metalloproteinases and their inhibitors in connective tissue Remodeling", FASEB J. 5:2145-54, 1991). Protease inhibitors have the capacity to influence the progress of numerous physiological and signaling processes through their inhibition of necessary proteolytic events; e.g. protease action is crucial to the clotting mechanism, remodeling of the extracellular matrix, and regulation of the activity of numerous signaling molecules.

Protease Inhibitors

Protease inhibitor activities were first noted in human plasma by Fermi and Pemossi in 1894 Zgcar. Hyg. 18:83). Many investigations have been made to determine the various inhibitory activities present in plasma primarily by adding proteases of varying specificities and catalytic mechanisms to plasma. There are now recognized at least nine separate, well-characterized proteins in human plasma which share the ability to inhibit the activity of various proteases.

Several of the inhibitors have been grouped together, namely $\alpha$-1-proteinase inhibitor, antithrombin III, antichymotrypsin, C1-inhibitor and $\alpha$.-2-antiplasmin. These are referred to as the $\alpha$-1-proteinase inhibitor class. The protein $\alpha$.-2-macroglobulin inhibits members of all four catalytic classes: serine, cysteine, aspartic, and metalloproteases. However, the other types of protease inhibitors are class specific. The $\alpha$.-1-proteinase inhibitor group and inter-$\alpha$.-trypsin inhibitor inhibit only serine proteases, $\alpha$-1-cysteine protease inhibitor inhibits only cysteine proteases, and $\alpha$-1-anticollagenase inhibits only collagenolytic enzymes of the metalloenzyme class. A-1-Proteinase inhibitor (antitrypsin, AT) is a glycoprotein of MW 51,000 with 394 amino acids and 3 oligosaccharide side chains and is present in human serum at 130 mg/100 ml or 23.6 $\mu$M. It easily diffuses into tissue spaces and forms a 1:1 complex with a target protease, principally neutrophil elastase. The enzyme/inhibitor complex is then removed from circulation and catabolized by the liver and spleen. Human AT was originally named antitrypsin because of its ability to inactivate pancreatic trypsin. Interest has focused on AT in both clinical and biochemical circles because many individuals with circulating levels of this inhibitor that are less than 15% of normal are susceptible to the development of lung disease (familial emphysema) at an early age (Eriksson (1965) Acta Med. Scan. 177 (Suppl. 432): 1-85). Therefore, it appears that this inhibitor represents an important part of the defense mechanism of the lung towards attack by proteases. Human AT is a single polypeptide chain with no internal disulfide bonds and only a single cysteine residue normally intermolecularly disulfide-linked to either cysteine or glutathione.

An important observation is that the reactive site of AT contains a methionine residue which is labile to oxidation. This oxidation to the corresponding sulfoxide which may be caused by cigarette smoke reduces the inhibitory activity of AT toward both pancreatic and neutrophil elastase. Inactive AT isolated from rheumatoid synovial fluid contains up to four methionine sulfoxide residues, two of which are at the P1 and P8 positions suggesting a connection to the tissue damage noted in this disease.

Human antithrombin III (AT III) is a serum glycoprotein (serum level=29 mg/100 mL or 4.7 $\mu$M) that plays a major role in controlling serine proteases in the coagulation cascade scheme. Purified AT III is a single-chain molecule of MW 58,000 containing about 15% carbohydrate, and has six disulfide bonds. The major heparin binding site in AT III is in the N-terminus (PNAS (1984) 81, 289-293). The inactivation of proteases by AT III is enhanced 100 fold by the presence of heparin, an effect caused by the increase in binding to the protease. Antichymotrypsin (ACT) is a plasma glycoprotein of MW 68,000 first isolated and characterized without knowledge of its function (Naturwissenschaften (1962) 49:133). It has since been shown to have inhibitory activity towards chymotrypsin, although its physiological role is thought to be the inhibition of leukocyte cathepsin G. This inhibition is brought about by formation of a 1:1 complex. This inhibitor is an acute phase protein, meaning that its concentration increases dramatically after traumatic events, e.g., surgery, burns, ulcerative colitis, and some cancers. The normal concentration of ACT in plasma is 25 mg/100 mL or 3.6 $\mu$M.

It is known that in some instances the degradative action of serine proteases results in serious pathological conditions or disease states. For example, elastase is a protease which causes degradation and fragmentation of elastic fibers as a result of its protelytic activity on elastin the structural component of elastic fiber. Elastic tissue is rich in elastin and possesses a rubber-like property. Cartilaginous tissues present in the ear and epiglottis are considered elastic tissue. Tissue comprising the lungs, bronchi and skin also contain relatively large amounts of elastin and are considered elastic tissue. Elastase is required for turnover of damaged cells and the digestion of certain invading bacteria. However, excessive degradation of elastin has been associated with arthritis, atherosclerosis, certain skin diseases, pulmonary emphysema and adult respiratory-distress syndrome. Therefore, by inhibiting the activity of elastase it is possible to treat a wide variety of pathological conditions.

Proteases serve another important function in human physiology by mediating the activation of the complement system. The complement system consists of a complex group of proteins in body fluids which, working together with antibodies and other factors, play an important role as mediators of inflammation and defense against infections. The complement system is now understood to be composed of two distinct pathways, the "classical" pathway and the "alternative" pathway.

The classical pathway (CP) of complement activation is typically initiated by the union of antigen and antibody. Not all antigen-antibody reactions initiate the classical pathway. Immunoglobulins of the IgM class and IgG1, IgG2, or IgG3 subclass activate the classical pathway whereas IgG4, IgA, IgD and IgE do not. A conformational change presumably occurs after antigen binding to the Fab region of immunoglobulins that permits binding and activation of the first component of complement, C1. C1 is a macromolecular complex of three proteins (C1q, C1r and C1s), and requires calcium ions for both stability and reactivity. Binding of C1 to a suitably altered immunoglobulin leads first to a conformational change in the C1q subunit and later to the acquisition of enzymatic activity by the C1s subunit. Activated C1 (C1s), while bound to antibody, cleaves its natural substrates, C4 and C2, by limited proteolytic reactions. The activity of C1s is regulated by the endogenous serum protein, C1 esterase inhibitor (C1-inhibitor) which binds to the enzyme and thereby limits cleavage of C4 and C2. An inherited deficiency of C1-inhibitor results in uncontrolled cleavage of C4 and C2 and is manifested by recurrent attacks of angioedema (periodically recurring episodes of swelling of skin, mucous membranes, viscera and brain). C4 cleavage by C1s results in the formation of a small peptide (C4a) which is released in the fluid phase and a larger fragment, C4b, which can bind to the immune complex. C2 is similarly cleaved by C1s into a small peptide (C2b) which is released into the fluid phase and a large fragment (C2a), which binds to C4b. The C4b2a complex thus formed possesses new proteolytic activity (C3 convertase) that is capable of cleaving the third component of complement, C3. Proteolytic cleavage of C3 by the C4b2a complex yields a small peptide, C3a, which is released into the fluid phase and a larger fragment (C3b), which possesses the ability to bind to immune complexes as well as to a variety of surfaces. Once bound, C3b forms a new C4b2a3b complex with surrounding C4b2a complexes, or C5 convertase, which is capable of cleaving native C5 to a small peptide C5a which is released to the fluid phase, and C5b which binds to the surface of the antigen. Bound C5b forms the basis for the stable macromolecular "membrane attack" complex with C6, C7, and C8. Binding of the final complement component C9 forms the attack sequence C5b6789 which inserts into the lipid bilayers of cell membranes and forms transmembrane channels that permit bidirectional flow of ions. This mechanism induces cellular injury and lysis.

The alternative pathway (AP) of complement activation is functionally a two-phase system in which six proteins participate. This pathway bypasses the early-acting components, C1, C4 and C2 and leads directly to proteolytic cleavage of C3 and ultimately to the assembly of the terminal attack complex, C5b-C9. The first phase is initiation in which particle-bound C3b fulfills a recognition function. The second phase is one of amplification by means of a positive feedback loop involving bound C3b, Factor B, Factor D, and unbound C3.

The alternative pathway can be activated by the introduction of a wide variety of substances into serum. These include lipopolysaccharides (e.g., bacterial endotoxins), complex polysaccharides (e.g. inulin, zymosan), and immune complexes containing immunoglobulins of the IgA or IgD classes that cannot activate the classical pathway. Surface constituents of some intact cells (e.g. rabbit erythrocytes, certain bacteria and fungi) activate the alternative complement pathway in human serum. This property of foreign cells provides a mechanism for their recognition in the complete absence of antibody. The alternative pathway may therefore be thought of as a phylogenetically older first line of defense against invading microorganisms. The actual mechanism that activates the alternative As with nearly all complex physiological pathways, there are situations in which activation of complement is triggered to the detriment of the host. This type of activation often results in grave pathological conditions. Exemplary of these conditions are autoimmune hemolytic anemia, rheumatoid arthritis, allergy complement activation, systemic lupus erythematosus, ankylosing spondylitis and myasthenia gravis.

Growth Factors

Growth factors are important for normal developmental processes, as well as for healing of wounds. Their abnormal expression has been implicated in neoplasia and other proliferative disorders (Aaronson, 1991). Growth factors are important for normal developmental processes, as well as healing of wounds. Growth factors are involved in signaling pathways that influence normal cellular differentiation. These proteins cause cells in the resting phase (Go) to enter and progress through the cell cycle. oncogenic mutations in several growth factors result in unregulated cell growth. Tumor suppressor genes are genes expressed in normal cells that play regulatory roles in cell proliferation, differentiation and other cellular events. Loss or inactivation of these genes is oncogenic. Tumor suppressor genes that have been extensively characterized include the genes for colon carcinoma, retinoblastoma, type 2 neurofibromatosis, the genes involved in Wilms tumor and the p53 gene (reviewed in Weinberg, 1991). Tumor suppressor genes are involved in cell cycle control, signal transduction, angiogenesis, and development (Sager, 1989; Weinberg, 1991).

The concept that the loss of genetic material or the inactivation of a gene plays an important role in human cancer is based on the original observation that somatic cell hybrids between tumor cells and normal cells were no longer tumorigenic. This indicated that normal cells contain genes coding for tumor suppressors whose function was absent in cancer cells. In addition, cytogenic and restriction fragment length polymorphism (RFLP) analyses have established an association between the loss of genetic material on specific chromosomes and the development of various human malignancies. The kringle-containing protein hepatocyte growth factor (HGF) was originally identified as a potent growth factor involved in liver regeneration after liver injury or partial hepatectomy. It is now known that HGF functions as a growth factor for a broad spectrum of tissues and cell types. In addition, it has been recently discovered that HGF is identical to scatter factor (SF) a cytokine secreted from certain fibroblasts that enhances movement and causes the dissociation and scattering of epithelial cells (Gheradi & Stoker, 1990). The proto-oncogene c-met, a tyrosine kinase, has been found to be the cell surface receptor for HGF (Rubin et al., 1991; Bottaro et al., 1991). These properties may be important for metastasis of tumor cells.

In 1973 it was recognized that serum from partially hepatectomized rats stimulated hepatocyte proliferation in vitro (Morley et al., 1973). One of the agents responsible for this phenomenon was identified and isolated from such serum and from serum of patients with fulminant liver failure (Morley et al., 1973; Michalopoulous et al., 1984; Nakamura et al., 1984; Gohda et al., 1988). This agent was named hepatopoietin A or hepatocyte growth factor (HGF). HGF stimulates hepatocyte DNA synthesis and proliferation. Its serum concentration increases dramatically after rats undergo partial hepatectomy and decreases when the liver regenerates. HGF is produced by non-parenchymal liver cells (Schirmacher et al., 1992) and acts directly on hepatocytes in a paracrine fashion to stimulate cell multiplication. Although HGF stimulates growth of normal hepatocytes, it also has antiproliferative effects on hepatocarcinoma cells in culture (Tajima et al., 1991; Shiota et al., 1992).

HGF is a heterodimer of 82 kD composed of a .☐.- and β-subunit with 51 kD and 26 kD molecular weight, respectively. The cDNAs for human and rat HGF have been cloned and characterized by several groups (Miyazawa et al., 1989; Nakamura et al., 1989; Okajima et al., 1990; Seki et al., 1990; Tashiro et al., 1990; Rubin et al., 1991).

HGF has no obvious homology with other known growth factors but is 38% homologous to plasminogen. It contains four kringle domains followed by a serine protease-like domain where the active site His and Ser have been changed to Gln and Tyr, respectively. HGF has no detectable protease activity. At present the function of the kringle domains in HGF is unknown.

Kringle domains were first identified in bovine prothrombin as an internal duplication of a triple-disulfide-bonded structure containing approximately 80 amino acids (Magnusson et al., 1975). Kringle domains were until recently only characterized in plasma proteins that functioned in blood coagulation or fibrinolysis (Davie et al., 1986) which includes prothrombin, Factor XII, urokinase-type plasminogen activator, tissue-type plasminogen activator and plasminogen. Recently, apolipoprotein(a) and HGF have also been shown to contain kringle domains. Apolipoprotein(a) is thought to be involved in atherosclerosis (McLean et al., 1987). Kringle structures are thought to function autonomously (Trexler & Patthy, 1983; van Zonneveld et al., 1986) and fold independently (Tulinsky et al., 1988).

Kringles appear to be protein-binding domains and have been shown to be essential for the function of prothrombin, plasminogen and tissue plasminogen activator. The functions of all other kringle structures has not been determined, but since these structures are over 50% identical with each other, it is reasonable to assume that they are involved in binding interactions with other proteins essential for their regulation.

Two functional variants of HGF have been identified and have been found to be expressed at variable levels depending on the cell line or tissue being analyzed. A form of HGF containing the amino-terminal end of the protein including the first two kringle domains appears to result from alternative processing of the gene coding for HGF (Chan et al., 1991; Miyazawa et al., 1991). This variant binds to the c-met receptor although not as effectively as the full-length protein. Another variant has a five amino acid deletion in the first kringle domain that appears to have no effect on its activity (Seki et al., 1990; Rubin et al., 1991). Specific domains in HGF have been deleted by using techniques in molecular biology and the resultant proteins have been studied in various assays where native HGF can be measured. Matsumoto et al. (1991) concluded that the amino-terminal portion of the protein including the first and second kringle domains are essential for biological activity of HGF and possibly binding to the receptor.

Deletion of the short arm of human chromosome 3 has been implicated in small cell lung carcinoma (SCLC; Whang-Peng et al., 1982; Naylor et al., 1987), other lung cancers (Kok et al., 1987; Brauch et al., 1987), renal cell carcinoma (Zbar et al., 1987; Kovacs et al., 1988) and von Hippel-Lindau syndrome (Seizinger et al., 1988) which suggests that one or more tumor suppressor genes reside on chromosome 3p which manifest their transformed phenotype upon their inactivation. The chromosomal locus DNF15S2 (also called D3F15S2) is a RFLP probe that most consistently is associated with loss of heterozygosity in SCLC, being detected in virtually 100% of SCLC.

Lung cancer is a common human malignancy with 150,000 new cases reported each year in the United States. Unfortunately, 90% of affected persons will die within 5 years of diagnosis. Mortality due to lung cancer has increased more than 15% since 1973. Increases in cigarette smoking from 1900 until the early 1960s has transformed lung cancer from a rare disease at the turn of the century to the current leading cause of cancer death. In women, lung cancer surpassed breast cancer as the leading cause of cancer death in 1986 with rates expected to continue to increase for at least another ten years (Henderson et al., 1991).

Lung cancer is divided into small cell and non-small cell varieties. The non-small cell lung cancers include adenocarcinoma, squamous and epidermoid lung cancer and large-cell lung cancer. Chromosome 3p(14-23) changes have been found in nearly all small cell lung cancers and in a large fraction of non-small cell lung cancers.

Cancer of the kidney accounts for 1-2% of all malignancies (excluding skin cancer) with renal cell carcinoma comprising 85% of these. Renal cell carcinoma (RCC) occurs in sporadic and familial forms and are commonly seen in the age group between 50 to 70 years. Cigarette smoking is a known risk factor for this form of cancer (Walter et al., 1989). Deletion of the short arm of chromosome 3 is the most commonly involved region of the genome in RCC and therefore appears to play a role in the development and/or progression of this form of cancer.

Another example of a growth factor is Keratinocyte growth factor (KGF) is a known mitogen which has been previously identified as specific for epithelial cells, particularly keratinocytes. Rubin et al., Proc. Natl. Acad. Sci. USA, 86:802-806 (1989); Finch et al., Science, 245:752-755 (1989); Marchese et al., J. Cell. Phys. 144:326-332 (1990). Expression of messenger RNA for KGF has been detected in several stromal fibroblast cell lines derived from epithelial tissues of embryonic, neonatal and adult human sources, and in RNA extracted from normal adult kidneys and gastrointestinal tracts. Such RNA has not been detected in glial cells, lung cell 8, brain cell 8, or in a variety of epithelial cell lines that include squamous cell carcinomas, mammary epithelial cells, immortalized bronchial epithelial cells, immortalized keratinocytes, or primary keratinocyte cultures. Finch et al., Science, above. However, KGF is mitogenically active for the continuous mouse cell line, BALB/MK cells. Weissman and Aaronson, Cell, 32:599 (1983); also, see PNAS and Science, above. This observation supports evidence indicating a paracrine action of KGF in the skin, with production of KGF in the dermis (but not in the epidermis) and action on keratinocytes.

In addition, using the expression of keratins and filagrin genes it has been demonstrated that KGF influences the differentiation and maturation of keratinocytes. See J. Cell Phys., above. Much of the aforementioned work investigating the biological activity of KGF has been carried out with recombinant KGF, which has permitted more widespread study of this factor. Published PCT patent application WO 90/08771 describes the purification of KGF from the conditioned medium of a human embryonic fibroblast cell line, partial amino acid sequencing of the isolated polypeptide, cloning of the gene, and expression in bacterial cells (*E. coli*) to achieve recombinant, biologically active KGF.

While the role of KGF as a stimulatory agent for keratinocytes in vitro has been clearly identified, much remains to be known regarding KGF as a growth factor, including additional types of cells for which it may be targeted, and the effect of KGF on such cells in vivo. This information is vital for an understanding of the full potential of KGF as a therapeutic agent.

Yet another example of growth factor family belongs to the fibroblast growth factor (FGF) was initially characterized as a fibroblast mitogen (Gospodarawicz, D. (1975) *J. Biol. Chem.*, 250:2515-2520). The FGF family currently comprises at least 19 structurally and functionally related proteins, including acidic and basic FGF, FGF-1 and FGF-2 respectively.

Several FGF family members are oncogene products int2 (FGF-3), hst (FGF-4), FGF-5, and hst2 (FGF-6) (Galzie, Z. et al. (1997) *Biochem. Cell. Biol.*, 75:669-685). Other members of this family include keratinocyte growth factor (FGF-7), androgen-induced growth factor (FGF-8) and glia-activating factor (FGF-9) (Galzie, Z. et al. (1997) *Biochem. Cell. Biol.*, 75:669-685). FGF-10 is preferentially expressed in the adult lung (Yamasaki, M. et al. (1996) *J. Biol. Chem.*, 271:15918-15921). FGFs 11-14, also referred to as FGF homologous factors (FHFs), appear to be involved in the development and function of the nervous system (Smallwood, P. M. et al. (1996) *Proc. Natl. Acad. Sci. USA*, 93:9850-9857). FGF-15 displays a regionally restricted and dynamic pattern of expression in the developing nervous system (McWhirter, J. R. et al. (1997) *Development*, 124:3221-3232). FGF-16 is predominantly expressed in rat embryonic brown adipose tissue and in the adult heart. FGF-17 displays preferential expression in the neuroepithelia of the isthmus and septum of the embryonic brain (Hoshikawa, M. et al. (1998) *Biochem. Biophys. Res. Comm.*, 244:187-191). FGF-18 is expressed primarily in the lungs and kidneys, and stimulates hepatic and intestinal proliferation (Hu, M. C. T. et al. (1998) *Mol. Cell. Biol.*, 18:6063-6074). FGF-19 is expressed in the fetal brain (Nishimura, T. et al. (1999) *Biochim Biophys Acta*, 1444:148-151).

Target cell responses are mediated, in part, by the binding of FGF ligands to cognate FGF receptors (FGFR) that possess intrinsic tyrosine kinase activity. There are currently four known genes encoding FGF receptors (FGFR-1, FGFR-2, FGFR-3, and FGFR-4), which can give rise to a variety of protein isoforms via alternative RNA splicing (Galzie, Z. et al. (1997) *Biochem. Cell. Biol.*, 75:669-685). A given FGFR can bind different members of the FGF family with varying degrees of specificity. The structure of the FGFR consists of an extracellular region with three immunoglobulin-like domains, a transmembrane region, and a cytosolic tyrosine kinase domain that is activated upon ligand binding. FGF binding causes dimerization of the receptors, resulting in receptor autophosphorylation on tyrosine residues and the activation of intracellular signal transduction cascades. The action of FGF appears to depend on interactions with heparan sulfate proteoglycans in the extracellular matrix. Several proposed roles for proteoglycans in this context include protection from proteolysis, localization, storage, and internalization of growth factors (Faham, S. et al. (1998) *Curr. Opin. Struct. Biol.*, 8:578-586). Heparan sulfate proteoglycans may serve as low affinity FGF receptors that act to present FGF to its cognate FGFR, and/or to facilitate receptor oligomerization (Galzie, Z. et al. (1997) *Biochem. Cell. Biol.*, 75:669-685).

Cytoskeletal Proteins

Cytoskeletal proteins are major constituent of the cytoskeleton found in the cytoplasm of eukaryotic cells. They form a flexible framework for the cell, provide attachment points for organelles and formed bodies, and make communication between parts of the cell possible. Individual cells carry out mechanical activities such as locomotion, phagocytosis, and division. In these and other processes the cell must maintain its shape under imposed stresses or change its shape to move or do work. Similarly, cells in tissues exert forces which establish the organization and mechanical characteristics of the extracellular matrix in which they are embedded. Both cells and matrix contribute to the mechanical properties of tissues. The mechanical properties and functions of cells are governed mainly by the cytoskeleton. The organization of cytoskeletal actin filaments, microtubules, and intermediate filaments is determined by proteins which modulate the lengths of the filaments, their interactions with each other, and their anchorage to other cellular structures.

There are three types of fibres that make up the cytoskeleton, microtubules, actin filaments and intermediate filaments. Actin and its regulatory proteins is an example of the relationship between signalling proteins and cytoskeletal proteins. Actin filaments (f-actin) are polymers of globular actin monomers (g-actin) joined together to form long helical filaments (Pollard and Copper 1986). Each actin monomer has an ATP or and ADP molecule bound to it. G-actin with ATP is favoured for polymerisation however actin is an ATPase and breaks ATP to $ADP+P_i$ (Welch et al. 1997). Actin filaments can be cross-linked to form networks and bundles (Pollard and Copper 1986). Networks are where actin fibres throughout a cells cytoplasm are cross-linked together to form a loosely spaced meshwork giving the cell shape and providing a method of transport (Schafer and Cooper 1995). Actin bundles are tightly joined groups of actin filaments, which are used to support the cell protuberances of cell membrane such as filopodia (Welch et al. 1997).

There is a considerable range of domains in signalling and cytoskeletal proteins. Some of the best-known domains are the CH, SH2, SH3 and PH domains and they are present in a wide variety of signalling and cytoskeletal proteins (Tsunoda et al. 1997; Castresana and Saraste 1995). Many domains such as SH2, in signalling and cytoskeletal proteins, mediate specific protein-protein interactions some of which enable the formation of signalling pathways and complex signalling networks (Pawson 1995). Proteins can also have catalytic domains such as the src tyrosine kinase domain (FIG. 1). Some cytoskeletal proteins have domains that can modify actin filaments such as severing, capping, or uncapping them (Schafer and Cooper 1995).

Another molecule related to the function of cytoskeleton are the cytoskeletal motor proteins. cytoskeletal motor proteins are defined as molecules that are able to convert chemical energy, from nucleotide hydrolysis, into the mechanical force necessary for them to move along cytoskeletal polymers. In this way motor proteins can mediate a remarkable array of animated tasks such as chromosome segregation, vesicle transport and muscle contraction. It is generally the case that a given motor will interact with a specific class of cytoskeletal polymer, e.g., kinesin and dynein proteins interact with microtubules while myosin interacts with actin filaments (intermediate filament motors, while they are sure to exist, have not yet been conclusively identified). These motors are able to detect the intrinsic polarity that are characteristic of cytoskeletal filaments (Amos and Klug. 1974. *J. Cell Sci.*, 14: 523-549: Woodrum et. al. 1975. *J. Cell Biol.*, 67: 231-237.). This is manifest as a distinct directionality to a given motor's movement. Hence kinesin and myosin are plus-end directed motors (Vale et. al. 1985. *Cell*, 42: 39-50; Kron and Spudich. 1986. *Proc. Natl. Acad. Sci. U.S.A.*, 83: 6272.) while dynein moves in a minus-end direction (Sale and Fox. 1988. *J. Cell Biol.*, 107: 1793-1798.). Kinesin, dynein and myosin remain the three main classes of distinct motor proteins, however over the past few years there has been an explosion in the number of cytoskeletal motors identified, in particular there appears to be a superfamily of kinesin-related proteins (Goodson et. al. 1994. *J. Cell Sci.*, 107: 1875-1884) and an ever growing number of myosin family members (Cheney et. 1993. *Cell Motility and the Cytoskeleton*, 24: 215-223).

Another member of this family are Cytokeratins. Cytokeratins are usually expressed in pairs comprising a type I and a type II cytokeratin. Type II cytokeratins are generally 8 kD larger than their type I counterparts. The primary cytokeratins (#5, #14, #8 & #18) are present in all cell types:cytokeratins (8/18) in simple epithelia and (5/14) in stratified epithelial. In complex epithelia, such as prostate, the inner (luminal) cell layer expresses simple primary cytokeratins (8/18) and the outer layer expresses squamous primary cytokeratins (5/14). The other cytokeratins are secondary cytokeratins. In squamous epithelium, as the cells mature and migrate away from the basal layer, the relative contribution of the secondary, differentiated cytokeratins increases at the expense of the primary cytokeratins. Suprabasal layers express specific types of secondary cytokeratins depending upon the site. Cytokeratin 19 is a simple epithelial cytokeratin which is also expressed in the squamous basal layer, depending upon the site.

Among number of diseases associated with malfunction of the cytoskeletal protein are Dystrophin-associated muscular dystrophies. Dystrophin-associated muscular dystrophies range from the severe Duchenne to the milder Becker muscular dystrophy (DMD and BMD). Mapping and molecular genetic studies indicate that both are the result of mutations in the huge gene that encodes dystrophin. Approximately two-thirds of the mutations in both forms are deletions of one or many exons in the dystrophin gene. Although there is no clear correlation found between the extent of the deletion and the severity of the disorder, DMD deletions usually shift the frame. Boland et al. (1996) studied a retrospective cohort of 33 male patients born between 1953 and 1983. The mean age at DMD diagnosis was 4.6 years; wheelchair dependency had a median age of 10 years; cardiac muscle failure developed in 15% of patients with a median age of 21.5 years; smooth muscle dysfunction in the digestive or urinary tract occurred in 21% and 6% of the patients, respectively, at a median age of 15 years. In this cohort, death occurred at a median age of 17 years.

Proteins Involved in Transcription or Translation

Proteins that bind sequence-specifically to DNA determine which genetic messages will be expressed and in what quantity. In both prokaryotes and eukaryotes, proteins having affinity for specific sites on DNA modulate transcriptional expression of genes. Through direct interaction with DNA at specific sites in genes, certain proteins called repressors hinder transcription by making the DNA inaccessible to RNA polymerase. Other DNA-binding proteins and some multi-functional repressors are activators which allow RNA polymerase to initiate transcription with increased efficiency. The regulation of gene transcription and translation is the major process by which a cell controls the appropriate expression of the large number of genes necessary for growth, development and differentiation. Controlled expression of genes with the proper timing and cell specificity is a highly specialized process in the cells of multi cellular organisms. The intricate regulation of gene expression drives the cell differentiation needed to provide the specialized functions required for multicellular life, and permits a greater repertoire of responses to environmental change. The regulation of transcription is implemented by the interaction of numerous proteins that possess distinct biochemical functions with each other, and with the DNA and chromatin of transcribed genes. The symptoms or causes of many diseases are rooted in the consequences of the dysfunctional regulation of gene expression, and the various proteins that control gene expression are potential gene therapeutics and targets for drugs that affect their function.

These functions include the direct binding of factors to DNA regulatory elements (promoter, enhancer, silencer and insulator elements) by sequence specific DNA binding proteins that either directly interact with RNA polymerases to activate or repress transcription or that can recruit accessory protein-binding transcription factors that mediate the activation or repression of RNA polymerase activity and that are targeted to specific genes by the DNA binding factors (Blackwood E M and Kadonaga J T, "Going the Distance: A Current View of Enhancer Action", Science 1998 Jul. 3; 281: 60-63). Antagonistic and synergistic interactions often occur among the various proteins and complexes that bind to transcriptional regulatory elements to modify transcriptional efficiency (Chariot A, Gielen J, Merville M P, Bours V, "The homeodomain-containing proteins: an update on their interacting partners", Biochem Pharmacol 1999 Dec. 15; 58(12): 1851-7). Modulation of chromatin structure is an important element in the activation and repression of transcription. Enzymatic activities are targeted to specific chromatin domains and act to disrupt chromatin structure and covalently modify histone and other transcription factors in the vicinity to influence the transcriptional accessibility of chromatin and activity of transcription factors (Ito, T., et al. (1999), "ACF consists of two subunits, Acfl and ISWI, that function cooperatively in the ATP-dependent catalysis of chromatin assembly", Genes Dev. 13: 1529-1539; LeRoy, G., et al. (1998), "Requirement of RSF and FACT for transcription of chromatin templates in vitro", Science 282(5395): 1900-4; Lu, X., et al. (1998), "A novel human gene, WSTF, is deleted in Williams syndrome", Genomics 54: 241-249; Tsukiyama, T., Daniel, C., Tamkun, J. and Wu, C. (1995), "ISWI, a member of the SWI2/SNF2 ATPase family, encodes the 140 kDa subunit of the nucleosome remodeling factor", Cell 83: 10211026; Davie J R, Spencer V A, "Control of histone modifications", J Cell Biochem 1999; Suppl 32-33:141-8).

Finally, gene expression can be regulated by factors that interact with RNA to affect its stability or translational efficiency. These include factors that are generally important for mRNA translational efficiency and stability (Gallie D R, "A tale of two termini: a functional interaction between the termini of an mRNA is a prerequisite for efficient translation initiation", Gene 1998 Aug. 17; 216(1):1-11), factors that regulate the translational efficiency or localization of specific mRNA species (Lasko P, "RNA sorting in *Drosophila* oocytes and embryos", FASEB J 1999 March; 13(3):421-33; Gebauer F, Merendino L, Hentze M W, Valcarcel J, "Novel functions for nuclear factors' in the cytoplasm: the Sex-lethal paradigm", Semin Cell Dev Biol 1997 December; 8(6):561-6; Vernet C, Artzt K, "STAR, a gene family involved in signal transduction and activation of RNA", Trends Genet. 1997 December; 13(12):479-84; Sommerville J, Ladomery M, "Masking of mRNA by Y-box proteins", FASEB J 1996 March; 10(4):435-43; Jarzembowski J A, Malter J S, "Cytoplasmic fate of eukaryotic mRNA: identification and characterization of AU-binding proteins", Prog Mol Subcell Biol 1997; 18:141-72), and factors that influence mRNA stability (Liebhaber S A, "mRNA stability and the control of gene expression", Nucleic Acids Symp Ser 1997; (36):29-32).

Among the types of sequence specific DNA binding transcription factors are those in the basic helix-loop-helix (Massari M E, Murre C, "Helix-loop-helix proteins: regulators of transcription in eucaryotic organisms", Mol Cell Biol 2000 January; 20(2):429-40), homeodomain (includes homeodomain proteins with Lim, Pou and Pax domains; Lewis E B, "The bithorax complex: the first fifty years", Int J Dev Biol 1998; 42(3 Spec No):403-15; Hirth F, Reichert H, "Conserved genetic programs in insect and mammalian brain development", Bioessays 1999 August; 21(8):677-84), zinc finger (Ruiz i Altaba A, "Gli proteins and Hedgehog signaling: development and cancer", Trends Genet 1999 October; 15(10):418-25; Klug A, "Zinc finger peptides for the regulation of gene expression", J Mol Biol 1999 Oct. 22; 293(2): 215-8), basic leucine zipper (b-zip; Luscher B, Larsson L G, "The basic region/helix-loop-helix/leucine zipper domain of Myc proto-oncoproteins: function and Regulation", Oncogene 1999 May 13; 18(19):2955-66), HMG box (Wegner M, "From head to toes: the multiple facets of Sox proteins", Nucleic Acids Res 1999 Mar. 15; 27(6):1409-20), winged helix, and ETS domain protein families but numerous distinct structures have also been demonstrated in proteins with transcription factor function.

Transcriptional regulation in eukaryotes also uses many different types of protein functions to affect the ability of genes to act as a transcriptional template through a variety of mechanisms that modulate chromatin structure. These include the modulation of the nucleosome-DNA interaction (Guschin D, Wolffe A P, "SWItched-on mobility", Curr Biol 1999 Oct. 7; 9(19):R742-6; Bustin M, "Regulation of DNA-dependent activities by the functional motifs of the high-mobility-group chromosomal proteins", Mol Cell Biol 1999 August; 19(8):5237-46), the modulation of histone structure and interactions (Davie J R, Spencer V A, "Control of histone modifications", J Cell Biochem 1999; Hansen J C, Tse C, Wolffe A P, "Structure and function of the core histone N-termini: more than meets the eye", Suppl 32-33:141-8; Biochemistry 1998 Dec. 22; 37(51):17637-41), the modulation of DNA winding (Hall M C, Matson S W, "Helicase motifs: the engine that powers DNA unwinding", Mol Microbiol 1999 December; 34(5): 67-77), the modulation of nuclear matrix chromatin association (Berezney R, Wei X, "The new paradigm: integrating genomic function and nuclear architecture", J Cell Biochem Suppl 1998; 30-31:238-42; Prasad S, Soldatenkov V A, Srinivasarao G, Dritschilo A, "Intermediate filament proteins during carcinogenesis and apoptosis", Int J Oncol 1999 March; 14(3):563-70), and the modulation of locus activation (Bulger M, Groudine M, "Looping versus linking: toward a model for long-distance gene activation", Genes Dev 1999 Oct. 1; 13(19):2465-77; Fraser P, Grosveld F, "Locus control regions, chromatin activation and transcription", Curr Opin Cell Biol 1998 June; 10(3):361-5) and insulator (Bell A C, Felsenfeld G, "Stopped at the border: boundaries and insulators", Curr Opin Genet Dev 1999 April; 9(2): 191-8; Dorsett D, "Distant liaisons: long-range enhancer-promoter interactions in *Drosophila*", Curr Opin Genet Dev 1999 October; 9(5):505-14) function in the implementation of activation domains within chromosomes. The ability to create novel DNA-binding proteins will have far-reaching applications, including, but not limited to, use in: a) treating viral diseases, b) treating genetic diseases, c) preparation of novel biochemical reagents, and d) biotechnology to regulate gene expression in cell cultures.

Protein-Protein Interaction

Proteins and protein-protein interactions play a central role in the various essential biochemical processes. For example, these interactions are evident in the interaction of hormones with their respective receptors, in the intracellular and extracellular signalling events mediated by proteins, in enzyme substrate interactions, in intracellular protein trafficking, in the formation of complex structures like ribosomes, viral coat proteins, and filaments, and in antigen-antibody interactions. These interactions are usually facilitated by the interaction of small regions within the proteins that can fold independently of the rest of the protein. These independent units are called protein domains. Abnormal or disease states can be the direct result of aberrant protein-protein interactions. For example, oncoproteins can cause cancer by interacting with and activating proteins responsible for cell division. Protein-protein interactions are also central to the mechanism of a virus recognizing its receptor on the cell surface as a prelude to infection. Identification of domains that interact with each other not only leads to a broader understanding of protein-protein interactions, but also aids in the design of inhibitors of these interactions.

Structural Proteins

Structural proteins are intrinsic to the cell (e.g. proteins that form the cytoskeleton, nuclear pore, chromatin and nuclear matrix). Numerous families of proteins participate in forming cellular structures including actins, myosins, tubulins, intermediate filament proteins, histones and others (Prasad S, Soldatenkov V A, Srinivasarao G, Dritschilo A, "Intermediate filament proteins during carcinogenesis and apoptosis", Int J Oncol 1999 March; 14(3):563-70; Martelli A M, Cocco L, Riederer B M, Neri L M, "The nuclear matrix: a critical appraisal", Histol Histopathol 1996 October; 11(4):1035-48). The cytoskeleton has been shown to be important for implementation of cell polarity, for the transport of organelles, for nuclear and cellular division, and for cell motility (Nixon R A, "Dynamic behavior and organization of cytoskeletal proteins in neurons: reconciling old and new Findings", Bioessays 1998 October; 20(10):798-807; Hamm-Alvarez S F, Sheetz M P, "Microtubuledependent vesicle transport: modulation of channel and transporter activity in liver and kidney", Physiol Rev 1998 October; 78(4):1109-29; Sutherland J D, Witke W, "Molecular genetic approaches to understanding the actin cytoskeleton", Curr Opin Cell Biol 1999 February; 11(1):142-51; Pereira G, Schiebel E, "Centrosome-microtubule nucleation", J Cell Sci 1997 February; 110 (Pt 3):295-300; Cowin P, Burke B, "Cytoskeleton-membrane interactions", Curr Opin Cell Biol 1996 February; 8(1):56-65; Kennedy M B, "The postsynaptic density", Curr Opin Neurobiol 1993 October; 3(5):732-7; Drenckhahn D, Jons T, Kollert-Jons A, Koob R, Kraemer D, Wagner S, "Cytoskeleton and epithelial polarity", Ren Physiol Biochem 1993 January-April; 16(1-2):614). Many of these processes require the transduction of external signals from cell adhesion, growth factors, hormones or other ligands to integrate the dynamic control of intracellular structures with the structural needs of cell differentiation, movement, polarization, and nuclear and cell division (Vidwans S J, O'Farrell P H, "Cytoskeleton: centrosom-in absentia", Curr Biol 1999 Oct. 21; 9(20):R764-6). Signaling by rho GAP kinases as well as peripheral membrane proteins (e.g. Band 4.1, ezrin, radixin & moesin) and numerous other signal transduction components modify these structural elements to regulate their dynamic response to environmental cues and the cell cycle. The importance of these structures for normal cell function is emphasized by the aberrations in the organization of the cytoskeleton, nuclear matrix, and chromatin structure that are associated with malignant transformation (Holth L T, Chadee D N, Spencer V A, Samuel S K, SaLneck J R, Davie J R, "Chromatin, nuclear matrix and the cytoskeleton: role of cell structure in neoplastic transformation", Int J Oncol 1998 October; 13(4):827-37).

Proteins that Regulate DNA Replication

DNA replication is a complex process that involves integrating the activity of numerous distinct proteins (Brush G S and Kelly, T J (1996), "Mechanisms for replicating DNA", In "DNA replieation in eukaryotic cells". Ed. M. L. DePamphilis. pp 1-43 Cold Spring Harbor Laboratory Press, Plainview, N.Y.; Chong J P J, Thommes P and Blow J J (1996), "The role of MCM/P1 proteins in licensing of DNA replication", Trends in Biochem. Sci. 21: 102-106; Gerbi S A and Urnov F D (1996), "Differential DNA replication in insects", In "DNA replication in eukaryotic cells". Ed. M. L. DePamphilis. pp 933-969 Cold Spring Harbor Laboratory Press, Plainview, N.Y.). Such molecules can regulate replication by serving as a component of the machinery that regulates and implements the replication of the genome, the partitioning of chromosomes to daughter cells, and nuclear division and cytokinesis. The proper implementation and control of replication is required for normal development, regeneration, regulation of gene expression and adult function and since defects can lead to malignancies and other disorders proteins involved in this process are attractive therapeutic targets (Shankland S J, "Cell cycle regulatory proteins in glomerular disease", Kidney Int. 1999 October; 56(4):1208-15; Shapiro G I, et al., "Anticancer drug targets: cell cycle and checkpoint control", J Clin Invest. 1999 December; 104(12):1645-53; Koyama H, et al., Cell signaling in injured rat arteries", Thromb Haemost. 1999 August; 82(2):806-9).

Central to replication are the proteins that act to carry out the intricate enzymatic reactions needed to actually copy the genome and remodel chromatin structure, but these reactions are tightly regulated by cell cycle controls that determine the timing of replication and its integration with feedback from cell metabolism and extrinsic signals that integrate replication with the requirements of physiology and development. Numerous DNA polymerases, single strand binding proteins, DNA ligases, RNAases, topoisomerases, PCNA processivity factor and helicases are involved in implementing the actual copying of the genome.

Other proteins serve to recognize and identify the origins of replication (ORC proteins), and to license the origins to permit the initiation of replication and to couple this process with signals from the cell cycle control machinery (Ferrell J E Jr, "*Xenopus* oocyte maturation: new lessons from a good egg", Bioessays 1999 October; 21(10):833-42; Roberts J M, "Evolving ideas about cyclins", Cell 1999 Jul. 23; 98(2): 129-32). Decisions regarding whether to implement replieation, growth arrest or apoptosis involve the integration of growth factor initiated signals with the cell cycle regulatory apparatus (Blagosklonny M V, "A node between proliferation, apoptosis, and growth arrest", Bioessays 1999 August; 21 (8):704-9). Chromatin remodeling factors also play roles in the removal and replacement of chromatin structures that is needed to permit replication, and regulation of gene expression (Devine J H, Hewetson A, Lee V H, Chilton B S, "After chromatin is SWItched-on ean it be RUSHed?", Mol Cell Endocrinol 1999 May 25; 151(1-2):49-56; Langst G, Bonte E J, Corona D F, Becker P B, "Nucleosome movement by CHRAC and ISWI without disruption or trans-displacement of the histone Octamer", Cell 1999 Jun. 25; 97(7):843-52; Harniche A, Sandaltzopoulos R, Gdula D A, Wu C, "ATP-dependent histone octamer sliding mediated by the chromatin remodeling complex NURF", Cell 1999 Jun. 25; 97(7):833-42).

Proteins Having Metabolic Enzyme Activity

Enzymes serve as the biological catalysts that perform most chemical reactions that occur within an organism. Most enzymes are highly specific thus a polynucleotide or polypeptide described herein may play an important role in carrying out a reaction involved in a particular, highly important anabolic or catabolic biological pathway. Diseases caused, exacerbated or predisposed by genetic defects have been associated with increased sensitivity to environmental agents (Foroud T, Li T K, "Genetics of alcoholism: a review of recent studies in human and animal models", Am J Addict 1999 Fall; 8(4):261-78; Dybing E, Soderlund E J, "Situations with enhanced chemical risks due to toxicokinetic and toxicodynamic factors", Regul Toxicol Pharmacol 1999 October; 30(2 Pt 2):S27-30), increased susceptibility to autoimmune disease (Wakeland E K, Wandstrat A E, Liu K, Morel L, "Genetic dissection of systemic lupus erythematosus", Curr Opin Immunol 1999 December; 11(ó):701-7), propensity towards the development of cancers (Friedrich C A, "Von Hippel-Lindau syndrome. A pleomorphic condition", Cancer 1999 Dec. 1; 86(11 Suppl):2478-82; Caldas C, Carneiro F, Lynch H T, Yokota J, Wiesner G L, Powell S M, Lewis F R, Huntsman D G, Pharoah P D, Jankowski J A, MacLeod P, Vogelsang H, Keller G, Park K G, Richards F M, Maher E R, Gayther S A, Oliveira C, Grehan N, Wight D, Seruca R, Roviello F, Ponder B A, Jackson C E, "Familial gastric cancer: overview and guidelines for management", J Med Genet 1999 December; 36(12):873-80; Lynch HT, de la Chapelle A, "Genetic susceptibility to non-polyposis colorectal cancer", J Med Genet 1999 November; 36(11):801-18), accelerated development of degenerative disease (Eisman J A, "Genetics of osteoporosis", Endocr Rev 1999 December; 20(ó):788-804), and deleterious developmental defects and inborn errors of metabolism (Roessler E, Muenke M, "The molecular genetics of holoprosencephaly: a model of brain development for the next century", Childs Nerv Syst 1999 November; 15(11-12): 646-51; Saunders-Pullman R, Braun I, Bressman S, "Pediatric movement disorders", Child Adolesc Psychiatr Clin N Am 1999 October; 8(4):747-65, viii; Beutler E, Luzzatto L, "Hemolytic anemia", Semin Hematol 1999 October; 36(4 Suppl 7):38-47 Shastry B S, "Recent developments in the genetics of schizophrenia", Neurogenetics 1999 September; 2(3): 149-54; Schenone A, Mancardi G L, "Molecular basis of inherited neuropathies", Curr Opin Neurol 1999 October; 12(5):603-16; Udar N S, Xu S, Bay J O, Dandekar S S, Patel N, Chen X, Liang T Y, Uhrhammer N, Klisak I, Shizuya H, Yang H, Samara G, Nelissen J, Sawicki M, Concannon P, Gatti R A, "Physical map of the region surrounding the ataxia-telangiectasia gene on human chromosome 11 q22-23", Neuropediatrics 1999 August; 30(4): 176-80; Jurkat-Rott K, McCarthy T, Lehmann-Horn F, "Genetics and pathogenesis of malignant hyperthermia", Muscle Nerve 2000 January; 23(1):4-17; Tsipouras P, Silverman D I, "The genetic basis of aortic disease. Marfan syndrome and beyond", Cardiol Clin 1999 November; 17(4):683-96; Spacey S D, Wood N R, "The genetics of Parkinson's disease", Curr Opin Neurol 1999 August; 12(4):427-32; DeHart M A, "Hereditary hemochromatosis: diagnosis and treatment in primary care", Term Med 1999 November; 92(11):415-7; Lippa C F, "Familial Alzheimer's disease: genetic influences on the disease process", Int J Mol Med 1999 November; 4(5):529-36; Traboulsi E I, "Ocular malformations and developmental genes", J AAPOS 1998 December; 2(ó):317-23). Identification of genes that participate in metabolic and developmental diseases can provide drug targets and therapeutics for their amelioration.

Various aspects of the invention are described in further detail in the following subsections:

I. Isolated Nucleic Acid Molecules

One aspect of the invention pertains to isolated nucleic acid molecules that encode polypeptides or biologically active portions thereof, as well as nucleic acid fragments sufficient for use as hybridization probes to identify nucleic acids encoding the polypeptides (e.g., mRNA) and fragments for use as PCR primers for the amplification or mutation of the nucleic acid molecules. As used herein, the term "nucleic acid molecule" is intended to include DNA molecules (e.g., cDNA or genomic DNA) and RNA molecules (e.g., mRNA) and analogs of the DNA or RNA generated using nucleotide analogs. The nucleic acid molecule can be single-stranded or double-stranded, but preferably is double-stranded DNA.

An "isolated" nucleic acid molecule is one which is separated from other nucleic acid molecules which are present in the natural source of the nucleic acid. For example, with regards to genomic DNA, the term "isolated" includes nucleic acid molecules which are separated from the chromosome with which the genomic DNA is naturally associated. Preferably, an "isolated" nucleic acid is free of sequences which naturally flank the nucleic acid (i.e., sequences located at the 5' and 3' ends of the nucleic acid) in the genomic DNA of the organism from which the nucleic acid is derived. For example, in various embodiments, the isolated nucleic acid molecules can contain less than about 5 kb, 4 kb, 3 kb, 2 kb, 1 kb, 0.5 kb or 0.1 kb of nucleotide sequences which naturally flank the nucleic acid molecule in genomic DNA of the cell from which the nucleic acid is derived. Moreover, an "isolated" nucleic acid molecule, such as a cDNA molecule, can be substantially free of other cellular material, or culture medium when produced by recombinant techniques, or substantially free of chemical precursors or other chemicals when chemically synthesized.

A nucleic acid molecule of the present invention, e.g., a nucleic acid molecule having the nucleotide sequence of SEQ ID NO:1-21062, or a portion thereof, can be isolated using standard molecular biology techniques and the sequence information provided herein. For example, using all or portion of the nucleic acid sequence of SEQ ID NO:1-21062 as a hybridization probe, the nucleic acid molecules can be isolated using standard hybridization and cloning techniques (e.g., as described in Sambrook, J., Fritsh, E. F., and Maniatis, T. *Molecular Cloning. A Laboratory Manual. 2nd, ed., Cold Spring Harbor Laboratory*, Cold Spring Harbor Laboratory Press, Cold Spring Harbor, N.Y., 1989).

Moreover, a nucleic acid molecule encompassing all or a portion of SEQ ID NO:1-21062 can be isolated by the polymerase chain reaction (PCR) using synthetic oligonucleotide primers designed based upon the sequence of SEQ ID NO:1-21062, respectively.

A nucleic acid molecules of the invention can be amplified using cDNA, mRNA or alternatively, genomic DNA, as a template and appropriate oligonucleotide primers according to standard PCR amplification techniques. The nucleic acid so amplified can be cloned into an appropriate vector and characterized by DNA sequence analysis. Furthermore, oligonucleotides corresponding to the nucleotide sequences of the invention can be prepared by standard synthetic techniques, e.g., using an automated DNA synthesizer.

In a preferred embodiment, an isolated nucleic acid molecule of the invention comprises the nucleotide sequence shown in SEQ ID NO:1-21062.

In another preferred embodiment, an isolated nucleic acid molecule of the invention comprises a nucleic acid molecule which is a complement of the nucleotide sequence shown in SEQ ID NO:1-21062, or a portion of any of these nucleotide sequences. A nucleic acid molecule which is complementary to the nucleotide sequence shown in SEQ ID NO:1-21062, is one which is sufficiently complementary to the nucleotide sequence shown in SEQ ID NO:1-21062, respectively, such that it can hybridize to the nucleotide sequence shown in SEQ ID NO:1-21062, respectively, thereby forming a stable duplex.

In still another preferred embodiment, an isolated nucleic acid molecule of the present invention comprises a nucleotide sequence which is at least about 60%, 65%, 70%, 75%, 80%, 85%, 90%, 95%, 98% or more homologous to the nucleotide sequence (e.g., to the entire length of the nucleotide sequence) shown in SEQ ID NO:1-21062, or a portion of any of these nucleotide sequences.

Moreover, the nucleic acid molecule of the invention can comprise only a portion of the nucleic acid sequence of SEQ ID NO:1-21062, for example a fragment which can be used as a probe or primer or a fragment encoding a biologically active portion of a polypeptide of the invention. The nucleotide sequences determined from the cloning of the novel nucleic acids of the invention allows for the generation of probes and primers designed for use in identifying and/or cloning other family members, as well homologues from other species. The probe/primer typically comprises substantially purified oligonucleotide. The oligonucleotide typically comprises a region of nucleotide sequence that hybridizes under stringent conditions to at least about 12 or 15, preferably about 20 or 25, more preferably about 30, 35, 40, 45, 50, 55, 60, 65, or 75 consecutive nucleotides of a sense sequence of SEQ ID NO:1-21062, or of a naturally occurring allelic variant or mutant of SEQ ID NO:1-21062. In an exemplary embodiment, a nucleic acid molecule of the present invention comprises a nucleotide sequence which is at least 100, 150, 200, 250, 300, 350, 400, 450, 500, 550, 600, 650, 700, 750, or 800 nucleotides in length and hybridizes under stringent hybridization conditions to a nucleic acid molecule of SEQ ID NO:1-21062.

Probes based on the nucleotide sequences of the invention can be used to detect transcripts or genomic sequences encoding the same or homologous proteins. In preferred embodiments, the probe further comprises a label group attached thereto, e.g., the label group can be a radioisotope, a fluorescent compound, an enzyme, or an enzyme co-factor. Such probes can be used as a part of a diagnostic test kit for identifying cells or tissues which misexpress a nucleic acid molecules of the invention, such as by measuring a level of a nucleic acid in a sample of cells from a subject e.g., detecting mRNA levels or determining whether the corresponding genomic gene has been mutated or deleted.

A nucleic acid fragment encoding a "biologically active portion" of a polypeptide of the invention can be prepared by isolating a portion of the nucleotide sequence of SEQ ID NO:1-21062, which encodes a polypeptide having a biological activity (the biological activities of the various types of proteins encoded by the nucleic acid molecules of the invention are described herein), expressing the encoded portion of the polypeptide (e.g., by recombinant expression in vitro) and assessing the activity of the encoded portion of the polypeptide, for example, in assays as described herein.

The invention further encompasses nucleic acid molecules that differ from the nucleotide sequence shown in SEQ ID NO:1-21062, due to the degeneracy of the genetic code and, thus, encode the same polypeptides as those encoded by the nucleotide sequence shown in SEQ ID NO:1-21062.

In addition to the nucleotide sequences shown in SEQ ID NO:1-21062, it will be appreciated by those skilled in the art that DNA sequence polymorphisms that lead to changes in the amino acid sequences of the polypeptides encoded by the nucleic acid molecules of the invention may exist within a population (e.g., the human population). Such genetic polymorphisms may exist among individuals within a population due to natural allelic variation. As used herein, the terms "gene" and "recombinant gene" refer to nucleic acid molecules which include an open reading frame encoding an polypeptide of the invention, preferably a mammalian polypeptide, more preferably a human polypeptide, and can further include non-coding regulatory sequences, and introns. Such natural allelic variations include both functional and non-functional polypeptides and can typically result in 1-5% variance in the nucleotide sequence of the corresponding genomic gene. Any and all such nucleotide variations and resulting amino acid polymorphisms in genes that are the result of natural allelic variation and that do not alter the functional activity of the encoded polypeptide are intended to be within the scope of the invention.

Moreover, nucleic acid molecules encoding other family members and, thus, which have a nucleotide sequence which differs from the nucleotide sequences of SEQ ID NO:121062 are intended to be within the scope of the invention. For example, another cDNA can be identified based on a nucleotide sequence selected from SEQ ID NO:1-21062. Moreover, nucleic acid molecules encoding polypeptides from different species, and thus which have a nucleotide sequence which differs from the sequences of SEQ ID NO:1-21062 are intended to be within the scope of the invention. For example, a mouse e cDNA can be identified based on the human nucleotide sequence.

Nucleic acid molecules corresponding to natural allelic variants and homologues of the nucleic acid molecules of the invention can be isolated based on their homology to the nucleic acid molecules disclosed herein using the nucleic acid molecules, or a portion thereof, as a hybridization probe according to standard hybridization techniques under stringent hybridization conditions.

Accordingly, in another embodiment, an isolated nucleic acid molecule of the invention is at least 15, 20, 25, 30 or more nucleotides in length and hybridizes under stringent conditions to the nucleic acid molecule comprising the nucleotide sequence of SEQ ID NO:1-21062. In other embodiment, the nucleic acid is at least 30, 50, 100, 150, 200, 250, 300, 350, 400, 450, 500, 550, or 600 nucleotides in length. As used herein, the term "hybridizes under stringent conditions" is intended to describe conditions for hybridization and washing under which nucleotide sequences at least 60% homologous to each other typically remain hybridized to each other. Preferably, the conditions are such that sequences at least about 70%, more preferably at least about 80%, even more preferably at least about 85%, even more preferably at least about 90% or 95% homologous to each other typically remain hybridized to each other.

Such stringent conditions are known to those skilled in the art and can be found in *Current Protocols in Molecular Biology*, Ausubel et al., eds., John Wiley & Sons, Inc. (1995), sections 2, 4, and 6. Additional stringent conditions can be found in *Molecular Cloning: A Laboratory Manual*, Sambrook et al., Cold Spring Harbor Press, Cold Spring Harbor, N.Y. (1989), chapters 7, 9, and 11. A preferred, non-limiting example of stringent hybridization conditions includes hybridization in 4× sodium chloride/sodium citrate (SSC), at about 65-70° C. (or alternatively hybridization in 4×SSC plus 50% formamide at about 42-50° C.) followed by one or more washes in 1×SSC, at about 65-70° C. A preferred, non-limiting example of highly stringent hybridization conditions includes hybridization in 1×SSC, at about 65-70° C. (or alternatively hybridization in 1×SSC plus 50% formamide at about 42-50° C.) followed by one or more washes in 0.3× SSC, at about 65-70° C. A preferred, non-limiting example of reduced stringency hybridization conditions includes hybridization in 4×SSC, at about 50-60° C. (or alternatively hybridization in 6×SSC plus 50% formamide at about 40-45° C.) followed by one or more washes in 2×SSC, at about 50-60° C. Ranges intermediate to the above-recited values, e.g., at 65-70° C. or at 42-50° C. are also intended to be encompassed by the present invention. SSPE (1×SSPE is 0.15M NaCl, 10 mM NaH$_2$PO$_4$, and 1.25 mM EDTA, pH 7.4) can be substituted for SSC (1×SSC is 0.15M NaCl and 15 mM sodium citrate) in the hybridization and wash buffers; washes are performed for 15 minutes each after hybridization is complete.

The hybridization temperature for hybrids can be calculated using standard methods, or, for example, with commercially available software that determines the melting point of nucleotide duplexes. The hybridization temperatures for hybrids anticipated to be less than 50 base pairs in length should be 5-10° C. less than the melting temperature ($T_m$) of the hybrid, where $T_m$ is determined according to the following equations. For hybrids less than 18 base pairs in length, $T_m(°C.) = 2(\# \text{ of A+T bases}) + 4(\# \text{ of G+C bases})$. For hybrids between 18 and 49 base pairs in length, $T_m(°C.) = 81.5 + 16.6 (\log_{10}[Na^+]) + 0.41(\% G+C) - (600/N)$, where N is the number of bases in the hybrid, and [Na$^+$] is the concentration of sodium ions in the hybridization buffer ([Na$^+$] for 1×SSC=0.165 M).

It will also be recognized by the skilled practitioner that additional reagents may be added to hybridization and/or wash buffers to decrease non-specific hybridization of nucleic acid molecules to membranes, for example, nitrocellulose or nylon membranes, including but not limited to blocking agents (e.g., BSA or salmon or herring sperm carrier DNA), detergents (e.g., SDS), chelating agents (e.g., EDTA), Ficoll, PVP and the like. When using nylon membranes, in particular, an additional preferred, non-limiting example of stringent hybridization conditions is hybridization in 0.25-0.5M NaH$_2$PO$_4$, 7% SDS at about 65° C., followed by one or more washes at 0.02M NaH$_2$PO$_4$, 1% SDS at 65° C. (see e.g., Church and Gilbert (1984) *Proc. Natl. Acad. Sci. USA* 81:1991-1995), or alternatively 0.2×SSC, 1% SDS.

Preferably, an isolated nucleic acid molecule of the invention that hybridizes under stringent conditions to the sequence of SEQ ID NO:1-21062 corresponds to a naturally-occurring nucleic acid molecule. As used herein, a "naturally-occurring" nucleic acid molecule refers to an RNA or DNA molecule having a nucleotide sequence that occurs in nature (e.g., encodes a natural protein).

In addition to naturally-occurring allelic variants of the nucleic acid molecules of the invention that may exist in the population, the skilled artisan will further appreciate that changes can be introduced by mutation into the nucleotide sequences of SEQ ID NO:1-21062, thereby leading to changes in the amino acid sequence of the encoded polypeptide, without altering the functional ability of the polypeptide. For example, nucleotide substitutions leading to amino acid substitutions at "non-essential" amino acid residues can be made in the sequence of a polypeptide. A "non-essential" amino acid residue is a residue that can be altered from the wild-type sequence of the polypeptide without altering the biological activity, whereas an "essential" amino acid residue is required for biological activity. For example, amino acid residues that are conserved among the polypeptides of the present invention, are predicted to be particularly unamenable to alteration. Furthermore, additional amino acid residues that are conserved between the polypeptides of the present invention and other family members are not likely to be amenable to alteration. Guidance concerning which amino acid changes are likely to be phenotypically silent can be found, for example, in Bowie et al., Science 247:1306-1310 (1990).

Accordingly, another aspect of the invention pertains to nucleic acid molecules encoding polypeptides that contain changes in amino acid residues that are not essential for activity.

An isolated nucleic acid molecule encoding a polypeptide homologous to the polypeptides of the present invention can be created by introducing one or more nucleotide substitutions, additions or deletions into the nucleotide sequence of SEQ ID NO:1-21062, such that one or more amino acid substitutions, additions or deletions are introduced into the encoded protein. Mutations can be introduced into SEQ ID NO:1-21062 by standard techniques, such as site-directed mutagenesis and PCR-mediated mutagenesis. Preferably, conservative amino acid substitutions are made at one or more predicted non-essential amino acid residues. A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Thus, a predicted nonessential amino acid residue in a polypeptide of the invention is preferably replaced with another amino acid residue from the same side chain family. Alternatively, in another embodiment, mutations can be introduced randomly along all or part of a polypeptide coding sequence, such as by saturation mutagenesis, and the resultant mutants can be screened for biological activity using standard assays such as those described herein to identify mutants that retain activity. Following mutagenesis of SEQ ID NO:1-21062, the encoded protein can be expressed recombinantly and the activity of the protein can be determined.

In addition to the nucleic acid molecules encoding polypeptides as described above, another aspect of the invention pertains to isolated nucleic acid molecules which are antisense thereto. An "antisense" nucleic acid comprises a nucleotide sequence which is complementary to a "sense" nucleic acid encoding a protein, e.g., complementary to the coding strand of a double-stranded cDNA molecule or complementary to an mRNA sequence. Accordingly, an antisense nucleic acid can hydrogen bond to a sense nucleic acid. The antisense nucleic acid can be complementary to an entire polypeptide coding strand, or only to a portion thereof. In one embodiment, an antisense nucleic acid molecule is antisense to a "coding region" of the coding strand of a nucleotide sequence of the invention. The term "coding region" refers to the region of the nucleotide sequence comprising codons which are translated into amino acid residues. In another embodiment, the antisense nucleic acid molecule is antisense to a "noncoding region" of the coding strand of a nucleotide sequence of the invention. The term "noncoding region" refers to 5' and 3' sequences which flank the coding region that are not translated into amino acids (i.e., also referred to as 5' and 3' untranslated regions).

Given the coding strand sequences of the nucleic acid molecules disclosed herein, antisense nucleic acids of the invention can be designed according to the rules of Watson and Crick base pairing. The antisense nucleic acid molecule can be complementary to the entire coding region of the corresponding mRNA, but more preferably is an oligonucleotide which is antisense to only a portion of the coding or noncoding region of the mRNA. For example, the antisense oligonucleotide can be complementary to the region surrounding the translation start site of an mRNA. An antisense oligonucleotide can be, for example, about 5, 10, 15, 20, 25, 30, 35, 40, 45 or 50 nucleotides in length. An antisense nucleic acid of the invention can be constructed using chemical synthesis and enzymatic ligation reactions using procedures known in the art. For example, an antisense nucleic acid (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used. Examples of modified nucleotides which can be used to generate the antisense nucleic acid include 5-fluorouracil, 5-bromouracil, 5-chlorouracil, 5-iodouracil, hypoxanthine, xantine, 4-acetylcytosine, 5-(carboxyhydroxylmethyl)uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl)uracil, (acp3)w, and 2,6-diaminopurine. Alternatively, the antisense nucleic acid can be produced biologically using an expression vector into which a nucleic acid has been subcloned in an antisense orientation (i.e., RNA transcribed from the inserted nucleic acid will be of an antisense orientation to a target nucleic acid of interest, described further in the following subsection).

The antisense nucleic acid molecules of the invention are typically administered to a subject or generated in situ such that they hybridize with or bind to cellular mRNA and/or genomic DNA encoding a polypeptide of the invention to thereby inhibit expression of the protein, e.g., by inhibiting transcription and/or translation. The hybridization can be by conventional nucleotide complementarity to form a stable duplex, or, for example, in the case of an antisense nucleic acid molecule which binds to DNA duplexes, through specific interactions in the major groove of the double helix. An example of a route of administration of antisense nucleic acid molecules of the invention include direct injection at a tissue site. Alternatively, antisense nucleic acid molecules can be modified to target selected cells and then administered systemically. For example, for systemic administration, antisense molecules can be modified such that they specifically bind to receptors or antigens expressed on a selected cell surface, e.g., by linking the antisense nucleic acid molecules to peptides or antibodies which bind to cell surface receptors or antigens. The antisense nucleic acid molecules can also be delivered to cells using the vectors described herein. To achieve sufficient intracellular concentrations of the antisense molecules, vector constructs in which the antisense nucleic acid molecule is placed under the control of a strong pol II or pol III promoter are preferred.

In yet another embodiment, the antisense nucleic acid molecule of the invention is an α-anomeric nucleic acid molecule. An α-anomeric nucleic acid molecule forms specific double-stranded hybrids with complementary RNA in which, contrary to the usual β-units, the strands run parallel to each other (Gaultier et al. (1987) *Nucleic Acids. Res.* 15:6625-6641). The antisense nucleic acid molecule can also comprise a 2'-o-methylribonucleotide (Inoue et al. (1987) *Nucleic Acids Res.* 15:6131-6148) or a chimeric RNA-DNA analogue (Inoue et al. (1987) *FEBS Lett.* 215:327-330).

In still another embodiment, an antisense nucleic acid of the invention is a ribozyme. Ribozymes are catalytic RNA molecules with ribonuclease activity which are capable of cleaving a single-stranded nucleic acid, such as an mRNA, to which they have a complementary region. Thus, ribozymes (e.g., hammerhead ribozymes (described in Haselhoff and Gerlach (1988) *Nature* 334:585-591)) can be used to catalytically cleave mRNA transcripts to thereby inhibit translation of the mRNA. A ribozyme having specificity for a polypeptide-encoding nucleic acid of the invention can be designed based upon the nucleotide sequence disclosed herein (i.e., SEQ ID NO:1-21062). For example, a derivative of a Tetrahymena L-19 IVS RNA can be constructed in which the nucleotide sequence of the active site is complementary to the nucleotide sequence to be cleaved in a polypeptide-encoding mRNA. See, e.g., Cech et al. U.S. Pat. No. 4,987,071; and Cech et al. U.S. Pat. No. 5,116,742. Alternatively, the mRNA can be used to select a catalytic RNA having a specific ribonuclease activity from a pool of RNA molecules. See, e.g., Bartel, D. and Szostak, J. W. (1993) *Science* 261:1411-1418.

Alternatively, gene expression can be inhibited by targeting nucleotide sequences complementary to the regulatory region of the gene containing the nucleic acid molecule of the invention (e.g., promoter and/or enhancers) to form triple helical structures that prevent transcription of the gene in target cells. See generally, Helene, C. (1991) *Anticancer Drug Des.* 6(6):569-84; Helene, C. et al. (1992) *Ann. N.Y. Acad. Sci.* 660:27-36; and Maher, L. J. (1992) *Bioassays* 14(12):807-15.

In yet another embodiment, the nucleic acid molecules of the present invention can be modified at the base moiety, sugar moiety or phosphate backbone to improve, e.g., the stability, hybridization, or solubility of the molecule. For example, the deoxyribose phosphate backbone of the nucleic acid molecules can be modified to generate peptide nucleic acids (see Hyrup B. et al. (1996) *Bioorganic & Medicinal Chemistry* 4 (1): 5-23). As used herein, the terms "peptide nucleic acids" or "PNAs" refer to nucleic acid mimics, e.g., DNA mimics, in which the deoxyribose phosphate backbone is replaced by a pseudopeptide backbone and only the four natural nucleobases are retained. The neutral backbone of PNAs has been shown to allow for specific hybridization to DNA and RNA under conditions of low ionic strength. The synthesis of PNA oligomers can be performed using standard solid phase peptide synthesis protocols as described in Hyrup B. et al. (1996) supra; Perry-O'Keefe et al. Proc. Natl. Acad. Sci. 93: 14670-675.

PNAs of nucleic acid molecules of the invention can be used in therapeutic and diagnostic applications. For example, PNAs can be used as antisense or antigene agents for sequence-specific modulation of gene expression by, for example, inducing transcription or translation arrest or inhibiting replication. PNAs of the nucleic acid molecules of the invention can also be used in the analysis of single base pair mutations in a gene, (e.g., by PNA-directed PCR clamping); as 'artificial restriction enzymes' when used in combination with other enzymes, (e.g., S1 nucleases (Hyrup B. (1996) supra)); or as probes or primers for DNA sequencing or hybridization (Hyrup B. et al. (1996) supra; Perry-O'Keefe supra).

In another embodiment, PNAs of nucleic acids of the invention can be modified, (e.g., to enhance their stability or cellular uptake), by attaching lipophilic or other helper groups to PNA, by the formation of PNA-DNA chimeras, or by the use of liposomes or other techniques of drug delivery known in the art. For example, PNA-DNA chimeras of the nucleic acid molecules of the invention can be generated which may combine the advantageous properties of PNA and DNA. Such chimeras allow DNA recognition enzymes, (e.g., RNAse H and DNA polymerases), to interact with the DNA portion while the PNA portion would provide high binding affinity and specificity. PNA-DNA chimeras can be linked using linkers of appropriate lengths selected in terms of base stacking, number of bonds between the nucleobases, and orientation (Hyrup B. (1996) supra). The synthesis of PNA-DNA chimeras can be performed as described in Hyrup B. (1996) supra and Finn P. J. et al. (1996) *Nucleic Acids Res.* 24 (17): 3357-63. For example, a DNA chain can be synthesized on a solid support using standard phosphoramidite coupling chemistry and modified nucleoside analogs, e.g., 5'-(4-methoxytrityl)amino-5'-deoxy-thymidine phosphoramidite, can be used as a between the PNA and the 5' end of DNA (Mag, M. et al. (1989) *Nucleic Acid Res.* 17: 5973-88). PNA monomers are then coupled in a stepwise manner to produce a chimeric molecule with a 5' PNA segment and a 3' DNA segment (Finn P. J. et al. (1996) supra). Alternatively, chimeric molecules can be synthesized with a 5' DNA segment and a 3' PNA segment (Peterser, K. H. et al. (1975) *Bioorganic Med. Chem. Lett.* 5: 1119-11124).

In other embodiments, oligonucleotides within the scope of the invention may include other appended groups such as peptides (e.g., for targeting host cell receptors in vivo), or agents facilitating transport across the cell membrane (see, e.g., Letsinger et al. (1989) *Proc. Natl. Acad. Sci. US.* 86:6553-6556; Lemaitre et al. (1987) *Proc. Natl. Acad. Sci. USA* 84:648-652; PCT Publication No. WO88/09810) or the blood-brain barrier (see, e.g., PCT Publication No. WO89/10134). In addition, oligonucleotides can be modified with hybridization-triggered cleavage agents (See, e.g., Krol et al. (1988) *Bio-Techniques* 6:958-976) or intercalating agents. (See, e.g., Zon (1988) *Pharm. Res.* 5:539-549). To this end, the oligonucleotide may be conjugated to another molecule, (e.g., a peptide, hybridization triggered cross-linking agent, transport agent, or hybridization-triggered cleavage agent).

II. Isolated Polypeptide and Antibodies

One aspect of the invention pertains to isolated polypeptides, proteins and biologically active portions thereof, as well as polypeptide fragments suitable for use as immunogens to raise antibodies (as used herein, the terms polypeptide and protein are used interchangeably). In one embodiment, native proteins encoded by the nucleic acids of the invention can be isolated from cells or tissue sources by an appropriate purification scheme using standard protein purification techniques. In another embodiment, proteins of the invention are produced by recombinant DNA techniques. Alternative to recombinant expression, a protein or polypeptide can be synthesized chemically using standard peptide synthesis techniques.

An "isolated" or "purified" protein, polypeptide or biologically active portion thereof is substantially free of cellular material or other contaminating proteins from the cell or tissue source from which the polypeptide or protein is derived, or substantially free from chemical precursors or other chemicals when chemically synthesized. The language "substantially free of cellular material" includes preparations of proteins in which the protein is separated from cellular components of the cells from which it is isolated or recombinantly produced. In one embodiment, the language "substantially free of cellular material" includes preparations of a protein encoded by a nucleic acid molecule of the invention (e.g., SEQ ID NO:1-21062) having less than about 30% (by dry weight) of proteins other than the protein being purified or isolated (also referred to herein as a "contaminating protein"), more preferably less than about 20% of contaminating protein, still more preferably less than about 10% of contaminating protein, and most preferably less than about 5% contaminating protein. When the protein of the invention, or biologically active portion thereof, is recombinantly produced, it is also preferably substantially free of culture medium, i.e., culture medium represents less than about 20%, more preferably less than about 10%, and most preferably less than about 5% of the volume of the protein preparation.

The language "substantially free of chemical precursors or other chemicals" includes preparations of a protein or polypeptide of the invention in which the protein is separated from chemical precursors or other chemicals which are involved in the synthesis of the protein. In one embodiment, the language "substantially free of chemical precursors or other chemicals" includes preparations of a protein of the invention having less than about 30% (by dry weight) of chemical precursors, more preferably less than about 20% chemical precursors, still more preferably less than about 10% chemical precursors, and most preferably less than about 5% chemical precursors.

Biologically active portions of a protein of the invention include peptides comprising amino acid sequences sufficiently homologous to or derived from the amino acid sequence of the polypeptide, which include less amino acids than the full length proteins, and exhibit at least one activity of a protein. Typically, biologically active portions comprise a domain or motif with at least one activity of the protein or polypeptide. For example, a biologically active portion of can be a polypeptide which is, for example, at least 10, 25, 50, 100 or more amino acids in length. Such fragments may be linear or in a cyclized form using methods know in the art such as found in, for reference, H. U. Saragovi, et. Al., Bio/Technology 10, 773-778 (1992) and R. S. McDowell, et al., J. Amer. Chem. Soc. 114, 9245-9253 (1992).

Where the polypeptides of the present invention are found to be membrane bound entities, this invention also provides for their soluble form. In these instances, the membrane bound portions of the polypeptides are deleted using standard methods such that they are secreted from the cell upone expression. Sequence information can be used by those knowledgeable in the art to determine where the membrane bound regions are located within the polypeptide sequence.

To determine the percent identity of two amino acid sequences or of two nucleic acid sequences, the sequences are aligned for optimal comparison purposes (e.g., gaps can be introduced in one or both of a first and a second amino acid or nucleic acid sequence for optimal alignment and non-homologous sequences can be disregarded for comparison purposes). In a preferred embodiment, the length of a reference sequence aligned for comparison purposes is at least 30%, preferably at least 40%, more preferably at least 50%, even more preferably at least 60%, and even more preferably at least 70%, 80%, or 90% of the length of the reference sequence. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position (as used herein amino acid or nucleic acid "identity" is equivalent to amino acid or nucleic acid "homology"). The percent identity between the two sequences is a function of the number of identical positions shared by the sequences, taking into account the number of gaps, and the length of each gap, which need to be introduced for optimal alignment of the two sequences.

The comparison of sequences and determination of percent identity between two sequences can be accomplished using a mathematical algorithm. For example, the percent identity between two amino acid sequences is determined using the Needleman and Wunsch (*J. Mol. Biol.* (48):444-453 (1970)) algorithm which has been incorporated into the GAP program in the GCG software package using either a Blosum 62 matrix or a PAM250 matrix, and a gap weight of 16, 14, 12, 10, 8, 6, or 4 and a length weight of 1, 2, 3, 4, 5, or 6. In another embodiment, the percent identity between two nucleotide sequences is determined using the GAP program in the GCG software package using a NWSgapdna.CMP matrix and a gap weight of 40, 50, 60, 70, or 80 and a length weight of 1, 2, 3, 4, 5, or 6. A preferred, non-limiting example of parameters to be used in conjunction with the GAP program include a Blosum 62 scoring matrix with a gap penalty of 12, a gap extend penalty of 4, and a frameshift gap penalty of 5.

In another embodiment, the percent identity between two amino acid or nucleotide sequences is determined using the algorithm of E. Meyers and W. Miller (*Comput. Appl. Biosci.*, 4:11-17 (1988)) which has been incorporated into the ALIGN program (version 2.0 or version 2.0 U), using a PAM120 weight residue table, a gap length penalty of 12 and a gap penalty of 4.

The nucleic acid and polypeptide sequences of the present invention can further be used as a "query sequence" to perform a search against public databases to, for example, identify other family members or related sequences. Such searches can be performed using the NBLAST and XBLAST programs (version 2.0) of Altschul, et al. (1990) *J. Mol. Biol.* 215:403-10. BLAST nucleotide searches can be performed with the NBLAST program, score=100, wordlength=12 to obtain nucleotide sequences homologous to nucleic acid molecules of the invention. BLAST protein searches can be performed with the XBLAST program, score=100, wordlength=3, and a Blosum62 matrix to obtain amino acid sequences homologous to polypeptide molecules of the invention. To obtain gapped alignments for comparison purposes, Gapped BLAST can be utilized as described in Altschul et al., (1997) *Nucleic Acids Res.* 25(17):3389-3402. When utilizing BLAST and Grapped BLAST programs, the default parameters of the respective programs (e.g., XBLAST and NBLAST) can be used.

The invention also provides chimeric or fusion proteins. As used herein, a "chimeric protein" or "fusion protein" comprises a polypeptide of the invention (e.g., encoded by a nucleic acid having a sequence shown in SEQ ID NO:1-21062; or having an amino acid sequence shown in SEQ ID NO:21063-21107) operatively linked to a heterologous polypeptide. A "heterologous polypeptide" refers to a polypeptide having an amino acid sequence corresponding to a protein which is not substantially homologous to the polypeptide of the invention used in the chimeric or fusion protein, e.g., a protein which is different from the polypeptide of the invention and which is derived from the same or a different organism. The fusion protein can contain all or a portion of a polypeptide of the invention. In a preferred embodiment, a fusion protein comprises at least one biologically active portion of a protein of the invention. In another preferred embodiment, a fusion protein comprises at least two biologically active portions of a protein of the invention. Within the fusion protein, the term "operatively linked" is intended to indicate that the polypeptide of the invention and the heterologous polypeptide are fused in-frame to each other. The heterologous polypeptide can be fused to the N-terminus or C-terminus of the polypeptide of the invention.

For example, in one embodiment, the fusion protein is a GST-fusion protein in which a polypeptide sequence of the invention is fused to the C-terminus of the GST sequences. Such fusion proteins can facilitate the purification of recombinant polypeptides.

In another embodiment, the fusion protein is a polypeptide of the invention containing a heterologous signal sequence at its N-terminus. In certain host cells (e.g., mammalian host cells), expression and/or secretion of polypeptide can be increased through use of a heterologous signal sequence.

The fusion proteins of the invention can be incorporated into pharmaceutical compositions and administered to a subject in vivo. The fusion proteins can be used to affect the bioavailability of a polypeptide substrate or ligand. Use of fusion proteins may be useful therapeutically for the treatment of disorders related to a polypeptide of the invention, e.g., as described herein. Moreover, the fusion proteins of the invention can be used as immunogens to produce antibodies in a subject specific for a polypeptide of the invention, to purify ligands or substrates of the polypeptides of the invention, and in screening assays to identify molecules which inhibit the interaction of a polypeptide of the invention with a ligand or substrate.

Preferably, a chimeric or fusion protein of the invention is produced by standard recombinant DNA techniques. For example, DNA fragments coding for the different polypeptide sequences are ligated together in-frame in accordance with conventional techniques, for example by employing blunt-ended or stagger-ended termini for ligation, restriction enzyme digestion to provide for appropriate termini, filling-in of cohesive ends as appropriate, alkaline phosphatase treatment to avoid undesirable joining, and enzymatic ligation. In another embodiment, the fusion gene can be synthesized by conventional techniques including automated DNA synthesizers. Alternatively, PCR amplification of gene fragments can be carried out using anchor primers which give rise to complementary overhangs between two consecutive gene fragments which can subsequently be annealed and reamplified to generate a chimeric gene sequence (see, for example, *Current Protocols in Molecular Biology*, eds. Ausubel et al. John Wiley & Sons: 1992). Moreover, many expression vectors are commercially available that already encode a fusion moiety (e.g., a GST polypeptide). A nucleic acid encoding a polypeptide of the invention can be cloned into such an expression vector such that the fusion moiety is linked in-frame to the polypeptide.

The present invention also pertains to variants of the polypeptides of the invention which function as either agonists (mimetics) or as antagonists of the polypeptide. Variants of a polypeptide of the invention can be generated by mutagenesis, e.g., discrete point mutation or truncation of the polypeptide. An agonist of a polypeptide of the invention can retain substantially the same, or a subset, of the biological activities of the naturally occurring form of the polypeptide.

An antagonist of a polypeptide of the invention can inhibit one or more of the activities of the naturally occurring form of the polypeptide by, for example, competitively modulating a cellular activity of the polypeptide. Thus, specific biological effects can be elicited by treatment with a variant of limited function. In one embodiment, treatment of a subject with a variant having a subset of the biological activities of the naturally occurring form of the protein has fewer side effects in a subject relative to treatment with the naturally occurring form of the protein.

In one embodiment, variants of a polypeptide of the invention which function as either agonists (mimetics) or as antagonists can be identified by screening combinatorial libraries of mutants, e.g., truncation mutants, of the polypeptide. In one embodiment, a variegated library of polypeptide variants is generated by combinatorial mutagenesis at the nucleic acid level and is encoded by a variegated gene library. A variegated library of polypeptide variants can be produced by, for example, enzymatically ligating a mixture of synthetic oligonucleotides into gene sequences such that a degenerate set of potential polypeptide sequences is expressible as individual polypeptides, or alternatively, as a set of larger fusion proteins (e.g., for phage display) containing the set of polypeptide variant sequences therein. There are a variety of methods which can be used to produce libraries of potential polypeptide variants from a degenerate oligonucleotide sequence. Chemical synthesis of a degenerate gene sequence can be performed in an automatic DNA synthesizer, and the synthetic gene then ligated into an appropriate expression vector. Use of a degenerate set of genes allows for the provision, in one mixture, of all of the sequences encoding the desired set of potential polypeptide variant sequences. Methods for synthesizing degenerate oligonucleotides are known in the art (see, e.g., Narang, S. A. (1983) *Tetrahedron* 39:3; Itakura et al. (1984) *Annu. Rev. Biochem.* 53:323; Itakura et al. (1984) *Science* 198:1056; Ike et al. (1983) *Nucleic Acid Res.* 11:477.

In addition, libraries of fragments of the coding sequence of a nucleic acid molecule of the invention can be used to generate a variegated population of the fragments of the polypeptide encoded by the nucleic acid for screening and subsequent selection of variants of the polypeptide. In one embodiment, a library of coding sequence fragments can be generated by treating a double stranded PCR fragment of a coding sequence with a nuclease under conditions wherein nicking occurs only about once per molecule, denaturing the double stranded DNA, renaturing the DNA to form double stranded DNA which can include sense/antisense pairs from different nicked products, removing single stranded portions from reformed duplexes by treatment with S1 nuclease, and ligating the resulting fragment library into an expression vector. By this method, an expression library can be derived which encodes N-terminal, C-terminal and internal fragments of various sizes of the polypeptide.

Several techniques are known in the art for screening gene products of combinatorial libraries made by point mutations or truncation, and for screening cDNA libraries for gene products having a selected property. Such techniques are adaptable for rapid screening of the gene libraries generated by the combinatorial mutagenesis of proteins. The most widely used techniques, which are amenable to high throughput analysis, for screening large gene libraries typically include cloning the gene library into replicable expression vectors, transforming appropriate cells with the resulting library of vectors, and expressing the combinatorial genes under conditions in which detection of a desired activity facilitates isolation of the vector encoding the gene whose product was detected. Recrusive ensemble mutagenesis (REM), a new technique which enhances the frequency of functional mutants in the libraries, can be used in combination with the screening assays to identify polypeptide variants (Arkin and Yourvan (1992) *Proc. Natl. Acad. Sci. USA* 89:7811-7815; Delgrave et al. (1993) *Protein Engineering* 6(3):327-331).

In one embodiment, cell based assays can be exploited to analyze a variegated library. For example, a library of expression vectors can be transfected into a cell line which ordinarily synthesizes and secretes the polypeptide. The transfected cells are then cultured such that polypeptide and a particular mutant of the polypeptide are secreted and the effect of expression of the mutant on polypeptide activity in cell supernatants can be detected, e.g., by any of a number of enzymatic assays. Plasmid DNA can then be recovered from the cells which score for inhibition, or alternatively, potentiation of polypeptide activity, and the individual clones further characterized.

An isolated polypeptide of the invention, or a portion or fragment thereof, can be used as an immunogen to generate antibodies that bind to the polypeptide using standard techniques for polyclonal and monoclonal antibody preparation. A full-length protein can be used or, alternatively, the invention provides antigenic peptide fragments of the polypeptides of the invention for use as immunogens. An antigenic peptide of a polypeptide of the invention comprises at least 8 amino acid residues and encompasses an epitope of polypeptide such that an antibody raised against the peptide forms a specific immune complex with the polypeptide. Preferably, the antigenic peptide comprises at least 10 amino acid residues, more preferably at least 15 amino acid residues, even more preferably at least 20 amino acid residues, and most preferably at least 30 amino acid residues. Preferred epitopes encompassed by the antigenic peptide are regions of the polypeptide that are located on the surface of the protein, e.g., hydrophilic regions.

A polypeptide immunogen typically is used to prepare antibodies by immunizing a suitable subject, (e.g., rabbit, goat, mouse or other mammal) with the immunogen. An appropriate immunogenic preparation can contain, for example, recombinantly expressed or a chemically synthesized polypeptide. The preparation can further include an adjuvant, such as Freund's complete or incomplete adjuvant, or similar immunostimulatory agent. Immunization of a suitable subject with an immunogenic polypeptide preparation induces a polyclonal antibody response to the polypeptide.

Accordingly, another aspect of the invention pertains to antibodies which bind to a polypeptide of the invention (e.g., a polypeptide encoded by nucleic acid having the sequence of SEQ ID NO:1-21062, or having the amino acid sequence of SEQ ID NO:21063-21107). The term "antibody" as used herein refers to immunoglobulin molecules and immunologically active portions of immunoglobulin molecules, i.e., molecules that contain an antigen binding site which specifically binds (immunoreacts with) an antigen, e.g., a polypeptide of the invention. Examples of immunologically active portions of immunoglobulin molecules include F(ab) and F(ab')$_2$ fragments which can be generated by treating the antibody with an enzyme such as pepsin. The invention provides polyclonal and monoclonal antibodies that bind to the polypeptides of the invention. The term "monoclonal antibody" or "monoclonal antibody composition", as used herein, refers to a population of antibody molecules that contain only one species of an antigen binding site capable of immunoreacting with a particular epitope of a polypeptide. A monoclonal antibody composition thus typically displays a single binding affinity for a particular protein with which it immunoreacts.

Polyclonal antibodies which bind to a polypeptide of the invention can be prepared as described above by immunizing a suitable subject with a polypeptide immunogen. The antibody titer in the immunized subject can be monitored over time by standard techniques, such as with an enzyme linked immunosorbent assay (ELISA) using immobilized immunogen. If desired, the antibody molecules directed against a polypeptide of the invention can be isolated from the mammal (e.g., from the blood) and further purified by well known techniques, such as protein A chromatography to obtain the IgG fraction. At an appropriate time after immunization, e.g., when the antibody titers are highest, antibody-producing cells can be obtained from the subject and used to prepare monoclonal antibodies by standard techniques, such as the hybridoma technique originally described by Kohler and Milstein (1975) *Nature* 256:495-497) (see also, Brown et al. (1981) *J. Immunol.* 127:539-46; Brown et al. (1980) *J. Biol. Chem* 0.255:4980-83; Yeh et al. (1976) *Proc. Natl. Acad. Sci. USA* 76:2927-31; and Yeh et al. (1982) *Int. J. Cancer* 29:269-75), the more recent human B cell hybridoma technique (Kozbor et al. (1983) *Immunol Today* 4:72), the EBV-hybridoma technique (Cole et al. (1985), *Monoclonal Antibodies and Cancer Therapy*, Alan R. Liss, Inc., pp. 77-96) or trioma techniques. The technology for producing monoclonal antibody hybridomas is well known (see generally R. H. Kenneth, in *Monoclonal Antibodies: A New Dimension In Biological Analyses*, Plenum Publishing Corp., New York, N.Y. (1980); E. A. Lerner (1981) *Yale J. Biol. Med.*, 54:387-402; M. L. Gefter et al. (1977) *Somatic Cell Genet.* 3:231-36). Briefly, an immortal cell line (typically a myeloma) is fused to lymphocytes (typically splenocytes) from a mammal immunized with a polypeptide immunogen of the invention as described above, and the culture supernatants of the resulting hybridoma cells are screened to identify a hybridoma producing a monoclonal antibody that binds to the polypeptide.

Any of the many well known protocols used for fusing lymphocytes and immortalized cell lines can be applied for the purpose of generating an a monoclonal antibody specific for a polypeptide of the invention (see, e.g., G. Galfre et al. (1977) *Nature* 266:55052; Gefter et al. *Somatic Cell Genet.*, cited supra; Lerner, *Yale J. Biol. Med.*, cited supra; Kenneth, *Monoclonal Antibodies*, cited supra). Moreover, the ordinarily skilled worker will appreciate that there are many variations of such methods which also would be useful. Typically, the immortal cell line (e.g., a myeloma cell line) is derived from the same mammalian species as the lymphocytes. For example, murine hybridomas can be made by fusing lymphocytes from a mouse immunized with an immunogenic preparation of the present invention with an immortalized mouse cell line. Preferred immortal cell lines are mouse myeloma cell lines that are sensitive to culture medium containing hypoxanthine, aminopterin and thymidine ("HAT medium"). Any of a number of myeloma cell lines can be used as a fusion partner according to standard techniques, e.g., the P3-NS1/1-Ag-4-1, P3-x63-Ag8.653 or Sp2/O-Ag14 myeloma lines. These myeloma lines are available from ATCC. Typically, HAT-sensitive mouse myeloma cells are fused to mouse splenocytes using polyethylene glycol ("PEG"). Hybridoma cells resulting from the fusion are then selected using HAT medium, which kills unfused and unproductively fused myeloma cells (unfused splenocytes die after several days because they are not transformed). Hybridoma cells producing a monoclonal antibody of the invention are detected by screening the hybridoma culture supernatants for antibodies that bind to the polypeptide of the invention, e.g., using a standard ELISA assay.

Alternative to preparing monoclonal antibody-secreting hybridomas, a monoclonal antibody for a polypeptide of the invention can be identified and isolated by screening a recombinant combinatorial immunoglobulin library (e.g., an antibody phage display library) with the polypeptide to thereby isolate immunoglobulin library members that bind to the polypeptide. Kits for generating and screening phage display libraries are commercially available (e.g., the Pharmacia *Recombinant Phage Antibody System*, Catalog No. 27-9400-01; and the Stratagene SurfZAP™ Phage Display Kit, Catalog No. 240612). Additionally, examples of methods and reagents particularly amenable for use in generating and screening antibody display library can be found in, for example, Ladner et al. U.S. Pat. No. 5,223,409; Kang et al. PCT International Publication No. WO 92/18619; Dower et al. PCT International Publication No. WO 91/17271; Winter et al. PCT International Publication WO 92/20791; Markland et al. PCT International Publication No. WO 92/15679; Breitling et al. PCT International Publication WO 93/01288; McCafferty et al. PCT International Publication No. WO 92/01047; Garrard et al. PCT International Publication No. WO 92/09690; Ladner et al. PCT International Publication No. WO 90/02809; Fuchs et al. (1991) *Bio/Technology* 9:1370-1372; Hay et al. (1992) *Hum. Antibod. Hybridomas* 3:81-85; Huse et al. (1989) *Science* 246:1275-1281; Griffiths et al. (1993) *EMBO J* 12:725-734; Hawkins et al. (1992) *J. Mol. Biol.* 226:889-896; Clarkson et al. (1991) *Nature* 352: 624-628; Gram et al. (1992) *Proc. Natl. Acad. Sci. USA* 89:3576-3580; Garrad et al. (1991) *Bio/Technology* 9:1373-1377; Hoogenboom et al. (1991) *Nuc. Acid Res.* 19:4133-4137; Barbas et al. (1991) *Proc. Natl. Acad. Sci. USA* 88:7978-7982; and McCafferty et al. *Nature* (1990) 348:552-554.

Additionally, recombinant antibodies, such as chimeric and humanized monoclonal antibodies, comprising both human and non-human portions, which can be made using standard recombinant DNA techniques, are within the scope of the invention. Such chimeric and humanized monoclonal antibodies can be produced by recombinant DNA techniques known in the art, for example using methods described in Robinson et al. International Application No. PCT/US86/02269; Akira, et al. European Patent Application 184,187; Taniguchi, M., European Patent Application 171,496; Morrison et al. European Patent Application 173,494; Neuberger et al. PCT International Publication No. WO 86/01533; Cabilly et al. U.S. Pat. No. 4,816,567; Cabilly et al. European Patent Application 125,023; Better et al. (1988) *Science* 240:1041-1043; Liu et al. (1987) *Proc. Natl. Acad. Sci. USA* 84:3439-3443; Liu et al. (1987) *J. Immunol.* 139:3521-3526; Sun et al. (1987) *Proc. Natl. Acad. Sci. USA* 84:214-218; Nishimura et al. (1987) *Canc. Res.* 47:999-1005; Wood et al. (1985) *Nature* 314:446-449; and Shaw et al. (1988) *J. Natl. Cancer Inst.* 80:1553-1559); Morrison, S. L. (1985) *Science* 229:1202-1207; Oi et al. (1986) *BioTechniques* 4:214; Winter U.S. Pat. No. 5,225,539; Jones et al. (1986) *Nature* 321:552-525; Verhoeyan et al. (1988) *Science* 239:1534; and Beidler et al. (1988) *J. Immunol.* 141:4053-4060.

An antibody (e.g., monoclonal antibody) specific for a polypeptide of the invention can be used to isolate the polypeptide by standard techniques, such as affinity chromatography or immunoprecipitation. The antibody can facilitate the purification of natural polypeptide from cells and of recombinantly produced polypeptide expressed in host cells. Moreover, an antibody specific for a polypeptide of the invention can be used to detect the polypeptide (e.g., in a cellular lysate or cell supernatant) in order to evaluate the abundance and pattern of expression of the protein. Antibodies can further be used diagnostically to monitor protein levels in tissue as part of a clinical testing procedure, e.g., to, for example, determine the efficacy of a given treatment regimen. Detection can be facilitated by coupling (i.e., physically linking) the antibody to a detectable substance. Examples of detectable substances include various enzymes, prosthetic groups, fluorescent materials, luminescent materials, bioluminescent materials, and radioactive materials. Examples of suitable enzymes include horseradish peroxidase, alkaline phosphatase, □-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include $^{125}$I, $^{131}$I, $^{35}$S or $^{3}$H.

A polynucleotide or polypeptide of the present invention may possess chemotactic abilities. As such, this molecule may have the ability to attract, among other cell types, T-cells, mast cells, eosinophils, monocytes, fibroblasts, neutrophils, epithelial and/or endothelial cells to sites in the body experiencing inflammation, infection, or hyperproliferation. These immune reactions normally occur in a tissue upon the occurrence of wounds, tissue trauma, infection, or tumor development in order to suppress such activities. By being able to stimulate these reactions, a polynucleotide or polypeptide described in this invention may have utility in increasing the chemotactic ability of a particular group of cells. By being able to inhibit chemotaxis, a polynucleotide or polypeptide described in this invention may likewise be able to treat disorders requiring suppression of chemotactic activity.

A polynucleotide or polypeptide of the present invention may be involved, either directly or indirectly, in inducing cellular proliferation. This sequence may therefore play a role in hyperproliferative disorders including but not limited to neoplasia, lymphoproliferative disorders, and Gaucher's Disease. As such, the respective polynucleotide or polypeptide may be used to treat or detect these biological alterations.

Alternatively, a polynucleotide or polypeptide of the present invention may be involved, either directly or indirectly, in inhibiting cellular proliferation. This sequence may therefore be useful in treating hyperproliferative conditions such as neoplasia. Tumor suppressor genes can act as gatekeepers of cellular proliferation, preventing the cell cycle from proceeding and hence a cell from dividing. In the absence, or alteration, of such sequence, hyperproliferation can result leading to a disorder such as neoplasia. A polynucleotide or polypeptide of this invention may therefore be used, for example, as an agent for the inhibition of tumor activity. It may act on neoplastic tissue itself, pre-neoplastic tissue, or tissue that supports tumor growth, preventing cellular transformation or the formation of the disease phenotype. This sequence may also be involved in a cascade that leads to the signaling of other factors that are involved in the therefore be valuable in the prevention or treatment of neoplasia. During its course of inducing or inhibiting cellular proliferation, a polynucleotide or polypeptide of the present invention, may be found to play a role in cellular differentiation. For example, cytokines can not only induce proliferation of a cell but can signal its differentiation down a particular lineage as well.

A polynucleotide or polypeptide of the present invention may therefore be useful in triggering proliferation and differentiation in B and/or T cells, in turn stimulating the immune system against an existing or new immune response such as, without limitation, a virus. In this manner a sequence in this invention may be useful in the detection or treatment of infectious agents and hence the detection or treatment of infectious disease. Similarly, a polynucleotide or polypeptide of this invention may be able to directly inhibit the agent of infection without requiring the up-regulation of the immune system.

Disease causing infectious agents that may be treated with a polynucleotide or polypeptide of the present invention include but are not limited to viruses, bacterial/fungal agents, or parasitic agents. These viruses include, but are not limited to Herpesviridae, Papovaviridae, Parvoviridae, Reoviridae, and Retroviridae. Diseases or symptoms caused by viruses such as these include, without limitation, encephalitis, chronic~(AIDS), and pneumonia, fatigue syndrome, hepatitis, meningitis, opportunistic infections.

Bacterial and fungal agents causing disorders that may be treated with a polynucleotide or polypeptide of this invention include, but are not limited to both Gram-Negative and Gram-positive bacterial families and fungi such as Aspergillosis, Bacillaceae, Enterobacteriaceae, Neisseriaceae, *Pseudomonas*, Rickettsiaceae, Syphillis and Staphylococcal. These families can cause lead to disease or symptoms such as, without limitation, eye infections, respiratory tract infections (e.g. Whooping cough), sepsis, Lyme Disease, Cat-Scratch Disease, Dystentery, food poisoning, Typhoid, pneumonia, Gonorrhea, Syphilis, Leprosy, Botulism, tetanus, or wound infections. Parasitic agents can likewise lead to disorders resulting in the stimulation of the immune system. Families of parisitic agents that cause disease or symptoms than may be treated or detected by a polynucleotide or polypeptide of the present invention include, but are not limited to Amebiasis, Cryptosporidiosis, Hemlinthiasis, Leishmaniasis, Toxoplasmosis, Trypanosomiasis, and Trichomonas. Parasites can lead to a number of diseases or symptoms when in a host such as, without limitation, intestinal disease, liver disease, lung disease, opportunistic infections (e.g. AIDS related), Malaria, and toxoplasmosis.

A polynucleotide or polypeptide of the present invention may be involved in the regulation of hematopoiesis. If one of the present sequences has the ability to induce the replication of colony forming cells, it may prove useful for the treatment of myeloid or lymphoid deficiencies. For example, if a polynucleotide or polypeptide of the given invention is involved, either alone or in conjunction with other molecules, in supporting the proliferation of ery~roid progenitor cells, the sequence may be useful in treating anemias associated with irradiation, chemotherapy, chronic renal failure, or end stage renal disease. In these situations, the upregulation of erythroid cells, as stimulated by a sequence of this invention, would aid in treating said conditions.

Alternatively, a polynucleotide or polypeptide of the present invention may be involved, either alone or in conjunction with other molecules, in the stimulation of growth in myeloid cells for use in treating or preventing myelosuppression resulting from chemotherapy or megakaryocytes (thereby platelets) for respective use in treating or preventing thrombocytopenia or providing cells for platelet transfusions.

A sequence of the present invention may also be found to have the ability to support the proliferation of hematopoietic stem cells. These cells are the origin of the more mature hematopoiteic cells thus therapeutic utility can be gained from a polynucleotide or polypeptide that can support growth of this cell type. These cells for example can be useful for treatment of disorders requiring transplantation.

A polynucleotide or polypeptide of the present invention may further be found to have hemostatic or thrombolytic activity. In these instances, the sequence would be useful for the treatment of coagulation disorders such as, but not limited to, hemophilia, as it has the ability to enhance coagulation. With this capability, a polynucleotide or polypeptide of the present invention may be useful in ameliorating other hemostatic events that result in wounds such as those received from surgery or other trauma. Alternatively, a polynucleotide or polypeptide of the present invention may be found to have the ability to prevent or break down thromboses. As such, this sequence would be useful for the treatment and prevention of disorders that result from thromboses formation such as, without limitation, cardiac and central nervous system infarction.

Polynucleotides and polypeptides of the present invention may demonstrate anti-inflammatory activity. These sequences may induce a cascade that signals cells responsible for promoting or inhibiting the biological activities involved in ant-inflammation. For example, a polynucleotide or polypeptide disclosed herein may be involved in promoting chemotaxis of cells that play a role in the inflammatory process. Polynucleotides or polypeptides that can initiate this response may therefore be useful in treating conditions that are associated with inflammation such as, but not limited to, arthritis, Crohn's disease, irritable bowel syndrome, infection (e.g. septic shock), or nephritis.

A protein encoded by a polynucleotide or polypeptide of the present invention, may demonstrate activity as an enzyme. Enzymes serve as the biological catalysts that perform most chemical reactions that occur within an organism. Most enzymes are highly specific thus a polynucleotide or polypeptide described herein may play an important role in directing a particular, highly important biological pathway.

A polynucleotide or polypeptide of the present invention may be useful as a nutritional source or supplement. As such this sequence may be a carbon, nitrogen, or carbohydrate source, or an amino acid or protein supplement. A protein encoded by a polynucleotide of the present invention may be added in the form of a powder, pill, capsule, solution, or liquid, to the feed of an organism. Alternatively, this molecule may be added to the medium in which a microorganism is cultured in or on. A polynucleotide or polypeptide of the present invention may have utility in leading to the regeneration of tissues such as, without limitation, bone, cartilage, ligament, tendon, or nerve tissue. Tissue regeneration potential would allow these sequences to be used for repair and replacement of tissues damaged by trauma (e.g. burns, wounds, ulcers, incisions), surgery, age, disease (e.g. osteoporosis, periodontal disease), or congenital defects.

The ability of a polynucleotide or polypeptide of the present invention to induce bone growth where bone was not previously formed may contribute to the treatment of bone fractures and other bone and cartilage defects. Likewise, stimulation of bone cell proliferation and differentiation may be useful for the treatment of periodontal disease, other tooth repair processes, osteoporosis, or osteoarthritis. Induction of de novo bone formation may also have applications in contributing to the repair of bone loss resulting from congenital, oncologic, or trauma induced bone conditions.

A polynucleotide or polypeptide of the present invention may also have the ability to stimulate regeneration of tendon or ligament formation where tendon or ligament was not previously formed. This sequence may then have applications in the treatment of tissue tears or other deformities involving tendon or ligament. The induction of tendon or ligament formation may be used to increase recovery time from damage to such tissue or be used prophylactically to avoid such damage. Likewise, a polynucleotide or polypeptide of the present invention may be useful in repairing congenital or trauma induced tissue damage. Such sequences may also create an environment that stimulates growth, differentiation or attraction of tendon or ligament forming progenitor cells, either in vivo or ex vivo for eventual in vivo return to trigger tissue repair internally. Induction of de novo tendon or ligament formation may also have applications in contributing to the repair of tendon or ligaTnent for treatment of tendinitis and other tendon or ligament disorders. In addition, these compositions may include an appropriate matrix and or sequestering agent as a carrier.

A polynucleotide or polypeptide of the present invention may also have the ability to stimulate regeneration of nerve or brain tissue or the proliferation of neural cells. This function could aid in the treatment of conditions including, without limitation, central or peripheral nervous system disorders and neuropathies, mechanical and traumatic disorders that entail degeneration, death, or injury to neural cells or tissue (e.g. spinal cord disorders, cerebrovascular disease, head trauma, stroke). A polynucleotide or polypeptide of the present invention may therefore bee used in the treatment of disorders of the peripheral nervous system encompassed by peripheral nerve injuries, peripheral neuropathy (including those resulting from chemotherapy or other medical therapies), localized neuropathy, and central nervous system diseases including, but not limited to, Alzheimer's, Parkinson's, Shy-Drager, Huntington's, and amyotrophic lateral sclerosis.

A polynucleotide or polypeptide of the present invention may also have the ability to cause the regeneration or proliferation of cells from other tissues such as, without limitation, organs (e.g. pancreas, stomach, skin, endothelium, kidney, liver, intestine), muscle (smooth, skeletal or cardiac), and vascular tissues. These functions may also be observed in tissues found in gut, thus they may have attributes for regeneration and treatment of lung or liver fibrosis, conditions resulting from systemic cytokine damage, or reperfusion injury. By virtue of the tissue caused to regenerate, a polynucleotide or polypeptide of this invention may demonstrate angiogenic activity or attribute to better or faster closure of non-healing wounds, including but not limited to, ulcers associated with pressure or vascular insufficiency, or surgical or traumatic wounds.

Additionally, a polynucleotide or polypeptide of the present invention may promote or inhibit differentiation or growth of the described tissues from precursor cells or tissues.

A polynucleotide or polypeptide of the present invention may be useful in stimulating or suppressing activities of the immune system by activating or inhibiting the proliferation, differentiation, or mobilization of cells associated with the immune system. Therefore, a sequence found herein may be useful for treating or diagnosing disorders and deficiencies of the immune system (e.g. severe combine immunodeficiency, SCID), including infectious diseases caused by viral, bacterial, fungal or other infections (e.g. HIV, hepatitis viruses, herpesviruses, mycobacteria, malaria spp.) as well as for boosting the immune system when appropriate (e.g. cancer treatment). Likewise, a polynucleotide or polypeptide of the present invention may be useful for regulating growth and proliferation of hematopoietc cells, including, without limitation, pluripotent stem cells myeloid (e.g. platelets, red blood cells, neutrophils and macrophages) or lymphoid cells (e.g. B and T lymphocytes). In this instance a given sequence may have utility for the treatment of disorders including, without being limited to, blood protein disorders (e.g. agammaglobulinemia), ataxia, telangiectasia, Digeorge Syndrome, anemia, Wiskott-Aldrich Disorder, and thrombocytopenia. Autoimmune disorders may also be treated or diagnosed with a polynucleotide or polypeptide of the present invention. Many disorders in this class result from a person's immune cells inappropriately recognizing self as foreign material, leading to the destruction of that tissue. As such, a sequence presented herein may be useful for inhibiting this immune response, in particular the proliferation, differentiation, or chemotaxis of T-cells. Autoimmune disorders that may be treatable using these polynucleotides or polypeptides include without limitation, Addison's Disease, rheumatoid arthritis, Autoimmune Eye Disease, Autoimmune Pulmonary Inflammation, connective tissue disease, dermatitis, glomerulonephritis, Grave's Disease, Multiple Sclerosis, Myasthenia Gravis, Reither's Disease, Systemic Lupus Eryhematosus, graft versus host disease, Guillain-Barre Syndrome, and insulin dependent diabetes mellitus. A polynucleotide or polypeptide of the present invention may also be useful in the treatment of allergic reactions and conditions such as asthma where suppression of the immune system is likewise desired.

The polynucleotides or polypeptides of the present invention may be able to modulate immune response through various means. This sequence may lead to down regulation of this system via the inhibition or the blocking of a currently occurring immune response. T cell responses may be suppressed in a non-antigen-specific manner or antigen-specific tolerances in T cells may be induced. Impeding autoreactive T cells may prove therapeutically beneficial in treating autoimmune disorders. Down regulation through prevention of one or more antigen activities (including but not limited to B lymphocyte antigen functions) may be useful, for example, in the prevention of graft-versus-host disease where high levels of lymphokine synthesis is triggered by T cells. The disclosed polynucleotide or polypeptide could therefore be used as an immunosuppresant, resulting in the reduction of damage caused by the immune response to the transplanted tissue. Obstructing antigen function may have utility in the treatment of autoimmune disorders.

A polynucleotide or polypeptide of this invention may be able to reduce immune system stimulation by blocking the receptor-ligand interactions of B lymphocyte antigens, preventing the costimulatory signals resulting in T cell activation. Such blocking ability may likewise show utility in preventing the production of autoantibodies or T cell-derived cytokines responsible for causing such disease. Long-term mitigation from disease symptoms may be achieved through this blocking ability upon the induction of antigen-specific tolerance in these autoreactive T cells.

Alternatively, up-regulation of antigen function (including but not limited to B lymphocyte antigen functions) by a polynucleotide or polypeptide of the present invention may be useful as a therapeutic measure for up regulating immune response. Such a response may take the form of complimenting or enhancing a currently active immune response or signaling a de novo one. Stimulating certain components of the immune system, for example B lymphocytes, may be useful in treating viral diseases (systemic or local), the common cold and encephalitis. This up regulation may also have utility in the treatment of tumors by inducing a patient to overcome a tumorspecific immune tolerance. Alternatively, the tumor itself can be transfected such that its cells contain vectors leading to the induction of a desired immune response. As an example, tumor cells can be engineered in an ex vivo manner such that they express polynucleotides or polypeptides of the given invention, the cells then being returned to the tumor such that they now express the given sequence. As this point, these cells may have the necessary signal to trigger a T cell mediated immune response against the tumor. Similarly techniques in gene therapy may be useful for the in vivo targeting of a tumor so that its cells induce said response.

A polynucleotide or polypeptide of the present invention may also be involved with one or more of the following activities: effecting human characteristics such as body weight: height; hair color; eye color; skin; percentage of adipose tissue; pigmentation; size; shape; biorhythms; cardiac cycles; fertility of male or female subjects and their reproductive capabilities (e.g. through Activin or Inhibin-like activity); metabolism, catabolism, anabolism, processing, utilization, storage or elimination of dietary fat, lipid, protein, carbohydrate, vitamins, minerals, cofactors, or other nutritional factors, or hormonal or endocrine levels.

A polynucleotide or polypeptide of the present invention may also effect behavioral characteristics such as, but not limited to, appetite, stress, libido, depression (including depressive disorders), cognition (including cognitive disorders), violent behaviors, or tolerance for pain.

In further embodiments, a polynucleotide or polypeptide of the present invention may increase or decrease the differentiation and growth of embryonic stem cells in lineages other than hematopoietic ones, or the sequences may effect treatment of enzyme deficiency related disorders, treatment of hyperproliferative disorders, immunoglobulin-like activity, or have the ability to act as an antigen in a vaccine used to illicit an immune response against a cross-reactive entity.

III. Computer Readable Means

The nucleotide or amino acid sequences of the invention are also provided in a variety of mediums to facilitate use thereof. As used herein, "provided" refers to a manufacture, other than an isolated nucleic acid or amino acid molecule, which contains a nucleotide or amino acid sequences of the present invention. Such a manufacture provides the nucleotide or amino acid sequences, or a subset thereof (e.g., a subset of open reading frames (ORI's)) in a form which allows a skilled artisan to examine the manufacture using means not directly applicable to examining the nucleotide or amino acid sequences, or a subset thereof, as they exist in nature or in purified form.

In one application of this embodiment, a nucleotide or amino acid sequence of the present invention can be recorded on computer readable media. As used herein "computer readable media" includes any medium that can be read and accessed directly by a computer. Such media include, but are not limited to: magnetic storage media, such as floppy discs, hard disc storage medium, and magnetic tape; optical storage media such a CD-ROM; electrical storage media such as RAM and ROM; and hybrids of these categories such as magnetic/optical storage media. The skilled artisan will readily appreciate how any of the presently known computer readable mediums can be used to create a manufacture comprising computer readable medium having recorded thereon a nucleotide or amino acid sequence of the present invention.

As used herein "recorded" refers to a process of storing information on computer readable medium. The skilled artisan can readily adopt any of the presently known methods for recording information on a computer readable medium to generate manufactures comprising the nucleotide or amino acid sequence information of the present invention.

A variety of data storage structures are available to a skilled artisan for creating a computer readable medium having recorded thereon a nucleotide or amino acid sequence of the present invention. The choice of the data storage structure will generally be based on the means chosen to access the stored information. In addition, a variety of data processor programs and formats can be used to store the nucleotide sequence information of the present invention on computer readable medium. The sequence information can be represented in a word processing text file, formatted in commercially-available software such as WordPerfect and Microsoft Word, or represented in the form of an ASCHII file, stored in a database application, such as DB2, Sybase Oracle, or the like. The skilled artisan can readily adapt any number of dataprocessor structuring formats (e.g., text file or database) in order to obtain computer readable medium having recorded thereon the nucleotide sequence information of the present invention.

By providing the nucleotide or amino acid sequences of the invention in computer readable form, the skilled artisan can routinely access the sequence information for a variety of purposes. For example, one skilled in the art can use the nucleotide or amino acid sequences of the invention in computer readable form to compare a target sequence or target structural motif with the sequence information stored within the data storage means. Search means are used to identity fragments or regions of the sequences of the invention which match a particular target sequence or target motif.

As used herein, a "target sequence" can be any DNA or amino acid sequence of six or more nucleotide or two or more amino acids. A skilled artisan can readily recognize that the longer a target sequence is, the less likely a target sequence will be present as a random occurrence in the database. The most preferred sequence length of a target sequence is from about 10 to 100 amino acids or form about 30 to 300 nucleotide residues. However, it is well recognized that commercially important fragments, such as sequence fragments involved in gene expression and protein processing, may be shorter length.

As used herein, "a target structural motif," or "target motif," refers to any rationally selected sequence or combination of sequences in which the sequence(s) are chosen based on a three-dimensional configuration which is formed upon the folding of the target motif. There are a variety of target motifs known in the art. Protein target motifs include, but are not limited to, enzyme active sites and signal sequences. Nucleic acid target motifs include, but are not limited to, promoter sequences, hairpin structures and inducible expression elements (protein binding sequences).

Computer software is publicly available which allows a skilled artisan to access sequence information provided in a computer readable medium for analysis and comparison to other sequences. A variety of known algorithms are disclosed publicly and a variety of commercially available software of conducting search means are and can be used in the computer-based systems of the present invention. Examples of such software include, but are not limited to, MacPatter (EMBL), BLASTN and BASTX (NCBIA).

For example, software which implements the BLAST (Altschul et al. (1990) *J. Mol. Biol.* 215:403-410) and BLAZE (Brutlag et al. (1993) *Comp. Chem.* 17:203-207) search algorithms on a Sybase system can be used to identify open reading frames (ORFs) of the sequences of the invention which contain homology to ORFs or proteins from other libraries. Such ORFs are protein encoding fragments and are useful in producing commercially important proteins such as enzyme used in various reactions and in the production of commercially useful metabolites.

IV. Recombinant Expression Vectors and Host Cells

Another aspect of the invention pertains to vectors, preferably expression vectors, containing a nucleic acid molecule of the invention that expresses a polypeptide (or a portion thereof). As used herein, the term "vector" refers to a nucleic acid molecule capable of transporting another nucleic acid to which it has been linked. One type of vector is a "plasmid", which refers to a circular double stranded DNA loop into which additional DNA segments can be ligated. Another type of vector is a viral vector, wherein additional DNA segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively linked. Such vectors are referred to herein as "expression vectors". In general, expression vectors of utility in recombinant DNA techniques are often in the form of plasmids. In the present specification, "plasmid" and "vector" can be used interchangeably as the plasmid is the most commonly used form of vector. However, the invention is intended to include such other forms of expression vectors, such as viral vectors (e.g., replication defective retroviruses, adenoviruses and adeno-associated viruses), which serve equivalent functions.

The recombinant expression vectors of the invention comprise a nucleic acid of the invention in a form suitable for expression of the nucleic acid in a host cell, which means that the recombinant expression vectors include one or more regulatory sequences, selected on the basis of the host cells to be used for expression, which is operatively linked to the nucleic acid sequence to be expressed. Within a recombinant expression vector, "operably linked" is intended to mean that the nucleotide sequence of interest is linked to the regulatory sequence(s) in a manner which allows for expression of the nucleotide sequence (e.g., in an in vitro transcription/translation system or in a host cell when the vector is introduced into the host cell). The term "regulatory sequence" is intended to includes promoters, enhancers and other expression control elements (e.g., polyadenylation signals). Such regulatory sequences are described, for example, in Goeddel; *Gene Expression Technology: Methods in Enzymology* 185, Academic Press, San Diego, Calif. (1990). Regulatory sequences include those which direct constitutive expression of a nucleotide sequence in many types of host cell and those which direct expression of the nucleotide sequence only in certain host cells (e.g., tissue-specific regulatory sequences). It will be appreciated by those skilled in the art that the design of the expression vector can depend on such factors as the choice of the host cell to be transformed, the level of expression of protein desired, and the like. The expression vectors of the invention can be introduced into host cells to thereby produce proteins or peptides, including fusion proteins or peptides, encoded by nucleic acids as described herein (e.g., proteins, mutant forms of proteins, fusion proteins, and the like).

The recombinant expression vectors of the invention can be designed for expression of polypeptides of the invention in prokaryotic or eukaryotic cells. For example, proteins can be expressed in bacterial cells such as *E. coli*, insect cells (using baculovirus expression vectors) yeast cells or mammalian cells. Suitable host cells are discussed further in Goeddel, *Gene Expression Technology: Methods in Enzymology* 185, Academic Press, San Diego, Calif. (1990). Alternatively, the recombinant expression vector can be transcribed and translated in vitro, for example using T7 promoter regulatory sequences and T7 polymerase.

Expression of proteins in prokaryotes is most often carried out in *E. coli* with vectors containing constitutive or inducible promoters directing the expression of either fusion or non-fusion proteins. Fusion vectors add a number of amino acids to a protein encoded therein, usually to the amino terminus of the recombinant protein. Such fusion vectors typically serve three purposes: 1) to increase expression of recombinant protein; 2) to increase the solubility of the recombinant protein; and 3) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase. Typical fusion expression vectors include pGEX (Pharmacia Biotech Inc; Smith, D. B. and Johnson, K. S. (1988) *Gene* 67:31-40), pMAL (New England Biolabs, Beverly, Mass.) and pRIT5 (Pharmacia, Piscataway, N.J.) which fuse glutathione S-transferase (GST), maltose E binding protein, or protein A, respectively, to the target recombinant protein.

Purified fusion proteins can be utilized in activity assays, (e.g., direct assays or competitive assays described in detail below), or to generate antibodies specific for a polypeptide of the invention, for example. In a preferred embodiment, a fusion protein such as those described herein expressed in a retroviral expression vector of the present invention can be utilized to infect bone marrow cells which are subsequently transplanted into irradiated recipients. The pathology of the subject recipient is then examined after sufficient time has passed (e.g., six (6) weeks).

Examples of suitable inducible non-fusion *E. coli* expression vectors include pTrc (Amann et al., (1988) *Gene* 69:301-315) and pET 11d (Studier et al., *Gene Expression Technology: Methods in Enzymology* 185, Academic Press, San Diego, Calif. (1990) 60-89). Target gene expression from the pTrc vector relies on host RNA polymerase transcription from a hybrid trp-lac fusion promoter. Target gene expression from the pET 11d vector relies on transcription from a T7 gn10-lac fusion promoter mediated by a coexpressed viral RNA polymerase (T7 gn1). This viral polymerase is supplied by host strains BL21(DE3) or HMS174(DE3) from a resident prophage harboring a T7 gn1 gene under the transcriptional control of the lacUV 5 promoter.

One strategy to maximize recombinant protein expression in *E. coli* is to express the protein in a host bacteria with an impaired capacity to proteolytically cleave the recombinant protein (Gottesman, S., *Gene Expression Technology: Methods in Enzymology* 185, Academic Press, San Diego, Calif. (1990) 119-128). Another strategy is to alter the nucleic acid sequence of the nucleic acid to be inserted into an expression vector so that the individual codons for each amino acid are those preferentially utilized in *E. coli* (Wada et al., (1992) *Nucleic Acids Res.* 20:2111-2118). Such alteration of nucleic acid sequences of the invention can be carried out by standard DNA synthesis techniques.

In another embodiment, the expression vector is a yeast expression vector. Examples of vectors for expression in yeast *S. cerivisae* include pYepSec1 (Baldari, et al., (1987) *Embo J.* 6:229-234), pMFa (Kurjan and Herskowitz, (1982) *Cell* 30:933-943), pJRY88 (Schultz et al., (1987) *Gene* 54:113-123), pYES2 (Invitrogen Corporation, San Diego, Calif.), and picZ (InVitrogen Corp, San Diego, Calif.).

Alternatively, proteins of the invention can be expressed in insect cells using baculovirus expression vectors. Baculovirus vectors available for expression of proteins in cultured insect cells (e.g., Sf 9 cells) include the pAc series (Smith et al. (1983) *Mol. Cell. Biol.* 3:2156-2165) and the pVL series (Lucklow and Summers (1989) *Virology* 170:31-39).

In yet another embodiment, a nucleic acid of the invention is expressed in mammalian cells using a mammalian expression vector. Examples of mammalian expression vectors include pCDM8 (Seed, B. (1987) *Nature* 329:840) and pMT2PC (Kaufman et al. (1987) *EMBO J.* 6:187-195). When used in mammalian cells, the expression vector's control functions are often provided by viral regulatory elements. For example, commonly used promoters are derived from polyoma, Adenovirus 2, cytomegalovirus and Simian Virus 40. For other suitable expression systems for both prokaryotic and eukaryotic cells see chapters 16 and 17 of Sambrook, J., Fritsh, E. F., and Maniatis, T. *Molecular Cloning: A Laboratory Manual. 2nd, ed., Cold Spring Harbor Laboratory*, Cold Spring Harbor Laboratory Press, Cold Spring Harbor, N.Y., 1989.

In another embodiment, the recombinant mammalian expression vector is capable of directing expression of the nucleic acid preferentially in a particular cell type (e.g., tissue-specific regulatory elements are used to express the nucleic acid). Tissue-specific regulatory elements are known in the art. Non-limiting examples of suitable tissue-specific promoters include the albumin promoter (liver-specific; Pinkert et al. (1987) *Genes Dev.* 1:268-277), lymphoid-specific promoters (Calame and Eaton (1988) *Adv. Immunol.* 43:235-275), in particular promoters of T cell receptors (Winoto and Baltimore (1989) *EMBO J.* 8:729-733) and immunoglobulins (Banerji et al. (1983) *Cell* 33:729-740; Queen and Baltimore (1983) *Cell* 33:741-748), neuron-specific promoters (e.g., the neurofilament promoter; Byrne and Ruddle (1989) *Proc. Natl. Acad. Sci. USA* 86:5473-5477), pancreas-specific promoters (Edlund et al. (1985) *Science* 230:912-916), and mammary gland-specific promoters (e.g., milk whey promoter; U.S. Pat. No. 4,873,316 and European Application Publication No. 264,166). Developmentally-regulated promoters are also encompassed, for example the murine hox promoters (Kessel and Gruss (1990) *Science* 249:374-379) and the □-fetoprotein promoter (Campes and Tilghman (1989) *Genes Dev.* 3:537-546).

The invention further provides a recombinant expression vector comprising a DNA molecule of the invention cloned into the expression vector in an antisense orientation. That is, the DNA molecule is operatively linked to a regulatory sequence in a manner which allows for expression (by transcription of the DNA molecule) of an RNA molecule which is antisense to mRNA encoding a polypeptide of the invention. Regulatory sequences operatively linked to a nucleic acid cloned in the antisense orientation can be chosen which direct the continuous expression of the antisense RNA molecule in a variety of cell types, for instance viral promoters and/or enhancers, or regulatory sequences can be chosen which direct constitutive, tissue specific or cell type specific expression of antisense RNA. The antisense expression vector can be in the form of a recombinant plasmid, phagemid or attenuated virus in which antisense nucleic acids are produced under the control of a high efficiency regulatory region, the activity of which can be determined by the cell type into which the vector is introduced. For a discussion of the regulation of gene expression using antisense genes see Weintraub, H. et al., Antisense RNA as a molecular tool for genetic analysis, *Reviews—Trends in Genetics*, Vol. 1(1) 1986.

Another aspect of the invention pertains to host cells into which a recombinant expression vector of the invention has been introduced. The terms "host cell" and "recombinant host cell" are used interchangeably herein. It is understood that such terms refer not only to the particular subject cell but to the progeny or potential progeny of such a cell. Because certain modifications may occur in succeeding generations due to either mutation or environmental influences, such progeny may not, in fact, be identical to the parent cell, but are still included within the scope of the term as used herein.

A host cell can be any prokaryotic or eukaryotic cell. For example, a protein of the invention can be expressed in bacterial cells such as *E. coli*, insect cells, yeast or mammalian cells (such as Chinese hamster ovary cells (CHO) or COS cells). Other suitable host cells are known to those skilled in the art.

Vector DNA can be introduced into prokaryotic or eukaryotic cells via conventional transformation or transfection techniques. As used herein, the terms "transformation" and "transfection" are intended to refer to a variety of art-recognized techniques for introducing foreign nucleic acid (e.g., DNA) into a host cell, including calcium phosphate or calcium chloride co-precipitation, DEAE-dextran-mediated transfection, lipofection, or electroporation. Suitable methods for transforming or transfecting host cells can be found in Sambrook, et al. (*Molecular Cloning: A Laboratory Manual. 2nd, ed., Cold Spring Harbor Laboratory*, Cold Spring Harbor Laboratory Press, Cold Spring Harbor, N.Y., 1989), and other laboratory manuals.

For stable transfection of mammalian cells, it is known that, depending upon the expression vector and transfection technique used, only a small fraction of cells may integrate the foreign DNA into their genome. In order to identify and select these integrants, a gene that encodes a selectable marker (e.g., resistance to antibiotics) is generally introduced into the host cells along with the gene of interest. Preferred selectable markers include those which confer resistance to drugs, such as G418, hygromycin and methotrexate. Nucleic acid encoding a selectable marker can be introduced into a host cell on the same vector as that encoding a polypeptide of the invention or can be introduced on a separate vector. Cells stably transfected with the introduced nucleic acid can be identified by drug selection (e.g., cells that have incorporated the selectable marker gene will survive, while the other cells die).

A host cell of the invention, such as a prokaryotic or eukaryotic host cell in culture, can be used to produce (i.e., express) a protein of the invention. Accordingly, the invention further provides methods for producing a protein of the invention using the host cells of the invention. In one embodiment, the method comprises culturing the host cell of invention (into which a recombinant expression vector encoding a rotein of the invention has been introduced) in a suitable medium such that the protein is produced. In another embodiment, the method further comprises isolating the protein from the medium or the host cell.

The host cells of the invention can also be used to produce non-human transgenic animals. For example, in one embodiment, a host cell of the invention is a fertilized oocyte or an embryonic stem cell into which protein-coding sequences have been introduced. Such host cells can then be used to create non-human transgenic animals in which exogenous protein-coding sequences have been introduced into their genome or homologous recombinant animals in which endogenous protein sequences have been altered. Such animals are useful for studying the function and/or activity of a protein of the invention and for identifying and/or evaluating modulators of protein activity. As used herein, a "transgenic animal" is a non-human animal, preferably a mammal, more preferably a rodent such as a rat or mouse, in which one or more of the cells of the animal includes a transgene. Other examples of transgenic animals include non-human primates, sheep, dogs, cows, goats, chickens, amphibians, and the like. A transgene is exogenous DNA which is integrated into the genome of a cell from which a transgenic animal develops and which remains in the genome of the mature animal, thereby directing the expression of an encoded gene product in one or more cell types or tissues of the transgenic animal. As used herein, a "homologous recombinant animal" is a non-human animal, preferably a mammal, more preferably a mouse, in which an endogenous Kinase and Phosphatase gene has been altered by homologous recombination between the endogenous gene and an exogenous DNA molecule introduced into a cell of the animal, e.g., an embryonic cell of the animal, prior to development of the animal.

A transgenic animal of the invention can be created by introducing a nucleic acid encoding a polypeptide of the invention into the male pronuclei of a fertilized oocyte, e.g., by microinjection, retroviral infection, and allowing the oocyte to develop in a pseudopregnant female foster animal. The nucleic acid sequence of SEQ ID NO:1-21062 can be introduced as a transgene into the genome of a non-human animal. Alternatively, a nonhuman homologue of a human gene, such as a mouse or rat gene, can be used as a transgene. Alternatively, a gene homologue, such as another family member, can be isolated based on hybridization to the sequences of SEQ ID NO:1-21062 (described further in subsection I above) and used as a transgene. Intronic sequences and polyadenylation signals can also be included in the transgene to increase the efficiency of expression of the transgene. A tissue-specific regulatory sequence(s) can be operably linked to the transgene to direct expression of a encoded protein to particular cells. Methods for generating transgenic animals via embryo manipulation and microinjection, particularly animals such as mice, have become conventional in the art and are described, for example, in U.S. Pat. Nos. 4,736,866 and 4,870,009, both by Leder et al., U.S. Pat. No. 4,873,191 by Wagner et al. and in Hogan, B., *Manipulating the Mouse Embryo*, (Cold Spring Harbor Laboratory Press, Cold Spring Harbor, N.Y., 1986). Similar methods are used for production of other transgenic animals. A transgenic founder animal can be identified based upon the presence of a the transgene in its genome and/or expression of the transgenic mRNA in tissues or cells of the animals. A transgenic founder animal can then be used to breed additional animals carrying the transgene. Moreover, transgenic animals carrying a transgene encoding a protein of the invention can further be bred to other transgenic animals carrying other transgenes.

To create a homologous recombinant animal, a vector is prepared which contains at least a portion of a gene into which a deletion, addition or substitution has been introduced to thereby alter, e.g., functionally disrupt, the gene. The gene can be a human gene (e.g., the SEQ ID NO:1-21062), but more preferably, is a non-human homologue of the human gene (e.g., a cDNA isolated by stringent hybridization with the nucleotide sequence of SEQ ID NO:1-21062). For example, a mouse gene can be used to construct a homologous recombination vector suitable for altering an endogenous gene in the mouse genome. In a preferred embodiment, the vector is designed such that, upon homologous recombination, the endogenous gene is functionally disrupted (i.e., no longer encodes a functional protein; also referred to as a "knock out" vector). Alternatively, the vector can be designed such that, upon homologous recombination, the endogenous gene is mutated or otherwise altered but still encodes a functional protein (e.g., the upstream regulatory region can be altered to thereby alter the expression of the endogenous protein). In the homologous recombination vector, the altered portion of the gene is flanked at its 5' and 3' ends by additional nucleic acid sequence of the gene to allow for homologous recombination to occur between the exogenous gene carried by the vector and an endogenous gene in an embryonic stem cell. The additional flanking nucleic acid sequence is of sufficient length for successful homologous recombination with the endogenous gene. Typically, several kilobases of flanking DNA (both at the 5' and 3' ends) are included in the vector (see e.g., Thomas, K. R. and Capecchi, M. R. (1987) *Cell* 51:503 for a description of homologous recombination vectors). The vector is introduced into an embryonic stem cell line (e.g., by electroporation) and cells in which the introduced gene has homologously recombined with the endogenous are selected (see, e.g., Li, E. et al. (1992) *Cell* 69:915). The selected cells are then injected into a blastocyst of an animal (e.g., a mouse) to form aggregation chimeras (see e.g., Bradley, A. in *Teratocarcinomas and Embryonic Stem Cells: A Practical Approach*, E. J. Robertson, ed. (IRL, Oxford, 1987) pp. 113-152). A chimeric embryo can then be implanted into a suitable pseudopregnant female foster animal and the embryo brought to term. Progeny harboring the homologously recombined DNA in their germ cells can be used to breed animals in which all cells of the animal contain the homologously recombined DNA by germline transmission of the transgene. Methods for constructing homologous recombination vectors and homologous recombinant animals are described further in Bradley, A. (1991) *Current Opinion in Biotechnology* 2:823-829 and in PCT International Publication Nos.: WO 90/11354 by Le Mouellec et al.; WO 91/01140 by Smithies et al.; WO 92/0968 by Zijlstra et al.; and WO 93/04169 by Berns et al.

In another embodiment, transgenic non-humans animals can be produced which contain selected systems which allow for regulated expression of the transgene. One example of such a system is the cre/loxP recombinase system of bacteriophage P1. For a description of the cre/loxP recombinase system, see, e.g., Lakso et al. (1992) *Proc. Natl. Acad. Sci. USA* 89:6232-6236. Another example of a recombinase system is the FLP recombinase system of *Saccharomyces cerevisiae* (O'Gorman et al. (1991) *Science* 251:1351-1355. If a cre/loxP recombinase system is used to regulate expression of the transgene, animals containing transgenes encoding both the Cre recombinase and a selected protein are required. Such animals can be provided through the construction of "double" transgenic animals, e.g., by mating two transgenic animals, one containing a transgene encoding a selected protein and the other containing a transgene encoding a recombinase.

Clones of the non-human transgenic animals described herein can also be produced according to the methods described in Wilmut, I. et al. (1997) *Nature* 385:810-813 and PCT International Publication Nos. WO 97/07668 and WO 97/07669. In brief, a cell, e.g., a somatic cell, from the transgenic animal can be isolated and induced to exit the growth cycle and enter Go phase. The quiescent cell can then be fused, e.g., through the use of electrical pulses, to an enucleated oocyte from an animal of the same species from which the quiescent cell is isolated. The reconstructed oocyte is then cultured such that it develops to morula or blastocyte and then transferred to pseudopregnant female foster animal. The offspring borne of this female foster animal will be a clone of the animal from which the cell, e.g., the somatic cell, is isolated.

V. Pharmaceutical Compositions

The nucleic acid molecules, proteins, and antibodies (also referred to herein as "active compounds") of the invention can be incorporated into pharmaceutical compositions suitable for administration. Such compositions typically comprise the nucleic acid molecule, protein, or antibody and a pharmaceutically acceptable carrier. As used herein the language "pharmaceutically acceptable carrier" is intended to include any and all solvents, dispersion media, coatings, antibacterial and antifungal agents, isotonic and absorption delaying agents, and the like, compatible with pharmaceutical administration. The use of such media and agents for pharmaceutically active substances is well known in the art. Except insofar as any conventional media or agent is incompatible with the active compound, use thereof in the compositions is contemplated. Supplementary active compounds can also be incorporated into the compositions.

A pharmaceutical composition of the invention is formulated to be compatible with its intended route of administration. Examples of routes of administration include parenteral, e.g., intravenous, intradermal, subcutaneous, oral (e.g., inhalation), transdermal (topical), transmucosal, and rectal administration. Solutions or suspensions used for parenteral, intradermal, or subcutaneous application can include the following components: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; chelating agents such as ethylenediaminetetraacetic acid; buffers such as acetates, citrates or phosphates and agents for the adjustment of tonicity such as sodium chloride or dextrose. pH can be adjusted with acids or bases, such as hydrochloric acid or sodium hydroxide. The parenteral preparation can be enclosed in ampoules, disposable syringes or multiple dose vials made of glass or plastic.

Pharmaceutical compositions suitable for injectable use include sterile aqueous solutions (where water soluble) or dispersions and sterile powders for the extemporaneous preparation of sterile injectable solutions or dispersion. For intravenous administration, suitable carriers include physiological saline, bacteriostatic water, Cremophor EL™ (BASF, Parsippany, N.J.) or phosphate buffered saline (PBS). In all cases, the composition must be sterile and should be fluid to the extent that easy syringability exists. It must be stable under the conditions of manufacture and storage and must be preserved against the contaminating action of microorganisms such as bacteria and fungi. The carrier can be a solvent or dispersion medium containing, for example, water, ethanol, polyol (for example, glycerol, propylene glycol, and liquid polyetheylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as manitol, sorbitol, sodium chloride in the composition. Prolonged absorption of the injectable compositions can be brought about by including in the composition an agent which delays absorption, for example, aluminum monostearate and gelatin.

Sterile injectable solutions can be prepared by incorporating the active compound (e.g., a protein or antibody) in the required amount in an appropriate solvent with one or a combination of ingredients enumerated above, as required, followed by filtered sterilization. Generally, dispersions are prepared by incorporating the active compound into a sterile vehicle which contains a basic dispersion medium and the required other ingredients from those enumerated above. In the case of sterile powders for the preparation of sterile injectable solutions, the preferred methods of preparation are vacuum drying and freeze-drying which yields a powder of the active ingredient plus any additional desired ingredient from a previously sterile-filtered solution thereof.

Oral compositions generally include an inert diluent or an edible carrier. They can be enclosed in gelatin capsules or compressed into tablets. For the purpose of oral therapeutic administration, the active compound can be incorporated with excipients and used in the form of tablets, troches, or capsules. Oral compositions can also be prepared using a fluid carrier for use as a mouthwash, wherein the compound in the fluid carrier is applied orally and swished and expectorated or swallowed. Pharmaceutically compatible binding agents, and/or adjuvant materials can be included as part of the composition. The tablets, pills, capsules, troches and the like can contain any of the following ingredients, or compounds of a similar nature: a binder such as microcrystalline cellulose, gum tragacanth or gelatin; an excipient such as starch or lactose, a disintegrating agent such as alginic acid, Primogel, or corn starch; a lubricant such as magnesium stearate or Sterotes; a glidant such as colloidal silicon dioxide; a sweetening agent such as sucrose or saccharin; or a flavoring agent such as peppermint, methyl salicylate, or orange flavoring.

For administration by inhalation, the compounds are delivered in the form of an aerosol spray from pressured container or dispenser which contains a suitable propellant, e.g., a gas such as carbon dioxide, or a nebulizer.

Systemic administration can also be by transmucosal or transdermal means. For transmucosal or transdermal administration, penetrants appropriate to the barrier to be permeated are used in the formulation. Such penetrants are generally known in the art, and include, for example, for transmucosal administration, detergents, bile salts, and fusidic acid derivatives. Transmucosal administration can be accomplished through the use of nasal sprays or suppositories. For transdermal administration, the active compounds are formulated into ointments, salves, gels, or creams as generally known in the art.

The compounds can also be prepared in the form of suppositories (e.g., with conventional suppository bases such as cocoa butter and other glycerides) or retention enemas for rectal delivery.

In one embodiment, the active compounds are prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Methods for preparation of such formulations will be apparent to those skilled in the art. The materials can also be obtained commercially from Alza Corporation and Nova Pharmaceuticals, Inc. Liposomal suspensions (including liposomes targeted to infected cells with monoclonal antibodies to viral antigens) can also be used as pharmaceutically acceptable carriers. These can be prepared according to methods known to those skilled in the art, for example, as described in U.S. Pat. No. 4,522,811.

It is especially advantageous to formulate oral or parenteral compositions in dosage unit form for ease of administration and uniformity of dosage. Dosage unit form as used herein refers to physically discrete units suited as unitary dosages for the subject to be treated; each unit containing a predetermined quantity of active compound calculated to produce the desired therapeutic effect in association with the required pharmaceutical carrier. The specification for the dosage unit forms of the invention are dictated by and directly dependent on the unique characteristics of the active compound and the particular therapeutic effect to be achieved, and the limitations inherent in the art of compounding such an active compound for the treatment of individuals.

Toxicity and therapeutic efficacy of such compounds can be determined by standard pharmaceutical procedures in cell cultures or experimental animals, e.g., for determining the LD50 (the dose lethal to 50% of the population) and the ED50 (the dose therapeutically effective in 50% of the population). The dose ratio between toxic and therapeutic effects is the therapeutic index and it can be expressed as the ratio LD50/ED50. Compounds which exhibit large therapeutic indices are preferred. While compounds that exhibit toxic side effects may be used, care should be taken to design a delivery system that targets such compounds to the site of affected tissue in order to minimize potential damage to uninfected cells and, thereby, reduce side effects.

The data obtained from the cell culture assays and animal studies can be used in formulating a range of dosage for use in humans. The dosage of such compounds lies preferably within a range of circulating concentrations that include the ED50 with little or no toxicity. The dosage may vary within this range depending upon the dosage form employed and the route of administration utilized. For any compound used in the method of the invention, the therapeutically effective dose can be estimated initially from cell culture assays. A dose may be formulated in animal models to achieve a circulating plasma concentration range that includes the IC50 (i.e., the concentration of the test compound which achieves a half-maximal inhibition of symptoms) as determined in cell culture. Such information can be used to more accurately determine useful doses in humans. Levels in plasma may be measured, for example, by high performance liquid chromatography.

As defined herein, a therapeutically effective amount of protein or polypeptide (i.e., an effective dosage) ranges from about 0.001 to 30 mg/kg body weight, preferably about 0.01 to 25 mg/kg body weight, more preferably about 0.1 to 20 mg/kg body weight, and even more preferably about 1 to 10 mg/kg, 2 to 9 mg/kg, 3 to 8 mg/kg, 4 to 7 mg/kg, or 5 to 6 mg/kg body weight. The skilled artisan will appreciate that certain factors may influence the dosage required to effectively treat a subject, including but not limited to the severity of the disease or disorder, previous treatments, the general health and/or age of the subject, and other diseases present. Moreover, treatment of a subject with a therapeutically effective amount of a protein, polypeptide, or antibody can include a single treatment or, preferably, can include a series of treatments. In a preferred example, a subject is treated with antibody, protein, or polypeptide in the range of between about 0.1 to 20 mg/kg body weight, one time per week for between about 1 to 10 weeks, preferably between 2 to 8 weeks, more preferably between about 3 to 7 weeks, and even more preferably for about 4, 5, or 6 weeks. It will also be appreciated that the effective dosage of antibody, protein, or polypeptide used for treatment may increase or decrease over the course of a particular treatment. Changes in dosage may result and become apparent from the results of diagnostic assays as described herein.

The present invention encompasses agents which modulate expression or activity. An agent may, for example, be a small molecule. For example, such small molecules include, but are not limited to, peptides, peptidomimetics, amino acids, amino acid analogs, polynucleotides, polynucleotide analogs, nucleotides, nucleotide analogs, organic or inorganic compounds (I.e., including heteroorganic and organometallic compounds) having a molecular weight less than about 10,000 grams per mole, organic or inorganic compounds having a molecular weight less than about 5,000 grams per mole, organic or inorganic compounds having a molecular weight less than about 1,000 grams per mole, organic or inorganic compounds having a molecular weight less than about 500 grams per mole, and salts, esters, and other pharmaceutically acceptable forms of such compounds.

It is understood that appropriate doses of small molecule agents depends upon a number of factors within the ken of the ordinarily skilled physician, veterinarian, or researcher. The dose(s) of the small molecule will vary, for example, depending upon the identity, size, and condition of the subject or sample being treated, further depending upon the route by which the composition is to be administered, if applicable, and the effect which the practitioner desires the small molecule to have upon the nucleic acid or polypeptide of the invention.

Exemplary doses include milligram or microgram amounts of the small molecule per kilogram of subject or sample weight (e.g., about 1 microgram per kilogram to about 500 milligrams per kilogram, about 100 micrograms per kilogram to about 5 milligrams per kilogram, or about 1 microgram per kilogram to about 50 micrograms per kilogram. It is furthermore understood that appropriate doses of a small molecule depend upon the potency of the small molecule with respect to the expression or activity to be modulated. Such appropriate doses may be determined using the assays described herein.

When one or more of these small molecules is to be administered to an animal (e.g., a human) in order to modulate expression or activity of a polypeptide or nucleic acid of the invention, a physician, veterinarian, or researcher may, for example, prescribe a relatively low dose at first, subsequently increasing the dose until an appropriate response is obtained. In addition, it is understood that the specific dose level for any particular animal subject will depend upon a variety of factors including the activity of the specific compound employed, the age, body weight, general health, gender, and diet of the subject, the time of administration, the route of administration, the rate of excretion, any drug combination, and the degree of expression or activity to be modulated.

The nucleic acid molecules of the invention can be inserted into vectors and used as gene therapy vectors. Gene therapy vectors can be delivered to a subject by, for example, intravenous injection, local administration (see U.S. Pat. No. 5,328,470) or by stereotactic injection (see e.g., Chen et al. (1994) *Proc. Natl. Acad. Sci. USA* 91:3054-3057). The pharmaceutical preparation of the gene therapy vector can include the gene therapy vector in an acceptable diluent, or can comprise a slow release matrix in which the gene delivery vehicle is imbedded. Alternatively, where the complete gene delivery vector can be produced intact from recombinant cells, e.g., retroviral vectors, the pharmaceutical preparation can include one or more cells which produce the gene delivery system.

The pharmaceutical compositions can be included in a container, pack, or dispenser together with instructions for administration.

VI. Uses and Methods of the Invention

The nucleic acid molecules, proteins, protein homologues, and antibodies described herein can be used in one or more of the following methods: a) screening assays; b) predictive medicine (e.g., diagnostic assays, prognostic assays, monitoring clinical trials, and pharmacogenetics); and c) methods of treatment (e.g., therapeutic and prophylactic). The isolated nucleic acid molecules of the invention can be used, for example, to express protein (e.g., via a recombinant expression vector in a host cell in gene therapy applications), to detect mRNA (e.g., in a biological sample) or a genetic alteration in a gene, and to modulate protein activity, as described further below. The proteins of the invention can be used to treat disorders characterized by insufficient or excessive production of a substrate or production of inhibitors. In addition, the proteins of the invention can be used to screen for naturally occurring substrates, to screen for drugs or compounds which modulate protein activity, as well as to treat disorders characterized by insufficient or excessive production of the protein or production of protein forms which have decreased or aberrant activity compared to wild type protein. Moreover, the antibodies of the invention can be used to detect and isolate the proteins of the invention, regulate the bioavailability of proteins of the invention, and modulate activity of the proteins of the invention.

A. Screening Assays:

The invention provides a method (also referred to herein as a "screening assay") for identifying modulators, i.e., candidate or test compounds or agents (e.g., peptides, peptidomimetics, small molecules or other drugs) which bind to a protein of the invention, have a stimulatory or inhibitory effect on, for example, protein expression or activity, or have a stimulatory or inhibitory effect on, for example, the expression or activity of a protein substrate or ligand.

In one embodiment, the invention provides assays for screening candidate or test compounds which are substrates or ligands of a protein or polypeptide or biologically active portion thereof of the invention. In another embodiment, the invention provides assays for screening candidate or test compounds which bind to or modulate the activity of a protein or polypeptide or biologically active portion thereof, e.g., modulate the ability of a protein of the invention to interact with its cognate ligand or substrate. The test compounds of the present invention can be obtained using any of the numerous approaches in combinatorial library methods known in the art, including: biological libraries; spatially addressable parallel solid phase or solution phase libraries; synthetic library methods requiring deconvolution; the 'one-bead one-compound' library method; and synthetic library methods using affinity chromatography selection. The biological library approach is limited to peptide libraries, while the other four approaches are applicable to peptide, non-peptide oligomer or small molecule libraries of compounds (Lam, K. S. (1997) *Anticancer Drug Des.* 12:145).

Examples of methods for the synthesis of molecular libraries can be found in the art, for example in: DeWitt et al. (1993) *Proc. Natl. Acad. Sci. USA.* 90:6909; Erb et al. (1994) *Proc. Natl. Acad. Sci. USA* 91:11422; Zuckermann et al. (1994). *J. Med. Chem.* 37:2678; Cho et al. (1993) *Science* 261:1303; Carrell et al. (1994) *Angew. Chem. Int. Ed. Engl.* 33:2059; Carell et al. (1994) *Angew. Chem. Int. Ed. Engl.* 33:2061; and in Gallop et al. (1994) *J. Med. Chem.* 37:1233.

Libraries of compounds may be presented in solution (e.g., Houghten (1992) *Biotechniques* 13:412-421), or on beads (Lam (1991) *Nature* 354:82-84), chips (Fodor (1993) *Nature* 364:555-556), bacteria (Ladner U.S. Pat. No. 5,223,409), spores (Ladner U.S. Pat. No. '409), plasmids (Cull et al. (1992) *Proc Natl Acad Sci USA* 89:1865-1869) or on phage (Scott and Smith (1990) *Science* 249:386-390); (Devlin (1990) *Science* 249:404-406); (Cwirla et al. (1990) *Proc.*

*Natl. Acad. Sci.* 87:6378-6382); (Felici (1991) *J. Mol. Biol.* 222:301-310); (Ladner supra.).

In another embodiment, an assay is a cell-based assay comprising contacting a cell expressing a target molecule of a polypeptide of the invention (e.g., substrate or ligand) with a test compound and determining the ability of the test compound to modulate (e.g. stimulate or inhibit) the activity of the target molecule. Determining the ability of the test compound to modulate the activity of a target molecule can be accomplished, for example, by determining the ability of the protein of the invention to bind to or interact with the target molecule, or by determining the ability of the protein of the invention to modify (e.g., cleave, phosphorylate, glycosylate, dephosphorylate, etc.) the target molecule.

Determining the ability of a protein of the invention to bind to or interact with a target molecule can be accomplished by determining direct binding. Determining the ability of the protein to bind to or interact with a target molecule can be accomplished, for example, by coupling the protein with a radioisotope or enzymatic label such that binding of the protein to a target molecule can be determined by detecting the labeled protein in a complex. For example, a polypeptide of the invention, can be labeled with $^{125}I$, $^{35}S$, $^{14}C$, or $^{3}H$, either directly or indirectly, and the radioisotope detected by direct counting of radioemmission or by scintillation counting. Alternatively, the polypeptide can be enzymatically labeled with, for example, horseradish peroxidase, alkaline phosphatase, or luciferase, and the enzymatic label detected by determination of conversion of an appropriate substrate to product.

It is also within the scope of this invention to determine the ability of a compound to modulate the interaction between a polypeptide of the invention and its target molecule, without the labeling of any of the interactants. For example, a microphysiometer can be used to detect the interaction of the polypeptide of the invention with its target molecule without the labeling of either the polypeptide or the target molecule. McConnell, H. M. et al. (1992) *Science* 257:1906-1912. As used herein, a "microphysiometer" (e.g., Cytosensor) is an analytical instrument that measures the rate at which a cell acidifies its environment using a light-addressable potentiometric sensor (LAPS). Changes in this acidification rate can be used as an indicator of the interaction between a target molecule and polypeptide.

In a preferred embodiment, determining the ability of a protein of the invention to bind to or interact with a target molecule can be accomplished by determining the activity of the target molecule. For example, the activity of the target molecule can be determined by detecting induction of a cellular second messenger of the target (e.g., intracellular $Ca^{2+}$, diacylglycerol, $IP_3$, etc.), detecting catalytic/enzymatic activity of the target an appropriate substrate, detecting the induction of a reporter gene (comprising a target-responsive regulatory element operatively linked to a nucleic acid encoding a detectable marker, e.g., chloramphenicol acetyl transferase), or detecting a target-regulated cellular response.

In yet another embodiment, an assay of the present invention is a cell-free assay in which a protein of the invention or biologically active portion thereof is contacted with a test compound and the ability of the test compound to bind to the protein or biologically active portion thereof is determined. Binding of the test compound to the protein can be determined either directly or indirectly as described above. In one example, the assay includes contacting the protein of the invention or biologically active portion thereof with a known compound which binds to the protein (e.g., antibody) to form an assay mixture, contacting the assay mixture with a test compound, and determining the ability of the test compound to interact with the protein, wherein determining the ability of the test compound to interact with a protein comprises determining the ability of the test compound to preferentially bind to protein or biologically active portion thereof as compared to the known compound.

In another embodiment, the assay is a cell-free assay in which a protein of the invention or biologically active portion thereof is contacted with a test compound and the ability of the test compound to modulate (e.g., stimulate or inhibit) the activity of the protein or biologically active portion thereof is determined. Determining the ability of the test compound to modulate the activity of a protein can be accomplished, for example, by determining the ability of the protein to bind to a target molecule by one of the methods described above for determining direct binding. Determining the ability of the protein to bind to a target molecule can also be accomplished using a technology such as real-time Biomolecular Interaction Analysis (BIA). Sjolander, S. and Urbaniczky, C. (1991) *Anal. Chem.* 63:2338-2345 and Szabo et al. (1995) *Curr. Opin. Struct. Biol.* 5:699-705. As used herein, "BIA" is a technology for studying biospecific interactions in real time, without labeling any of the interactants (e.g., BIAcore). Changes in the optical phenomenon of surface plasmon resonance (SPR) can be used as an indication of real-time reactions between biological molecules.

In an alternative embodiment, determining the ability of the test compound to modulate the activity of a protein of the invention can be accomplished by determining the ability of the protein to further modulate the activity of a target molecule (e.g., a signal transduction pathway component). For example, the activity of the effector molecule on an appropriate target can be determined, or the binding of the effector to an appropriate target can be determined as previously described.

The cell-free assays of the present invention are amenable to use of both soluble and/or membrane-bound forms of proteins. In the case of cell-free assays in which a membrane-bound form a protein is used (e.g., a cell surface receptor) it may be desirable to utilize a solubilizing agent such that the membrane-bound form of the protein is maintained in solution. Examples of such solubilizing agents include non-ionic detergents such as n-octylglucoside, n-dodecylglucoside, n-dodecylmaltoside, octanoyl-N-methylglucamide, decanoyl-N-methylglucamide, Triton® X-100, Triton® X-114, Thesit®, Isotridecypoly(ethylene glycol ether)$_n$, 3-[(3-cholamidopropyl)dimethylamminio]-1-propane sulfonate (CHAPS), 3-[(3-cholamidopropyl)dimethylamminio]-2-hydroxy-1-propane sulfonate (CHAPSO), or N-dodecyl=N,N-dimethyl-3-ammonio-1-propane sulfonate.

In more than one embodiment of the above assay methods of the present invention, it may be desirable to immobilize either the protein of the invention or its target molecule to facilitate separation of complexed from uncomplexed forms of one or both of the proteins, as well as to accommodate automation of the assay. Binding of a test compound to a protein of the invention, or interaction of the protein with a target molecule in the presence and absence of a candidate compound, can be accomplished in any vessel suitable for containing the reactants. Examples of such vessels include microtitre plates, test tubes, and micro-centrifuge tubes. In one embodiment, a fusion protein can be provided which adds a domain that allows one or both of the proteins to be bound to a matrix. For example, glutathione-5-transferase/polypeptide fusion proteins or glutathione-5-transferase/target fusion proteins can be adsorbed onto glutathione sepharose beads (Sigma Chemical, St. Louis, Mo.) or glutathione derivatized microtitre plates, which are then combined with the test compound or the test compound and either the non-adsorbed target protein or protein of the invention, and the mixture incubated under conditions conducive to complex formation (e.g., at physiological conditions for salt and pH). Following incubation, the beads or microtitre plate wells are washed to remove any unbound components, the matrix immobilized in the case of beads, complex determined either directly or indirectly, for example, as described above. Alternatively, the complexes can be dissociated from the matrix, and the level of protein binding or activity determined using standard techniques.

Other techniques for immobilizing proteins on matrices can also be used in the screening assays of the invention. For example, either a protein of the invention or a target molecule can be immobilized utilizing conjugation of biotin and streptavidin. Biotinylated protein or target molecules can be prepared from biotin-NHS (N-hydroxy-succinimide) using techniques well known in the art (e.g., biotinylation kit, Pierce Chemicals, Rockford, Ill.), and immobilized in the wells of streptavidin-coated 96 well plates (Pierce Chemical). Alternatively, antibodies reactive with a protein of the invention or target molecules but which do not interfere with binding of the protein to its target molecule can be derivatized to the wells of the plate, and unbound target or protein trapped in the wells by antibody conjugation. Methods for detecting such complexes, in addition to those described above for the GST-immobilized complexes, include immunodetection of complexes using antibodies reactive with the protein of the invention or target molecule, as well as enzyme-linked assays which rely on detecting an enzymatic activity associated with the protein of the invention or target molecule.

In another embodiment, modulators of protein expression are identified in a method wherein a cell is contacted with a candidate compound and the expression of mRNA encoding a protein of the invention or of the protein in the cell is determined. The level of expression of mRNA or protein in the presence of the candidate compound is compared to the level of expression the mRNA or protein in the absence of the candidate compound. The candidate compound can then be identified as a modulator of protein expression based on this comparison. For example, when expression of mRNA or protein is greater (statistically significantly greater) in the presence of the candidate compound than in its absence, the candidate compound is identified as a stimulator of mRNA or protein expression. Alternatively, when expression of mRNA or protein is less (statistically significantly less) in the presence of the candidate compound than in its absence, the candidate compound is identified as an inhibitor of mRNA or protein expression. The level of mRNA or protein expression in the cells can be determined by methods described herein.

In yet another aspect of the invention, the proteins of the invention can be used as "bait proteins" in a two-hybrid assay or three-hybrid assay (see, e.g., U.S. Pat. No. 5,283,317; Zervos et al. (1993) *Cell* 72:223-232; Madura et al. (1993) *J. Biol. Chem.* 268:12046-12054; Bartel et al. (1993) *Biotechniques* 14:920-924; Iwabuchi et al. (1993) *Oncogene* 8:1693-1696; and Brent WO94/10300), to identify other proteins, which bind to or interact with the proteins of the invention and are involved in protein activity. Such binding proteins are also likely to be involved in the propagation of signals by the proteins of the invention or targets of the proteins of the invention as, for example, downstream elements of a polypeptide-mediated signaling pathway.

The two-hybrid system is based on the modular nature of most transcription factors, which consist of separable DNA-binding and activation domains. Briefly, the assay utilizes two different DNA constructs. In one construct, a nucleic acid that encodes a protein of the invention is fused to a gene encoding the DNA binding domain of a known transcription factor (e.g., GAL-4). In the other construct, a DNA sequence, from a library of DNA sequences, that encodes an unidentified protein ("prey" or "sample") is fused to a gene that codes for the activation domain of the known transcription factor. If the "bait" and the "prey" proteins are able to interact, in vivo, forming a polypeptide-dependent complex, the DNA-binding and activation domains of the transcription factor are brought into close proximity. This proximity allows transcription of a reporter gene (e.g., LacZ) which is operably linked to a transcriptional regulatory site responsive to the transcription factor. Expression of the reporter gene can be detected and cell colonies containing the functional transcription factor can be isolated and used to obtain the cloned nucleic acid which encodes the protein which interacts with the polypeptide of the invention.

This invention further pertains to novel agents identified by the above-described screening assays. Accordingly, it is within the scope of this invention to further use an agent identified as described herein in an appropriate animal model. For example, an agent identified as described herein (e.g., a modulating agent, an antisense nucleic acid molecule, a polypeptide-specific antibody, or a polypeptide-binding partner) can be used in an animal model to determine the efficacy, toxicity, or side effects of treatment with such an agent. Alternatively, an agent identified as described herein can be used in an animal model to determine the mechanism of action of such an agent. Furthermore, this invention pertains to uses of novel agents identified by the above-described screening assays for treatments as described herein.

B. Detection Assays

Portions or fragments of the nucleic acid sequences identified herein (and the corresponding complete gene sequences) can be used in numerous ways as polynucleotide reagents. For example, these sequences can be used to: (i) map their respective genes on a chromosome; and, thus, locate gene regions associated with genetic disease; (ii) identify an individual from a minute biological sample (tissue typing); and (iii) aid in forensic identification of a biological sample. These applications are described in the subsections below.

1. Chromosome Mapping

Once the sequence (or a portion of the sequence) of a gene has been isolated, this sequence can be used to map the location of the gene on a chromosome. This process is called chromosome mapping. Accordingly, portions or fragments of the nucleotide sequences, described herein, can be used to map the location of the corresponding genes on a chromosome. The mapping of the nucleotide sequences to chromosomes is an important first step in correlating these sequences with genes associated with disease.

Briefly, genes can be mapped to chromosomes by preparing PCR primers (preferably 15-25 bp in length) from the nucleotide sequences disclosed herein (e.g., SEQ ID NO:1-21062). Computer analysis of the sequences can be used to predict primers that do not span more than one exon in the genomic DNA, thus complicating the amplification process. These primers can then be used for PCR screening of somatic cell hybrids containing individual human chromosomes. Only those hybrids containing the human gene corresponding to the sequences will yield an amplified fragment.

Somatic cell hybrids are prepared by fusing somatic cells from different mammals (e.g., human and mouse cells). As hybrids of human and mouse cells grow and divide, they gradually lose human chromosomes in random order, but retain the mouse chromosomes. By using media in which mouse cells cannot grow, because they lack a particular enzyme, but human cells can, the one human chromosome that contains the gene encoding the needed enzyme, will be retained. By using various media, panels of hybrid cell lines can be established. Each cell line in a panel contains either a single human chromosome or a small number of human chromosomes, and a full set of mouse chromosomes, allowing easy mapping of individual genes to specific human chromosomes. (D'Eustachio P. et al. (1983) *Science* 220:919-924). Somatic cell hybrids containing only fragments of human chromosomes can also be produced by using human chromosomes with translocations and deletions.

PCR mapping of somatic cell hybrids is a rapid procedure for assigning a particular sequence to a particular chromosome. Three or more sequences can be assigned per day using a single thermal cycler. By using the nucleotide sequences disclosed herein to design oligonucleotide primers, sublocalization can be achieved with panels of fragments from specific chromosomes. Other mapping strategies which can similarly be used to map a 9o, 1p, or 1v sequence to its chromosome include in situ hybridization (described in Fan, Y. et al. (1990) *Proc. Natl. Acad. Sci. USA*, 87:6223-27), pre-screening with labeled flow-sorted chromosomes, and pre-selection by hybridization to chromosome specific cDNA libraries.

Fluorescence in situ hybridization (FISH) of a DNA sequence to a metaphase chromosomal spread can further be used to provide a precise chromosomal location in one step. Chromosome spreads can be made using cells whose division has been blocked in metaphase by a chemical such as colcemid that disrupts the mitotic spindle. The chromosomes can be treated briefly with trypsin, and then stained with Giemsa. A pattern of light and dark bands develops on each chromosome, so that the chromosomes can be identified individually. The FISH technique can be used with a DNA sequence as short as 500 or 600 bases. However, clones larger than 1,000 bases have a higher likelihood of binding to a unique chromosomal location with sufficient signal intensity for simple detection. Preferably 1,000 bases, and more preferably 2,000 bases will suffice to get good results at a reasonable amount of time. For a review of this technique, see Verma et al., Human Chromosomes: A Manual of Basic Techniques (Pergamon Press, New York 1988).

Reagents for chromosome mapping can be used individually to mark a single chromosome or a single site on that chromosome, or panels of reagents can be used for marking multiple sites and/or multiple chromosomes. Reagents corresponding to noncoding regions of the genes actually are preferred for mapping purposes. Coding sequences are more likely to be conserved within gene families, thus increasing the chance of cross hybridizations during chromosomal mapping.

Once a sequence has been mapped to a precise chromosomal location, the physical position of the sequence on the chromosome can be correlated with genetic map data. (Such data are found, for example, in V. McKusick, Mendelian Inheritance in Man, available on-line through Johns Hopkins University Welch Medical Library). The relationship between a gene and a disease, mapped to the same chromosomal region, can then be identified through linkage analysis (co-inheritance of physically adjacent genes), described in, for example, Egeland, J. et al. (1987) *Nature*, 325:783-787.

Moreover, differences in the DNA sequences between individuals affected and unaffected with a disease associated with a gene, can be determined. If a mutation is observed in some or all of the affected individuals but not in any unaffected individuals, then the mutation is likely to be the causative agent of the particular disease. Comparison of affected and unaffected individuals generally involves first looking for structural alterations in the chromosomes, such as deletions or translocations that are visible from chromosome spreads or detectable using PCR based on that DNA sequence. Ultimately, complete sequencing of genes from several individuals can be performed to confirm the presence of a mutation and to distinguish mutations from polymorphisms.

2. Tissue Typing

The nucleic acid sequences of the present invention can also be used to identify individuals from minute biological samples. The United States military, for example, is considering the use of restriction fragment length polymorphism (RFLP) for identification of its personnel. In this technique, an individual's genomic DNA is digested with one or more restriction enzymes, and probed on a Southern blot to yield unique bands for identification. This method does not suffer from the current limitations of "Dog Tags" which can be lost, switched, or stolen, making positive identification difficult. The sequences of the present invention are useful as additional DNA markers for RFLP (described in U.S. Pat. No. 5,272,057).

Furthermore, the sequences of the present invention can be used to provide an alternative technique which determines the actual base-by-base DNA sequence of selected portions of an individual's genome. Thus, the nucleotide sequences described herein can be used to prepare two PCR primers from the 5' and 3' ends of the sequences. These primers can then be used to amplify an individual's DNA and subsequently sequence it.

Panels of corresponding DNA sequences from individuals, prepared in this manner, can provide unique individual identifications, as each individual will have a unique set of such DNA sequences due to allelic differences. The sequences of the present invention can be used to obtain such identification sequences from individuals and from tissue. The nucleotide sequences of the invention uniquely represent portions of the human genome. Allelic variation occurs to some degree in the coding regions of these sequences, and to a greater degree in the noncoding regions. It is estimated that allelic variation between individual humans occurs with a frequency of about once per each 500 bases. Each of the sequences described herein can, to some degree, be used as a standard against which DNA from an individual can be compared for identification purposes. Because greater numbers of polymorphisms occur in the noncoding regions, fewer sequences are necessary to differentiate individuals. The noncoding sequences of SEQ ID NO:1-10, can comfortably provide positive individual identification with a panel of perhaps 10 to 1,000 primers which each yield a noncoding amplified sequence of 100 bases. If predicted coding sequences are used, a more appropriate number of primers for positive individual identification would be 500-2,000.

If a panel of reagents from the nucleotide sequences described herein is used to generate a unique identification database for an individual, those same reagents can later be used to identify tissue from that individual. Using the unique identification database, positive identification of the individual, living or dead, can be made from extremely small tissue samples.

3. Use of Partial Nucleotid Sequences in Forensic Biology

DNA-based identification techniques can also be used in forensic biology. Forensic biology is a scientific field employing genetic typing of biological evidence found at a crime scene as a means for positively identifying, for example, a perpetrator of a crime. To make such an identification, PCR technology can be used to amplify DNA sequences taken from very small biological samples such as tissues, e.g., hair or skin, or body fluids, e.g., blood, saliva, or semen found at a crime scene. The amplified sequence can then be compared to a standard, thereby allowing identification of the origin of the biological sample.

The sequences of the present invention can be used to provide polynucleotide reagents, e.g., PCR primers, targeted to specific loci in the human genome, which can enhance the reliability of DNA-based forensic identifications by, for example, providing another "identification marker" (i.e. another DNA sequence that is unique to a particular individual). As mentioned above, actual base sequence information can be used for identification as an accurate alternative to patterns formed by restriction enzyme generated fragments. Sequences targeted to noncoding regions are particularly appropriate for this use as greater numbers of polymorphisms occur in the noncoding regions, making it easier to differentiate individuals using this technique. Examples of polynucleotide reagents include the nucleotide sequences disclosed herein or portions thereof having a length of at least 20 bases, preferably at least 30 bases.

The nucleotide sequences described herein can further be used to provide polynucleotide reagents, e.g., labeled or labelable probes which can be used in, for example, an in situ hybridization technique, to identify a specific tissue, e.g., brain tissue. This can be very useful in cases where a forensic pathologist is presented with a tissue of unknown origin. Panels of such probes can be used to identify tissue by species and/or by organ type.

In a similar fashion, these reagents, e.g., primers or probes derived from the nucleic acid sequences disclosed herein can be used to screen tissue culture for contamination (i.e. screen for the presence of a mixture of different types of cells in a culture).

C. Predictive Medicine:

The present invention also pertains to the field of predictive medicine in which diagnostic assays, prognostic assays, and monitoring clinical trials are used for prognostic (predictive) purposes to thereby treat an individual prophylactically. Accordingly, one aspect of the present invention relates to diagnostic assays for determining protein and/or nucleic acid expression as well as protein activity, in the context of a biological sample (e.g., blood, serum, cells, tissue) to thereby determine whether an individual is afflicted with a disease or disorder, or is at risk of developing a disorder, associated with aberrant protein expression or activity. The invention also provides for prognostic (or predictive) assays for determining whether an individual is at risk of developing a disorder associated with a protein or nucleic acid of the invention. For example, mutations in a gene containing a nucleic acid of the invention can be assayed in a biological sample. Such assays can be used for prognostic or predictive purpose to thereby phophylactically treat an individual prior to the onset of a disorder characterized by or associated with a protein, nucleic acid expression or activity.

Another aspect of the invention pertains to monitoring the influence of agents (e.g., drugs, compounds) on the expression or activity of a protein of the invention in clinical trials.

These and other agents are described in further detail in the following sections.

1. Diagnostic Assays

An exemplary method for detecting the presence or absence of protein or nucleic acid of the invention in a biological sample involves obtaining a biological sample from a test subject and contacting the biological sample with a compound or an agent capable of detecting the protein or nucleic acid (e.g., mRNA, genomic DNA) that encodes the protein such that the presence of the protein or nucleic acid is detected in the biological sample. A preferred agent for detecting mRNA or genomic DNA is a labeled nucleic acid probe capable of hybridizing to the mRNA or genomic DNA. The nucleic acid probe can be, for example, a human nucleic acid, such as the nucleic acid of SEQ ID NO:1-21062, or a portion thereof, such as an oligonucleotide of at least 15, 30, 50, 100, 250 or 500 nucleotides in length and sufficient to specifically hybridize under stringent conditions to the mRNA or genomic DNA. Other suitable probes for use in the diagnostic assays of the invention are described herein.

A preferred agent for detecting a protein of the invention is an antibody capable of binding to the protein, preferably an antibody with a detectable label. Antibodies can be polyclonal, or more preferably, monoclonal. An intact antibody, or a fragment thereof (e.g., Fab or $F(ab')_2$) can be used. The term "labeled", with regard to the probe or antibody, is intended to encompass direct labeling of the probe or antibody by coupling (i.e., physically linking) a detectable substance to the probe or antibody, as well as indirect labeling of the probe or antibody by reactivity with another reagent that is directly labeled. Examples of indirect labeling include detection of a primary antibody using a fluorescently labeled secondary antibody and end-labeling of a DNA probe with biotin such that it can be detected with fluorescently labeled streptavidin.

The term "biological sample" is intended to include tissues, cells and biological fluids isolated from a subject, as well as tissues, cells and fluids present within a subject. That is, the detection method of the invention can be used to detect mRNA, protein, or genomic DNA in a biological sample in vitro as well as in vivo. For example, in vitro techniques for detection of mRNA include Northern hybridizations and in situ hybridizations. In vitro techniques for detection of proteins include enzyme linked immunosorbent assays (ELISAs), Western blots, immunoprecipitations and immunofluorescence. In vitro techniques for detection of genomic DNA include Southern hybridizations. Furthermore, in vivo techniques for detection of a protein of the invention include introducing into a subject a labeled antibody against the protein. For example, the antibody can be labeled with a radioactive marker whose presence and location in a subject can be detected by standard imaging techniques.

The diagnostic detection of gene expression has been shown to be useful in disease diagnosis and this expression can be assayed by numerous methods (e.g. RT-PCR, microarray, Northern analysis, ELISA, immunohistochemistry, and other methods; Lipshutz R J, Fodor S P, Gingeras T R, Lockhart D J, "High density synthetic oligonucleotide arrays", Nat Genet 1999 January; 21(1 Suppl):20-4; Shivers S C, Stall A, Goscin C, Trudeau W, Li W, Haddad F F, Reintgen D S, "Molecular staging for melanoma and breast cancer", Surg Oncol Clin N Am 1999 July; 8(3):515-26; Thiry M, "Ultrastructural methods for nucleic acid detection by immunocytology", Prog Histochem Cytochem 1999; 34(2):87-159; Macdonald R, "Zebrafish immunohistochemistry", Macdonald R; Syrigos K N, Deonarian D P, Epenetos A A, "Use of monoclonal antibodies for the diagnosis and treatment of bladder cancer", Hybridoma 1999 June; 18(3):219-24; Hage D S, "Immunoassays", Anal Chem 1999 Jun. 15; 71(12):294R-304R). All of the assays enabling the diagnostic detection of transcripts or polypeptides depend upon the availability of polynucleotide sequences corresponding to the gene transcripts. Diagnostic gene expression assays of the genes identified by the disclosed polynucleotide sequences are therefore enabled by the disclosure of these sequences.

In one embodiment, the biological sample contains protein molecules from the test subject. Alternatively, the biological sample can contain mRNA molecules from the test subject or genomic DNA molecules from the test subject. A preferred biological sample is a serum sample isolated by conventional means from a subject.

In another embodiment, the methods further involve obtaining a control biological sample from a control subject, contacting the control sample with a compound or agent capable of detecting protein, mRNA, or genomic DNA, such that the presence of the protein, mRNA or genomic DNA is detected in the biological sample, and comparing the presence of the protein, mRNA or genomic DNA in the control sample with the presence of the protein, mRNA or genomic DNA in the test sample.

The invention also encompasses kits for detecting the presence of proteins or nucleic acids of the invention in a biological sample. For example, the kit can comprise a labeled compound or agent capable of detecting a protein of the invention or mRNA encoding a protein of the invention in a biological sample; means for determining the amount of protein or mRNA in the sample; and means for comparing the amount of protein or mRNA in the sample with a standard. The compound or agent can be packaged in a suitable container. The kit can further comprise instructions for using the kit to detect the protein or nucleic acid.

2. Prognostic Assays

The diagnostic methods described herein can furthermore be utilized to identify subjects having or at risk of developing a disease or disorder associated with aberrant protein expression or activity. For example, the assays described herein, such as the preceding diagnostic assays or the following assays, can be utilized to identify a subject having or at risk of developing a disorder associated with expression or activity of a protein or nucleic acid of the invention. Thus, the present invention provides a method for identifying a disease or disorder associated with aberrant protein or nucleic acid expression or activity in which a test sample is obtained from a subject and protein or nucleic acid (e.g., mRNA, genomic DNA) is detected, wherein the presence of protein or nucleic acid is diagnostic for a subject having or at risk of developing a disease or disorder associated with aberrant expression or activity of a protein or nucleic acid of the invention. As used herein, a "test sample" refers to a biological sample obtained from a subject of interest. For example, a test sample can be a biological fluid (e.g., serum), cell sample, or tissue.

Furthermore, the prognostic assays described herein can be used to determine whether a subject can be administered an agent (e.g., an agonist, antagonist, peptidomimetic, protein, peptide, nucleic acid, small molecule, or other drug candidate) to treat a disease or disorder associated with aberrant expression or activity of a protein or nucleic acid of the invention. Thus, the present invention provides methods for determining whether a subject can be effectively treated with an agent for a disorder associated with aberrant expression or activity of a protein or nucleic acid of the invention in which a test sample is obtained and protein or nucleic acid expression or activity is detected (e.g., wherein the abundance of protein or nucleic acid expression or activity is diagnostic for a subject that can be administered the agent to treat a disorder associated with aberrant expression or activity).

The methods of the invention can also be used to detect genetic alterations in a gene comprising a nucleic acid of the invention, thereby determining if a subject with the altered gene is at risk for a disorder associated with the gene. In preferred embodiments, the methods include detecting, in a sample of cells from the subject, the presence or absence of a genetic alteration characterized by at least one of an alteration affecting the integrity of a gene encoding a protein of the invention, or the mis-expression of the gene. For example, such genetic alterations can be detected by ascertaining the existence of at least one of 1) a deletion of one or more nucleotides from a gene; 2) an addition of one or more nucleotides to a gene; 3) a substitution of one or more nucleotides of a gene, 4) a chromosomal rearrangement of a gene; 5) an alteration in the level of a messenger RNA transcript of a gene, 6) aberrant modification of a gene, such as of the methylation pattern of the genomic DNA, 7) the presence of a non-wild type splicing pattern of a messenger RNA transcript of a gene, 8) a non-wild type level of a protein, 9) allelic loss of a gene, and 10) inappropriate post-translational modification of a protein. As described herein, there are a large number of assay techniques known in the art which can be used for detecting alterations in a Kinase and Phosphatase gene. A preferred biological sample is a tissue or serum sample isolated by conventional means from a subject, e.g., a cardiac tissue sample.

In certain embodiments, detection of the alteration involves the use of a probe/primer in a polymerase chain reaction (PCR) (see, e.g., U.S. Pat. Nos. 4,683,195 and 4,683,202), such as anchor PCR or RACE PCR, or, alternatively, in a ligation chain reaction (LCR) (see, e.g., Landegran et al. (1988) *Science* 241:1077-1080; and Nakazawa et al. (1994) *Proc. Natl. Acad. Sci. USA* 91:360-364), the latter of which can be particularly useful for detecting point mutations in the gene (see Abravaya et al. (1995) *Nucleic Acids Res* 0.23:675-682). This method can include the steps of collecting a sample of cells from a patient, isolating nucleic acid (e.g., genomic, mRNA or both) from the cells of the sample, contacting the nucleic acid sample with one or more primers which specifically hybridize to the gene under conditions such that hybridization and amplification of the gene (if present) occurs, and detecting the presence or absence of an amplification product, or detecting the size of the amplification product and comparing the length to a control sample. It is anticipated that PCR and/or LCR may be desirable to use as a preliminary amplification step in conjunction with any of the techniques used for detecting mutations described herein.

Alternative amplification methods include: self sustained sequence replication (Guatelli, J. C. et al., (1990) *Proc. Natl. Acad. Sci. USA* 87:1874-1878), transcriptional amplification system (Kwoh, D. Y. et al., (1989) *Proc. Natl. Acad. Sci. USA* 86:1173-1177), Q-Beta Replicase (Lizardi, P. M. et al. (1988) *Bio-Technology* 6:1197), or any other nucleic acid amplification method, followed by the detection of the amplified molecules using techniques well known to those of skill in the art. These detection schemes are especially useful for the detection of nucleic acid molecules if such molecules are present in very low numbers.

In an alternative embodiment, mutations in a gene of the invention from a sample cell can be identified by alterations in restriction enzyme cleavage patterns. For example, sample and control DNA is isolated, amplified (optionally), digested with one or more restriction endonucleases, and fragment length sizes are determined by gel electrophoresis and compared. Differences in fragment length sizes between sample and control DNA indicates mutations in the sample DNA. Moreover, the use of sequence specific ribozymes (see, for example, U.S. Pat. No. 5,498,531) can be used to score for the presence of specific mutations by development or loss of a ribozyme cleavage site.

In other embodiments, genetic mutations in genes encoding the nucleic acids and proteins of the invention can be identified by hybridizing a sample and control nucleic acids, e.g., DNA or RNA, to high density arrays containing hundreds or thousands of oligonucleotides probes (Cronin, M. T. et al. (1996) *Human Mutation* 7: 244-255; Kozal, M. J. et al. (1996) *Nature Medicine* 2: 753-759). For example, genetic mutations in Kinase and Phosphatase can be identified in two dimensional arrays containing light-generated DNA probes as described in Cronin, M. T. et al. supra. Briefly, a first hybridization array of probes can be used to scan through long stretches of DNA in a sample and control to identify base changes between the sequences by making linear arrays of sequential ovelapping probes. This step allows the identification of point mutations. This step is followed by a second hybridization array that allows the characterization of specific mutations by using smaller, specialized probe arrays complementary to all variants or mutations detected. Each mutation array is composed of parallel probe sets, one complementary to the wild-type gene and the other complementary to the mutant gene.

In yet another embodiment, any of a variety of sequencing reactions known in the art can be used to directly sequence the gene and detect mutations by comparing the sequence of the sample sequence with the corresponding wild-type (control) sequence. Examples of sequencing reactions include those based on techniques developed by Maxam and Gilbert ((1977) *Proc. Natl. Acad. Sci. USA* 74:560) or Sanger ((1977) *Proc. Natl. Acad. Sci. USA* 74:5463). It is also contemplated that any of a variety of automated sequencing procedures can be utilized when performing the diagnostic assays ((1995) *Biotechniques* 19:448), including sequencing by mass spectrometry (see, e.g., PCT International Publication No. WO 94/16101; Cohen et al. (1996) *Adv. Chromatogr.* 36:127-162; and Griffin et al. (1993) *Appl. Biochem. Biotechnol.* 38:147-159).

Other methods for detecting mutations in the gene encoding the nucleic acids and protein of the invention include methods in which protection from cleavage agents is used to detect mismatched bases in RNA/RNA or RNA/DNA heteroduplexes (Myers et al. (1985) *Science* 230:1242). In general, the art technique of "mismatch cleavage" starts by providing heteroduplexes formed by hybridizing (labeled) RNA or DNA containing the wild-type sequence with potentially mutant RNA or DNA obtained from a tissue sample. The double-stranded duplexes are treated with an agent which cleaves single-stranded regions of the duplex such as which will exist due to basepair mismatches between the control and sample strands. For instance, RNA/DNA duplexes can be treated with RNase and DNA/DNA hybrids treated with S1 nuclease to enzymatically digesting the mismatched regions. In other embodiments, either DNA/DNA or RNA/DNA duplexes can be treated with hydroxylamine or osmium tetroxide and with piperidine in order to digest mismatched regions. After digestion of the mismatched regions, the resulting material is then separated by size on denaturing polyacrylamide gels to determine the site of mutation. See, for example, Cotton et al. (1988) *Proc. Natl. Acad Sci USA* 85:4397; Saleeba et al. (1992) *Methods Enzymol.* 217:286-295. In a preferred embodiment, the control DNA or RNA can be labeled for detection.

In still another embodiment, the mismatch cleavage reaction employs one or more proteins that recognize mismatched base pairs in double-stranded DNA (so called "DNA mismatch repair" enzymes) in defined systems for detecting and mapping point mutations in cDNAs obtained from samples of cells. For example, the mutY enzyme of *E. coli* cleaves A at G/A mismatches and the thymidine DNA glycosylase from HeLa cells cleaves T at G/T mismatches (Hsu et al. (1994) *Carcinogenesis* 15:1657-1662). According to an exemplary embodiment, a probe based on a sequence, e.g., a wild-type sequence, is hybridized to a cDNA or other DNA product from a test cell(s). The duplex is treated with a DNA mismatch repair enzyme, and the cleavage products, if any, can be detected from electrophoresis protocols or the like. See, for example, U.S. Pat. No. 5,459,039.

In other embodiments, alterations in electrophoretic mobility will be used to identify mutations in genes encoding the nucleic acids and polypeptides of the invention. For example, single strand conformation polymorphism (SSCP) may be used to detect differences in electrophoretic mobility between mutant and wild type nucleic acids (Orita et al. (1989) *Proc Natl. Acad Sci USA:* 86:2766, see also Cotton (1993) *Mutat Res* 285:125-144; and Hayashi (1992) *Genet Anal Tech Appl* 9:73-79). Single-stranded DNA fragments of sample and control nucleic acids will be denatured and allowed to renature. The secondary structure of single-stranded nucleic acids varies according to sequence, the resulting alteration in electrophoretic mobility enables the detection of even a single base change. The DNA fragments may be labeled or detected with labeled probes. The sensitivity of the assay may be enhanced by using RNA (rather than DNA), in which the secondary structure is more sensitive to a change in sequence. In a preferred embodiment, the subject method utilizes heteroduplex analysis to separate double stranded heteroduplex molecules on the basis of changes in electrophoretic mobility (Keen et al. (1991) *Trends Genet* 7:5).

In yet another embodiment the movement of mutant or wild-type fragments in polyacrylamide gels containing a gradient of denaturant is assayed using denaturing gradient gel electrophoresis (DGGE) (Myers et al. (1985) *Nature* 313: 495). When DGGE is used as the method of analysis, DNA will be modified to insure that it does not completely denature, for example by adding a GC clamp of approximately 40 bp of high-melting GC-rich DNA by PCR. In a further embodiment, a temperature gradient is used in place of a denaturing gradient to identify differences in the mobility of control and sample DNA (Rosenbaum and Reissner (1987) *Biophys Chem* 265:12753).

Examples of other techniques for detecting point mutations include, but are not limited to, selective oligonucleotide hybridization, selective amplification, or selective primer extension. For example, oligonucleotide primers may be prepared in which the known mutation is placed centrally and then hybridized to target DNA under conditions which permit hybridization only if a perfect match is found (Saiki et al. (1986) *Nature* 324:163); Saiki et al. (1989) *Proc. Natl. Acad. Sci USA* 86:6230). Such allele specific oligonucleotides are hybridized to PCR amplified target DNA or a number of different mutations when the oligonucleotides are attached to the hybridizing membrane and hybridized with labeled target DNA.

Alternatively, allele specific amplification technology which depends on selective PCR amplification may be used in conjunction with the instant invention. Oligonucleotides used as primers for specific amplification may carry the mutation of interest in the center of the molecule (so that amplification depends on differential hybridization) (Gibbs et al. (1989) *Nucleic Acids Res.* 17:2437-2448) or at the extreme 3' end of one primer where, under appropriate conditions, mismatch can prevent, or reduce polymerase extension (Prossner et al. (1993) *Tibtech* 11:238). In addition it may be desirable to introduce a novel restriction site in the region of the mutation to create cleavage-based detection (Gasparini et al. (1992) *Mol. Cell Probes* 6:1). It is anticipated that in certain embodiments amplification may also be performed using Taq ligase for amplification (Barany (1991) *Proc. Natl. Acad Sci USA* 88:189). In such cases, ligation will occur only if there is a perfect match at the 3' end of the 5' sequence making it possible to detect the presence of a known mutation at a specific site by looking for the presence or absence of amplification.

The methods described herein may be performed, for example, by utilizing pre-packaged diagnostic kits comprising at least one probe nucleic acid or antibody reagent described herein, which may be conveniently used, e.g., in clinical settings to diagnose patients exhibiting symptoms or family history of a disease or illness involving a Kinase and Phosphatase gene.

Furthermore, any cell type or tissue in which protein or nucleic acid of the invention is expressed may be utilized in the prognostic assays described herein.

3. Monitoring of Effects During Clinical Trials

Monitoring the influence of agents (e.g., drugs or compounds) on the expression or activity of a protein of the invention can be applied not only in basic drug screening, but also in clinical trials. For example, the effectiveness of an agent determined by a screening assay as described herein to increase gene expression, protein levels, or upregulate protein activity, can be monitored in clinical trials of subjects exhibiting decreased gene expression, protein levels, or downregulated protein activity. Alternatively, the effectiveness of an agent determined by a screening assay to decrease gene expression, protein levels, or downregulate protein activity, can be monitored in clinical trials of subjects exhibiting increased gene expression, protein levels, or upregulated protein activity. In such clinical trials, the expression or activity of a gene encoding a nucleic acid or polypeptide of the invention, and preferably, other genes that have been implicated in a disorder can be used as a "read out" or markers of the phenotype of a particular cell.

For example, and not by way of limitation, genes that are modulated in cells by treatment with an agent (e.g., compound, drug or small molecule) which modulates protein activity (e.g., identified in a screening assay as described herein) can be identified. Thus, to study the effect of agents on a disorder associated with a polypeptide of the invention, for example, in a clinical trial, cells can be isolated and RNA prepared and analyzed for the levels of expression of protein and other genes implicated in the associated disorder, respectively. The levels of gene expression (i.e., a gene expression pattern) can be quantified by Northern blot analysis or RT-PCR, as described herein, or alternatively by measuring the amount of protein produced, by one of the methods as described herein, or by measuring the levels of activity of the gene encoding the protein of the invention or other genes. In this way, the gene expression pattern can serve as a marker, indicative of the physiological response of the cells to the agent. Accordingly, this response state may be determined before, and at various points during treatment of the individual with the agent.

In a preferred embodiment, the present invention provides a method for monitoring the effectiveness of treatment of a subject with an agent (e.g., an agonist, antagonist, peptidomimetic, protein, peptide, nucleic acid, small molecule, or other drug candidate identified by the screening assays described herein) comprising the steps of (i) obtaining a pre-administration sample from a subject prior to administration of the agent; (ii) detecting the level of expression of the protein of the invention or corresponding mRNA, or genomic DNA in the pre-administration sample; (iii) obtaining one or more post-administration samples from the subject; (iv) detecting the level of expression or activity of the protein, mRNA, or genomic DNA in the post-administration samples; (v) comparing the level of expression or activity of the protein, mRNA, or genomic DNA in the pre-administration sample with the protein, mRNA, or genomic DNA in the post administration sample or samples; and (vi) altering the administration of the agent to the subject accordingly. For example, increased administration of the agent may be desirable to increase the expression or activity of protein of the invention to higher levels than detected, i.e., to increase the effectiveness of the agent. Alternatively, decreased administration of the agent may be desirable to decrease expression or activity of protein of the invention to lower levels than detected, i.e. to decrease the effectiveness of the agent. According to such an embodiment, expression or activity of the protein or nucleic acid of the invention may be used as an indicator of the effectiveness of an agent, even in the absence of an observable phenotypic response.

D. Methods of Treatment:

The present invention provides for both prophylactic and therapeutic methods of treating a subject at risk of (or susceptible to) a disorder or having a disorder associated with aberrant expression or activity of a protein or nucleic acid of the invention. With regards to both prophylactic and therapeutic methods of treatment, such treatments may be specifically tailored or modified, based on knowledge obtained from the field of pharmacogenomics. "Pharmacogenomics", as used herein, refers to the application of genomics technologies such as gene sequencing, statistical genetics, and gene expression analysis to drugs in clinical development and on the market. More specifically, the term refers the study of how a patient's genes determine his or her response to a drug (e.g., a patient's "drug response phenotype", or "drug response genotype".) Thus, another aspect of the invention provides methods for tailoring an individual's prophylactic or therapeutic treatment with either the protein or nucleic acid molecules of the present invention or modulators of these molecules according to that individual's drug response genotype. Pharmacogenomics allows a clinician or physician to target prophylactic or therapeutic treatments to patients who will most benefit from the treatment and to avoid treatment of patients who will experience toxic drug-related side effects.

Treatment is defined as the application or administration of a therapeutic agent to a patient, or application or administration of a therapeutic agent to an isolated tissue or cell line from a patient, who has a disease, a symptom of disease or a predisposition toward a disease, with the purpose to cure, heal, alleviate, relieve, alter, remedy, ameliorate, improve or affect the disease, the symptoms of disease or the predisposition toward disease.

A therapeutic agent includes, but is not limited to, small molecules, peptides, antibodies, ribozymes and antisense oligonucleotides.

1. Prophylactic Methods

In one aspect, the invention provides a method for preventing in a subject, a disease or condition associated with an aberrant expression or activity of a protein or nucleic acid of the invention, by administering to the subject an agent which modulates protein or nucleic acid expression or at least one protein activity. Subjects at risk for a disease which is caused or contributed to by aberrant expression or activity of a protein or nucleic acid of the invention can be identified by, for example, any or a combination of diagnostic or prognostic assays as described herein. Administration of a prophylactic agent can occur prior to the manifestation of symptoms characteristic of the aberrancy, such that a disease or disorder is prevented or, alternatively, delayed in its progression. Depending on the type of aberrancy, for example an agonist or antagonist agent of the protein or nucleic acid of the invention can be used for treating the subject. The appropriate agent can be determined based on screening assays described herein.

2. Therapeutic Methods

Another aspect of the invention pertains to methods of modulating the expression or activity of a protein or nucleic acid of the present invention for therapeutic purposes. Accordingly, in an exemplary embodiment, the modulatory method of the invention involves contacting a cell with a protein or nucleic acid of the invention, or agent that modulates one or more of the activities of protein associated with the cell. An agent that modulates protein activity can be an agent as described herein, such as a nucleic acid or a protein, a naturally-occurring target molecule of the protein (e.g., a substrate or ligand), an antibody, an agonist or antagonist, a peptidomimetic of the agonist or antagonist, or other small molecule. In one embodiment, the agent stimulates one or more activities of a protein of the invention. Examples of such stimulatory agents include active protein and a nucleic acid molecule encoding the protein that has been introduced into the cell. In another embodiment, the agent inhibits one or more protein activities. Examples of such inhibitory agents include antisense nucleic acid molecules, antibodies, and protein inhibitors. These modulatory methods can be performed in vitro (e.g., by culturing the cell with the agent) or, alternatively, in vivo (e.g, by administering the agent to a subject). As such, the present invention provides methods of treating an individual afflicted with a disease or disorder characterized by aberrant expression or activity of a protein or nucleic acid molecule of the invention. In one embodiment, the method involves administering an agent (e.g., an agent identified by a screening assay described herein), or combination of agents that modulates (e.g., upregulates or downregulates) the expression or activity of the protein or nucleic acid of the invention. In another embodiment, the method involves administering a protein or nucleic acid molecule of the invention as therapy to compensate for reduced or aberrant expression or activity of a protein or nucleic acid of the invention.

Stimulation of protein activity is desirable in situations in which the protein is abnormally downregulated and/or in which increased protein activity is likely to have a beneficial effect. For example, stimulation of protein activity is desirable in situations in which the protein is downregulated and/ or in which increased protein activity is likely to have a beneficial effect. Likewise, inhibition of protein activity is desirable in situations in which the protein is abnormally upregulated and/or in which decreased protein activity is likely to have a beneficial effect.

3. Pharmacogenomics

The protein and nucleic acid molecules of the present invention, as well as agents, or modulators which have a stimulatory or inhibitory effect on the expression or activity of a protein or nucleic acid molecule of the invention as identified by a screening assay described herein can be administered to individuals to treat (prophylactically or therapeutically) disorders associated with aberrant expression or activity of the protein or nucleic acid of the invention. In conjunction with such treatment, pharmacogenomics (i.e., the study of the relationship between an individual's genotype and that individual's response to a foreign compound or drug) may be considered. Differences in metabolism of therapeutics can lead to severe toxicity or therapeutic failure by altering the relation between dose and blood concentration of the pharmacologically active drug. Thus, a physician or clinician may consider applying knowledge obtained in relevant pharmacogenomics studies in determining whether to administer a protein or nucleic acid of the invention or modulator thereof as well as tailoring the dosage and/or therapeutic regimen of treatment.

Pharmacogenomics deals with clinically significant hereditary variations in the response to drugs due to altered drug disposition and abnormal action in affected persons. See, for example, Eichelbaum, M. et al. (1996) Clin. Exp. Pharmacol. Physiol. 23(10-11):983-985 and Linder, M. W. et al. (1997) Clin. Chem. 43(2):254-266. In general, two types of pharmacogenetic conditions can be differentiated. Genetic conditions transmitted as a single factor altering the way drugs act on the body (altered drug action) or genetic conditions transmitted as single factors altering the way the body acts on drugs (altered drug metabolism). These pharmacogenetic conditions can occur either as rare genetic defects or as naturally-occurring polymorphisms. For example, glucose-6-phosphate dehydrogenase deficiency (G6PD) is a common inherited enzymopathy in which the main clinical complication is haemolysis after ingestion of oxidant drugs (antimalarials, sulfonamides, analgesics, nitrofurans) and consumption of fava beans.

One pharmacogenomics approach to identifying genes that predict drug response, known as "a genome-wide association", relies primarily on a high-resolution map of the human genome consisting of already known gene-related markers (e.g., a "bi-allelic" gene marker map which consists of 60,000-100,000 polymorphic or variable sites on the human genome, each of which has two variants.) Such a high-resolution genetic map can be compared to a map of the genome of each of a statistically significant number of patients taking part in a Phase II/III drug trial to identify markers associated with a particular observed drug response or side effect. Alternatively, such a high resolution map can be generated from a combination of some ten-million known single nucleotide polymorphisms (SNPs) in the human genome. As used herein, a "SNP" is a common alteration that occurs in a single nucleotide base in a stretch of DNA. For example, a SNP may occur once per every 1000 bases of DNA. A SNP may be involved in a disease process, however, the vast majority may not be disease-associated. Given a genetic map based on the occurrence of such SNPs, individuals can be grouped into genetic categories depending on a particular pattern of SNPs in their individual genome. In such a manner, treatment regimens can be tailored to groups of genetically similar individuals, taking into account traits that may be common among such genetically similar individuals.

Single nucleotide polymorphisms and other genetic polymorphisms can be detected by microarray analysis, real time PCR, mass spectroscopic, sequencing and related strategies (Li J, Butler J M, Tan Y, Lin H, Royer S, Ohler L, Shaler T A, Hunter J M, Pollart D J, Monforte J A, Becker C H, "Single nucleotide polymorphism determination using primer extension and time-of-flight mass Spectrometry", Electrophoresis 1999 June; 20(6):1258-65; Li J, Wang F, Zabarovska V, Wahlestedt C, 20 Zabarovsky E R, "Cloning of polymorphisms (COP): enrichment of polymorphic sequences from complex genomes", Nucleic Acids Res 2000 Jan. 15; 28(2):el; Kuklin A, Munson K, Taylor P, Gjerde D, "Isolation and analysis of amplified cDNA fragments during detection of unknown polymorphisms with temperature modulated heteroduplex chromatography", Mol Biotechnol 1999 June; 11(3):257-61; Glaab W E, Skopek T R, "A novel assay for allelic discrimination that combines the fluorogenic 5' nuclease polymerase chain reaction (TaqMan) and mismatch amplification mutation assay", Mutat Res 1999 Nov. 29; 430(1): 1-12; Lipshutz R J, Fodor S P, Gingeras T R, Lockhart D J, "High density synthetic oligonucleotide arrays", Nat Genet 1999 January; 21(1 Suppl):20-4). All of these strategies depend upon foreknowledge of at least part of the sequence to be analyzed. The polynucleotide sequences disclosed herein enable the development of assays for the identification of genetic polymorphisms in the genes identified by the disclosed polynucleotides.

Alternatively, a method termed the "candidate gene approach", can be utilized to identify genes that predict a drug response. According to this method, if a gene that encodes a drug target is known (e.g., a protein of the present invention), all common variants of that gene can be fairly easily identified in the population and it can be determined if having one version of the gene versus another is associated with a particular drug response.

As an illustrative embodiment, the activity of drug metabolizing enzymes is a major determinant of both the intensity and duration of drug action. The discovery of genetic polymorphisms of drug metabolizing enzymes (e.g., N-acetyltransferase 2 (NAT 2) and cytochrome P450 enzymes CYP2D6 and CYP2C19) has provided an explanation as to why some patients do not obtain the expected drug effects or show exaggerated drug response and serious toxicity after taking the standard and safe dose of a drug. These polymorphisms are expressed in two phenotypes in the population, the extensive metabolizer (EM) and poor metabolizer (PM). The prevalence of PM is different among different populations. For example, the gene coding for CYP2D6 is highly polymorphic and several mutations have been identified in PM, which all lead to the absence of functional CYP2D6. Poor metabolizers of CYP2D6 and CYP2C19 quite frequently experience exaggerated drug response and side effects when they receive standard doses. If a metabolite is the active therapeutic moiety, PM show no therapeutic response, as demonstrated for the analgesic effect of codeine mediated by its CYP2D6-formed metabolite morphine. The other extreme are the so called ultra-rapid metabolizers who do not respond to standard doses. Recently, the molecular basis of ultra-rapid metabolism has been identified to be due to CYP2D6 gene amplification.

Alternatively, a method termed the "gene expression profiling", can be utilized to identify genes that predict drug response. For example, the gene expression of an animal dosed with a drug (e.g., a protein, nucleic acid of the present invention or modulator thereof) can give an indication whether gene pathways related to toxicity have been turned on.

Information generated from more than one of the above pharmacogenomics approaches can be used to determine appropriate dosage and treatment regimens for prophylactic or therapeutic treatment an individual. This knowledge, when applied to dosing or drug selection, can avoid adverse reactions or therapeutic failure and thus enhance therapeutic or prophylactic efficiency when treating a subject with protein or nucleic acid molecule or, such as a modulator identified by one of the exemplary screening assays described herein.

4. Use of Polypeptides and Nucleic Acid Molecules as Surrogate Markers

The polypeptides and nucleic acid molecules of the invention are also useful as markers of disorders or disease states, as markers for precursors of disease states, as markers for predisposition of disease states, as markers of drug activity, or as markers of the pharmacogenomic profile of a subject. Using the methods described herein, the presence, absence and/or quantity of the polypeptides or nucleic acid molecules of the invention may be detected, and may be correlated with one or more biological states in vivo. For example, the polypeptide and nucleic acid molecules of the invention may serve as surrogate markers for one or more disorders or disease states or for conditions leading up to disease states.

As used herein, a "surrogate marker" is an objective biochemical marker which correlates with the absence or presence of a disease or disorder, or with the progression of a disease or disorder (e.g., with the presence or absence of a tumor). The presence or quantity of such markers is independent of the causation of the disease. Therefore, these markers may serve to indicate whether a particular course of treatment is effective in lessening a disease state or disorder. Surrogate markers are of particular use when the presence or extent of a disease state or disorder is difficult to assess through standard methodologies (e.g., early stage tumors), or when an assessment of disease progression is desired before a potentially dangerous clinical endpoint is reached (e.g., an assessment of cardiovascular disease may be made using cholesterol levels as a surrogate marker, and an analysis of HIV infection may be made using HIV RNA levels as a surrogate marker, well in advance of the undesirable clinical outcomes of myocardial infarction or fully-developed AIDS). Examples of the use of surrogate markers in the art include: Koomen et al. (2000) *J. Mass. Spectrom.* 35:258-264; and James (1994) *AIDS Treatment News Archive* 209.

The polypeptide and nucleic acid molecules of the invention are also useful as pharmacodynamic markers. As used herein, a "pharmacodynamic marker" is an objective biochemical marker which correlates specifically with drug effects. The presence or quantity of a pharmacodynamic marker is not related to the disease state or disorder for which the drug is being administered; therefore, the presence or quantity of the marker is indicative of the presence or activity of the drug in a subject. For example, a pharmacodynamic marker may be indicative of the concentration of the drug in a biological tissue, in that the marker is either expressed or transcribed or not expressed or transcribed in that tissue in relationship to the level of the drug. In this fashion, the distribution or uptake of the drug may be monitored by the pharmacodynamic marker. Similarly, the presence or quantity of the pharmacodynamic marker may be related to the presence or quantity of the metabolic product of a drug, such that the presence or quantity of the marker is indicative of the relative breakdown rate of the drug in vivo. Pharmacodynamic markers are of particular use in increasing the sensitivity of detection of drug effects, particularly when the drug is administered in low doses. Since even a small amount of a drug may be sufficient to activate multiple rounds of marker transcription or expression, the amplified marker may be in a quantity which is more readily detectable than the drug itself. Also, the marker may be more easily detected due to the nature of the marker itself; for example, using the methods described herein, antibodies may be employed in an immune-based detection system for a protein marker, or nucleic acid-specific radiolabeled probes may be used to detect a mRNA marker. Furthermore, the use of a pharmacodynamic marker may offer mechanism-based prediction of risk due to drug treatment beyond the range of possible direct observations. Examples of the use of pharmacodynamic markers in the art include: Matsuda et al. U.S. Pat. No. 6,033,862; Hattis et al. (1991) *Env. Health Perspect.* 90:229-238; Schentag (1999) *Am. J. Health-Syst. Pharm.* 56 Suppl. 3:S21-S24; and Nicolau (1999) *Am. J. Health-Syst. Pharm.* 56 Suppl. 3:S16-S20.

The polypeptide and nucleic molecules of the invention are also useful as pharmacogenomic markers. As used herein, a "pharmacogenomic marker" is an objective biochemical marker which correlates with a specific clinical drug response or susceptibility in a subject (see, e.g., McLeod et al. (1999) *Eur. J. Cancer* 35(12):1650-1652). The presence or quantity of the pharmacogenomic marker is related to the predicted response of the subject to a specific drug or class of drugs prior to administration of the drug. By assessing the presence or quantity of one or more pharmacogenomic markers in a subject, a drug therapy which is most appropriate for the subject, or which is predicted to have a greater degree of success, may be selected. For example, based on the presence or quantity of RNA, or protein for specific tumor markers in a subject, a drug or course of treatment may be selected that is optimized for the treatment of the specific tumor likely to be present in the subject. Similarly, the presence or absence of a specific sequence mutation in the DNA encoding a nucleic acid or protein of the invention may correlate drug response. The use of pharmacogenomic markers therefore permits the application of the most appropriate treatment for each subject without having to administer the therapy.

VII. Electronic Apparatus Readable Media and Arrays

Electronic apparatus readable media comprising nucleic acid and polypeptide sequence information is also provided. As used herein, "nucleic acid and polypeptide sequence information" refers to any nucleotide and/or amino acid sequence information particular to the polypeptide and nucleic acid molecules of the present invention, including but not limited to full-length nucleotide and/or amino acid sequences, partial nucleotide and/or amino acid sequences, polymorphic sequences including single nucleotide polymorphisms (SNPs), epitope sequences, and the like. Moreover, information "related to" said sequence information includes detection of the presence or absence of a sequence (e.g., detection of expression of a sequence, fragment, polymorphism, etc.), determination of the level of a sequence (e.g., detection of a level of expression, for example, a quantative detection), detection of a reactivity to a sequence (e.g., detection of protein expression and/or levels, for example, using a sequence-specific antibody), and the like. As used herein, "electronic apparatus readable media" refers to any suitable medium for storing, holding or containing data or information that can be read and accessed directly by an electronic apparatus. Such media can include, but are not limited to: magnetic storage media, such as floppy discs, hard disc storage medium, and magnetic tape; optical storage media such as compact disc; electronic storage media such as RAM, ROM, EPROM, EEPROM and the like; general hard disks and hybrids of these categories such as magnetic/optical storage media. The medium is adapted or configured for having recorded thereon nucleic acid and polypeptide sequence information of the present invention.

As used herein, the term "electronic apparatus" is intended to include any suitable computing or processing apparatus or other device configured or adapted for storing data or information. Examples of electronic apparatus suitable for use with the present invention include stand-alone computing apparatus; networks, including a local area network (LAN), a wide area network (WAN) Internet, Intranet, and Extranet; electronic appliances such as a personal digital assistants (PDAs), cellular phone, pager and the like; and local and distributed processing systems.

As used herein, "recorded" refers to a process for storing or encoding information on the electronic apparatus readable medium. Those skilled in the art can readily adopt any of the presently known methods for recording information on known media to generate manufactures comprising the nucleic acid and polypeptide sequence information.

A variety of software programs and formats can be used to store the sequence information on the electronic apparatus readable medium. For example, the sequence information can be represented in a word processing text file, formatted in commercially-available software such as WordPerfect and MicroSoft Word, or represented in the form of an ASCII file, stored in a database application, such as DB2, Sybase, Oracle, or the like, as well as in other forms. Any number of datap-rocessor structuring formats (e.g., text file or database) may be employed in order to obtain or create a medium having recorded thereon the nucleic acid and polypeptide sequence information.

By providing nucleic acid and polypeptide sequence information in readable form, one can routinely access the sequence information for a variety of purposes. For example, one skilled in the art can use the sequence information in readable form to compare a target sequence or target structural motif with the sequence information stored within the data storage means. Search means are used to identify fragments or regions of the sequences of the invention which match a particular target sequence or target motif.

VIII. Microarrays

The sequences disclosed in this application provide a novel set of expression probes for microarray and other expression assays thereby enabling the identification of novel transcriptional correlates of disease biology. These sequences therefore provide novel expression probes for more detailed and accurate disease diagnosis and treatment. One use of the disclosed sequences as diagnostics entails arraying the disclosed sequences in a microarray and using these arrays to detect altered transcription of these genes in transcript populations isolated from diseased tissues (e.g. cancerous or virally infected tissues) or from normal tissues challenged with various environmental challenges (e.g. drug treatment). Detection of expression changes using these reagents is used to diagnose disease or physiological responses. Microarray analysis is being used to analyze how transcription changes depend upon environment, drug treatment, and the expression of other genes. It is well known that genetic interactions profoundly affect physiology, development, and health, and by identifying how these transcriptional changes depend upon various medically relevant stimuli microarray analysis (and other techniques for large scale identification of transcription patterns) can provide insight into disease biology, gene function, and therapeutic approaches.

Research Uses

The polynucleotides included in the present invention may be used as reagents for various purposes. These polynucleotides can be used as markers for chromosome identification and gene mapping using techniques such as linkage analysis and fluorescence in situ hybridization.

These polynucleotides may also be used in the designing of polymerase chain reaction primers. Such primers may then be used for amplifying specific regions of a genome for the purposes of comparison with similar regions of DNA sequence either within or across species. These primers may be useful for identifying DNA sequence that is potentially responsible for genetic disorders by amplifying and comparing similar regions in patients with a given disorder and controls without a given disorder.

The present polynucleotides may alternatively be useful as primers for identifying specific individuals by restriction fragment polymorphism analysis and genetic fingerprinting.

The sequences found in the present invention may also be used as probes to identify the disclosed sequences with the aim of identifying ones not previously identified. The polynucleotides may also be used as oligonucleotide probes for attachment to micro-arrays, or gene-chips, for among other applications, the purpose of determining expression patterns.

Using DNA immunization techniques, the present polynucleotides could also be used to raise anti-DNA specific antibodies.

The polypeptides of the present invention may also be used for various purposes. These polypeptides may be useful as analytical tools to measure protein expression in a tissue, to assess transformation of a recombinant host cell, or as a molecular weight marker for laboratory analysis techniques (e.g. Southern blot analysis).

The polypeptide may be used as a marker for determining if the polypeptide is present in a tissue specific manner. Such a polypeptide may be constitutively expressed, expressed during a specific stage of development or tissue differentiation, or found preferentially in disease affected tissues.

The polypeptides of the present invention can be used as an antigen to raise antibodies. These antibodies can then be used to treat disease or as diagnostic markers for the detection of the corresponding disorder. Such antibodies can alternatively be used for detecting polyoucleotide expression using various laboratory techniques (i.e. enzyme linked immunosorbent assay and radioimmune assay).

The polypeptide of the present invention may be used to identify additional polypeptides and polynucleotides if the given polypeptide is used in a trap assay. Such an assay can identify molecules that bind to a given polypeptide and possibly alter the polypeptide's function. In this manner, receptor-ligand interactions, amongst other activities, may be discerned.

Binding activities involving polypeptides of this invention make them useful them useful for screening combinatorial chemistry and other libraries for purposes of identifying small molecules or peptides that activate, increase, decrease or inhibit the activity of this molecule encoded by a polynucleotide or polypeptide disclosed in this invention.

The polynucleotides of the present invention may also be used to express recombinant polypeptides for therapeutic use. As such, these polypeptides can be administered to replace low ore non present polypeptide levels in a patient, to block or reduce the activity of another polypeptide, to activate a polypeptide, or elicit a 20 specific response.

This invention is further illustrated by the following examples which should not be construed as limiting. The contents of all references, patents and published patent applications cited throughout this application, as well as the Figures and the Sequence Listing are incorporated herein by reference.

EXAMPLES

Example 1

Construction of pRIG-1

Human DHFR was amplified by PCR from cDNA produced from HT1080 cells by PCR using the primers DHFR-F1 (5'TCCTTCGAAGCTTGTCATGGTTGGT-TCGCTAAACTGC AT3') (SEQ ID NO:1) and DHFR-R1 (5'AAACTTAAGATCGATTAATCATTCTTCT-CATATACTTCAA3') (SEQ ID NO:2), and cloned into the T site in pTARGET™ (Promega) to create pTARGET:DHFR. The RSV promoter was isolated from PREP9 by digestion with NheI and XbaI and inserted into the NheI site of pTAR-GET:DHFR to create pTgT:RSV+DHFR. Oligonucleotides JH169(5' ATCCACCATGGCTACAGGTG AGTACTCG3') (SEQ ID NO:3) and JH170 (5'ATCCGAGTACTCACCTG-TAGCCATGGTGGATTTAA 3') (SEQ ID NO:4) were annealed and inserted into the I-Ppo-I and NheI sites of pTgT:

RSV+DHFR to create pTgT:RSV+DHFR+Exl. A 279 bp region corresponding to nucleotides 230-508 of pBR322 was PCR amplified using primers Tet F1 (5' GGC-GAGATCTAGCGCTATATGCGTTGATGC AAT3') (SEQ ID NO:5) and Tet F2 (5'GGCCAGATCTGCTACCTTAA-GAGAGCCG-AAACAAGCGCTCATGAGCCCGAA3') (SEQ ID NO:6). Amplification products were digested with BglII and cloned into the BamHI site of pTgT:RSV+RSV+DHFR+Exl to create pRIG-1 (SEQ ID NO:7).

Example 2

Creation of pR1G-1 Gene Activation Library in HT1080 Cells

To activate gene expression, a suitable activation construct is selected from the group of constructs described above. The selected activation construct is then introduced into cells by any transfection method known in the art. Examples of transfection methods include electroporation, lipofection, calcium phosphate precipitation, DEAE dextran, and receptor mediated endocytosis. Following introduction into the cells, the DNA is allowed to integrate into the host cell's genome via non-homologous recombination. Integration can occur at spontaneous chromosome breaks or at artificially induced chromosomal breaks.

$2 \times 10^9$ HH1 cells, an HPRT subclone of HT1080 cells, was grown in 150 mm tissue culture plates to 90% confluency. Media was removed from the cells and saved as conditioned media (see below). Cells were removed from the plate by brief incubation with trypsin, added to media/10% fetal bovine serum to neutralize the trypsin, and pelleted at 1000 rpm in a Jouan centrifuge for 5 minutes. Cells were washed in 1×PBS, counted, and repelleted as above. The cell pellet was resuspended at $2.5 \times 10^7$ cells/ml final in 1×PBS (Gibco BRL Cat #14200-075). Cells were then exposed to 50 rads of γ-irradiation from a $^{137}CS$ source. pRIG1 (FIGS. 14A-14B; SEQ ID NO: 18) was linearized with BamHI, purified with phenol/chloroform, precipitated with ethanol, and resuspended in PBS. Purified and linearized activation construct was added to the cell suspension to produce a final concentration of 40 1 µg/ml. The DNA/irradiated cell mixture was then mixed and 400 µl was placed into each 0.4 cm electroporation cuvettes (Biorad). The cuvettes were pulsed at 250 Volts, 600 µFarads, 50 Ohms using an electroporation apparatus (Biorad). Following the electric pulse, the cells were incubated at room temperature for 10 minutes, and then placed into α MEM/10% FBS containing penicillin/streptomycin (Gibco/BRL). The cells were then plated at approximately $7 \times 10^6$ cells/150 mm plate containing 35 ml α MEM/10% FBS/penstrep (33% conditioned media/67% fresh media). Following a 24 hour incubation at 37° C., G418 (Gibco/BRL) was added to each plate to a final concentration of 500 µg/ml from a 60 mg/ml stock. After 4 days of selection, the media was replaced with fresh α MEM/10% FBS/penstrep/500 µg/ml G418. The cells were then incubated for another 7-10 days and the culture supernatant assayed for the presence of new protein factors or stored at −80° C. for later analysis. The drug resistant clones can be stored in liquid nitrogen for later analysis.

Example 3

Use of Ionizing Irradiation to Increase the Frequency and Randomness of DNA Integration HH1 cells were harvested at 90% confluency, washed in 1×PBS, and resuspended at a cell concentration of $7.5 \times 10^6$ cells/ml in 1×PBS. 15 µg linearized DNA (pRIG-1) was added to the cells and mixed. 400 µl was added to each electroporation cuvette and pulsed at 250 Volts, 600 µFarads, 50 Ohms using an electroporation apparatus (Biorad). Following the electric pulse, the cells were incubated at room temperature for 10 minutes, and then placed into 2.5 ml MEM/10% FBS/1× penstrep. 300 µl of cells from each shock were irradiated at 0, 50, 500, and 5000 rads immediately prior to or at either 1 hour or 4 hours post transfection. Immediately following irradiation, the cells were plated onto tissue culture plates in complete medium. At 24 hours post plating, G418 was added to the culture to a final concentration of 500 µg/ml. At 7 days post-selection, the culture medium was replaced with fresh complete medium containing 500 µg/ml G418. At 10 days post selection, medium was removed from the plate, the colonies were stained with Coomassie Blue/90% methanol/10% acetic acid and colonies with greater than 50 cells were counted.

Example 4

Isolation of cDNAs Encoding Transmembrane Proteins pRIG8R1-CD2 (SEQ ID NO:8), pRIG8R2-CD2 (SEQ ID NO:9), and pRIG8R3-CD2 (SEQ ID NO:10) vectors contain the CMV immediate early gene promoter operably linked to an exon followed by an unpaired splice donor site. The exon on the vector encodes a signal peptide linked to the extracellular domain of CD2 (lacking an in frame stop codon). Each vector encodes CD2 in a different reading frame relative to the splice donor site. To create a library of activated genes, $2 \times 10^7$ cells were irradiated with 50 rads from a $^{137}Cs$ source and electroporated with 15 µg of linearized pRIG8R1-CD2 (SEQ ID NO:8). Separately, this was repeated with pRIG8R2-CD2 (SEQ ID NO:9), and again with pRIG8R3-CD2 (SEQ ID NO:10). Following transfection, the three groups of cells were combined and plated into 150 mm dishes at $5 \times 10^6$ transfected cells per dish to create library #1. At 24 hours post transfection, library #1 was placed under 500 µg/ml G418 selection for 14 days. Drug resistant clones containing the vector integrated into the host cell genome were combined, aliquoted, and frozen for analysis. Library #2 was created as described above, except that $3 \times 10^7$ cells, $3 \times 10^7$ cells and $1 \times 10^7$ cells were transfected with pRIG8R1-CD2 (SEQ ID NO:8), pRIG8R2-CD2 (SEQ ID NO:9), and pRIG8R3-CD2 (SEQ ID NO:10), respectively.

To isolate cells containing activated genes encoding integral membrane proteins, $3 \times 10^6$ cells from each library were cultured and treated as follows:
(1) Cells are trypsinized using 4 mls of Trypsin-EDTA
(2) After the cells had released, the trypsin was neutralized by addition of 8 ml of alpha MEM/10% FBS.
(3) The cells were washed once with sterile PBS and collected by centrifugation at 800×g for 7 minutes.
(4) The cell pellet was resuspended in 2 ml of alpha MEM/10% FBS. 1 ml was used for sorting while the other 1 ml was replated in alpha MEM/10% FBS containing 500 µg/ml G-418, expanded and saved.
(5) The cells used for sorting were washed once with sterile alpha MEM/10% FBS and collected by centrifugation at 800×g for 7 minutes.
(6) The supernatant was removed and the pellet resuspended in 1 ml of alpha MEM/10% FBS. 100 µl of these cells was removed for staining with the isotype control.
(7) 200 µl of Anti-CD2 FITC (Pharmingen catalog #30054X) was added to the 900 µl of cells while 201 of the Mouse IgG$_1$ isotype control (Pharmingen catalog #33814X) was added to the 100 µl of cells. The cells were incubated, on ice, for 20 minutes.

(8) To the tube that contained the cells stained with the Anti-Human CD2 FITC, 5 ml of PBS/1% FBS were added. To the isotype control, 900 µl of PBS/1% FBS were added. The cells were collected by centrifugation at 600×g for 6 minutes.

(9) The supernatant from the tubes was removed. The cells that had been stained with the isotype control were resuspended in 500 µl of alpha MEM/10% FBS, and the cells that had been stained with anti-CD2-FITC were resuspended in 1.5 ml alpha MEM/10% FBS.

Cells were sorted through five sequential sorts on a FACS Vantage Flow Cytometer (Becton Dickinson Immunocytometry Systems; Mountain View, Calif.). In each sort, the indicated percentage of total cells, representing the most strongly fluorescent cells (see below) were collected, expanded, and resorted. HT1080 cells were sorted as a negative control. The following populations were sorted and collected in each sort:

|  | Library #1 | Library #2 | Library #3 |
| --- | --- | --- | --- |
| Sort #1 | 500,000 cells collected (top 10%) | 100,000 cells collected (top 10%) | 40,000 cells collected (top 10%) |
| Sort #2 | 300,000 cells collected (top 5%) | 220,000 cells collected (top 11%) | 14,000 cells collected (top 5%) |
| Sort #3 | 90,000 cells collected (top 5%) | 40,000 cells collected (top 10%) | 120,000 cells collected (top 10%) |
| Sort #4 | 600,000 cells collected (top 40%) | (a) 6,000 cells collected (top 5%) (b) 10,000 cells collected (next 5%) |  |
| Sort #5 | (a) 260,000 cells collected (top 10%) (b) 530,000 cells collected (next 25%) | (b) from group (b) of sort #4 120,000 cells collected (top 10%) | (Not done) |

Cells from each of the final sorts for each library were expanded and stored in liquid nitrogen.

Example 7

Isolation of Activated Genes from FACs-Sorted Cells

Once cells had been sorted as described above, activated endogenous genes from the sorted cells were isolated by PCR-based cloning. One of ordinary skill will appreciate, however, that any art-known method of cloning of genes may be equivalently used to isolate activated genes from FACS-sorted cells.

Genes were isolated by the following protocol:

(1) Using PolyATract System 1000 mRNA isolation kit (Promega), mRNA was isolated from 3×10$^7$ CD2+ cells (sorted 5 rounds by FACS, as described above) from libraries #1 and #2.

(2) After mRNA isolation, the concentration of mRNA was determined by diluting 0.5 µl of isolated mRNA into 99.5 µl water and measuring OD$^{260}$ 21 µg of mRNA were recovered from the CD2+ cells.

(3) First strand cDNA synthesis was then carried out as follows:
   (a) While the PCR machine was holding at 4° C., first strand reaction mixtures were set up by sequential addition of the following components:
   41 µl DEPC-treated ddH$_2$O
   4 µl 10 mM each dNTP
   8 µl 0.1 MDTT
   16 µl 5×MMLV first strand buffer (Gibco-BRL)
   5 µl (10 pmoV'll) of the consensus polyadenylation site primer GD.R1(SEQ ID NO:11)*
   1 µl RNAsin (Promega)
   3 µl (1.25 µg/µl) mRNA.
   *Note: GD.R1,5'TTTTTTTTTTTTCGTCAGCGGCCG-CATCNNNNTTTATT3' (SEQ ID NO: 11), is a "Gene Discovery" primer for first strand cDNA synthesis of mRNA; this primer is designed to anneal to the polyadenylation signal AATAAA and downstream poly-A region. This primer will introduce a NotI site into the first strand.

Once samples had been made up, they were incubated as follows:
   (b) 70° C. for 1 min.
   (c) 42° C. hold.
   2 µl of 400 U/µl SuperScript II (Gibco-BRL; Rockville, Md.) was then added to each sample, to give a final total volume of 82 µl. After approximately three minutes, samples were incubated as follows:
   (d) 37° C. for 30 min.
   (e) 94° C. for 2 min.
   (f) 4° C. for 5 min.
   2 µl of 20 U/µl Rnace-IT (Stratagene) was then added to each sample, and samples were incubated at 37° C. for 10 min.

(4) Following first strand synthesis, cDNA was purified using a PCR cleanup kit (Qiagen) as follows:
   (a) 80 µl of the first strand reaction were transferred to a 1.7 ml siliconized eppendorf tube and adding 400 µl of PB.
   (b) Samples were then transferred to a PCR clean-up column and centrifuged for two minutes at 14,000 RPM.
   (c) Columns were then disassembled, flowthrough decanted, 750 of µl PE were added to pellets, and tubes were centrifuged for two minutes at 14,000 RPM.
   (d) Columns were disassembled and flowthrough decanted, and tubes then centrifuged for two minutes at 14,000 RPM to dry resin.
   (e) cDNA was then eluted using 50 µl of EB through transferring column to a new siliconized eppendorf tube which was then centrifuged for two minutes at 14,000 RPM.

(5) Second strand cDNA synthesis was then carried out as follows:
   (a) Second strand reaction mixtures were set up at RT, through the sequential addition of the following components:

| ddH20 | 55 µl |
| --- | --- |
| 10× PCR buffer | 10 µl |
| 50 mM MgCl2 | 5 µl |
| 10 mM dNTPs | 2 µl |
| pmol/µl RIG.751-Bio* | 4 µl |

-continued

| | |
|---|---|
| 25 pmol/µl GD.R2** | 4 µl |
| First strand product | 20 µl |

*Note: RIG.F751-Bio, 5' Biotin-CAGATCACTAGAAGCTTTATTGCGG 3' (SEQ ID NO:12), anneals at the cap-site of the transcript expressed from pRIG vectors.
**Note: GD.R2, 5' TTTTCGTCAGCGGCCGCATC 3' (SEQ ID NO:13), is a primer used to PCR amplify cDNAs generated using primer GD.R1 (SEQ ID NO:11). GD.R2 (SEQ ID NO:13), is a sub-sequence of GD.R1 (SEQ ID NO:11) with matching sequence up to the degenerate bases preceding the polyA signal sequence.

(b) Start second strand synthesis:
        94° C. for 1 min;
        add 1 µl Taq (5U/Ill, Gibco-BRL);
        add 1 µl Vent DNA pol (0.1 U/µl, New England Biolabs).
    (c) Incubate at 63° C. for 2 min. (d)
    (e) Incubate at 72° C. for 3 min.
    (f) Repeat step (b) four times.
    (g) Incubate at 72° C. for 6 min.
    (h) Incubate at 4° C. (hold)
(6) 200 µl of 1 mg/ml Streptavidin-Paramagnetic Particles (SA-PMP) were then prepared by washing three times with STE.
(7) The products of the second strand reaction were added directly to the SA-PMPs and incubated at RT for 30 minutes.
(8) After binding, SA-PMPs were collected through the use of the magnet, and flowthrough material recovered.
(9) Beads were washed three times with 500 µl STE.
(10) Beads were resuspended in 50 µl of STE and collected at the bottom of the tube using the magnet. STE supernatant was then carefully pipetted off.
(11) Beads were resuspended in 50 µl of ddH20 and placed into a 100° C. water bath for two minutes, to release purified cDNA from PMPs.
(12) Purified cDNA was recovered by collecting PMPs on the magnet and carefully removing the supernatant containing the cDNA.
(13) Purified products were transferred to a clean tube and centrifuged at 14,000 RPM for two minutes to remove all of the residual PMPs.
(14) A PCR reaction was then carried out to specifically amplify RIG activated cDNAs, as follows:
    (a) PCR reaction mixtures were set up at RT, through the sequential addition of the following components:

| | |
|---|---|
| H$_2$O | 59 µl |
| 10× PCR buffer | 10 µl |
| 50 mM MgCl2 | 5 µl |
| 10 nM dNTPs | 2 µl |
| 25 pmol/µl RIG.F781* | 2 µl |
| 25 pmol/µl GD.R2 | 2 µl |
| second strand product | 20 µl |

*Note: RIG.F781,5'ACTCATAGGCCATAGAGGCCTATCA-CAGTTAAATTGCTAACGCAG 3' (SEQ ID NO:14), anneals downstream of GD.F 1 (5'TTCTAGGCCATAGAGGCCAGATCACTA-GAAGCTTTATTGCGG3')(SEQ ID NO:15), GD.F3 (5' TGACTCAGGC-CATAGAGGCCTGAACCGTCAGATCACTAGAAGCTTTATTGCGG3') (SEQ ID NO:16), GD.F5-Bio (5' Biotin 15 AGTTGACTCAGGCCTAATGGCCGTCA-GATCACTAGAAGCTTTATTGC3')(SEQ ID NO:17), and RIG.F751-Bio (SEQ ID NO:12), and adds an SfiI site for 5' cloning of cDNAs. This primer is used in nested PCR amplification of RIG ExonI specific second strand cDNAs.

(b) Start thermal cycler:
        94° C. for 3 min;
        add 1 µl of Taq (5 U/µl; Gibco-BRL);
        add 1 µl of 0.1 U/µl Vent DNA polymerase (New England 25 Biolabs) PCR was then carried out by 10 cycles of steps (c) to (e):
    (c) 94° C. for 30 sec.
    (d) 60° C. for 40 sec.
    (e) 72° C. for 3 min.
    PCR was then completed by carrying out the following steps:
    (f) 94° C. for 30 sec.
    (g) 60° C. for 40 sec.
    (h) 72° C. for 3 min.
    (i) 72° C.+20 sec each cycle for 10 cycles
    (j) 72° C. for 5 min
    (k) 4° C. hold.
(15) After elution of library material with 50 µl EB, samples were digested by adding 10 µl of NEB Buffer 2, 40 µl of dH20 and 2 µl of SfiI and digesting for 1 hour at 50° C., to cut the 5' end of the cDNA at the SfiI site encoded by the forward primer (R1G.F781; SEQ ID NO:14).
(16) Following SfiI digestion, 5 µl of 1 M NaCl and 2 µl of NotI were added to each sample, and samples digested for one hour at 37° C., to cut the 3' end of the cDNA at the NotI site encoded by the first strand primer (GD.R1; SEQ ID NO:11).
(17) The digested cDNA was then separated on a 1% low melt agarose gel. CDNAs ranging in size from 1.2 Kb to 8 Kb were excised from the gel.
(18) cDNA was recovered from the excised agarose gel using Qiaex II Gel Extraction (Qiagen). 2 µl of cDNA (approximately 30 mg) was ligated to 7 µl (35 ng) of pBS-HSB (linearized with SfiI/NotI) in a total volume of 10 µl of 1×T4 ligase buffer (NEB), using 400 units of T4 DNA ligase (NEB).
(19) 0.5 µl of the ligation reaction mixture from step (18) was transformed into *E. coli* DH1OB.
(20) 103 colonies/0.5 µl ligated DNA were recovered.
(21) These colonies were screened for exons using the primers M13F20(5'GTAAAACGACGGCCAGTGAA3') (SEQ ID NO:18) and JH182(5'CGAGA CTGTTGTCTCA-GAAGC3') (SEQ ID NO:19) (RIG ExonI specific) through PCR in 12.5 µl volumes as follows:
    (a) 100 µl of LB (with selective antibiotic) were dispensed into the appropriate number of 96-well plates.
    (b) Single colonies were picked and inoculated into individual wells of the 96-well plate, and the plate placed into a 37° C. incubator for 2-3 hours without shaking.
    (c) A PCR reaction "master mix" was prepared on ice, as follows:

| # of 96-Well Plates: | | | | |
|---|---|---|---|---|
| Total # of 12.5 µl PCR rxns: | 1 Plate | | | |
| 96 | 2 Plates | | | |
| 192 | 3 Plates | | | |
| 288 | 4 Plates | | | |
| 384 | | | | |
| dH20 | 755 µl | 1.47 ml | 2.20 ml | 2.94 ml |
| 5X PCR Premix-4 | 250 µl | 500 µl | 750 µl | 1.0 ml |
| F Primers premix (25 pmol/µl) | 10 µl | 20 µl | 30 µl | 40 µl |
| R Primers premix (25 pmol/µl) | 10 µl | 20 µl | 30 µl | 40 µl |
| RNace-ItCocktail | 3.2 µl | 6.3 µl | 9.6 µl | 12.8 µl |
| Taq Polymerase (5 U/µl) | 3.2 µl | 6.3 µl | 9.6 µl | 12.8 µl |
| Total Volume (ml) | 1.01 | 2.02 | 3.03 | 4.04 |

(d) 10 µl of the master mix were dispensed into each well of the PCR reaction plate.
(e) 2.5 µl from each 100 µl E. coli culture were transferred into the corresponding wells of the PCR reaction plate.
(f) PCR was performed, using typical PCR cycle conditions of:
 (i) 94° C./2 min. (Bacterial lysis and plasmid denaturation)
 (ii) 30 cycles of 92° C. denaturation for 15 sec; 60° C. primer annealing for 20 sec; and 72° C. primer extension for 40 sec.
 (iii) 72° C. final extension for S min.
 (iv) 4° C. hold.
(g) Bromophenol blue was then added to the PCR reaction; samples were mixed, centrifuged, and then the entire reaction mix was loaded onto an agarose gel.
(23) Of 200 clones screened, 78% were positive for the vector exon. 96 of these clones were grown as minipreps and purified using a Qiagen 96-well turbo-prep following the Qiagen Miniprep Handbook (April 1997).
(24) Many duplicate clones were eliminated though simultaneous digestion of 2 µl of DNA with NotI, Bam HI, XhoI, XbaI, HindIII, EcoRI in NEB Buffer 3, in a total volume of 22 µl, followed by electrophoresis on a 1% agarose gel.

Two different cDNA libraries were screened using this protocol. In the first library (TMT#1), eight of the isolated activated genes were sequenced. Of these eight genes, four genes encoded known integral membrane proteins and six were novel genes. In the second library (TMT#2), 11 isolated activated genes were sequenced. Of these 11 genes, one gene encoded a known integral membrane protein, one gene encoded a partially sequenced gene homologous to an integral membrane protein, and nine were novel genes. In all cases where the isolated gene corresponds to a characterized known gene, that gene was an integral membrane protein.

Example 8

Activation of Endogenous Genes Using a Poly(A) Trap Vector

HT1080 cells ($1 \times 10^7$ cells) were irradiated with 50 rads using a 137Cs source and electroporated with 15 µg linearized Prig-14 (SEQ ID NO:20). Following transfection, the cells were plated into a 150 mm dish at $5 \times 10^6$ cells/dish. At 24 hours, puromycin was added to 3 µg/ml. The cells were incubated at 37° C. for 12 days in the presence of 3 µl/ml puromycin. The media was replaced every 5 days. At 12 days, the number of colonies was counted, and the cells were trypsinized and replated onto a new dish. The cells were grown to 90% confluency and harvested for frozen storage and gene isolation. Typically, 1000-3000 colonies were produced per $1 \times 10^7$ cells transfected.

Example 9

Activation of Endogenous Genes Using a Dual Poly(A) Trap/SAT Vector $1 \times 10^7$ HH1 cells (HPRT-minus HT1080 cells) were irradiated with 50 rads using a 137Cs source and electroporated with 15 µl linearized pRIG-22 (SEQ ID NO:21). Following transfection, the cells were plated into a 150 mm dish at $5 \times 10^6$ cells/dish. At 24 hours, neomycin was added to 500 µg/ml G481. The cells were incubated at 37° C. for 4 days in the presence of 500 µg/ml G418. The media was replaced with fresh media containing 500 µg/ml G418 and AgThg and grown in the presence of both drugs for an additional 7 days. Alternatively, as a control for HPRT activity, the media was replaced with fresh media containing 500 µg/ml G418 and HAT (available from Life Technologies, Inc., Rockville, Md., and used at manufacturer's recommended concentration) and grown in the presence of both drugs for an additional 7 days. At 12 days post transfection, the number of colonies was counted, and the cells were trypsinized and replated onto a new dish. The cells were grown to 90% confluency and harvested for frozen storage and gene isolation. Typically, cells subjected to G418/AgThg selection produced 1000-3000 colonies per $1 \times 10^7$ cells transfected. In contrast, cells subjected to G418/HAT selection produced approximated 100 colonies per $1 \times 10^7$ cells transfected.

Example 10

Isolation of Activated Genes

Non-targeted gene activation vectors are integrated into the genome of a eukaryotic cells using the methods of the invention. By integrating the vector into multiple cells, a library is created in which cells are expressing different vector activated genes. RNA is isolated from these cells using a commercial RNA isolation kit. In this example, RNA is isolated from cells using Poly(A) Tract 1000 (Promega). The RNA is converted into cDNA, amplified, size fractionated, and cloned into a plasmid for analysis and sequencing. A brief description of this process is presented.

(1) Place 4 ml GTC Extraction buffer (Poly(A) tract 1000 Kit-Promega) in a 15 ml polycarbonate screw cap tube and add 168 µl 2-mercaptoethanol and place in a 70° C. water bath.
(2) Place 8 ml dilution buffer in a 15 ml polycarbonate screw cap tube for every pellet processed and add 168 µl 2-mercaptoethanol and place in a 70° C. water bath.
(3) Remove from −80° C. storage cell pellets ($1 \times 10^7 - 1 \times 10^8$ cells) containing non-targeted gene activation vector integrated into their genome. Pipette 4 ml GTC Extraction buffer immediately onto cell pellet. Pipette up-and-down several times until the pellet is resuspended and transfer into a 15 ml snap cap polypropylene tube.
(4) Add the 8 ml dilution buffer and mix by inversion.
(5) Add 10 µl (500 pmol) of the biotinlylated oligo dT primer and mix.
(6) Let sit at 70° C. for 5 minutes inverting every couple of minutes to ensure even heating.
(7) Centrifuge in a Sorvall HB-6 rotor at 7800 rpm (10k×g) at 25° C. for 10 minutes. During this period of time wash 6 ml Strepavidin-Paramagnetic particles (SA-PMPs) 3× with 6 ml 0.5×SSC through use of the Poly(A) Tract system 1000 magnet.
(8) After 3 washes resuspend the SA-PMPs in 6 ml 0.5× SSC.
(9) Pipette to remove the supernatant from the RNA prep and add to the resuspended SA-PMPs (Be careful when removing supernatant so that you do not disrupt the pellet).
(10) Let the SA-PMP/RNA mix and incubate for 2 minutes at room temperature.
(11) Capture the magnetic beads through use of the Poly (A) Tract system 1000 magnet. Note that it takes some time for all of the beads to pellet due to the high viscosity of the liquid.

(12) Pour off the supernatant and resuspend the beads in 1.7 ml of 0.5×SSC using a 2 ml pipette and transfer to a 2 ml screw cap tube.
(13) Capture the SA-PMPs using the magnet and remove the supernatant by pipetting with a P1000.
(14) Add 1.7 ml 0.5×SSC and invert the tube several times to mix.
(15) Repeat steps 14 and 15 two more times.
(16) Resuspend the SA-PMPs in 1 ml of nuclease free water and invert several times to mix.
(17) Capture the SA-PMPs and pipette off the mRNA.
(18) Place 0.5 ml of the mRNA into each of two siliconized eppendorf tubes and add 50 µl of DEPC-treated 3M NaOAc solution and 0.55 ml of isopropanol. Invert several times to mix and place at −20° C. for at least 4 hours.
(19) Centrifuge the mRNA for 10 minutes at max RPM (14 k).
(20) Carefully pipette off the supernatants and wash pellets with 200 µl 80% ethanol through re-centrifugation for 2 minutes at 14K RPM. Note that the pellets are often brown or tan in color. This color results from residual SA-PMPs.
(21) Remove wash and let pellets air dry for not more than 10 minutes at room temperature.
(22) Resuspend pellets in 5 µl each and combine into a single tube.
(23) Centrifuge at 14K RPM for 2 minutes to remove the residual SA-PMPs and carefully remove the mRNA.
(24) Determine the concentration of mRNA by diluting 0.5 µl into 99.5 µl water and measuring OD 260. Note that 1 OD 260=40 µg RNA.
(25) Set up first strand reaction for both the test sample and the negative control (HT1080) through the sequential addition of the following components while the PCR machine is holding at 4° C.:
Step 1: 42 µl DEPC-treated ddH20
    4 µl 0mM each dNTP
    8 µl 0.1 M DTT
    16 µl 5×MMLV 1st strand buffer
    5 µl (10 µl pmol/µl) GD.R1 (SEQ ID NO: 11)
    1 µl RNAsin (Promega)
    4 µl (1.25 µg/µl) mRNA.
Step 2: 70° C./1 min
Step 3: 42° C./hold
Step 4: After 1 minute add 2 µl SUPERSCRIPT II® (Life Technologies, Inc.; Rockville, Md.) and incubate at 37° C. for 30 min
Step 5: 94°/2 min
Step 6: 4° C./hold
Step 7: Add 2 µl RNase and incubate at 37° C. for 10 min
Step 8: 4° C./hold
(26) Analyze 8 µl of cDNA on a 1% agarose gel to check for cDNA synthesis and purify remaining cDNA using the PCR cleanup kit from Qiagen by transferring the 70 µl first strand reaction to a 1.5 ml siliconized eppendorf tube and adding 400 µl PB.
(27) Transfer to a PCR clean-up column and centrifuge 2 minutes at max RPM.
(28) Disassemble column and pour out Flow through. Add 750 µl PE and centrifuge 2 minutes at max RPM.
(29) Disassemble column and pour out Flow through then centrifuge 2 minutes at max RPM to dry resin.
(30) Elute using 50 µl of EB through transferring column to a new siliconized eppendorf tube and centrifuging for 2 minutes at max RPM.
(31) Second Strand cDNA synthesis set up at RT:

| | |
|---|---|
| H2O | 8.5 µl |
| 10× PCR buffer | 5 µl |
| 50 mM MgCl2 | 2.5 µl |
| 10 mM dNTPs | 1 µl |
| 25 pmol/µl GD.FSBio (SEQ ID NO:17) | 10 µl |
| 25 pmol/µl GD.R2 (SEQ ID NO:13) | 10 µl |

First Strand Product
Step 9: 94° C./1 min.
Step 10: 60° C./10 min.
Add 0.25 µl Taq polymerase
Step 11: 60° C./2 min.
Step 12: 72° C./10 min.
Step 13: 94° C./1 min.
Step 14: min go to "Step 11" four more times
Step 15: 60° C./2 min.
Step 16: 70° C./10 min.
Step 17: END
(32) Prepare 100l of SA-PMPs by washing 3× with STE and collection using a magnet. After the final wash, resuspend the beads in 150 µl STE.
(33) Purify the products of the second strand reaction using the PCR cleanup kit from Qiagen. Elute in 50 µl EB and add the products of the second strand reaction to 150 µl of the PMPs.
(34) Mix gently at RT for 30 minutes.
(35) After binding collect SA-PMPs through use of a magnet and recover flow 20 through material (SAVE THIS MATERIAL!)
(36) Wash the beads 3× with 500 µl STE and 1× with NEB 2 (1×).
(37) Resuspend the beads in 100 µl NEB 2 (1×).
(38) Add 2 µl SfiI and digest at 50° C. for 30 minutes with gentle mixing every 10 minutes.
(39) Recover purified cDNA through use of a magnet and carefully removing the supernatant.
(40) Transfer the products to a new tube and centrifuge at maximum RPM for 2 minutes to remove all of the beads.
(41) Set up a PCR reaction to specifically amplify RAGE activated cDNAs:

| | |
|---|---|
| H2O | 37 µl |
| 10× PCR buffer | 10 µl |
| 10 mM dNTPs | 2 µl |
| 25 pmoL/µl GDF 781* (SEQ ID NO: 22) | 10 µl |
| 25 pmol/µl GDR2 (SEQ ID NO:13) | 10 µl |

*Note GDF 781 (SEQ ID NO:22) sequence is 5'ACTCATAGGCCATAGAG-GCCTATCACAGTTAAATTGCT AACGCAG3'

Second Strand Product 25 µl
Step 1: 94° C./2 min.
Step 2: 94° C./45 sec.
Step 3: 60° C./10 min.
Add 0.5 µl Taq Polymerase
Step 4: 72° C./10 min.
Step 6: 60° C./2 min.
Step 7: 72° C./10 min.
Step 8: Cycle to step 5, 8 more times
Step 9: 94° C./45 sec.
Step 10: 60° C./2 min.

Step 11: 72° C./10 min. +20 sec each cycle
Step 12: Cycle to step 9, 14 more times
Step 13: 72° C./5 min.
Step 14: 4° C. hold

(42) Check specificity of PCR amplification of HT1080 versus library material through analysis on a 1% agarose gel. If there is a high specificity of cDNA amplification, then use Qiagen PCR clean up kit to purify PCR products.
(43) After elution of library material with 50 µl EB add 10 µl NEB2, 40 µl dH20 and 2 µl SfiI and digest for 1 hour at 50° C.
(44) Add 5 µl of 1 M NaCl and 2 µl of NotI and digest for 1 hour at 37° C.
(45) Prepare and run a 1% L.M. agarose gel and run library material on gel. After visualization of material, cut out fragments ranging in size from 500 bp to 10 Kb.
(46) Recover the library DNA from agarose using Qiaex II Gel Extraction Protocol (Qiagen) and elute DNA in 10 µl EB. Ligate 5 µl of this material to 4 µl pBS-HSB (SfiI/NotI) or pBS-SNS in a total volume of 10 µl.
(47) Transform E. coli with 0.5 µl ligated DNA per 40 µl cells.
(48) Pick colonies, grow overnight in LB, isolate plasmids.
(49) Analyze gene activated cDNA inserts by restriction digest and DNA sequencing.

Example 11

Isolation of Activated Genes from Subtracted cDNA Pools

Purified mRNAs from non-transfected HT1080 cells was prepared using the Poly-A Tract 1000 system (Promega), as described in Example 8 steps 1-24, and were biotinylated using EZ-Link™ Biotin LC-ASA reagent (Pierce), as follows:

(1) 25 µl DEPC-treated dH20 and 15 µl containing 10 µg of HT1080 mRNA was added into a siliconized microfuge tube and held on ice.
(2) Working under subdued light, 40 µl of prepared LC-ASA stock reagent (1 mg/ml in 100% ethanol) was added into the reaction tube.
(3) A UV light (365 nm wavelength) was positioned 5 cm above the microfuge tube and used to irradiate the reaction mix for 15 minutes.
(4) Unlinked biotin reagent was removed from the labeled HT1080 mRNA by passing the reaction mix through an Rnase-free MicroSpin P-30 column (BioRad), as prescribed by the manufacturer.

HT1080 cells were transfected with a poly(A) trap pRIG activation vector and grown under selective media to produce a population of drug resistant colonies, as described in Example 1. Purified mRNAs were prepared from the pooled colonies using the Promega Poly-A Tract 1000 system, as described in Example 8. First strand cDNA was prepared from 5 µg of this mRNA using oligo GD.R1 (SEQ ID NO: 11), as described in Example 8, Step 25. The reaction mix was passed through a Qiagen PCR Quick Clean-up column and the purified 1st strand cDNA was recovered in 100 µl EB.

The subtractive hybridization of biotinylated HT1080 mRNAs (subtractor population) and 1st strand cDNAs prepared from the superpool of pRIG-transfected colonies (target population) was performed as follows:

(1) 9 µg of biotinylated mRNA was added into a 0.5 ml microfuge tube containing 0.5 µg 1st strand cDNA.
(2) 1100× volume of 10 mg/ml glycogen, 1/10× volume of 3 M sodium acetate, pH 5.5, and 2.6× volume of 100% ethanol were added into the tube and mixed.
(3) The tube was placed at −80° C. for 1 hr, then spun in a refrigerated microfuge for 20 minutes.
(4) The pellet of precipitated nucleic acids was drained, washed once with 70% ethanol, then air-dried.
(5) The pellet was solvated in 5 µl HBS (50 mM HEPES, pH 7.6; 2 mM EDTA; 0.2% SDS; 500 mM NaCl) and overlayered with 5 µl light mineral oil, then heated to 95° C. for 2 minutes followed by 68° C. for 24 hours.
(6) The reaction mix was diluted with 100 µl HB (HBS without SDS) and extracted once with 100 µl chloroform to remove the oil.
(7) The diluted hybridization mix was added to 300 µl streptavidin-coated paramagnetic particles (Promega) which had been pre-washed 3×in 300 µl HB.
(8) The mix was incubated 10 minutes at room temperature and the SA-PMP's and bound Biotin-mRNA:DNA hybrids were removed from solution by magnetic capture.
(9) Steps 7 and 8 were repeated once.
(10) The cleared solution was subjected to one additional round of subtractive hybridization and magnetic removal of captured hybrids (Steps 1-9), with the following exceptions:
   Step 6: the hybridization reaction was diluted with 2×PCR Buffer (40 mM Tris-HCl, pH 8.4; 100 mM KCl).
   Step 7: PMPs were pre-washed in 1×PCR Buffer The twice-subtracted 1st strand cDNA was used to generate 2nd strand cDNA by combining 45 µl of 1st strand cDNA with 7 µl dH20, 5 µl 50 mM MgCl2, 2 µl premix of 10 mM each dNTP, 1 µl 10×PCR Buffer, 20 µl of 12.5 µmol/µl GD19F1-Bio (5' Biotin-CTCGTTTAGTGCGGCCGCT-CAG-ATCACTGAATTCTGACGACCT) (SEQ ID NO:23), 20 µl of 12.5 µmol/µl GD.R2 (SEQ ID NO:13), and 0.5 µl Taq Polymerase, with thermocycling as described in Example 8, Step 31. The second strand cDNA product was amplified and further processed for the production of an E. coli-based cDNA library, as described in Example 8, steps 32-49.

Example 12

Selective Capture of RIG-Activated Transcripts

HT1080 cells were transfected with pRIG19 (SEQ ID NO:24) activation vector and cultured for 2 weeks in selective media, as described in Example 6. Total RNA was prepared from a pellet comprised of 108 cells using TrIzol® Reagent (Life Technologies, Inc.; Rockville, Md.) following the manufacturer's protocol, and was dissolved in 720 µl of DEPC-treated dH20 (dH20DEPC). Contaminating genomic DNA was eliminated from the RNA preparation by mixing 80 µl NEB 10× Buffer 2, 8 µl Promega RNasin, and 20 µl RQ1 Promega Rnase-free DNase, incubating at 37° C. for 30 minutes, extracting sequentially with equal volumes of phenol: chlorofom (1:1) and chloroform, mixing with 1/10× volume sodium acetate (pH 5.5), precipitating the RNA with 2× volume of 100% ethanol, and solvating the dried RNA pellet in dH20DEPC to a final concentration of 4.8 µg/ul.

mRNA transcripts derived from pRIG19-activated genes were selectively captured from the pool of total cellular RNAs by mixing in a 2 ml Rnase-free microfuge tube 150 µl total RNA, 150 µl HBDEPC (50 mM HEPES, pH 7.ó; 2 mM EDTA; 500 mM NaCl), 3 µl Promega RNasin, and 2.5 µl (25 µmol/µl) oligo GD19.R1-Bio (5TCGTCAGAATTCAGT-GATCT-Biotin-3') (SEQ ID NO:25), then incubating at 70° C. for 5 minutes followed by 50° C. for 15 minutes. One ml of Promega streptavidin coated paramagnetic particles (SA-PMPs) was magnetically captured and washed 3× each with 1.5 ml of 0.5×SSC, and the SA-PMPs were left without being resuspended. The warm oligo:RNA hybridization reaction was added directly into the tube containing the semi-dry SA-PMPs. After incubating for 10 minutes at room temperature the SA-PMPs were washed 3× with 1 ml 0.5×SSC.

After the final magnetic capture, the SA-PMP's were suspended in 190 µl dH20DE; PC and incubated at 68° C. for 15 minutes. PMPs were immobilized by exposure to a magnetic and the cleared solution containing RIG-activated transcripts was transferred to a microfuge tube. 63 µl of captured RIG-activated transcript were transferred to a PCR tube where first and second strand cDNA synthesis was performed using PCR program "1+2cDNA", as follows:

Step 1: 4° C.: Add into the PCR tube containing the RIG-activated transcripts 20 µl 5× GibcoBRL RT Buffer, 1 µl Promega RNasin, 10 µl 100 mM DTT, 5 µl dNTP premix at 10 mM each, 1 µl oligo GD.R1 (SEQ ID NO:11) at 25 µmol/µl.

Step 2: 70° C./3 minutes

Step 3: 42° C./10 minutes

Step 4: Add 2.5 µl SUPERSCRIPT II (Life Technologies, Inc.) then incubate at 37° C./1 hour Step 5: 94° C./2 minutes Step 6: 4° C./hold To the 1st strand cDNA mix, 2 µl of Stratagene Rnase-II was added and the mixture was incubated at 37° C. for 15 minutes. 600 µl of Qiagen PB reagent was added to the reaction, then transferred to a Qiagen PCR clean-up column and processed according to the manufacturer's protocol. cDNA was eluted from the 10 column in 50 µl EB and transferred to a PCR tube. The second strand cDNA reaction was performed using oligos GD19.F2-Bio (5' Biotin-CTCGTT-TAGTGGCGCGCCAGATCACTGAATTCTGACGACCT) (SEQ ID NO 26) and GD.R2 (SEQ ID NO:13) as described in Example 9. The second strand product was captured on Promega SA-PMPs as described in Example 9, with the exception that the final suspension of SA-PMPs was in 1×NEB 4 Buffer and the captured cDNAs were cleaved from the particles using restriction endonuclease Asc I. Amplification of the second strand cDNA products using oligos GD19.F2 (5'GACCTACTGATTAACGGCCATA3') (SEQ ID NO: 27) and GD.R2 (SEQ ID NO: 13), digestion of the amplified cDNAs using endonucleases SfiI and NotI, and size selection of cDNAs prior to cloning were all performed as described in Example 9. The final cDNA cleanup was achieved by eluting the cDNA pool off a Qiagen PCR Cleanup column in 30 µl EB. 11 µl of cDNA was mixed with 4 µl 5× GibcoBRL Ligase Buffer, µl pGD5 vector DNA previously prepared by digestion with SfiI, NotI, and CIP. 1 µl T4 DNA Ligase was added, and the reaction mix was incubated at 16° C. overnight. 1 µl of ligation reaction was used to transform electro-competent *E. coli* DH1OB cells, which were subsequently plated on LB agar plates containing 12.5 µg/ml chloramphenicol. Typically, 60 to 80 bacterial colonies were recovered per 111 of ligation mix transformed.

Example 13

Selective Capture of RIG-Activated Transcripts

HT1080 cells were transfected with pRIG19 (SEQ ID NO:24) activation vector and cultured for 2 weeks in selective media, as described in Example 6. Total RNA was prepared from a pellet comprised of 108 cells using TRIzol® Reagent (Life Technologies, Inc.) following the manufacturer's protocol, and was dissolved in 720 µl of DEPC treated dH20 (dH20DEPC). Contaminating genomic DNA was eliminated from the RNA preparation by mixing 80 µl NEB 10× Buffer 2, 8 µl Promega RNasin, and 20 µl RQ1 Promega Rnase-free DNase, incubating at 37° C. for 30 minutes, extracting sequentially with equal volumes of phenol:chlorofom (1:1) and chloroform, mixing with ¹/₁₀× volume sodium acetate (pH 5.5), precipitating the RNA with 2× volume of 100% ethanol, and solvating the dried RNA pellet in dH20DEPC to a final concentration of 4.8 mRNA transcripts derived from pRIG19-activated genes were selectively captured from the pool of total cellular RNAs by mixing in a 2 ml Rnase-free microfuge tube 150 µl total RNA, 150 µl HBDEPC (50 mM HEPES, pH 7.6; 2 mM EDTA; 500 mM NaCl), 3 µl Promega RNasin, and 2.5 µl (25 µmol/µl) oligo GD19.R1-Bio (TCGT-CAGAATTCAGTGATCT-3' Biotin) (SEQ ID NO: 25), then incubating at 70° C. for 5 minutes followed by 50° C. for 15 minutes. One ml of Promega streptavidin coated paramagnetic particles (SA-PMPs) was magnetically captured and washed 3× each with 1.5 ml of 0.5×SSC, and the SA-PMPs were left without being resuspended. The warm oligo:RNA hybridization reaction was added directly into the tube containing the semi-dry SA-PMPs. After incubating for 10 minutes at room temperature the SA-PMPs were washed 3× with 1 ml 0.5×SSC. After the final magnetic capture the SA-PMP's were suspended in 190 µl dH20DEPC and incubated at 68° C. for 15 minutes. PMPs were immobilized by exposure to a magnetic and the cleared solution containing RIG-activated transcripts was transferred to a microfuge tube. 63 µl of captured RIG-activated transcript were transferred to a PCR tube where first and second strand cDNA synthesis was performed using PCR program "1+2CDNA", as follows:

Step 1: 4° C./hold: Add into the PCR tube containing the RIG-activated transcripts 20 µl 5× GibcoBRL RT Buffer, 1 µl Promega RNasin, 10 µl 100 mM DTT, 5 µl dNTP premix at 10 mM each, 1 µl oligo GD.R1 (SEQ ID NO: 11) at 25 µmol/µl.

Step 2: 70° C./3 minutes

Step 3: 42° C./10 minutes

Step 4: Add 2.5 µl SUPERSCRIPT II® (Life Technologies, Inc.), then incubate at 37° C./1 hour Step 5: 94° C./2 minutes Step 6: 60° C./hold; while holding temperature, the following were added: µl 50 mM MgCl2, 1 µl oligo GD19.F1-Bio (SEQ ID NO. 23) at 25 pmol/µl, and 2 µl Stratagene Rnace-It. After 10 minutes, 0.5 µl Taq DNA Polymerase (Life Technologies, Inc.) was added and the cycling was continued:

Step 7: 72° C./10 minutes

Step 8: 4° C./hold.

The 100 µl volume cDNA reaction mix was transferred to a 1.5 ml siliconized microfuge tube and extracted sequentially with equal volumes of phenol:chloroform (1:1) and chloroform, and the aqueous phase was transferred to a new tube and place in speed-vac for 5 minutes at 37° C. Restriction digestion of the cDNA was performed by adding 74 µl dH20, 20 µl NEB 10× Buffer 2, 2 µl 1 mg/ml BSA, 4 µl SfiI and incubating at 50° C. for 1 hour, then adding 10 µl 1 M NaCl, 4 µl NotI and incubating an additional 37° C. for 1 hour. The reaction mix was extracted sequentially with equal volumes of phenol:chloroform (1:1) and chloroform, then cDNAs were precipitated by adding ¹/₁₀₀× volume 10 mg/ml glycogen, ¹/₃₀× volume 3 M sodium acetate (pH 7.5), 2× volume 100% absolute ethanol, and freezing at −80° C. for 1 hour. The cDNA pellet was washed once with 70% ethanol and air dried for 15 minutes, then solvated in 5 µl dH20, 1 µl 10×NEB Ligase Buffer, 4 µl pGD5 vector DNA previously prepared by digestion with SfiI, NotI, and CIP. 0.5 µl T4 DNA Ligase was added, and the reaction mix was incubated at 16 C overnight.

10 µl dH20 was added to the ligation reaction and 0.5 µl was used to transform electro-competent *E. coli* DH10B cells. Typically, 6 to 10 colonies per µl of transformed ligation mix were observed.

Example 14

DNA Sequence Data Analysis

After the DNA sequences are determined by the Perkin-Elmer 3700 DNA sequencing workstations, individual clone sequences are masked for vector and repeat sequences using BLASTN (Altschul, Stephen F., Thomas L. Madden, Alejandro A. Schaffer, Jinghui Zhang, Zheng Zhang, Webb Miller, and David J. Lipman (1997), "Gapped BLAST and PSI-BLAST: a new generation of protein database search programs", Nucleic Acids Res. 25:3389-3402.) and xblast (Jean-Michel Clayerie, version 2.0, release date 12/92). This eliminates portions of DNA sequence that contain vector elements from the cloning process and portions of DNA that are similar to genomic repeats. These individual clone sequences are compared to existing consensus sequences in the Athersys database using BLASTN. Clone sequences are considered belonging to a given cluster if the BLASTN E-score is less than $1\times10$-25 and does not have a mismatching stretch of sequence outside of the matching region longer than a total of 60 bases on either side of the match region. All of the unmasked clone sequences of a given cluster are then formed into consensus sequences using CAP2.p70 DNA assembly software using the default parameters (Xiaoqiu Huang, version 2).

The resulting consensus sequences are masked for vector and repetitive sequences in the same way as above, and are then compared to public databases: BLASTN is used for the nonredundant nucleotide database (referred to as "nt") and the human EST database (referred to as "est_human"), and BLASTX is used for the nonredundant protein database (referred to as "nr"). These databases are kept current via ftp from the public repository at the National Center for Biotechnology Information (ftp://ftp.ncbi.nlm.nih.gov/blast/db) on at least a weekly basis. Consensus sequences are considered novel if the best hits versus both nt and 5 est_human have E-scores greater than $1\times10$-50.

The masked consensus sequences are also conceptually translated into all six reading frames (3 forward and 3 reverse) using the standard genetic translation. These translations are examined with protein analysis software. Toppred is used to look for hydrophobic regions that may indicate transmembrane domains ("Membrane Protein Structure Prediction, Hydrophobicity Analysis and the Positive-inside Rule", Gunnar von Heijne, J. Mol. Biol. (1992) 225, 487-494). EMatrix is used to look for known protein domains (Thomas D. Wu, Craig G. Nevill-Manning, and Douglas L. Brutlag, "Minimal-risk scoring matrices for sequence analysis", Journal of Computational Biology 6: 219-235, 1999.).

Example 15

Expression Profiling of Polypeptides or Proteins Encoded by Sequences of this Invention Novel genes cloned from RAGE-activated human cell libraries were analyzed by RT-PCR to determine their patterns of endogenous expression in selected human tissues, as follows: Gene specific (GS) forward and reverse PCR primers were designed for each novel gene and validated in control reactions using plasmid DNA purified from their corresponding cDNA clones. Primers were typically 24-28 nt in length, $\geq$50% G:C, and produced 200-300 bp amplification products. Control reactions were performed in 15 µl volumes containing 1×PCR buffer and 0.4 U Platinum Taq polymerase (LTI), 4 mM MgCl2, 0.23 mM dNTP's, 7.5 µmol of each GS primer, and 1 fg of plasmid template. After initial thermal denaturation at 95° C./2 min., reactions were performed by incubating at (95° C./15 sec.; 58° C./30 sec.; 72° C./40 sec) for ten cycles, (95° C./15 sec.; 63° C./30 sec.; 72° C./40 sec.) for 25 cycles, and 72° C./2 minutes. Amplification products were resolved on 2% agarose gels containing CyberGold (Molecular Probes) and visualized on a transilluminator. GS primers failing to produce the expected amplification product were redesigned. Preparations of tissue specific (TS) total RNA's purified from normal human kidney, skeletal muscle, placenta, lung, spleen, liver, heart, adipose, prostate, mammary, pancreas, thymus, brain, cerebellum, salivary gland, uterus, colon, stomach, small intestine, adrenal gland, lymph node, thyroid, bladder and fetal liver and brain tissues were purchased from Clontech.

Total RNA was purified from cultured HT1080 cells using TriZol Reagent (LTI) following the manufacturer's recommended protocol. All RNA preparations were further treated to remove contaminating genomic by mixing 20 µg RNA with a premix of 0.5× Universal Buffer (Stratagene), 0.01 mM DTT, 40 U RNAsin (Promega), 20 U RNAse-free DNAse (Stratgene) to achieve a final volume of 100 µl. Reaction mixes were incubated at 37° C./30 minutes, then extracted once with an equal volume of phenol:chloroform (1:1). Samples were centrifuged, the aqueous phases transferred to fresh tubes and RNA's were precipitated by mixing 1× volume 3M sodium acetate and 2.5× volume absolute ethanol, incubating at −80° C./30 minutes and centrifuging. RNA pellets were rinsed with 80% ethanol, air-dried, and solvated in 100 µl dH20. cDNA reactions containing reverse transcriptase (+RT) and control reactions lacking reverse transcriptase (−RT) were performed by mixing 50 µl (approx. 10 µg) of DNAse-treated RNA with 50 µl of premixed 2×1st Strand Buffer (LTI), 20 mM DTT, 1 mM dNTP's, 40 U RNAsin, 50 pmol primer GDR3V (5'TCAGACTTAGATG-GCCAACGAGGCCATTTTTTTT 1-1-1-1 TTTTT[A/C/G]3') (SEQ ID NO: 28) and either no added reverse transcriptase (−RT control reaction) or 300 U LTI SuperScript II (+RT reaction). Mixtures were chilled to 16° C./6 minutes, incubated at 37° C./60 minutes, then incubated at 92° C./2 minutes. +RT and −RT reactions were validated for the absence of contaminating genomic DNA by PCR analysis using forward primer 159F12F (5'AACCCAGCGTTGGACAAATACIT3') (SEQ ID NO:29) and reverse primer 159F12R (5'TAGCGC-CATCATTCACATAATACAT3') (SEQ ID NO:30) specific to exons 9 and 10, respectively, of human ornithine decarboxylase (ODC). PCR reaction chemistry and cycling conditions were the same as those described above. A single amplification product of 201 bp is expected from ODC cDNA, whereas an amplification product of 220 bp generated from the +RT cDNA reaction and/or −RT control reaction is diagnostic for the persistence of contaminating genomic DNA, and such cDNA samples were typically remade. Validated GS primers and a panel of 22 TS cDNA preparations were used in PCR analysis to determine expression profiles for each novel gene by adding 0.5 µg of cDNA into a premix containing 1×PCR buffer, 0.23 mM dNTP's, 4 mM MgCl2, 7.5 µmol each of forward and reverse GS primer, and 0.4 U Platinum Taq polymerase at a final reaction volume of 15 µl. Conditions for PCR cycling and the detection of amplification products were the same as those described above.

Example 16

Ion Channel Proteins

Ion channels in mammalian systems have been, and currently are, the subject of intensive scientific investigation because of the importance and variety of their biochemical functions. Ion channels are now understood to be polypeptide or protein structures with tertiary-quaternary structure forming interior pores embedded in cell membrane walls, that control the flow of ionic currents.

There are many types of ion channels which share both similarity of function and amino acid sequence, thus defining familial relationships between many of these channels. Current work shows there are ion channel families comprised of voltage gated sodium, potassium, and calcium channels, as well as the ligand gated acetylcholine receptors, glycine receptors, and γ aminobutyric acid receptors.

Sequences identified according to the methods described herein as encoding ion channel and related polypeptides are depicted in tables 2, 11, 12, and 18. SEQ ID NOS. corresponding to the cluster identifiers are depicted in table 26.

For example, sequences included within cluster ID 53, shown in table 2, are depicted in Table 26 and indicated with decimal points, e.g., 53.1 and 53.2. The SEQ ID NOS corresponding to each sequence are noted in Table 26, and the nucleic acid sequences are set forth in Appendix I. One of ordinary in the skill in the art can easily determine the correlation between cluster IDs and the sequences corresponding to these clusters by referring to the tables and examples provided herein.

The tissue expression profiles of these ion channel and related polypeptides are depicted in table 1 and table X, respectively.

The homology between polynucleotides and polypeptides of this invention and the members of this class of proteins indicates that polynucleotides and polypeptides of this invention are useful for detection/treatment of number of disease states that are associated with ion channel and related polypeptides as described herein.

Preferred ion channel and related polypeptides identified according to the methods of this invention are exemplified in tables 28 and 29, for example, and are classified by cluster ID NOS: 17,593; 17,714; and 17,901 (Table 28), and cluster ID NOS: 390; 1,987; 7,404; 7,754; 11189; 11,829; 14,822; 15,585; 18, 988 19,201; 19,043; 19,054; 20,981; 21,027; 21,027 (Table 29).

The corresponding tissue expressions of these polypeptides are shown in table 1 and table X, respectively.

Examples of translated amino acid sequences for several of the preferred polypeptides of this invention are included in Table 26 and their amino acid sequences in Appendix II.

References identifying the closest homologues to these preferred sequences are also set forth in Tables 28 and 29 and these patents and publications are specifically incorporated by reference herein.

Example 17

G-Protein Coupled Receptor Proteins

G protein coupled receptor proteins have a very important role as targets for molecules such as hormones, neurotransmitters and physiologically active substances. These molecules control, regulate or adjust the functions of living bodies. Each molecule has its own receptor protein which is specific thereto, whereby the specificities of individual physiologically active substances, including specific target cells and organs, specific pharmacological actions, specific action strength, action time, etc., are decided. Accordingly, it has been believed that, if G protein coupled receptor genes or cDNA can be cloned, those will be helpful not only for the clarification of structure, function, physiological action, etc. of the G protein coupled receptor but also for the development of pharmaceuticals by investigating the substances which act on the receptor.

Sequences identified according to the methods described herein as encoding G-protein coupled receptor and related polypeptides are depicted in tables 5 and 13. SEQ ID NOS. corresponding to the cluster identifiers are depicted in table 26.

For example, sequences included within cluster ID 1676, shown in table 5, are depicted in Table 26 and indicated with decimal points, e.g. 1676.1. The SEQ ID NOS corresponding to each sequence are noted in Table 26, and the nucleic acid sequences are set forth in Appendix I. One of ordinary in the skill in the art can easily determine the correlation between cluster IDs and the sequences corresponding to these clusters by referring to the tables and examples provided herein.

The tissue expression profiles of these ion channel and related polypeptides are depicted in table 1 and table X, respectively.

The homology between polynucleotides and polypeptides of this invention and the members of this class of proteins indicates that polynucleotides and polypeptides of this invention are useful for detection/treatment of number of disease states that are associated with G-protein coupled receptor and related polypeptides as described herein.

Preferred G-protein coupled receptor and related polypeptides identified according to the methods of this invention are exemplified in tables 28 and 29, for example, and are classified by cluster ID NOS: 1,676; 8,059; 10,277; and 21,340 (Table 28) and cluster ID NOS: 6,635; 17,762; 3,778; 11,507; 20,734; 2,709; 20, 988; 15,580; 4,325; 12,169; 12,977; and 12,978 (Table 29).

The corresponding tissue expressions of these polypeptides are shown in table I and table X, respectively.

Examples of translated amino acid sequences for several of the preferred polypeptides of this invention are included in Table 26 and their amino acid sequences in Appendix II.

References identifying the closest homologues to these preferred sequences are also set forth in Tables 28 and 29 and these patents and publications are specifically incorporated by reference herein.

Example 18

Protein Kinases and Phosphatases

Protein kinases and phosphatases have the ability to regulate many cellular processes through catalyzing the addition and removal of phosphate groups to proteins. These molecules are classified by the amino acid that they phosphorylate on their targets, the two major types being protein tyrosine kinases and protein serine/threonine kinases. These enzymes can exist as cytoplasmic proteins that can interact with receptor or adaptor proteins or with other kinase or phosphatase molecules to transduce intracellular signals or they can be an integral cytoplasmic domain of transmembrane receptors. Protein kinase and phosphatase receptors are capable of translating a signal across the cellular membrane by a ligand binding to the extracellular region of the receptor, which thereby induces activation of the enzymatic domain lying in the intracellular region. This activation then generally leads to either the modification of the phosphorylation state of a second messenger to change its biological activity, or the triggering of a cascade of kinase phosphorylation that alters multiple protein functions to affect cell biology and gene expression. The signal is potentiated from the outside of a cell, across the plasma membrane, eventually influencing intracellular events through the transfer of phosphate groups. The protein kinase and phosphatase receptors include many of the growth factor receptors (e.g. epidermal growth factor, fibroblast growth factor, nerve growth factor, insulin, and transforming growth factor and many cell adhesions and other receptors).

Sequences identified according to the methods described herein as encoding Protein kinases and phosphatases and related polypeptides are depicted in table 6. SEQ ID NOS. corresponding to the cluster identifiers are depicted in table 26.

For example, sequences included within cluster ID 12851, shown in table 6, are depicted in Table 26 and indicated with decimal points, e.g. 12851.145. The SEQ ID NOS corresponding to each sequence are noted in Table 26, and the nucleic acid sequences are set forth in Appendix I. One of ordinary in the skill in the art can easily determine the correlation between cluster IDs and the sequences corresponding to these clusters by referring to the tables and examples provided herein.

The tissue expression profiles of these protein kinases and phosphatases and related polypeptides are depicted in table I and table X, respectively.

The homology between polynucleotides and polypeptides of this invention and the members of this class of proteins indicates that polynucleotides and polypeptides of this invention are useful for detection/treatment of number of disease states that are associated with protein kinases and phosphatases and related polypeptides as described herein.

Preferred protein kinases and phosphatases and related polypeptides identified according to the methods of this invention are exemplified in tables 28 and 29, for example, and are classified by cluster ID NOS: 3,134; 7,456; 14,845 and 16,194 (Table 28) and cluster ID NOS: 9,197; 14,720; 22,802; 21,817; and 18,485 (Table 29).

The corresponding tissue expression of these polypeptides is shown in table 1 and table X, respectively.

Examples of translated amino acid sequences for several of the preferred polypeptides of this invention are included in Table 26 and their amino acid sequences in Appendix II.

References identifying the closest homologues to these preferred sequences are also set forth in Tables 28 and 29 and these patents and publications are specifically incorporated by reference herein.

Example 19

Transmembrane Proteins

Cell membranes regulate the passage of materials into and out of a cell, a function which makes it possible to maintain the structural and functional integrity of the cell. It has long been recognized that the basic structure of cell membranes consist of a lipid bilayer having proteins embedded throughout. Proteins contribute to the structural strength of the membrane, act as enzymes to promote chemical reactions, act as carriers for the transport of substances through the membrane and provide breaks in the lipid bilayer so as to form pores through the membrane. Membranes of various cell types differ in biological function largely due to the different kinds of proteins embedded in the lipid bilayer.

Proteins may be embedded in the outer (exofacial) surface of the lipid bilayer, or in the inner (endofacial) surface of the lipid bilayer. Other proteins pass through the lipid bilayer and are exposed on both the inner (i.e., intracellular or cytoplasmic) surface and the outer (i.e., extracellular) surface of the membrane. Still other proteins are more loosely bound to one surface of the membrane or both, depending on the membrane. A number of protein enzymes are either dissolved in the cell membrane or are adherent to it. Many of these enzymes are present on the intracellular surface of the membrane and function at the boundary between the inner surface of the membrane and the cytoplasm to catalyze chemical reactions.

Sequences identified according to the methods described herein as encoding transmembrane proteins and related polypeptides are depicted in tables 9 and 25. SEQ ID NOS. corresponding to the cluster identifiers are depicted in table 26. For example, sequences included within cluster ID 13311, shown in table 25, are depicted in Table 26 and indicated with decimal points, e.g., 13311.30, 13311.31, and 13311.32. The SEQ ID NOS corresponding to each sequence are noted in Table 26, and the nucleic acid sequences are set forth in Appendix I. One of ordinary in the skill in the art can easily determine the correlation between cluster IDs and the sequences corresponding to these clusters by referring to the tables and examples provided herein.

The tissue expression profiles of these transmembrane proteins and related polypeptides are depicted in table 1 and table X, respectively.

The homology between polynucleotides and polypeptides of this invention and the members of this class of proteins indicates that polynucleotides and polypeptides of this invention are useful for detection/treatment of number of disease states that are associated with transmembrane proteins and related polypeptides as described herein.

Preferred transmembrane proteins and related polypeptides identified according to the methods of this invention are exemplified in tables 28 and 29, for example, and are classified by cluster ID NOS: 2,327; 2,446; 4,603; 4,921; 4991; 6961; 8,147; 16,669; 17,007; 17,176; and 17,603 (Table 28) and cluster ID NOS: 11831; and 20,799 (Table 29).

The corresponding tissue expression of these polypeptides is shown in table 1 and table X, respectively.

Examples of translated amino acid sequences for several of the preferred polypeptides of this invention are included in Table 26 and their amino acid sequences in Appendix II.

References identifying the closest homologues to these preferred sequences are also set forth in Tables 28 and 29 and these patents and publications are specifically incorporated by reference herein.

Example 20

Secreted Proteins

Many biologically important molecules, in particular for use in therapy, are secreted proteins. For example, growth factors, interferons, erythropoietin, and insulin have been used successfully for treating various conditions and diseases.

Secreted proteins are characterized by the presence of a hydrophobic signal peptide at the amino terminus of the protein. The hydrophobic signal sequence is typically from about 16 to about 30 amino acids long and contains one or more positively charged amino acid residues near its N-terminus, followed by a continuous stretch of 6-12 hydrophobic residues. Signal peptides from various secreted proteins have otherwise no sequence homology. The presence of a hydrophobic signal peptide at the amino terminus of a protein mediates its association with the rough endoplasmic reticulumn (ER), which in turn mediates its secretion from the cell.

The mechanism by which peptides or proteins having a signal peptide associate with the endoplasmic reticulumn and are secreted is as follows. Protein synthesis begins on free ribosomes. When the elongating peptide is about 70 amino acids long, the signal peptide is recognized by a particle, termed a "signal recognition particle" or "SRP", which in turn is capable of interacting with a receptor, termed "SRP receptor", located on the ER. Thus, growing peptides having a signal peptide are targeted to the ER, where peptide synthesis continues on the rough ER. At some point during the protein synthesis or after the protein synthesis is completed, the protein is translocated across the ER membrane into the ER lumen, where the signal peptide is cleaved off. There the protein can be postranslationally modified, e.g., glycosylated. Whether posttranslationally modified or not, the protein can then be directed to the appropriate cellular compartment, e.g., secreted outside the cell.

Sequences identified according to the methods described herein as encoding secreted proteins and related polypeptides are depicted in tables 10 and 24. SEQ ID NOS. corresponding to the cluster identifiers are depicted in table 26.

For example, sequences included within cluster ID 14853, shown in table 10, are depicted in Table 26 and indicated with decimal points, e.g., 14853.30, 14853.31, and 14853.32. The SEQ ID NOS corresponding to each sequence are noted in Table 26, and the nucleic acid sequences are set forth in Appendix I. One of ordinary in the skill in the art can easily determine the correlation between cluster IDs and the sequences corresponding to these clusters by referring to the tables and examples provided herein.

The tissue expression profiles of these secreted proteins and related polypeptides are depicted in table 1 and table X, respectively.

The homology between polynucleotides and polypeptides of this invention and the members of this class of proteins indicates that polynucleotides and polypeptides of this invention are useful for detection/treatment of number of disease states that are associated with secreted proteins and related polypeptides as described herein.

Preferred secreted proteins and related polypeptides identified according to the methods of this invention are exemplified in tables 28 and 29, for example, and are classified by cluster ID NOS: 1,361; and 2,692 (Table 28) and cluster ID NOS: 842; 2,360; 2,438; and 17,724 (Table 29).

The corresponding tissue expression of these polypeptides is shown in table 1 and table X, respectively.

Examples of translated amino acid sequences for several of the preferred polypeptides of this invention are included in Table 26 and their amino acid sequences in Appendix II.

References identifying the closest homologues to these preferred sequences are also set forth in Tables 28 and 29 and these patents and publications are specifically incorporated by reference herein.

Example 21

Proteases

Proteases are enzymes that cleave a peptide bond found within a polypeptide chain, thereby mediating physiologically important processing events. Based on their catalytic activities and the amino acid residues essential for directing this function, these enzymes can be arranged into four mechanistic classes. These molecules are classified as serine proteases, cysteine proteases, aspartic proteases, and metalloproteases. Within the serine protease group lies thrombin, chymotrypsin, trypsin, and elastase. The cysteine family includes lysosomal cathepsins, the caspases involved in the proteolytic implementation of apoptosis and the cytosolic calpains. Examples of aspartic proteinases are digestive enzymes such as pepsin and chymosin, lysosomal cathepsins D, and the renin processing enzyme. Metallo proteinases contain a catalytically active metal atom (e.g. zinc) and include, for example, thermolysin. Physiological processes involving remodelling of the extracellular matrix, such as wound healing, embryogenesis, angiogenesis, and the female reproductive cycle, require the activity of matrix metalloproteinases.

Sequences identified according to the methods described herein as encoding proteases and related polypeptides are depicted in tables 7, 16, and 22. SEQ ID NOS. corresponding to the cluster identifiers are depicted in table 26.

For example, sequences included within cluster ID 2, shown in table 16, are depicted in Table 26 and indicated with decimal point, e.g., 2.1. The SEQ ID NOS corresponding to each sequence are noted in Table 26, and the nucleic acid sequences are set forth in Appendix I. One of ordinary in the skill in the art can easily determine the correlation between cluster IDs and the sequences corresponding to these clusters by referring to the tables and examples provided herein.

The tissue expression profiles of these proteases and related polypeptides are depicted in table 1 and table X, respectively.

The homology between polynucleotides and polypeptides of this invention and the members of this class of proteins indicates that polynucleotides and polypeptides of this invention are useful for detection/treatment of number of disease states that are associated with proteases and related polypeptides as described herein.

Preferred proteases proteins and related polypeptides identified according to the methods of this invention are exemplified in tables 28 and 29, for example, and are classified by cluster ID NOS: 1,361; and 13,406; and 14,805 (Table 28) and cluster ID NOS: 5,881; and 6,083 (Table 29).

The corresponding tissue expression of these polypeptides is shown in table 1 and table X, respectively.

Examples of translated amino acid sequences for several of the preferred polypeptides of this invention are included in Table 26 and their amino acid sequences in Appendix II.

References identifying the closest homologues to these preferred sequences are also set forth in Tables 28 and 29 and these patents and publications are specifically incorporated by reference herein.

Example 22

Protease Inhibitors

Protease inhibitor activities were first noted in human plasma by Fermi and Pemossi in 1894. Many investigations have been made to determine the various inhibitory activities present in plasma primarily by adding proteases of varying specificities and catalytic mechanisms to plasma. There are now recognized at least nine separate, well-characterized proteins in human plasma which share the ability to inhibit the activity of various proteases. Several of the inhibitors have been grouped together, namely .α.-1-proteinase inhibitor, antithrombin III, antichymotrypsin, C1-inhibitor and α.-2-antiplasmin. These are referred to as the .α.-1-proteinase inhibitor class. The protein α.-2-macroglobulin inhibits members of all four catalytic classes: serine, cysteine, aspartic, and metalloproteases. However, the other types of protease inhibitors are class specific. The α.-1-proteinase inhibitor group and inter-a-trypsin inhibitor inhibit only serine proteases, α-1-cysteine protease inhibitor inhibits only cysteine proteases, and α-1-anticollagenase inhibits only collagenolytic enzymes of the metalloenzyme class. A.-1-Proteinase inhibitor (antitrypsin, AT) is a glycoprotein of MW 51,000 with 394 amino acids and 3 oligosaccharide side chains and is present in human serum at 130 mg/100 ml or 23.6 µM. It easily diffuses into tissue spaces and forms a 1:1 complex with a target protease, principally neutrophil elastase. The enzyme/inhibitor complex is then removed from circulation and catabolized by the liver and spleen. Human AT was originally named anti-trypsin because of its ability to inactivate pancreatic trypsin. Interest has focused on AT in both clinical and biochemical circles because many individuals with circulating levels of this inhibitor that are less than 15% of normal are susceptible to the development of lung disease (familial emphysema) at an early age. Therefore, it appears that this inhibitor represents an important part of the defense mechanism of the lung towards attack by proteases.

Sequences identified according to the methods described herein as encoding proteases inhibitors and related polypeptides are depicted in table 15. SEQ ID NOS. corresponding to the cluster identifiers are depicted in table 26.

For example, sequences included within cluster ID 127, shown in table 15, are depicted in Table 26 and indicated with decimal point, e.g., 127.1. The SEQ ID NOS corresponding to each sequence are noted in Table 26, and the nucleic acid sequences are set forth in Appendix I. One of ordinary in the skill in the art can easily determine the correlation between cluster IDs and the sequences corresponding to these clusters by referring to the tables and examples provided herein.

The tissue expression profiles of these proteases inhibitors and related polypeptides are depicted in table 1 and table X, respectively.

The homology between polynucleotides and polypeptides of this invention and the members of this class of proteins indicates that polynucleotides and polypeptides of this invention are useful for detection/treatment of number of disease states that are associated with proteases inhibitors and related polypeptides as described herein.

Preferred protease inhibitors and related polypeptides identified according to the methods of this invention are exemplified in tables 28 and 29, for example, and are classified by cluster ID NO: 5,981 (Table 28) and cluster ID NO: 20,194 (Table 29).

The corresponding tissue expressions of these polypeptides are shown in table 1 and table X, respectively.

Examples of translated amino acid sequences for several of the preferred polypeptides of this invention are included in Table 26 and their amino acid sequences in Appendix II.

References identifying the closest homologues to these preferred sequences are also set forth in Tables 28 and 29 and these patents and publications are specifically incorporated by reference herein.

Example 23

Growth Factors

Growth factors are important for normal developmental processes, as well as for healing of wounds. Their abnormal expression has been implicated in neoplasia and other proliferative disorders. Growth factors are important for normal developmental processes, as well as healing of wounds. Growth factors are involved in signaling pathways that influence normal cellular differentiation. These proteins cause cells in the resting phase (Go) to enter and progress through the cell cycle. oncogenic mutations in several growth factors result in unregulated cell growth. Tumor suppressor genes are genes expressed in normal cells that play regulatory roles in cell proliferation, differentiation and other cellular events. Loss or inactivation of these genes is oncogenic. Tumor suppressor genes that have been extensively characterized include the genes for colon carcinoma, retinoblastoma, type 2 neurofibromatosis, the genes involved in Wilms tumor and the p53 gene. Tumor suppressor genes are involved in cell cycle control, signal transduction, angiogenesis, and development.

Sequences identified according to the methods described herein as encoding growth factor and related polypeptides are depicted in table 17. SEQ ID NOS. corresponding to the cluster identifiers are depicted in table 26.

For example, sequences included within cluster ID 45, shown in table 17, are depicted in Table 26 and indicated with decimal point, e.g., 45.1, 45.2, and 45.3. The SEQ ID NOS corresponding to each sequence are noted in Table 26, and the nucleic acid sequences are set forth in Appendix I. One of ordinary in the skill in the art can easily determine the correlation between cluster IDs and the sequences corresponding to these clusters by referring to the tables and examples provided herein.

The tissue expression profiles of these growth factor and related polypeptides are depicted in table 1 and table X, respectively.

The homology between polynucleotides and polypeptides of this invention and the members of this class of proteins indicates that polynucleotides and polypeptides of this invention are useful for detection/treatment of number of disease states that are associated with growth factors and related polypeptides as described herein.

Preferred growth factors and related polypeptides identified according to the methods of this invention are exemplified in tables 28 and 29, for example, and are classified by cluster ID NOS: 2,163; 8,188; and 14,891 (Table 28) and cluster ID NOS 21,386 (Table 29).

The corresponding tissue expressions of these polypeptides are shown in table 1. References identifying the closest homologues to these preferred sequences are also The corresponding tissue expression of these polypeptides are shown in table 1 and table X, respectively.

Examples of translated amino acid sequences for several of the preferred polypeptides of this invention are included in Table 26 and their amino acid sequences in Appendix II.

References identifying the closest homologues to these preferred sequences are also set forth in Tables 28 and 29 and these patents and publications are specifically incorporated by reference herein.

Example 24

Cytoskeletal Proteins

Cytoskeletal proteins are major constituent of the cytoskeleton found in the cytoplasm of eukaryotic cells. They form a flexible framework for the cell, provide attachment points for organelles and formed bodies, and make communication between parts of the cell possible.

Individual cells carry out mechanical activities such as locomotion, phagocytosis, and division. In these and other processes the cell must maintain its shape under imposed stresses or change its shape to move or do work. Similarly, cells in tissues exert forces which establish the organization and mechanical characteristics of the extracellular matrix in which they are embedded. Both cells and matrix contribute to the mechanical properties of tissues. The mechanical properties and functions of cells are governed mainly by the cytoskeleton. The organization of cytoskeletal actin filaments, microtubules, and intermediate filaments is determined by proteins which modulate the lengths of the filaments, their interactions with each other, and their anchorage to other cellular structures.

Sequences identified according to the methods described herein as encoding cytoskeletal proteins and related polypeptides are depicted in tables 3 and 19. SEQ ID NOS. corresponding to the cluster identifiers are depicted in table 26.

For example, sequences included within cluster ID 17422, shown in table 3, are depicted in Table 26 and indicated with decimal point, e.g., 17422.3. The SEQ ID NOS corresponding to each sequence are noted in Table 26, and the nucleic acid sequences are set forth in Appendix I. One of ordinary in the skill in the art can easily determine the correlation between cluster IDs and the sequences corresponding to these clusters by referring to the tables and examples provided herein.

The tissue expression profiles of these cytoskeletal proteins and related polypeptides are depicted in table 1 and table X, respectively.

The homology between polynucleotides and polypeptides of this invention and the members of this class of proteins indicates that polynucleotides and polypeptides of this invention are useful for detection/treatment of number of disease states that are associated with cytoskeletal proteins and related polypeptides as described herein.

Preferred cytoskeletal proteins and related polypeptides identified according to the methods of this invention are exemplified in tables 28 and 29, for example, and are classified by cluster ID NO: 2,322; 15,873; and 16,369 (Table 28) and cluster ID NOS: 6,565; 6,767; 9,518; 20,189; 12345; 12067; 8,054; 9,660; 1,144; 14,282; 53; 17,964; 19,115; 20,188 (Table 29).

The corresponding tissue expressions of these polypeptides are shown in table 1 and table X, respectively.

Examples of translated amino acid sequences for several of the preferred polypeptides of this invention are included in Table 26 and their amino acid sequences in Appendix II.

References identifying the closest homologues to these preferred sequences are also set forth in Tables 28 and 29 and these patents and publications are specifically incorporated by reference herein.

Example 25

Proteins Involved in Protein-Protein Interactions

Proteins and protein-protein interactions play a central role in the various essential biochemical processes. For example, these interactions are evident in the interaction of hormones with their respective receptors, in the intracellular and extracellular signaling events mediated by proteins, in enzyme substrate interactions, in intracellular protein trafficking, in the formation of complex structures like ribosomes, viral coat proteins, and filaments, and in antigen-antibody interactions. These interactions are usually facilitated by the interaction of small regions within the proteins that can fold independently of the rest of the protein. These independent units are called protein domains. Abnormal or disease states can be the direct result of aberrant protein-protein interactions. For example, oncoproteins can cause cancer by interacting with and activating proteins responsible for cell division. Protein-protein interactions are also central to the mechanism of a virus recognizing its receptor on the cell surface as a prelude to infection.

Sequences identified according to the methods described herein as encoding protein-protein interaction proteins and related polypeptides are depicted in tables 8 and 23. SEQ ID NOS. corresponding to the cluster identifiers are depicted in table 26.

For example, sequences included within cluster ID 7456, shown in table 8, are depicted in Table 26 and indicated with decimal point, e.g., 7456.51. The SEQ ID NOS corresponding to each sequence are noted in Table 26, and the nucleic acid sequences are set forth in Appendix I. One of ordinary in the skill in the art can easily determine the correlation between cluster IDs and the sequences corresponding to these clusters by referring to the tables and examples provided herein.

The tissue expression profiles of these protein-protein interaction proteins and related polypeptides are depicted in table 1 and table X, respectively.

The homology between polynucleotides and polypeptides of this invention and the members of this class of proteins indicates that polynucleotides and polypeptides of this invention are useful for detection/treatment of number of disease states that are associated with protein-protein interaction proteins and related polypeptides as described herein.

Preferred protein-protein interaction proteins and related polypeptides identified according to the methods of this invention are exemplified in tables 28 and 29, for example, and are classified by cluster ID NO: 14,030; and 18,557 (Table 28) and cluster ID NOS: 782; 1,599; 3,286; 4,782; 6,407; 8,518; 14,075; 3,582; 12,408; 20,244; 16,485; 11,339; 15,130; 10,621; 15,909; 5,347; 4,368; 10,119; 15,912; 8,233; 885; 5,435; 16,888; 7,452; 1,473; 1,823 14,726; 18,684; 18,762; 20,463; and 21,252 (Table 29).

The corresponding tissue expressions of these polypeptides are shown in table 1 and table X, respectively.

Examples of translated amino acid sequences for several of the preferred polypeptides of this invention are included in Table 26 and their amino acid sequences in Appendix II.

References identifying the closest homologues to these preferred sequences are also set forth in Tables 28 and 29 and these patents and publications are specifically incorporated by reference herein.

Example 26

Proteins Involved in Transcription or Translation

Proteins that bind sequence-specifically to DNA determine which genetic messages will be expressed and in what quantity. In both prokaryotes and eukaryotes, proteins having affinity for specific sites on DNA modulate transcriptional expression of genes. Through direct interaction with DNA at specific sites in genes, certain proteins called repressors hinder transcription by making the DNA inaccessible to RNA polymerase. Other DNA-binding proteins and some multifunctional repressors are activators which allow RNA polymerase to initiate transcription with increased efficiency. The regulation of gene transcription and translation is the major process by which a cell controls the appropriate expression of the large number of genes necessary for growth, development and differentiation. Controlled expression of genes with the proper timing and cell specificity is a highly specialized process in the cells of multi cellular organisms. The intricate regulation of gene expression drives the cell differentiation needed to provide the specialized functions required for multicellular life, and permits a greater repertoire of responses to environmental change. The regulation of transcription is implemented by the interaction of numerous proteins that possess distinct biochemical functions with each other, and with the DNA and chromatin of transcribed genes. The symptoms or causes of many diseases are rooted in the consequences of the dysfunctional regulation of gene expression, and the various proteins that control gene expression are potential gene therapeutics and targets for drugs that affect their function.

Sequences identified according to the methods described herein as encoding DNA binding proteins and related polypeptides are depicted in tables 4 and 20. SEQ ID NOS. corresponding to the cluster identifiers are depicted in table 26.

For example, sequences included within cluster ID 23867, shown in table 4, are depicted in Table 26 and indicated with decimal point, e.g., 23867.30. The SEQ ID NOS corresponding to each sequence are noted in Table 26, and the nucleic acid sequences are set forth in Appendix I. One of ordinary in the skill in the art can easily determine the correlation between cluster IDs and the sequences corresponding to these clusters by referring to the tables and examples provided herein.

The tissue expression profiles of these DNA binding protein interaction proteins and related polypeptides are depicted in table I and table X, respectively. The homology between polynucleotides and polypeptides of this invention and the members of this class of proteins indicates that polynucleotides and polypeptides of this invention are useful for detection/treatment of number of disease states that are associated with DNA binding protein interaction proteins and related polypeptides as described herein.

Preferred DNA binding proteins and related polypeptides identified according to the methods of this invention are exemplified in tables 28 and 29, for example, and are classified by cluster ID NO: 12,692; and 14,102 (Table 28) and cluster ID NO: 12,851 (Table 29).

The corresponding tissue expressions of these polypeptides are shown in table 1 and table X, respectively.

Examples of translated amino acid sequences for several of the preferred polypeptides of this invention are included in Table 26 and their amino acid sequences in Appendix II.

References identifying the closest homologues to these preferred sequences are also set forth in Tables 28 and 29 and these patents and publications are specifically incorporated by reference herein.

Example 27

Receptor Proteins (Includes Non-GPCR Related Sequences)

Receptors are broadly distributed in the body and they exert very important pleiotropic functions in different systems. Receptors are composed of extracellular, intracellular, and transmembrane polypeptide domains. Receptors are incorporated into the cell's membranes to permit the detection of exogenous chemical and physical stimuli that interact with the receptor. Detection of these environmental stimuli induces a change in the receptor that can be communicated to other proteins that are associated with the cell to influence cell function. Receptor mediated signaling in response to environmental stimuli can take the form of receptor mediated alterations in the flux of ions or other small molecules across the cell membranes, receptor induced changes in the pattern or magnitude of enzymatically catalyzed covalent protein modification (e.g. phosphorylation or dephosphorylation of cellular substrates), receptor induced changes in the enzymatic generation or degradation of small molecule second messengers (e.g. cAMP, cGMP, Ca~ or inositol triphosphate) or alteration in the association of the receptor with accessory proteins (e.g., peripheral membrane proteins, cytoskeletal proteins, or other adaptor proteins). Interaction of the activated receptor with these accessory proteins activates the signaling function of the complex to implement enzymatic protein modification or altered protein associations that directly or through additional signaling intermediates serves to influence cell structure, replication, metabolism and gene expression. Combination of these signaling mechanisms is often an important aspect of signaling. For example, activated receptors can bind or covalently modify a accessory protein or protein complex (including other receptors or ion channels) to change their function (e.g. changing small molecule flux through a channel, enzymatic activity or ability of the accessory proteins to associate with other molecules) and the altered function of these signaling partners can be the mechanism by which receptor detected stimuli are transduced into signals that alter cell biochemistry.

Sequences identified according to the methods described herein as encoding receptor proteins (including G-protein coupled receptor proteins) and related polypeptides are depicted in table 14. SEQ ID NOS. corresponding to the cluster identifiers are depicted in table 26.

For example, sequences included within cluster ID 45, shown in table 14, are depicted in Table 26 and indicated with decimal point, e.g., 45.1, 45.2, 45.3, and 45.4. The SEQ ID NOS corresponding to each sequence are noted in Table 26, and the nucleic acid sequences are set forth in Appendix I. One of ordinary in the skill in the art can easily determine the correlation between cluster IDs and the sequences corresponding to these clusters by referring to the tables and examples provided herein.

The tissue expression profiles of these receptor proteins (including G-protein coupled receptor proteins) and related polypeptides are depicted in table 1 and table X, respectively.

The homology between polynucleotides and polypeptides of this invention and the members of this class of proteins indicates that polynucleotides and polypeptides of this invention are useful for detection/treatment of number of disease states that are associated with receptor proteins (including G-protein coupled receptor proteins) and related polypeptides as described herein.

Preferred receptor proteins (including G-protein coupled receptor proteins) and related polypeptides identified according to the methods of this invention are exemplified in tables 28 and 29, for example, and are classified by cluster ID NOS: 6,539; 12,155; 14,760; 14,853; 17,644 and 22,667 (Table 28) and cluster ID NOS: 4,819; 16,890; 9,712; 10,714; 11,875; 21,353; and 13,348 (Table 29).

The corresponding tissue expressions of these polypeptides are shown in table I and table X, respectively.

Examples of translated amino acid sequences for several of the preferred polypeptides of this invention are included in Table 26 and their amino acid sequences in Appendix II.

References identifying the closest homologues to these preferred sequences are also set forth in Tables 28 and 29 and these patents and publications are specifically incorporated by reference herein.

Example 28

Identification of Protein or Nucleic Acid Activity

The EST-related nucleotides, fragments, positional segments, fragments of positional segments of EST-related nucleotides, nucleic acids encoding the EST related polypeptides, encoding positional segments, or those encoding fragments of EST-related positional segments can be cloned into expression vectors such as, but not limited to, the mammalian expression vectors pXT1 (Stratagene) and pSG5 (Stratagene), or left in the expression vectors from which they were isolated from. Upon purification, isolation and enrichment these expressed polypeptides or proteins can be labeled using techniques known to those skilled in the art. These polypeptides or proteins can then be incubated with cells or cell lines that have been derived from various tissues or organs, allowing the labeled polypeptide time to bind to its associated receptor on the surface of the cell. These cells are then washed, removing non-specifically bound polypeptides, the specifically bound labeled polypeptides being detected via autoradiography. Unlabeled proteins may also be used in this assay. In this instance, the unlabeled polypeptide or protein may be incubated with cells or cell lines that have been derived from various tissues or organs. Detection of binding can then be made via antibodies having a detectable label, such as, without limitation, a fluorescent molecule.

Cell surface binding may also be analyzed through competition analysis. In this assay, various amounts of unlabeled polypeptide or protein are incubated with a labeled polypeptide or protein. Inversely, as the amount of competitive unlabeled polypeptide or protein increases, the amount of labeled polypeptide or protein bound to the cell surface decreases. A varying quantity of unlabeled polypeptide and protein is added to some of these mixtures as a control. It is a good indication that the polypeptide binds to the cell surface when the amount of labeled polypeptide or protein that remains bound to the cell surface does not decrease in binding reactions that contain increasing levels of unrelated, unlabeled polypeptide or protein.

As discussed previously, a polynucleotide or polypeptide of this invention may have cell proliferation or differentiation activity. To this end, such activity may be evidenced by a number of factor dependent cell proliferation assays for cell lines including, but not limited to, 32D, DA2, DAIG, T10, B9, B9/11, BaF3, MC9/G, 2E8, RB5, DA1, T1165, and CMK.

Such proteins may also be assessed for their ability to regulate T cell or thymocyte proliferation by measures such as, but not limited to those found in Takai et al., J. Immunol. 137:3494-500, 1986; Bertagnolli et al., J. Immunol. 145: 1706-12, 1990; Bowman et al., J. hnmunol 152:176-61, 1994. These proteins may also be assessed for their ability to produce cytokines, and hence regulate proliferation in spleen and lymph node cells and thymocytes. These techniques can be found in various works such as, without limitation, Current Protocols in Immunology, J. E. Coligan et al Eds, 1:3.12.1-0.12.14, John Wiley and Sons, Toronto, 1994; and Schreiber, R. D. Current Protocols in Immunology., supra 1:ó6.8.1-ó.8.8.

Polynucleotides and polypeptides of this invention may also be assayed for their activity in regulating the proliferation and differentiation of hematopoietic or lymphopoietic cells. Assays for this measurement can be found in various works such as, without limitation, Bottomly et al., In Current Protocols in Immunology., supra.1:ó.3.1-ó.3.12; deVries et al., J Exp Med 173:1205-1211, 1991; Moreau et al., Nature 36:690-692, 1988; Greenberger et al., Proc. Natl. Acad. Sci. U.S.A. 80:2931-8, 1983; Nordan, R., In Current Protocols in Immunology., supra.1:ó. ó.1-ó. ó.5; Smith et al., Proc Natl. Acad. Sci. U.S.A. 83:1857-1861, 1986; Bennett et al in Current Protocols in Immunology., supra 1:ó.15.1; Ciarletta et al In Current Protocols in Immunology. Supra 1:ó.13.1

Such polynucleotides and polypeptides may also be examined for their activity in regulating T-cell responses to antigens. Assays for this measurement can be found in various works such as, without limitation, Chapter 3 (In vitro Assays for Mouse Lyphocyte Function), Chapter 6 (Cytokines and their Cellular Receptors) and Chapter 7, (Immunologic Studies in Humans) in Current Protocols in Immunology supra; Weinberger et al., Proc. Natl. Acad. Sci. USA 77:6091-5, 1980; Weinberger et al., Eur. J. Immun. 11:405-11, 1981; Takai et al., J. Immunol. 137:3494-500, 1986; Takai et al., J. Immunol. 140:508-12, 1988.

A polynucleotide or polypeptide of the present invention that demonstrates cytokine, cell proliferation, or cell differentiation activity may be found to be useful as a pharmaceutical agent for the treatment of conditions in which the induction of cell proliferation or differentiation may produce a beneficial response.

A polynucleotide or polypeptide of the present invention may have activity as a regulator of the immune system. To this end, it may be desired to evaluate these sequences for their ability to induce thymocyte or splenocyte cytotoxicity. For these measurements, many assays are know to those skilled in the art such as those found in various works including, without limitation, Chapter 3 (In vitro Assays for Mouse Lymphocyte Function 3.1-3.19) and Chapter 7 (Immunologic studies in Humans) in Current Protocols in Immunology, J. E. Coligan et al. Eds, Greene Publishing Associates and Wiley-Interscience; Herrmann et al., Proc. Natl. Acad. Sci. USA 78:2488-2492, 1981; Herrmann et al., J. Immunol. 128:1968-1974, 1982; Handa et al., J. Immunol. 135:1564-172, 1985; Takai et al., J. Immunol. 137:3494-500, 1986; Takai et al., J. Immunol. 140:508-12, 1988; Bowman et al., J. Virology 61:1992-1998; Bertagnolli et al. Cell. Immunol. 133:327-41, 1991; Brown et al., J. Immunol. 153:3079-3092, 1994.

These sequences may also be examined for their ability to modulate T-cell dependent immunoglobulin responses and isotype switching. For this analysis many assays are know to those skilled in the art such as those found in various works including, without limitation, Maliszewski, J. Immunol. 144: 3028-3033, 1990; Mond et al. in Current Protocols in Immunology, 1:3.8.1-3.8.16, supra.

A polynucleotide or polypeptide of the present invention may also be examined for its effect on immune effector cells, such as, without limitation, Th1 cells and cytotoxic lymphocytes. Many assays are know to those skilled in the art for these measurements such as those found in various works including, without limitation, Chapter 3 (In vitro Assays for Mouse Lymphocyte Function 3.1-3.19) and Chapter 7 (Immunologic Studies in Human) in Current Protocols in Immunology, supra; Takai et al., J. Immunol. 137:3494-3500, 1986; Takai et al., J. Immunol. 140:508-12, 1988; Bertagnolli et al., J. Immunol. 149:3778-3784, 1992.

The sequences contained within this invention may also be examined for their effect on dendritic cell mediated activation on naive T-cells. Many assays are known to those skilled in the art for these measurements such as those found in various works including, without limitation, Guery et al., J. Immunol. 134:536-44, 1995; Inaba et al., J. Exp. Med. 173:549-59, 1991; Macatonia et al., J. hnmunol. 154:5071-9, 1995; Porgador et al J. Exp. Med. 182:255-60, 1995; Nair et al., J. Virol.

67:462-69, 1993; Huang et al., Science 264:961-965, 1994; Macatonia et al., J. Exp. Med. 169:1255-64, 1989; Bhardwaj et al., J. Clin. Investigation 94:797-807, 1994; and Inaba et al., J. Exp. Med. 172:631-640, 1990.

A polynucleotide or polypeptide of the present invention may also be examined for its ability to affect lymphocytes of the course of their lifetime. Many assays are know to those skilled in the art for these measurements such as those found in various works including, without limitation, Darzynkiewicz et al. Cytometry 13:795-808, 1992; Gorczyca et al., leukemia 7:659-70, 1993; Gorczyca et al., Cancer Res. 53:1945-1951, 1993; Itoh et al., Cell 66:233-243, 1991; Zacharchuk, J. Immunol. 145:4037-4045, 1990; Zamai et al., Cytometry 14:891-897, 1993; Gorczyca et al., Int. J. Oncol 1:639-48, 1992.

A polynucleotide or polypeptide of the present invention may also be examined for its ability to affect the initial stages of T-cell commitment and development. Many assays are known to those skilled in the art for these measurements such as those found in various works including, without limitation, Antica et al, Blood 84:111-117, 1994; Fine et al., Cell. Immunol. 155:111-122, 1994; Galy et al., Blood 85:20-8, 1995; Toki et al., Proc. Nat. Acad. Sci USA 88:7548-7551, 1991.

A polynucleotide or polypeptide of the present invention that, demonstrates activity as an immune system regulator may be found to be useful as a pharmaceutical agent for the treatment of conditions in which the induction of the immune system may produce a beneficial response as previously detailed. The ability of a sequence of this invention to play a role in blocking antigen function may allow it to play a role in the treatment of autoimmune disorders by its preventing the activation of autoreactive T cells. The ability of a polynucleotide or polypeptide described herein to serve as such an agent can be determined through their use in animal models of human autoimmune diseases. Such models include, without limitation, murine autoimmuno collagen collagen arthritis, diabetes mellitus in OB mice and BB rats and systemic lupus ertyhmatosis in MRilpr/pr mice or NZB hybrid mice (see Paul ed., Fundamental Immunology, Raven Press, New York, 1989, pp. 840-56).

Therapeutic utility may also be gathered through the up regulation of antigen function (preferably a B lymphocyte antigen) subsequently up regulating an immune response. This up regulation may take the form of enhancing the current immune response or eliciting a new response. Many therapeutic uses for enhancing an immune response through B lymphocyte antigen function can be found such as for those diseases including, without limitation, local viral infection, or systemic viral disorders such as influenza, the common cold, and encephalitis. This immune response can also be enhanced in an infected individual through removal of T cells from the individual and costimulating these cells in vitro with viral antigen-pulsed APCs that express the polynucleotide or polypeptide of this invention. Alternatively, a similar response can be obtained through costimulating the removed T cells with a stimulatory form of the polynucleotide or polypeptide of the given invention. Through either method, the in vitro primed T cells are reintroduced in the patient, the previously infected cells now having the ability to deliver a costimulatory signal in vivo to the T cells, activating them.

A polynucleotide or polypeptide of the given invention may also be useful in the induction of tumor immunity likewise through the enhancement of antigen function (preferably B lymphocyte antigen function). A sequence described herein may encode a protein that allows an individual with this disorder to overcome tumorspecific tolerance once the sequence of this invention is transfected into the tumor cell such as those produced from, without limitation, sarcoma, melanomas, lymphomas, leukemias, neuroblastomas, or carcinomas. Alternatively, the diseased cell may be transfected with a combination of polypeptides including a polypeptide or polypeptides of this invention. In this instance, a diseased cell isolated from an individual may be transfected with an expression vector containing the sequence of a polynucleotide or polypeptide of this invention such that the expressed polypeptide has B7-2 like activity alone or in conjunction with another polypeptide that has B71 like activity and/or B7-3 like activity. When such cells are returned to the individual with the disorder, these cells should express the given polypeptide or polypeptides on its surface. By being located on the surface of the cell, the polypeptide encoded by a sequence described herein having B lymphocyte activity, has the ability to costimulate T cells to induce a T cell mediated response against the altered disease cells.

In addition to this modification, some disease cells that do not express sufficient amounts of MHC class I or MHC class II molecules, may also be transfected with polynucleotides that encode all or a portion of an MHC class I a chain and an MHC class I p-2 chain. The expression of these polypeptides on the surface of the cell in addition to the previously described B lymphocyte antigens likewise induces a T cell mediated immune response versus the altered disease cell. Alternatively, tumor specific immunity may be induced by transfecting a disease cell that has been modified by the previously described B lymphocyte antigens, with an antisense construct that serves to block the expression of an MHC class II associated protein, such as, without limitation, the invariant chain.

A polynucleotide or polypeptide of the given invention may also be evaluated for its ability to regulate hematopoiesis. In this instance, the activity of a sequence described herein may be evaluated for its effect on embryonic stem cell differentiation. Many assays are know to those skilled in the art for these measurements such as those found in various works including, without limitation, Johansson et al. Cell. Biol. 15:141-51, 1995; Keller et al., Mol. Cell. Biol. 13:473-86, 1993; McClanahan et al et al., Blood 81:2903-15, 1993.

A polynucleotide or polypeptide of the given invention may also be evaluated for its ability to regulate stem cell differentiation or its effect on the lifetime of stem cells. Many assays are know to those skilled in the art for these measurements such as those found in various works including, without limitation, Freshney, M. G. Methylcellulose Colony Forming Assays, in Culture of Hematopoietic Cells, R. I. Freshney, et al. Eds. Pp. 265-8, Wiley-Liss, inc., New York, N.Y., 1994; Hirayama et al., Proc. Natl. Acad. Sci. USA 89:5907-11, 1992; McNiece, I. K. and Briddell, R. A. Primitive Hemaopoietic Colony Forming Cells with High Proliferative Potential, in Cultue of Hematopoietic Cells. supra; Neben et al., Experimental Hematology 22:353-359, 1994; Ploemacher, R. E. Cobblestone Are Forming Cell Assay, in Culture of Hematopoietic Cells, supra; Spooner, E., Dexter, M. and Allen, T. Long Terms Bone Marrow Cultures in the Presence of Stromal Cells, in Culture of Hematopoietic Cells, supra; and Sutherland, H. J. Long Terms Culture Initiating Cell Assay, in Culture of Hematopoietic Cells, supra.

A polynucleotide or polypeptide of the present invention that demonstrates activity hematopoietic regulation may be found to be useful as a pharmaceutical agent for the treatment of conditions in which the hematopoietic regulation may produce a beneficial response.

A polynucleotide or polypeptide of the given invention may also be evaluated for its ability to regulate tissue growth.

Many assays are know to those skilled in the art for these measurements such as those found in various works including, without limitation, those disclosed in International Patent Publication No. WO95/16035, International Patent Publication No. WO95/05846 and International Patent Publication No. WO91/07491.

A polynucleotide or polypeptide of the given invention may also be evaluated for its ability to heal wounds. Many assays are know to those skilled in the art for these measurements such as those found in various works including, without limitation, Winter, Epidermal Wound Healing, pps. 71-112 (Maibach, H and Rovee, D T, eds), Year Book Medical Publishers, Inc., Chicago, as modified by Eaglstein and Mertz, J. Invest. Dermatol. 71:382-4 (1978).

A polynucleotide or polypeptide of the present invention that demonstrates activity in the regulation of tissue growth for both the purposes of increasing or decreasing tissue, may be found to be useful as a pharmaceutical agent for the treatment of conditions in which such regulation of tissue growth may produce a beneficial response. A polynucleotide or polypeptide of the given invention may also be evaluated for its ability to regulate reproductive hormones. Many assays are know to those skilled in the art for these measurements such as those found in various works including, without limitation, Vale et al., Endocrinol. 91:562-72, 1972; Ling et al., Nature 321:79-82, 1986; Vale et al., Nature 321:776-9, 1986; Mason et al., Nature 318:659-663, 1985; Forage et al., Proc, Natl. Acad. Sci. USA 83:3091-5, 1986. Chapter 6.12 in Current Protocols in Immunology, J. E. Coligan et al. Eds. Greene Publishing Associates and Wiley-Interscience; Taub et al. J. Clin. Invest. 95:1370-ó, 1995; Lind et al. APMIS 103:140-ó, 1995; Muller et al., Eur. J. Immunol. 25:1744-8; Gruber et al., J. Immunol. 152:8560-7, 1994; Johnston et al., J. Immunol. 153:1762-8, 1994.

A polynucleotide or polypeptide of the present invention that demonstrates activity in as a reproductive hormone or a regulator of cell movement may be found to be useful as a pharmaceutical agent for the treatment of conditions in which such regulation of tissue growth may produce a beneficial response.

A polynucleotide or polypeptide of the given invention may also be evaluated for its ability to regulate chemotaxis, inducing migration of cells across a membrane as well as induction of the adhesion of one cell population to another cell population. Many assays are know to those skilled in the art for these measurements such as those found in various works including, without limitation, Current Protocols in Immunology, Ed by J. E. Coligan, A. M. Kruisbeek, D. H. Margulies, E. M. Shevach, W. Strober, Pub. Greeene Publishing Associates and Wiley-Interscience, Chapter 206.12: ó.12.1-ó.12.28; Taub et al., J. Clin. Invest. 95:1370-ó, 1995; Lind et al. APMIS103:140-ó, 1995; Mueller et al., Eur. J. Immunol. 25:1744-8; Gruber et al., J. Immunol. 152:5860-7, 1994; Johnston et al., J. Immunol., 153:1762-8, 1994.

A polynucleotide or polypeptide of the present invention that demonstrates activity in regulating chemotaxis may be found to be useful as a pharmaceutical agent for the treatment of conditions in which such regulation may produce a beneficial response. A polynucleotide or polypeptide of the given invention may also be evaluated for its ability to regulate blood clotting. Many assays are know to those skilled in the art for these measurements such as those found in various works including, without limitation, Linet et al., J. Clin. Pharmacol. 26:131-40, 1986; Burdick et al., Thrombosis Res. 45:413-9, 1987; Humphrey et al., Fibrinolysis 5: 71-9 (1991); Schaub, Prostaglandins 35:467-74, 1988.

A polynucleotide or polypeptide of the present invention that demonstrates activity in regulating blood clotting may be found to be useful as a pharmaceutical agent for the treatment of conditions in which such regulation may produce a beneficial response.

A polynucleotide or polypeptide of the given invention may also be evaluated for its involvement in receptor/ligand interactions. Many assays are know to those skilled in the art for these measurements such as those found in various works including, without limitation, Chapter 7:7.28.1-7.28.22, in Current Protocols in Immunology, J. E. Coligan et al., Eds. Greene Publishing Associates and Wiley-Interscience; Takaai et al., Proc. Natl. Acad. Sci. USA 84:6864-8, 1987; Bierer et al., J. Exp. Med. 168:114-56, 1988; Rosenstein et al., J. Exp. Med. 169:149-60, 1989; Stoltenborg et al., J. Immunol. Methods 175:59-68, 1994; Stitt et al., Cell 80:661-70, 1995; Gyuris et al., Cell 75:791-803, 1993.

The sequences described herein may have activity as receptors, receptor ligands or inhibitors or agonists of receptor/ligand interactions. Such molecules include, without limitation, cytokine receptors and their ligands, receptor kinases and their ligands, and receptor phosphatases and their ligands. Additionally, receptor/ligand assays serve as valuable screening tools for the identification of potential peptide or small molecule inhibitors of the receptor/ligand complex.

A polynucleotide or polypeptide of the given invention may also be evaluated for its involvement in anti-inflammatory responses. The anti-inflammatory activity of these sequences may be examined by inducing those cells involved in the inflammatory response, by inhibiting or promoting cell-cell interactions such as, without limitation, cell adhesion, by inhibiting or promoting chemotaxis of cells that play a role in the inflammatory response, by inhibiting or promoting cell extravasation, or by inhibiting or promoting the production of other molecules that more directly inhibit or promote an inflammatory response. A polynucleotide or polypeptide of the given invention that exhibits such activity may be used in the treatment of the inflammatory conditions previously mentioned.

A polynucleotide or polypeptide of the given invention may also be examined for its tumor inhibition activity. Not only may a sequence described herein be used for the immunological treatment or prevention of a tumor, a sequence of this invention may exhibit other anti-tumor activities such as, without limitation, acting on tumor or tumor precursor tumor tissue, inhibiting formation of tissues necessary to support tumor growth, by suppressing additional factors, agents or cell types that promote tumor growth, or by causing the production of other factors, agents or cell types that inhibit tumor growth.

Polypeptides or proteins may interact with polypeptides of the present invention. These molecules may be identified using a two hybrid system such as the Matchmaker Two Hybrid System (Catalog number K1612-1, Clontech). This system is based on the fact that transcriptional activators are composed of separate domains that can be physically and functionally separated into a DNA binding domain (DNA-BD) and a transcriptional activator domain (AD) (Keegan et al., Science, 231:699-704, 1986; Ma and Ptashne, Cell, 51:113-9 (1987); Ma and Ptashne 48:847-53, 1987; Mitchell and Tijan, 1989). The DNA binding domain acts in a sequence specific manner allowing the transcription factor to bind only to genes that have this recognition site in their promoters, while the transcriptional activator domain interacts with the protein subunits of the RNA polymerase holoenzyme leading to upregulation of the gene (Ma and Ptashne, 1988).

An example of a well-characterized transcription factor is the yeast GAL4 protein. 5 The first 74 amino terminal residues, of this 881 residue protein, are sufficient for binding to DNA in a sequence specific manner but can not stimulate transcription (Keegan et al., Science, 231:699-704, 1986). Sequence downstream in this gene codes for the segment of the protein that has the ability to activate transcription but cannot bind DNA. The ability to separate these domains and ffise them with other proteins is useful for detecting protein-protein interactions, respectively (Fields and Song, Nature, 340:245-6, (1989).

In the two hybrid system, the DNA sequence or polypeptide of interest, as described in this invention, can be bound to the yeast GAL4 DNA binding sequence. This complex will allow the protein of interest to bind to the GAL upstream activation site of a vector but does confer on it the ability to lead to transcription of a downstream reporter gene. Transcription of this reporter gene can only occur if a protein bound to the yeast activator domain (i.e. an agonist or antagonist) binds to the protein of interest. The binding of these two proteins physically brings together the DNA-BD and the transcriptional activator domain such that it can ffnction as it normally does, triggering expression of a downstream gene. In order, to increase the chances that one will find a protein bound to an activator domain that in fact binds to the protein of interest, expression libraries with genome wide coverage are constructed containing random gene sequences ffised to the activator domain. The DNA-BD construct is then used to screen the expression library for proteins that bind to the protein of interest. Binding between proteins is determined when one sees the up regulation of the downstream reporter gene. The sequence coding the protein that binds to the protein of interest is then easily obtained by isolating the vector encoding it and eventually sequencing it.

Many alternative assays are know to those skilled in the art for identifying proteins that may bind to the sequences of this invention such as those found in various works including, without limitation, Lustig et al, Methods in Enzymology 283: 83-99 (1997 Ramunsen et al., Electrophoresis, 18:588-98, (1997); Edwards and Leatherbarrow, Analytical Biochemistry, 246:1-ó, (1997); Wang et al., Chromatographia, 44:205-8 (1997); Busch et al., J. Chromatogr. 777:311-28 (1997), U.S. Pat. No. 5,654,150

Table Captions

Table 1: Expression Profiles

A list of Athersys clusters and tissues that have at least one consensus sequence whose mRNA has been determined by rt-PCR to be expressed in the given tissue. Key Letter—Expressed in: A—Kidney; B—Skeletal Muscle; C—Placenta; D—Lung; E—Spleen; F—Liver; G—Brain; H—Fetal Liver; I—Skin; J—Heart; K—Colon; L—Stomach; M—Uterus; N—Fetal Brain; O—Pancreas; P—Salivary Gland; Q—Adipose; R—Adrenal Gland; S—Small Intestine; T—Bladder; U—Cerebellum; V—Thymus; W—Lymphnode; X—Thyroid; Y—Prostate; Z—Mammary; a—Testis; b—Pituitary; c—Ovary; d—Peripheral Blood Lymphocytes.

Table X: Expression Profiles of Rarely Expressed Genes

A list of Athersys clusters and tissues that have at least one consensus sequence whose mRNA has been determined by rt-PCR to be rarely expressed in the given tissue. Key Letter—Expressed in: A—Kidney; B—Skeletal Muscle; C—Placenta; D—Lung; E—Spleen; F—Liver; G—Brain; H—Fetal Liver; I—Skin; J—Heart; K—Colon; L—Stomach; M—Uterus; N—Fetal Brain; O—Pancreas; P—Salivary Gland; Q—Adipose; R—Adrenal Gland; S—Small Intestine; T—Bladder; U—Cerebellum; V—Thymus; W—Lymphnode; X—Thyroid; Y—Prostate; Z—Mammary; a—Testis; b—Pituitary; c—Ovary; d—Peripheral Blood Lymphocytes Table 2: Channel Related Sequences, BLASTX A list of Athersys sequence clusters that are similar to channel protein sequences in nr when compared by BLASTX. Sequences were considered similar if they had an E-score of $1\times10^{-3}$ or less. Comparison was made with the default BLASTX parameters. The results were compiled by searching for the following key words in the descriptions of the similar proteins: channel, pore, anion, potassium, calcium, chloride, exchange, symport, and transport.

Table 3: Cytoskeletal Related Sequences, BLASTX

A list of Athersys sequence clusters that are similar to cytoskeletal protein sequences in nr when compared by BLASTX. Sequences were considered similar if they had an E-score of $1\times10^{-3}$ or less. Comparison was made with the default BLASTX parameters. The results were compiled by searching for the following key words in the descriptions of the similar proteins: cytoskeleton cytoskeletal, actin, myosin, tubulin, vinculin, talin, collagen, junction, dynein, UNC-89, nebulin, and diaphanous.

Table 4: DNA Binding Related Sequences, BLASTX

A list of Athersys sequence clusters that are similar to DNA binding protein sequences in nr when compared by BLASTX. Sequences were considered similar if they had an E-score of $1\times10^{-3}$ or less. Comparison was made with the default BLASTX parameters. The results were compiled by searching for the following key words in the descriptions of the similar proteins: transcription, DNA binding, hlh, helix loop helix, homeobox, RNA binding, tat-interacting, and Zn or zinc finger.

Table 5: G-Protein Coupled Receptor Related Sequences, BLASTX

A list of Athersys sequence clusters that are similar to G-protein coupled receptor sequences in nr when compared by BLASTX. Sequences were considered similar if they had an E-score of $1\times10^{-3}$ or less. Comparison was made with the default BLASTX parameters. The results were compiled by searching for the following key words in the descriptions of the similar proteins: GPCR, g-protein coupled, olfactory, odorant.

Table 6: Kinase Related Sequences, BLASTX

A list of Athersys sequence clusters that are similar to kinase sequences in nr when compared by BLASTX. Sequences were considered similar if they had an E-score of $1\times10^{-3}$ or less. Comparison was made with the default BLASTX parameters. The results were compiled by searching for the following key words in the descriptions of the similar proteins: kinase, phosphatase, phosphodiesterase, cAMP, phosphorylase, calcium-binding, rapamycin, cyclophilin, peptidylprolyl, gtp-binding, gtpase, geminin and cyclin.

Table 7: Protease Related Sequences, BLASTX

A list of Athersys sequence clusters that are similar to protease sequences in nr when compared by BLASTX. Sequences were considered similar if they had an E-score of $1\times10^{-3}$ or less. Comparison was made with the default BLASTX parameters. The results were compiled by searching for the following key words in the descriptions of the similar proteins: protease, peptidase, proteinase, caspase, pepsinogen, gastricsin, proteosome, convertase, death, ded, ubiquitin conjugating, f-box, heat shock, and neuroendocrine.

Table 8: Protein-Protein Interacting Related Sequences, BLASTX

A list of Athersys sequence clusters that are similar to proteins that are involved in protein-protein interaction in nr when compared by BLASTX. Sequences were considered similar if they had an E-score of $1\times10^{-3}$ or less. Comparison was made with the default BLASTX parameters. The results were compiled by searching for the following key words in the descriptions of the similar proteins: annexin, zipper, ring finger, pdz, chaperon, intersectin, enhancer, lysosomal traffic, phospholipid, dimerization, sh3, and mago nashi.

Table 9: Transmembrane Related Sequences, BLASTX

A list of Athersys sequence clusters that are similar to transmembrane protein sequences in nr when compared by BLASTX. Sequences were considered similar if they had an E-score of $1\times10^{-3}$ or less. Comparison was made with the default BLASTX parameters. The results were compiled by searching for the following key words in the descriptions of the similar proteins: receptor, adhesion, notch, motch, zona, mhc, sortilin, tm, membrane, cadherin, zp, embigin, glycoprotein, aquaproin, polycystin, bax epsilon, sarcoglycan, and surface.

Table 10: Secreted Related Sequences, BLASTX

A list of Athersys sequence clusters that are similar to secreted protein sequences in nr when compared by BLASTX. Sequences were considered similar if they had an E-score of $1\times10^{-3}$ or less. Comparison was made with the default BLASTX parameters. The results were compiled by searching for the following key words in the descriptions of the similar proteins: growth factor, schlafen, integrin, neuromedin, immunoglobulin, hormone, thrombospondin, proteoglycan, complement, and prolactin.

Table 11: ABC Channel Related Sequences, eMatrix

A list of Athersys sequence clusters that are similar to ABC channel protein motifs when compared with eMatrix. Motifs were considered similar if they had a probability score of $1\times10^{-7}$ or less. Comparison was made with the default eMatrix parameters.

Table 12: Ion Channel Related Sequences, eMatrix

A list of Athersys sequence clusters that are similar to ion channel protein motifs when compared with eMatrix. Motifs were considered similar if they had a probability score of $1\times10^{-7}$ or less. Comparison was made with the default eMatrix parameters.

Table 13: G-Protein Coupled Receptor Related Sequences, eMatrix

A list of Athersys sequence clusters that are similar to G-protein coupled receptor or olfactory receptor motifs when compared with eMatrix. Motifs were considered similar if they had a probability score of $1\times10^{-7}$ or less. Comparison was made with the default eMatrix parameters.

Table 14: Other Receptor Related Sequences, eMatrix

A list of Athersys sequence clusters that are similar to other (non-GPCR) receptor motifs when compared with eMatrix. Motifs were considered similar if they had a probability score of $1\times10^{-7}$ or less. Comparison was made with the default eMatrix parameters.

Table 15: Protease Inhibitor Related Sequences, eMatrix

A list of Athersys sequence clusters that are similar to protease inhibitor motifs when compared with eMatrix. Motifs were considered similar if they had a probability score of $1\times10^{-7}$ or less. Comparison was made with the default eMatrix parameters.

Table 16: Protease Related Sequences, eMatrix

A list of Athersys sequence clusters that are similar to protease motifs when compared with eMatrix. Motifs were considered similar if they had a probability score of $1\times10^{-7}$ or less. Comparison was made with the default eMatrix parameters.

Table 17: Growth Factor Related Sequences, eMatrix

A list of Athersys sequence clusters that are similar to protease motifs when compared with eMatrix. Motifs were considered similar if they had a probability score of $1\times10^{-7}$ or less. Comparison was made with the default eMatrix parameters. Domains that are known to be associated with growth factors are: laminin, inhibin, tissue factor, hormone, histone binding, fibronectin, apple, thyroglobulin, discordin, ARAC bacterial, neuresin, PWWp, wnt, erythropoetin, bun family, chromo, anaphylotoxin, lectin, U32, cystin knot, wilm's tumor, serine protease, C type lectin, VWFC, coagulation factor, metallothionein, TGF, gliadin, granulocyte, pleiotrophin, allergen, and lif/os domains.

Table 18: Channel Related Sequences, BLASTN

A list of Athersys sequence clusters that are similar to nucleotide sequences in nt when compared by BLASTN. Sequences were considered similar if they had an E-score of $1\times10^{-10}$ or less. Comparison was made with the default BLASTN parameters. The results were compiled by searching for the following key words in the descriptions of the similar nucleotide sequences: channel, pore, anion, potassium, calcium, chloride, exchange, symport, and transport.

Table 19: Cytoskeletal Related Sequences, BLASTN

A list of Athersys sequence clusters that are similar to cytoskeletal protein sequences in nt when compared by BLASTN. Sequences were considered similar if they had an E-score of $1\times10^{-10}$ or less. Comparison was made with the default BLASTN parameters. The results were compiled by searching for the following key words in the descriptions of the similar proteins: cytoskeleton cytoskeletal, actin, myosin, tubulin, vinculin, talin, collagen, junction, dynein, UNC-89, nebulin, and diaphanous.

Table 20: DNA Binding Related Sequences, BLASTN

A list of Athersys sequence clusters that are similar to DNA binding protein sequences in nt when compared by BLASTN. Sequences were considered similar if they had an E-score of $1\times10^{-10}$ or less. Comparison was made with the default BLASTN parameters. The results were compiled by searching for the following key words in the descriptions of the similar proteins: transcription, dna binding, hlh, helix loop helix, homeobox, ma binding, tat-interacting, and Zn or zinc finger.

Table 21: Kinase Related Sequences, BLASTN

A list of Athersys sequence clusters that are similar to kinase sequences in nt when compared by BLASTN. Sequences were considered similar if they had an E-score of $1\times10^{-10}$ or less. Comparison was made with the default BLASTN parameters. The results were compiled by searching for the following key words in the descriptions of the similar proteins: kinase, phosphatase, phosphodiesterase, cAMP, phosphorylase, calcium-binding, rapamycin, cyclophilin, peptidylprolyl, gtp-binding, gtpase, geminin and cyclin.

Table 22: Protease Related Sequences, BLASTN

A list of Athersys sequence clusters that are similar to protease sequences in nt when compared by BLASTN. Sequences were considered similar if they had an E-score of $1\times10^{-10}$ or less. Comparison was made with the default BLASTN parameters. The results were compiled by searching for the following key words in the descriptions of the similar proteins: protease, peptidase, proteinase, caspase, pepsinogen, gastricsin, proteosome, convertase, death, ded, ubiquitin conjugating, f-box, heat shock, and neuroendocrine.

Table 23: Protein-Protein Interacting Related Sequences, BLASTN

A list of Athersys sequence clusters that are similar to proteins that are involved in protein-protein interaction in nt when compared by BLASTN. Sequences were considered similar if they had an E-score of $1\times10^{-10}$ or less. Comparison was made with the default BLASTN parameters. The results were compiled by searching for the following key words in the descriptions of the similar proteins: annexin, zipper, ring finger, pdz, chaperon, intersectin, enhancer, lysosomal traffic, phospholipid, dimerization, sh3, and mago nashi.

Table 24: Secreted Related Sequences, BLASTN

A list of Athersys sequence clusters that are similar to secreted protein sequences in nt when compared by BLASTN. Sequences were considered similar if they had an E-score of $1\times10^{-10}$ or less. Comparison was made with the default BLASTN parameters. The results were compiled by searching for the following key words in the descriptions of the similar proteins: growth factor, schlafen, integrin, neuromedin, immunoglobulin, hormone, thrombospondin, proteoglycan, complement, and prolactin.

Table 25: Transmembrane Related Sequences, BLASTN

A list of Athersys sequence clusters that are similar to transmembrane protein sequences in nt when compared by BLASTN. Sequences were considered similar if they had an E-score of $1\times10^{-10}$ or less. Comparison was made with the default BLASTN parameters. The results were compiled by searching for the following key words in the descriptions of the similar proteins: receptor, gpcr, G-protein coupled, olfactory, odorant, adhesion, notch, motch, zona, mhc, sortilin, tm, membrane, cadherin, zp, embigin, glycoprotein, aquaproin, polycystin, bax epsilon, sarcoglycan, and surface.

Table 26: Sequence Identifiers and Sequence Names

A list of SEQ ID NOS and the corresponding sequence and/or cluster name.

Table 28:

A list of Athersys sequences with homologies to gene families with references.

Table 29:

A list of Athersys sequences with homologies to gene families with references.

Appendix 1:

SEQ ID NOS: 1-21062

Appendix 2:

SEQ ID NOS: 21063-21107

EQUIVALENTS

Those skilled in the art will recognize, or be able to ascertain using no more than routine experimentation, many equivalents to the specific embodiments of the invention described herein. Such equivalents are intended to be encompassed by the following claims.

SEQUENCE LISTING (21107 sequences)

SEQ ID NO: 1 - DNA, 39 bp, Homo sapiens
tccttcgaagcttgtcatggttggttcgctaaactgcat

SEQ ID NO: 2 - DNA, 40 bp, Homo sapiens
aaacttaagatcgattaatcattcttctcatatacttcaa

SEQ ID NO: 3 - DNA, 28 bp, Homo sapiens
atccaccatggctacaggtgagtactcg

SEQ ID NO: 4 - DNA, 36 bp, Homo sapiens
gatccgagtactcacctgtagccatggtggatttaa

SEQ ID NO: 5 - DNA, 33 bp, Homo sapiens
ggcgagatctagcgctatatgcgttgatgcaat

SEQ ID NO: 6 - DNA, 51 bp, Homo sapiens
ggccagatctgctaccttaagagagccgaaacaagcgctcatgagcccgaa

SEQ ID NO: 7 - DNA, 6835 bp, Homo sapiens
agatcttcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaaatccaccatggctacaggtgagtactcggatctagcgctatatgcgttgatgcaatttctatgcgcacccgttctcggagcactgtccgaccgctttggccgccgcccagtcctgctcgcttcgctacttggagccactatcgactacgcgatcatggcgaccacacccgtcctgtggatcctctacgccggacgcatcgtggccggcatcaccggcgccacaggtgcggttgctggcgcctatatcgccgacatcaccgatggggaagatcgggctcgccacttcgggctcatgagcgcttgtttcggctctcttaaggtagcagatccttgctagagtcgaccaattctcatgtttgacagcttatcatcgcagatcctgagcttgtatggtgcactctcagtacaatctgctctgctgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgtatctgaggggactagggtgtgtttaggcgcccagcggggcttcggttgtacgcggttaggagtcccctcaggatatagtagtttcgcttttgcatagggagggggaaatgtagtcttatgcaatacacttgtagtcttgcaacatggtaacgatgagttagcaacatgccttacaaggagagaaaaagcaccgtgcatgccgattggtggaagtaaggtggtacgatcgtgccttattaggaaggcaacagacaggtctgacatggattggacgaaccactgaattccgcattgcagagataattgtatttaagtgcctagctcgatacaataaacgccatttgaccattcaccacattggtgtgcacctccaagctgggtaccagctgctagcctcgagacgcgtgatttccttcgaagcttgtcatggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattaatcgatcttaagtttaatctttcccgggggtaccgtcgactgcggccgcgaattccaagcttgagtattctatcgtgtcacctaaataacttggcgtaatcatggtcatatctgtttcctgtgtgaaattgttatccgctcacaattccacacaacatacgagccggaagcataaagtgtaaagcctggggtgcctaatgagtgagctaactcacattaattgcgttgcgcgatgcttccattttgtgagggttaatgcttcgagaagacatgataagatacattgatgagtttggacaaaccacaacaagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgattccggagcctgaatggcgaatggacgcgccctgtagcggcgcattaagcgcggcgggtgtggtggttacgcgcacgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcgcctgtgtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaagatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagtttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgac

SEQ ID NO: 8 - DNA, 6054 bp, Homo sapiens
agatcttcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaattaactccaccagtctcacttcagttccttttgcatgaagagctcagaatcaaaagaggaaaccaacccctaagatgagctttccatgtaaatttgtagccagcttccttctgattttcaatgtttcttccaaaggtgcagtctccaaagagattacgaatgccttggaaacctggggtgccttgggtcaggacatcaacttggacattcctagttttcaaatgagtgatgatattgacgatataaaatgggaaaaaacttcagacaagaaaaagattgcacaattcagaaaagagaaagagactttcaaggaaaaagatacatataagctatttaaaaatggaactctgaaaattaagcatctgaagaccgatgatcaggatatctacaaggtatcaatatatgatacaaaaggaaaaaatgtgttggaaaaaatatttgatttgaagattcaagagagggtctcaaaaccaaagatctcctggacttgtatcaacacaaccctgacctgtgaggtaatgaatggaactgaccccgaattaaacctgtatcaagatgggaaacatctaaaactttctcagagggtcatcacacacaagtggaccaccagcctgagtgcaaaattcaagtgcacagcagggaacaaagtcagcaaggaatccagtgtcgagcctgtcagctgtccagagaaagggatccaggtgagtagggcccgatccttctagagtcgagctctcttaaggtagcaaggttacaagacaggtttaaggagaccaatagaaactgggcttgtcgagacagagaagactcttgcgtttctgataggcacctattggtcttacgcggccgcgaattccaagcttgagtattctatcgtgtcacctaaataacttggcgtaatcatggtcatatctgtttcctgtgtgaaattgttatccgctcacaattccacacaacatacgagccggaagcataaagtgtaaagcctggggtgcctaatgagtgagctaactcacattaattgcgttgcgcgatgcttccattttgtgagggttaatgcttcgagaagacatgataagatacattgatgagtttggacaaaccacaacaagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgattccggagcctgaatggcgaatggacgcgccctgtagcggcgcattaagcgcggcgggtgtggtggttacgcgcacgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcgcctgtgtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaagatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgac

SEQ ID NO: 9 - DNA, 6055 bp, Homo sapiens
agatcttcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaattaactccaccagtctcacttcagttccttttgcatgaagagctcagaatcaaaagaggaaaccaacccctaagatgagctttccatgtaaatttgtagccagcttccttctgattttcaatgtttcttccaaaggtgcagtctccaaagagattacgaatgccttggaaacctggggtgccttgggtcaggacatcaacttggacattcctagttttcaaatgagtgatgatattgacgatataaaatgggaaaaaacttcagacaagaaaaagattgcacaattcagaaaagagaaagagactttcaaggaaaaagatacatataagctatttaaaaatggaactctgaaaattaagcatctgaagaccgatgatcaggatatctacaaggtatcaatatatgatacaaaaggaaaaaatgtgttggaaaaaatatttgatttgaagattcaagagagggtctcaaaaccaaagatctcctggacttgtatcaacacaaccctgacctgtgaggtaatgaatggaactgaccccgaattaaacctgtatcaagatgggaaacatctaaaactttctcagagggtcatcacacacaagtggaccaccagcctgagtgcaaaattcaagtgcacagcagggaacaaagtcagcaaggaatccagtgtcgagcctgtcagctgtccagagaaagggatcccaggtgagtagggcccgatccttctagagtcgagctctcttaaggtagcaaggttacaagacaggtttaaggagaccaatagaaactgggcttgtcgagacagagaagactcttgcgtttctgataggcacctattggtcttacgcggccgcgaattccaagcttgagtattctatcgtgtcacctaaataacttggcgtaatcatggtcatatctgtttcctgtgtgaaattgttatccgctcacaattccacacaacatacgagccggaagcataaagtgtaaagcctggggtgcctaatgagtgagctaactcacattaattgcgttgcgcgatgcttccattttgtgagggttaatgcttcgagaagacatgataagatacattgatgagtttggacaaaccacaacaagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgattccggagcctgaatggcgaatggacgcgccctgtagcggcgcattaagcgcggcgggtgtggtggttacgcgcacgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcgcctgtgtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaagatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgac

SEQ ID NO: 10 - DNA, 6056 bp, Homo sapiens
agatcttcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaattaactccaccagtctcacttcagttccttttgcatgaagagctcagaatcaaaagaggaaaccaacccctaagatgagctttccatgtaaatttgtagccagcttccttctgattttcaatgtttcttccaaaggtgcagtctccaaagagattacgaatgccttggaaacctggggtgccttgggtcaggacatcaacttggacattcctagttttcaaatgagtgatgatattgacgatataaaatgggaaaaaacttcagacaagaaaaagattgcacaattcagaaaagagaaagagactttcaaggaaaaagatacatataagctatttaaaaatggaactctgaaaattaagcatctgaagaccgatgatcaggatatctacaaggtatcaatatatgatacaaaaggaaaaaatgtgttggaaaaaatatttgatttgaagattcaagagagggtctcaaaaccaaagatctcctggacttgtatcaacacaaccctgacctgtgaggtaatgaatggaactgaccccgaattaaacctgtatcaagatgggaaacatctaaaactttctcagagggtcatcacacacaagtggaccaccagcctgagtgcaaaattcaagtgcacagcagggaacaaagtcagcaaggaatccagtgtcgagcctgtcagctgtccagagaaagggatccacaggtgagtagggcccgatccttctagagtcgagctctcttaaggtagcaaggttacaagacaggtttaaggagaccaatagaaactgggcttgtcgagacagagaagactcttgcgtttctgataggcacctattggtcttacgcggccgcgaattccaagcttgagtattctatcgtgtcacctaaataacttggcgtaatcatggtcatatctgtttcctgtgtgaaattgttatccgctcacaattccacacaacatacgagccggaagcataaagtgtaaagcctggggtgcctaatgagtgagctaactcacattaattgcgttgcgcgatgcttccattttgtgagggttaatgcttcgagaagacatgataagatacattgatgagtttggacaaaccacaacaagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgattccggagcctgaatggcgaatggacgcgccctgtagcggcgcattaagcgcggcgggtgtggtggttacgcgcacgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcgcctgtgtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaagatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgac

SEQ ID NO: 11 - DNA, 38 bp, Homo sapiens
  misc_feature (1)...(38): n = A,T,C or G
ttttttttttttcgtcagcggccgcatcnnnntttatt

SEQ ID NO: 12 - DNA, 25 bp, Homo sapiens
cagatcactagaagctttattgcgg

SEQ ID NO: 13 - DNA, 20 bp, Homo sapiens
ttttcgtcagcggccgcatc

SEQ ID NO: 14 - DNA, 45 bp, Homo sapiens
actcataggccatagaggcctatcacagttaaattgctaacgcag

SEQ ID NO: 15 - DNA, 42 bp, Homo sapiens
ttctaggccatagaggccagatcactagaagctttattgcgg

SEQ ID NO: 16 - DNA, 53 bp, Homo sapiens
tgactcaggccatagaggcctgaaccgtcagatcactagaagctttattgcgg

SEQ ID NO: 17 - DNA, 48 bp, Homo sapiens
agttgactcaggcctaaatggccgtcagatcactagaagctttattgc

SEQ ID NO: 18 - DNA, 20 bp, Homo sapiens
gtaaaacgacggccagtgaa

SEQ ID NO: 19 - DNA, 21 bp, Homo sapiens
cgagactgttgtctcagaagc

SEQ ID NO: 20 - DNA, 5338 bp, Homo sapiens
  misc_feature (1)...(5338): n = A,T,C or G
cacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtacaattcaattcgtcgacctcgaaattctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcanctcgcgtcgtgcaggacgtgacaaatggaaatagcacgtctcactagtctcgtgcagatggacaagcaccgctgagcaatggagcgggtaggcctttggggcagcggccaatagcagctttgctccttcgctttctgggctcagaggctggnaaggggtgggtccgggggcgggctcaggggcgggctcaggggcggggcgggcgcccgaaggtcctccggaggcccggcattctgcacgcttcaaaagcgcacgtctgccgcgctgttctcctcttcctcatctccgggcctttcgacctgcatccatctagatctcgagcagctgaagcttaccatgaccgagtacaagcccacggtgcgcctcgccacccgcgacgacgtcccccgggccgtacgcaccctcgccgccgcgttcgccgactaccccgccacgcgccacaccgtcgacccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccgggcccaaggagcccgcgtggttccttggcccaccgtcgggcgtcttcgcccgaccaccagggcaagggtctggcaagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgacgcccgccccacgacccgcagcgcccgaccgaaaggagcgcacgaccccatgcatcgatggcactgggcaggtaagtatcaaggttagcgatcttcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaattaaccaccgctacaggtgagtactcggatctgctaccttaagagagccgaaacaagcgctcatgagcccgaagtggcgagcccgatcttccccatcggtgatgtcggcgatataggcgccagcaaccgcacctgtggcgccggtgatgccggccacgatgcgtccggcgtagaggatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagatccttgctagagtcgaggccgccaccgcggtggagctccagcttttgttccctttagtgagggttaatttcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgc

SEQ ID NO: 21 - DNA, 5314 bp, Homo sapiens
gatcttcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactgaattctgacgacctactgattaacggccatagaggcctcctgcagaactgtcttagtgacaactatcgatttccacacattatacgagccgatgttaattgtcaacagctcatgcatgacgtcccgggagcagacaagcccgaccatggctcgagtaatacgactcactatagggcgacaggtgagtactcgctaccttaagagaggcctatctggccagttagcagtcgaagaaagaagtttaagagagccgaaacaagcgctcatgagcccgaagtggcgagcccgatcttccccatcggtgatgtcggcgatataggcgccagcaaccgcacctgtggcgccggtgatgccggccacgatgcgtccggcgtagaggatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagatccttgctagagtcgagatctgtcgagccatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttatcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttgtcaaccttaccagataaaagtgctcatcattggaaaacgttcaattctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagccattctgctggatggctacaggtcgcagccctggcgtcgtgattagtgatgatgaaccaggttatgaccttgatttattttgcatacctaatcattatgctgaggatttggaaagggtgtttattcctcatggactaattatggacaggactgaacgtcttgctcgagatgtgatgaaggagatgggaggccatcacattgtagccctctgtgtgctcaaggggggctataaattctttgctgacctgctggattacatcaaagcactgaatagaaatagtgatagatccattcctatgactgtagattttatcagactgaagagctattgtaatgaccagtcaacaggggacataaaagtaattggtggagatgatctctcaactttaactggaaagaatgtcttgattgtggaagatataattgacactggcaaaacaatgcagactttgctttccttggtcaggcagtataatccaaagatggtcaaggtcgcaagcttgctggtgaaaaggaccccacgaagtgttggatataagccagactttgttggatttgaaattccagacaagtttgttgtaggatatgcccttgactataatgaatacttcagggatttgaatcatgtttgtgtcattagtgaaactggaaaagcaaaatacaaagcctaagcggccgctaacctggttgctgactaattgagatgcatgctttgcatacttctgcctgctggggagcctggggactttccacaccctaactgacacacattccacagctggttctttccgcctcagaaggtacacaggcgaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccac

SEQ ID NO: 22 - DNA, 45 bp, Homo sapiens; identical to SEQ ID NO: 14

SEQ ID NO: 23 - DNA, 43 bp, Homo sapiens
ctcgtttagtgcggccgctcagatcactgaattctgacgacct

SEQ ID NO: 24 - DNA, 5208 bp, Homo sapiens
gatcttcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactgaattctgacgacctactgattaacggccatagaggcctcctgcagaactgtcttagtgacaactatcgatttccacacattatacgagccgatgttaattgtcaacagctcatgcatgacgtcccgggagcagacaagaccatggctcgagtaatacgactcactatagggcgacaggtgagtactcgctaccttaagagaggcctatctggccagttagccgtcgaagaaagaagtttaagagagccgaaacaagcgctcatgagcccgaagtggcgagcccgatcttccccatcggtgatgtcggcgatataggcgccagcaaccgcacctgtggcgccggtgatgccggccacgatgcgtccggcgtagaggatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagatccttgctagagtcgagatctgtcgagccatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttatcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttgtcaaccttaccagataaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatacgcggatcttcacacaaaaaaccaacacacagatgtaatgaaaataaagatattttattgcggccatcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatggtggctctagccttaagttcgagactgttgtgtcagaagaatcaagctttttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagctggttctttccgcctcagaaggtacacaggcgaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccac

SEQ ID NO: 25 - DNA, 20 bp, Homo sapiens
tcgtcagaattcagtgatct

SEQ ID NO: 26 - DNA, 41 bp, Homo sapiens
ctcgtttagtggcgcgccagatcactgaattctgacgacct

SEQ ID NO: 27 - DNA, 22 bp, Homo sapiens
gacctactgattaacggccata

SEQ ID NO: 28 - DNA, 44 bp, Homo sapiens
  misc_feature (44)...(44): n = A,C or G
tcagacttagatggccaacgaggccatttttttttttttttttn

SEQ ID NO: 29 - DNA, 23 bp, Homo sapiens
aacccagcgttggacaaatactt

SEQ ID NO: 30 - DNA, 25 bp, Homo sapiens
tagcgccatcattcacataatacat

SEQ ID NO: 31 - DNA, 1094 bp, Homo sapiens
aggttgattattagcaggaaaaaagagtaatagaggaacaagtccaaacatgtccttcaggaacgtggctcaatatttccccttatttgcatgagtgaaaagagaatcccgaggatggttttgagccccagtgccaaccccattctctgcatctcagattcctcggtaacttcatgtcatggaattctaacaagttttggctgattgatatagcaaaacaacaaagacaggcttgaaaaaagacagatggggcaaatgtggaaggtggcggccactttaaatgacagctccgcaacggacaaaaacgggctctcctcattatgttcatggaacaccaaatatgaagaaatcaagctgctttaggactgagacccttatggcagctcatattgcattgggaaagaatgttaacattaataagttacataagaaaaatgtccaagatcaacacattcaaggccattataaatactagcatatacattcagaaatgcaattacaccatcagcatgaacacgcaggaaaagaaaattcctatttgcatggctgtgaggtttcttctggttgccagcaatttccagagtgtattgaaattttcaaattaactgaggacattttagtcaattttatctctcaatgcttttgtgtcactttttcttcaaggtctgtgcattttgctgattgaaatgctcaaacatttattcatttattcatctcaaaggcacagatcatcattatgactttttttttttgaaaaaatagtgtcagaactttctaatgttcttttctgtctcttttctccaaatactttccctcttcataaccctctttctccccaggggactttctattgcttctatagggaattttttcaacgtctggtctttaaaaagaattcctctttaatcctaaagcattctatggagaaatcagtttccagaagttagaataaaattccatgtgcatgcctgggtctgggacagggtgcgggaaaagaagaaatgttggtatgtaatcttaaaattcaaatgctgttcagtagtggcataccatctgaactagctgcaaatggtaaataaaccccgatcggccag

SEQ ID NO: 32 - DNA, 367 bp, Homo sapiens
aggaattctcttccatgatgttgacagcctcaattacagcagaagctaacaggggaagtagtaaaactgaacagcagtaatcctggctggaaagtcactgatggtcaattatgaaagatctgtcacaggagaagccttcaatagaagcaagtaaagagaagtgtacatggctttttccagatcagaactgagagtggaactcaaagctctctttttatgtttgcccccactgtcctgagaatgcaagaacaagatccaggagcctatccccaaatttcacagagtttattaaaaatgacaatgtatttgggaaaaaaaatataaaatatatgagatagcttccgttctcttcggaggctgcccgttt

SEQ ID NO: 33 - DNA, 596 bp, Homo sapiens
cggccgcatctaagtttattaacttatattataaaattacttttttcttttgtgaatgcacaccatacttcttcatcttttatccctggggctcccaggcaacatcagagtgagatatttttgtgagtctcagatattattaaaaagatgctgtgggagggttgatggaagcacacaatatcacagctcctcttcctcttttcctacggatgaaattcaggctatcggcccatcgcatcagggtgagctctgctcatcagcatcactcaggagcccaaactgcaggagcagccaccatttcaaatgtcactggttgccacactccttaacatcacctaagtagcaagtagcaggtctgggattccgactctgatatattgattccaatgctgaaagctccaagctgtattaccgcactctctggcttcattgatgtgcagtttgtacagtcacacagggtcctgtgctcagaggacatcaaacttgatgtaatgctgtctgtcactgtctggaagttctgaataatttttgaacaaggagttcctcatttttcttttgcactaggctccgcaaattaggagtcctgctcttctact

SEQ ID NO: 34 - DNA, 921 bp, Homo sapiens
aaaagactcagaatggatggaagttgtttataaattctcctctgctgcatactgttaagaaggggatagaggagtgctggcagatgctgagactaggacataaaaagattaagtggcatggtttgaagtcacacagtggagatggtaatgagtgaccaccaggaacccctcctgcattctcatatttcagcattacttcctgcccctggccacagtgattgacggctcttggaagaggcatatgatgcgagctgagcccatcagaatccttctctgggatttttctttctggagctggaggaaaagagttctttttgtctggtcgggcatccccctttttagaaaactttctttccacccaaatctgcaagattgtagagggagcagccattgttatagtataaccctgcctctggtcacagttgattgttttaaaggaaaacacttgacccaagaaagactaattagtcctgtgttgttttaaaaatatatctgtcagaggcgtttgaatcacagcgactccatcttgagtgagggctggaaaatgagactgggacctgctgggctgcgtcctcagaaagtttggcattctgagcctctagatgtttacggttaagggaacaaattaataatgtttactaacagacccagacttgggagtgtccagatatcctgatatctggagaacacaggcattcctaattttgctttaaagataataatatcgattcttgcaaaatatagtcattaagaaaattaatcctctatcacaaacccttggagcacatctccccatatatacaaacattgtacctagggtggatgtgttcctcctctcactttcaggaatgtcctactctgtctatggagtagctgtcctttcaccactttacttacttaataaacctagttcgccaaaac

SEQ ID NO: 35 - DNA, 471 bp, Homo sapiens
ccagctgccatgttgtaaggacactcaagctgctctatggagaggtccacatggtgaggaactgaggcctctggccaacagccacgtgagtgtgccatcttgggaaaggatctgccagccccagtcaagccttcagatacctgccaccctgcccagcatcttgactgcaacctcatgaaagaccttgagccagatctttccaggaatcataaatccggttctgattatcgccacacacacagatccttctcaaagattcagagtcttattcttttatctcttccctaaaatacgatctaatttacaaaactttgacttacaactccgccagaagcccagctggcgtgtgaagtgatgcactctgcagccggcagcactgaaaagcaccggcctcccgggaacccagcaaggaccgtgatcttcagttattttgtgcaataaagaaattttgtaaaacgaaaaaaaaaaaaa

SEQ ID NO: 36 - DNA, 789 bp, Homo sapiens
ctcggtgttgggataaatccacagtctgggtcttttctgattcttaccttttgatcgggcccccaaaaggtatctggccttgattttcaccccaccagtgcccagattttttatttttaataaaaagttaaggtgggagggtcaggtgtttagctttaaaaattgtgtccggaactggaattttgtttttacatgcaaacacacaaacacacacacacacactcgcacactcacagagagagagagaatgttgaattttgtctccttttgaagttctattatgctggtcgtgtatcaagtttgcttggcatactcattttctttttagctgctgaatccccttagatgggttgttattttctttgtcagctgattggtatcacatatgatccctggagaatccaagtggtagcattctgggagtgtctactcccatgggcccttgacatacaagtaggcagtgttagccccctcctgaacacctgaaggaagcctctttgttttcagatatcttcatattctcccaggcttagtgccaaagaggagacaacccacatgtttcgctatttattttcttgttggattccatagaaaccaaacaaattatagtaaggagcttccctaggaatttatagatcccatgggtcaagtcttccaatgatatgctattttcttgtcattgccttatgacttccagcagtaagtttccaggcattcatccattccttggagttttcttcacaagaaatccagcagagctcagggtcacacctgcaaagggccatcagt

SEQ ID NO: 37 - DNA, 283 bp, Homo sapiens
cctggcgcaacgcgctttatttattatttagttgatcttttcacaatttttatagtgagaacctggaacaataaaagagttcacataattgttccatcattttttgtgggagggtgaaaggaggatgagtatagatagataagagatagggaaggcaagtgatcaacaggtctctgccctgtaacttctgccataagacatgcaggtgggtgcccagtacccttaaaaaggctacttcctgaggttttcttctatttcattgtacttccaagcaattcttctt

SEQ ID NO: 38 - DNA, 1017 bp, Homo sapiens
tcaacctgcgaacttggaaactatcaggaacattaaaaaatgatctaaggaccctgatgccacaagcaagagtctcatacttcatttcatcagtcagctgtgtcaacctccacaagaaactcaagctgccttcttcagacctcatctctcaccctgttcttcacatacccttctcaatctaccatttcttcccaattcctaaagtctttctattggatcatctggaattcacaggatttggatctatagcatcagctcctctggttctcaggcctttggacttgaactgaattacaccaccagctctcctggctccctcaaacttgaggttggcatatgaaagataacaaggcagtcaagaactacagggaaagacacggaagtagaaggaaattcagcaagatcaactttggtgctacttttcacctggaggtacctgaccatttcagaagagggaggtgagaggctaagcagctgaacggaactttcaattgactctaagctaaaatttctacaaactcatagggttagaatcacaatatattggagttcaatctataaatttcaagatgtgccatcctcatcaagaagtataaatacaagcaaagactcctaggcacactgtggtagtgactgaaaagcaaaaaccaaaaattttaaaagcagctacaaaaaagatatattacctttaaaggagagtcaatcagacttacacctagcttctcaacaaaaaacagtggatgccagaacataataaaataacttcaagttgctagaaggaaataaatacagatactaattctataccacgaaaaatacctttcaaaaatgaaaattaaaacagagacattttccgataaagaaacgctgacagcattcattatcagtaggccacaataaatgaaatattaaaggcaattcttcaggcagaagacaaaccatgttagttgaaataagatgcaggtggaaatgaaggacaaggaaaagggggaataaaataaataccgatgctgggcg

SEQ ID NO: 39 - DNA, 555 bp, Homo sapiens
ctttggactcaagccaggactgacaccaccatcaaccccttctctgctacacaggacttctgactcagactaaattacattgtcagctttcctgtttctccagcttcaatatggcatgttataggatacctcagcctccataattatctaccagaagactctgatgtatgggatgacatagccaacatatgcctccctcaacctagtgattttacatccatcacataatcaagaagtaagctgtattaatccattgtcacactggtataacaactaccctgggactgggtaatttataaagagaagagggttaattgactcacattccttattggttgggaggccttaggaacttacatcgtggcaaaggagaacaggcaatcttactggtggcattaaagaagcaccaaagcaagaataccgtttataaacatcagattcttgtcacccctcccgtctaagaccgcttgtgaaggcccctcaggtccatcgctgcccaccgtccttccttgaccttgggatatcgggccataattgtatagaatgcgggcggaa

SEQ ID NO: 40 - DNA, 496 bp, Homo sapiens
gtctttggactcaagccagggctgacaccaccatcaaccccttctctgctacacaggacttctgactcagactaaattacattgtcagcttcaatatggcatgttataggatacctcagcctccataattatactgagtcaaccagaatccatatcataagctggacatttatgttatgcatcctcttatgtttgaatgaaatagataagctaccagaagactctgatgtaggggatgacagagccaacagatgcctccctcaacctagtgaaagaaataagctgtattagtccattttcacactgctataagaactacctgggactggggaatttataaagagaagagggttaattgactcacaagttctgcttggacaatcatgggcaaaagaaaaaccaggcccttttacatggggggggggcaagaaaagcacgcaaaacaaagaaaccgctttataaaccctcaaatcttatgaatacccactcaccatca

SEQ ID NO: 41 - DNA, 476 bp, Homo sapiens
ctttggactcaagccaggactgacaccaccatcaaccccttctctgctacacaggacttctgactcagactaaattacattgtcagctttcctgtttctccagcttcaatatggcatgttataggatacctcagcctccataattatgttctgaaaaagacatgttgaacagtgagaaatggaggagcggtgtgattaattgtcaagagagagaagcgcagaagcataactcttcttcctgacagatgctccagctgattacatacagtcaagtaacagagttgttacagatatttggccaactgttttaggtaccatctgctcattttcccccagaagagtaaccccttttcaaaggttaaagggaaggttaaaaagcctgtttagacacttcacaaattttcaccaatttccagaattgtgagtcacttaaatgaaatgcaaagaaaaattaacaataaaaggcgatccgccag

SEQ ID NO: 42 - DNA, 791 bp, Homo sapiens
  misc_feature (1)...(791): n = A,T,C or G
aggttggagaagtcattagttggattgaatacaaatatttatagtataaattatctacagtataatcatctttcatgcagcctgtactaactttgacaaatttaggttgttactcaggctgaacctttggctcccagaggagatgcagcttcactctcaaggcatagactttgcatcctcctgagcaccaccagatatctctactgaagtccacagaacaagactattggactacatgttctgtatgttctctaacaaatatttagacctaaggattttgtttcaatgttttccttagagagataagattcatttatgtcatatggaatgatgaataaacctggctttggggatttgatggaccttgtatttttctctacaaggccttctggaaaacatcgcttaatttatctgtttcttaatttcccatctgtaaaaaaaagtggcaataatgcttatcttttcaaagttttgtgagttagataaaataagacatgtataatatctgatcaagtaagtactcaatggatagtaatttcctcctctaattgtcttcaataggtctagattcaatttttttaaaacaatgataagacttcatttgagggctatttggacaggtttgagggggcaatgatgttaggtggtttgcaattccatcatagtggctagattaanggctatgaatgtcaaggtataaatggatgcctgagtgagtccaatggctctgtggccaaaactatactggatttgtatatttattaaagagaccacaanaatgctgccacctt

SEQ ID NO: 43 - DNA, 1066 bp, Homo sapiens
aatcagctacaaaacataaaatacatctcaaaaagaaagaaaaaaacccacaaggtttggcaaaagaaagaagaaaaataaaactgagtcctctgtcttgcctcatcgcctggactggtctttggactcaagccaggactgacaccaccatcaaccccttctctgctacacaggacttctgactcagactaaattacattgtcagctttcctgtttctccagcttcaatatggcatgttataggatacctcagcctccataattatactgagtcaaccagaatccatatcataagctggacatttatgttacccataggaattcctgttatgcatcctcttatgtttgaatgaaatagataagctaccagaagactctgatgtaggggatgacagagccaacagatgcctccctcaacctagtgatttacatccatcacataatcaagaaataagctgtattagtccattttcacactgctataagaactacctgggactgggtaatttataaagagaaggggtttaattgactcacagttctgcatggctggggaggcctcaggaaacttacaatcatggcagaaggagaagcaggcacatcttacatggtggcaggcaagagaaagcaagcaagagcagagaaaaccgctttataaaaccatcagatctcatgataactcactcaccatcacaagaacagcatgggaaaagccaccaccatgatccagccacttcccacctggtccctcccttgacacgtggagattatggggatcataatttgagatgagatttgggtagggacacagagttaaatcatatcacaagcttttgttgtattaagtaactgaaattttaggattttctatttatatcacttaccctaccttgattaatatagtcaattttgcatcacttaagaatcataagcttttacctactctgatttacaaacaaatcttggtaaatcaatatgtattaatgtgctattttacatacaagattgatcaaatttacacatttaataaatgccaggttcaaaatttgtaaaaaaaaaaaaaaaa

SEQ ID NO: 44 - DNA, 1020 bp, Homo sapiens
gattcatcatgaatatccataatatggtttctacaaatgcatgaaggaatcagaggagacctgctaaccatgaaaagaagagcatagcaatagagaaccaaagtggcacaagaatgatcatctttgaataatttagaatcaaataacatcaaatcaacaaacacttattgaagctctccatctttccatccttgattcctgtgttattcagcatttttggtaggtttccagcaggcagccttctctcaaaagtactgttaggttgtaatgtttgcaagtgctgtcttcaggctctcttactgctgatgagtatcaatcacataaaattgtgtaaactcctgcttcataaaaaagcaagaggcaaaaatcttcctgcttggcatttcaatgaagttgaattcaatgtcatgatagcagtaaatataaattgatttctagtatgataaccaataaggagaccctaagtttctctcagaacccagatagcatgtaataaattctccatatcttgacaaatttttaaacaaagtattttagctcttcttctagctttcaaaatatgcattaaaaccagaagacaaagacttaaatccaaatgcagtatcatcatatggcaatgtcacataattgcatgaaaaaattgattctaaattataaaattcattataaataaaaggtgagaatgcagtgatatatagtgtagtggtaccagacaacaagagttgaaatcctaaattaaccgcttaatagatgcataaccttgtcatatttcttaacatatgtgtgcttcattttctttgtctgtaaataggaataatggtaactactttataggatagttgcaaaaattctatggattaataatgcctggcacatagtaagcgccaaaaattgtgtttgtcattattagtagtattgctagtactattactcctatgaataaaagactccatgagcaattaggaaaataaaacaaggtgcggccgaaatttttcctcttttctttaaaataaacgtaca

SEQ ID NO: 45 - DNA, 884 bp, Homo sapiens
  misc_feature (1)...(884): n = A,T,C or G
ctgccgatccctgtttattcacaggctgctgtaacttctggggagccatcaaggtttatttagactagagagaaccttcttttccttaaaaaaaaaaaaacaaacccatatacacaggagagacgtcttatttcattaggatctacttgaggaatcatttcttttcttgcttttataaaaaagtcctttgcctaaagaacatacatgcttcttcctgaattcttgcagacaaactgtttgttagaactttgatgagttgggaatgtattacagcagctgtcactgggttaaccatgtgattgctcctacagatgtagttgcttgtctgagtgcatttcccgggagaggggagtaggcaagccggaaggtaggaaagctgtccaggctacttcttgtctgagctccactgctttccggccttgagataggagcttgcccagggtacttggcctatttggttaaagttgcagtgtttgttggtgaattttcattaaaatgaagagaggctccaagaagaaaactcttctgttaactctgcagtgacaacctggcaaagaattttcccctctcgctcatattcttggttttttgtttctcacaggggtcatcaatcagttaggaggtggccaggtcttccaaggaaatccggaatgcaggagtcacggaactccaggtgttggttgttctttaaataggggcaaacggctttcttctcctctgcacttcttgatcttttggcgatggcaaatagcttcaacagttctaatcctggagcgttggttattataaaagcactcgaacttaagtcccaaactgttgtgncacaacccttactgcgtagcattttactgtgatagcctctttgcgccaaaacatctgctttc

SEQ ID NO: 46 - DNA, 267 bp, Homo sapiens
actaaaagctgtgtttctcatggggaggcaccaaaaaaatccagaactgcaaaggagaagaaagccatttgccactattaaagatacaactcaccccccgtagattcagggactcctgacatccctatttccttggaggacatggccacctcctaactgggtgattacccctgtgagaaaaaaaaaccaagattttgagcggaggggaaattgttgtccggttggcttgccgatttaccaaaaactttttttttaaaaaacttttgt

SEQ ID NO: 47 - DNA, 413 bp, Homo sapiens
tctaggtttatttctaggatatagggtgccaaggagaacgcttcaggaaggagaaaggctcctgtcggtgactgaatttttcaggaactaaagtgggagtttttgggacggtgctattgagcgacgtgggtggcactttatttttcctggggagcgggggttgctaggggttgggaggtgggcggtggaagacaggcttgatgaacagaggcagcggatccccagctaagcgtcttcacacggttgctaggtgtcagcgaggcaaatgccaagttcacaaacttgttcccgtcgtgggatgctgcgatcttgccttgatggagtgtcgggggcctctgggaggtgcgcctgtgtgtgttccgacccagcctctcgctgcggatttggctgtatcatcttttggaggtgttgtt

SEQ ID NO: 48 - DNA, 904 bp, Homo sapiens
actaaaagctgtgaagctaattggcaatcaccaaaaagatcaagaactgcagaggagaagaaagccatctgccactattaaagatacaaccaacacctggagttccagtgactcctgacatcccgatttccttggaagacctggccacctcctaactgattgatgacccctgtgagaaacaaaaaaacaagaatatgagcgagaggggaaaattctttgccaggttgtcactgcagagttaacagaagagttttcttcttggagtggcttgggtgagagtggtagaggtggacaagatgatccgacattggatcctggatatattttgaagcctctcttcattttaatgaaaattcaccaacaaacactgacaacttaaccaaataggccaagtaccctgggcaagctcctatctcaaggccggaaagcagtggagctcagacaagaagtagcctggacagctttcctaccttccggcttgcctactcccctctcccgggaaatgcactcagacaagcaactacatctgtaggagcaatcacatggttaacccagtgacagctgctgtaatacattcccaactcatcaaagttctaacaaacagtttgtctgcaagaattcaagaagaagcatgtatgttctttaggcaaaggacttttttataaaagcaagaaaagaaatgattcctcaagtagatcctaatgaaataagacgtctctctgtgtatatgggtttgttttttttttttttaaagaaaaagaaggttctctctagtctaaataaaccttgatggctccccagaagttacagcagcctgttgaataaacagacagcatttacattaacatttctttagttctgtttgcatgcagtggtttttcttactaaaaataaagatagatcg

SEQ ID NO: 49 - DNA, 802 bp, Homo sapiens
gctctctaatttccaccgctacaggaggcacttaagataagaaatagacatggaaactttattgggaatgacactcaacctgagaggacagaggaaaaatttttcctcctggatatatttattcataaatgaaacatctcttaataaacatctggttgctcagatcatatagaggccttactttggtggacggccatctacaacatcactgcctgaaatgaaacacagatgttaactgtttaattggactggcctattcatgggattgaaaagattggttcagctgcttataagatggtccaccaattcaatttctggactgtaaatttcttggagaggtttcagactggataatcttgggactcagaaagcaataccccgaaatgaaggcctcataatcagcctcaaagaaaaaatttttccctgaccttcccctgccctcctatttgtaagtcccatgcctccccaaagctagacatggaaattataatccttcttccccaaggtgggttacagaaaacagaatcccttttccccaaagcccgccagaaaacctaccggattttgccaactttccctttttcttgcttggtaaaaactggctataaaaatttatccgacgtccccccgttgactttgttgccttacacccactccctaattaaagttcacatctaccctcagaggaaaaagcgcatgttaagataggcaagcaacaatcagacagacaagtcttgctggttaacccattacgatattatctctcaccccccccttttcgtttattctgtttcacgtgacg

SEQ ID NO: 50 - DNA, 973 bp, Homo sapiens
acactcaacctgagaggacagaggaaaaatttttcctcctggatatatttattcataaatggtgattcaggaaagtaggatcaattcatgtaatattgtgttgagggaaatattcaggggtacatgtgcagttttgtacatgggtaaattgcgtgttgccgaggattggtgtacaaatgatcctatcacccagaaacatctcttaataaatatctggttgctcagatcatatagaggccttactttggtggacggccatctacaacatcactgcctgaaatgaaacacagatgttaactgtttaattggactggcctattcatgggattgaaaagattggttcagctgcttataagatggtccaccaattcaatttctggactgtaaatttcttggagaggtttcagactggataatcttgggactcagaaagcaataccccgaaatgaaggcctcagaatcagcctcaaagaaaaaatttttccctgaccttcccctgccctcctatctctaagtcccattctcccccaaagctagacatggaaattagaatccttcttccccaaggtgggttacagaaaacagaatcccttttccccaaagccagccagaaaacctaaaaatatttttctaactttccctctaccttgctgtgtaaaaactggtcataaaaatttatctgacctaccttgtttgactgtaggtcataagacccccccactcaagagaggttcagatctacactcagaggaaaaagtgcatgttcagagaggccaagaacaatctggacagacaggccttgctgggtttccccactcagcatattagcattagatcatacacatttcgttcaattatatttctacatggatgtctgtattttgttgaacctaagcataagaatggacaattttccctgtatgtttgggtcttcattctgaagacttctatgtgtatacattaaataaatttg

SEQ ID NO: 51 - DNA, 959 bp, Homo sapiens
  misc_feature (1)...(959): n = A,T,C or G
attatgacagcagcacctcagccgttccgagtagacatcctcccggtagatgatggcacgcctagaattgtcaccaacctgggactccagtggctggaatacatggatggcaaggcaaccaacctgatcaccaagaaggaactgctgaccatggacccagacaccgaggacgcgcagcttgtctatgagataacgacgggccctaagcatggctttgtggagaacaagctgcagcctggcagagctgctgccactttcacccaggaggatgtgaacttggggttgattcgttatgtgttgcacaaggagaagatccgtgagatgatggatagttttcagtttctggtgaaagacagtaaacccaatgtggtcagcgacaatgtcttccatatccagtggtcactcatcagctttaaatataccagctacaatgtcagtgagaaggcagggtctgtcattgtcacnggggcaaaagacttgggaacctgaaccaatatgccattcgccttgtgtcgcaccgagcaaggcaccgccagctccagctccagggtcagctcccaacctgggcaacaggactatgtagagtatgctggccaggtccagtttgatgagcgagaggacaccaagtcctgcaccattgtcatcaacgatgatgacgtgtttgaaaatgttgagagtttcactgtggagctcagcatgccagcttatgccctgttaggggaattcacccaggcgaaggtcattatcaacgataccgaggatgaacccacattagagtttgacaagaagatctactgggttaacgagagcgctggttttctgtttgcacctattgaaagaaaaggagatgcaagcagcattgtatctgcaatttgctacacagtccctaagtcagctatgggaagtagcctctatgctctagaatcaggctctgattttagataaaaagggatcggcag

SEQ ID NO: 52 - DNA, 769 bp, Homo sapiens
cggccgatctctttttatttttcaaaacactaataattagttaaacatcagtttatgtcccctcaacctaagagtaactaaagataatttcttctgttaccatcttcatcattggatatggtgatggtggccatgttattctttccaattctagctccactccagtggtttccaagaggaaggccgaggtagaccctgaactgttcctctggctcaaacatggagtcatcgtggatatagaccgtacagttcttcactttgtcccctttgagaaatgtaatccgtgaagagtctgcattttgtctctcctcaaagtcctccatgacctgagcggaatggctctgagtatagcacctcactgatgactcatagctcaggtctccgctccgagtgatagggacatgcaggacaccctccttctccttcactaggagcaaatccttggcaaactgcatgctgggcgcatcttggaatgtgtcattaattgcaatgactgcctggaagggtttggtcagttccggcttccttgtgctgagctgaagaaaacccaaatgtctccagtccttcagttaccggatactgagtgtcatccaagatagtcaaggtgcaatactggtcaatgacaccaggcccaaattccactcttccgagagctgggaacgtattcaactccctggtgtggcagaagctgagtctgagggccgcgttgcacaccagacagatgcgaaagtagagaggtcagtaccatggcggatactggatctttacg

SEQ ID NO: 53 - DNA, 1244 bp, Homo sapiens
ggggaaggtagtctgcaacgactctcttaatctaccaccgctacacgcactgggctgaggtgaacccttcaaataaaagatgacaacctactaacaaaacaatgaggcagaagaagtgggtgctaagaggaaaagtaactaagaggagaagtaactattagcaattacttgttgccagtaaatgaaggatgagagacggagtaataaagactatggaaatcatgttagacaaaatcaaactatagcaactttcttattcaagttcaaaatggcccataaagtagtggagacacctcacaacatcaactatgcatttggcccaggaactgctaatgaacatacgctggagtggtggttcaagaagttttgcaaaggagacgagagccttgaagatgaggagcatagtggttggccatcagaagtcgacaatgaccaattgggagcaatcatcggatgatccttttccaacaacccaaaaaggtggcaaagcactcaatgtccaacaatggaaagtcatttggccattgaaagcaaatgggaaaggtgaaaaagcttggtaagtgagtgcctcatcagctgagtgaaaatcaaaaagactgtccattttgaagggtcgtcttctcttagtctatacaccaacaataacccatttcttgataagattgtcatgtgtgatgaaaagtggattttatatggcaactgatgtttggaatgagaaaaggcttcaaagcacttcccaaagccaaacttgcatcaaggaaagttcatggtcactgtttggtgatctgctgccagtctgatccattacagctttctgaatcccagtgaaaccattacatctgagaagtatgctcagcaaactgatgagatgcaccaaaactgtaacacctgcagctggcattggccaacagaatgggcccaattcttctccatgacaacaccccaccgcatgttgcataaccaacatgtccttgaatgaattgggctgtgaagttttgtctcatctaccatatttacctgaccactcaccaaatgattaccacttcttcaagcatctcaaccacttttttgcagggaaaatgctcccacaaccagcaggatgcagaaaacacactttcccagagttcatcgaatcccaaagcacagaattttaagctacaggaataaacaaacttatttcttattgggaaaaatgtctcgattgtaatggttcctactttaattaataaagaatgttcggccag

SEQ ID NO: 54 - DNA, 716 bp, Homo sapiens
tggtattacagggctagtaaatcaaacccccaaaaactttctccaccgaacttcacctgtaacctctaccatttaaaggaatttccatttctgtgaggttcccaagatttgctaaacctaccagcctggtcgtaggacatgataaagaagaaaaaaggaaaaaaggtgggaagactgagaactcacctattgattcagaccaaaacccaattcagcttttccagaagacaagagtctgcgtcatagattgagtgttgctgcagtaatgtgaagcaagcctactgtcaccttctcatagaaaattggatatctttcctgactgcctgttgtggactgaattgagtccacttcaaaattcatatgttaaagccctaacccccaatgtcactgttaaggaggaaattaaggttaaatgaggtcatatgggtgggaaccttaattcaataagactggtgtccttatcagaagaaacacaccaaggatgcatactcacagaaaaaagccctcatgaggacatagagagaagatggtcatcagcaaggcaaagagagaggcatcaagagaaaccaaacctgcagacactttgatcttagacttccagcctccatactgtgagataaatttctgttatttaagtcacatagtctgtggtattttgttatggcaaccctagcaaactactacacagccttttcatgaaaaaaaaaaaaaaaaaa

SEQ ID NO: 55 - DNA, 249 bp, Homo sapiens
ctaataaccaccgctaccagatcaacttgatttataccacttctagatctataagagaagtggagcagtgtcgaggaatggcgagtgaatgccttgcacactggagaatctctagcaaaacagtacttgaagaaagagagtaaattacacttataagagtatcatcaagaaaatttctgtcacagatcttataccttatatctaaaacaataccaaagaatcagcaatcccactactggtagataacca

SEQ ID NO: 56 - DNA, 305 bp, Homo sapiens
atcaacttgatttataccacttctagatctataagagaagtggagcagtgtcgaggaatggagtttaaagagaaattcgagtgaatgccttgcacactggagaatctctagcaaaacagtacttgaagaaagagagtaaattacacttataagagtatcatcaaattatcctaaatctcaagaaaatttctgtcacagatcttataccttatatctaaaacaataccaaagaatcagcaatcccactactgggtagataaccaaaaagaataaaatcagtatgtccaaaaaaaaaaaaaaaaaaa

SEQ ID NO: 57 - DNA, 1024 bp, Homo sapiens
ctgccgatctgtctttattgaacagataaaagggtatgatgagaaaagcctttcattaggcacagaagagcctgcctagttattctggctgataaactctgagggtcaggagagctgggactactcttacagatcctgatcagcaatgaatccctaatcctaacacaacagtggaactttttaaagttatatgttacttttgacacactgatataaactatgggctttttctcctgggaaatttgaaacccaatgatagggctctatggacccctgattaagaacccttggcactagtagatggtagtgtgacttccaacatctgatttagtgtgtttggaccctcattctgcaaaatgtgaacaattcaccgcatttggtaattatgagtgctgagtgagttcatactcacaaatgtttaatagccagaatatactaagtgctaaatgcacatatgaaatttttaactagcactatacctggcacattgtacaagagttcagcaaatatttattaaaggaataagtaactgttcttacctacttctcaggattgtgaatgtcagatcattggcataactttgaaaattataaagcaacaaatgaagaattcttgtctcattctggggctttgaggatattcataggacataaatcatagctctaccataaacataatgcttcttttgcaagattcgctatggtatttgcttccatccagcaacgcccttcaattaagttgactttttggcatacttaacatttgcatgctatgatacatctctcatgtgaccctattctcttttttaatcttaagaatcttatgttttcaatataaccaaatgcagaagttcagtttctgacactgaaagctattccagtgttttggagaattctgacatcgtaggttctaaaatgagatatgagcagaaagaagagctcttggtgggagaatcggactttctcctttctttcaatatggtgagccagacaagaggttgtattttcttcaagatgtgagttat

SEQ ID NO: 58 - DNA, 448 bp, Homo sapiens
tctgtttttatttgatttttgttttagagttctctctaaagattttttaaaaaatatttttgccttaagtcaagtaactcagaaacagaaagtcaaataccacgtgttctcacttattaattgggagctaaatcgtgtatacctgtggacatgagtagagtaatagacattggagacttagaagggtaggaagagggtgaggaaagagaagttacttaatggagaaaaatacacttgcgtaggtgatggctgcattaaaaacccaggcttcaccactgtgcaatataggcacataacaaaacagcacttgcaccacctccatctgttcagagtgagaatcttcatcccacaaaacatttttcttcagaaaagtaatgatgaccttaggacttgagtttctcaacatgtgtatcaggagtgtccaattttttggcttccctaggccaca

SEQ ID NO: 59 - DNA, 395 bp, Homo sapiens
catacattaagtgtgggagagagctatcctgctcaaaagagagtgctccccattctgacacatctggaaatcatctggcaaatgtcttctgaccgtctctgagtgaaaaagccttcgagtgcatcagcccatttcagctccacaactttctcttgtgatcatccctgttttacaggatatggagggtgtgggtgatcactcagtgctcttcggtagtgatgaaagaatcagactccactgcagaaaacacctcattctattctcagaaggtcagtcatgagaaatggagctttctttaaaacaggcttacagaaaacaaaaacacgaactttttagcttattaacgaaaaagctctccatctgctttttttgttgttgttgttaataaacagaga

SEQ ID NO: 60 - DNA, 379 bp, Homo sapiens
actctgacctgaatttaacatacgagtgtccagtatatctgggatatcactggagctctatgcattagccaaaggttatgagccttgttcaccaagactacggtccatgaaggaggccaacctggtagagatgatccctgtgagataatggaacattcactcaataaatcccagaaggaaaatttaaacgacgatgaagcaaaagaaaaggaattgtcactcacggctggtgggctgagtacaagttgatgtaacttttggggagggaaatttagtgatacctaagaaaattgaaaatgcatatatccttggacctggaagttctacatctagaaatatgaattattctcacaaataagtgcataagaataaatcaaga

SEQ ID NO: 61 - DNA, 1029 bp, Homo sapiens
ctccaccgctacacaagttcaacatcttataatattatttggaactttataatgtgagttgaccgaccagctctcagaaaggtggggactttatgtataaaacaaacataagacaaccctgaagtctgaagaaatgataacctgccaaaggacactgtggcatgaaggatgacttggcagcaggatgatattagtggagactcggctgtataggagaactgagtgaacccagagggcggaggttgcaatgagccaaaatcgcaccactgcactccagccttggtgacagagcaaaactctgtctcaaaagaaaaaaaaaaaagaagaaaagaaaataagagaaaacatttttattttacaggattttagttaaaatggctgtcaaaataacactcaaatatgaaaccgcattcaaagagcctatattgattcacaccatttaaaagcttaggcgtgtattggcagtaatacattaagcacagaaaggtgcctaaatatgtgtggaatcaagcatatgaaatcaaaaccaagaaagaaaatacaatttagaatcagaagttgaattataggtcatccaccccaaattcttgcttataacaattacagggtcactagaacatggcaaatctcaacattactgtcacgtagctgtgagcctttagataagatgattcattccaaaaagcttccaatttgtttcctgcagaataaagacaacgattcccatttcataaaacaatgtataaataatatatgaaaaacatgtataacattatgtctgacatattggaaatactgaagaaatggtagacatttcattataaattctttttctttttcctctgctaccctttccaccaaaagtctgtacttcaagttccatagcgtgcatttgacattgaaaagtgcaagctgctctcccagtaaccactttcttgacccgattcttatctaaatgtggtcatgtactaattgccactgcagaggtaaatggaagtgatgtgaacagaataaaaacagatcggccag

SEQ ID NO: 62 - DNA, 743 bp, Homo sapiens
cggccgatcgagttttattctcaaatttatccagaagtttgaaagttgtctagttatgccaattttcacatgaggatgctgtagaaagggatgctgaagaagatcatggcttcttgttttcactcccagaatccctttaccaaagtgttgccgtgtatgaaatcacagaagtaggcgaacagaattccattgtgatgtactgtgttgtccactctcactcctctgcactggcaaaggccacctccactgttccagatgaaaaatctctctataatcatggaaacacaagaaaaacatatttaaaattatttgcagaaaagtttgtaaatcaagcatttgaaagttgtctttttgatggctggtatcctagatttcattcagcaaaacttttctgtttcccagaaaatgctttacatttatttttgtttcattaagatctgaatttacatggacacagactttcccaaggtcagggcaacgatttcactcaatgggtgattatcaaatagccctcattcaaaagtaatcgcccgcaacttctagctttaaaacatctatttataaatggcttaaaaatatactttattatagagttccgtagtgagtgatcgagggtattaaggcaactgtgtttcatatagtcattcaggtatccaggcttcttccctcgggttactctgccacttcctagggtgatcatgttataggcatggtagaagttgggtagcttcagtgtctgaatt

SEQ ID NO: 63 - DNA, 677 bp, Homo sapiens
ttacttgcataaggtgaaactgaagtttctgaagacatgagctggagatatgatgttgggagtcatgggcatagaggatttaaagctatggaactgcaggggatgacccagaactttaggcagaagcctgaatagagatcagaaatctgaggagaaaatgacaaaggagactgaggaagaatcacggttaaagaaaaatgaaagagtattattccagaagccaaattcagaaagtgtttcaagaaactgacaaattctgatcataggttaaataatacatgaactgagaaattgtgacttccacaaatcataggggtgaaaatggttcagaaaagaatgagaagaggatttggatatgattaattgtaaaagaagataaattcttctatgaaattaatgtaaaggagaacagaaaggctttcagagcatgtcatatattgaccacttccatccttgaaacatgtttactggactttgacaaaatcactctcttctagagagaggtaaattgttatcaccacaaaatgataaccatgtgatgtaatgcacatgtatatgttaattagcccgatttagtcattccacaatgcatttatacttgaagacataatgttgtacacagtaaatacatacaattgtatctgtcaatgaagaaaataaaacccgtatgcggccag

SEQ ID NO: 64 - DNA, 527 bp, Homo sapiens
tggagcccaagaccactccctggtgagcttcctgaggctcacctccatctgatgatctgcttcctggaaatcccatccatcctctgacagttagaaacatgtgattcacttgttcagtgaacatgctagtcaagctgctgttctaacatgaaatgggggccaagcacaggagtgtcttcagtaggaactgtacctccagaacttcaatttctacagaagattcaccgactgttcccccaaaaaacagtcctgaaatcatgcctaggagttaaagtgactaagaatgcagcacaggacccctgcacagataggccaggtagccaaaggttgccaatcattgcattactgatgctaaggattttattacttgaagaaaaccaggaataggctatttgcaaagattctaactcttgggagttcccatatcactaccttccaagatgccaggtgagccgtggaaaagcagacattcccatgagaccattttgaaagttgtcttgttattggaataaagcaagatcggccag

SEQ ID NO: 65 - DNA, 657 bp, Homo sapiens
atcatgcaccggatgagttttgacaaatttatataccagtgtagccaccactccaaagaagatctaaaatatttccagtactccagaaagttctctcatttttctttgcagtcaattcctgactctctcctggcctcaggcaaccagtgatctgcttttagtagaggcagcaaagctggtaaagaaatactacaatccttctggagaccagaatcctgacttctggatgtgacaacaatctaacaggattctctgatgcagactagcaggaggtatgaacacccctcccaagtcttcctctgccaatatgaaaagctgctccacaaatcttgcccctatacgtagagggcgaatgaagagaacactgatctcaatttcaagaagaaactaaagaacatctacagatttttcttctatctgaagagtcaaaactaattaaactgcaataactttctaccttgtcttcaaatctctttacgttcaaaacttccattaacccatttcatataatctccactaccatttgctatcttcataccaagaaaataaaatgtttgcttactgctctttgaaattccaactcttttcatacttatgcctcaaaaatattacttgtcaataaaaagaaaaacattttacttgtcaaaaaaaaaaaaa

SEQ ID NO: 66 - DNA, 810 bp, Homo sapiens
ttttttttttttttttttttttttttttttttttttttttttttttttttttttttttttttttttttttttttttttttttttttttttttggaccccccctttttttttgtttttttaaaggaccccccaaacaaccgggaaaagggggaaaaaaatcccctagggccccaaaaaaaaaagggggggggcccttggtttttttttgaaaccggtttcccaaaaaaagggcccgtaaaaagggtcccccctcccccccaaaagtttccccggaaaaaaaaaaatgaaacctggggggggtaattttttccaaacccccctttttttaaaacttttaccctttccccaccccaaaaaggggaaaaccgaaaaaaccctcaaactgccaaatttccgggaacattttttttttttaaaacccccccccaaaagggggttaaccccaaaaatccctaatttgtccaatttgtggaaaatggagagttccttagagacccttttttcttttagggcgggccccttccgcttgttttttttttttttctcctttcccccctttcaaaaagggaaaaacctttccaaaattcacttttttgcccaaaaaagattgtgggctggaacaaaaaaaaattttaagagggtgccccacctggcccctttaaaacaaaaaaaaacattatttgtttttaaggggcctgggatcccccctcttaaaaaaaaaaccacatgttttccacctaaacacgggaaaaaaaaagtccccctcccctctttttggagccccctttaaaaaaaaaggccctcacccct

SEQ ID NO: 67 - DNA, 782 bp, Homo sapiens
tattgacaattacaaattccatatacgacacaggaatagatgtgactggtcaaaaggattctccagacccttgtccagaaatgggcactggactcaagcaggcccattctttgcaaggaatgatctgcatactagaagaccatagatgggatagtgctggagtgttgggaacccaagcagagtctcccacagatgatcttgacatgaaaaaagtaagtctgctgacagcctcttacagtaatgatgagttatcacattacctaagcaggaagcagagcaaggaaggctcatttcatatggagccatatacagtgaaggagcaacaccaaacaatggcagctggaaagtcaggagaattgtgaaaacgactaagaaaccctacaagtgtgaggacatctacaagttgttgcagctcctatacaactctgaaatgagattgagtatccccaaaatagacattgtgaacttgtatctttgaatatacccaaagtcagtattgcgatacaaatagctttttttggaagtgattccaggaagcaacattgaggaatgtttgtagtccgaaagaaaagccttctgaaccctgggagagaaaagaacaagtttctgttggtggcaaatggggtccaatcgtactggggaccctttgagagaccatgtgaacttattgagggcaaagattttgtagtttatccattgacccttctctcttggatattaaagtactgcttacattactactccagcatgtgactggccccatagttgtcccgctgaaaaga

SEQ ID NO: 68 - DNA, 899 bp, Homo sapiens
cttttttttcctgcctttttaacatgtcataaaattttttgtgaaaagctggacttaatgtattggagaattgaaactgagttggaagattctgtgcctgttgtcaaggtgacactccccggaattttaaagagaagttttaaagtaggatgctttggctagtatttgcagaaacatatacactttttttacatgataaggaaaacaacagatatttattcttcatcccagggggaaaaaaacccttggaggaataattcagaggcaacatccttaacgggtgatcagtagacacaagactcatcccagtgagccactggttctggcagctgtgtgactttggacagagatatctacaatctttcaatattgtttgtgcaccaactgcattctccacgttgtattactgcagatttattgatgagtaaaacaaattcctaccctcaaggagtttgcaagcaaaagagtgaaatgaagatgaaagtgcaatgctccactgtcttttcgtgtgctcagagattactttcttaatctttaaaatgaaaggcttttgcctaaatgactgagtgatgttgcacctataaccctaatactctttgattcccaaggacaagaatcagaactaacaaggtatataatgacaaaagaattttcattatgaggaacttatcaagaaatcatagagtggagagacttgcactaaaaacacttaaaatgaatgggaagcccgtcagcatattgtatgtccatattttccaaaaagagttaagtttgtaagctactgcataggaccatgggaattctggatgtccttggcctgtatcacatgtggtttcttggcatcttagatgatgcaattttttattgctttgtccgtgcaataaacgccgatcggccag

SEQ ID NO: 69 - DNA, 734 bp, Homo sapiens
atcatggctgcttcagttctggctgccttggtgactccaagatgtttttgaatagtttcccctaccctttggcttttggaagggggtttcaacgaccacaatttagtcactcatacctggaagtaaaagtctagcatggtttaaaaatgcaaagaatttccttggagtacaactattgttggaagaaaccttcactaaaggcctgggacttagcttacagatatagagaaaaacaaagtcagattctcaagttactgcattctcatgtatcctgctttctacttggataattattatggactgaattgtgttcccctaaaatttgtagtctgaagccctaaccttcaatgtgactgtattgggagataaggcctttaaagaagtgattatggttaaatgagattgtaaaagtgaggccctaatctaataggactggtatccttctaagaacaggagaagacaccagagatctatctctctccatgcacagaggaaaggccatatgaggacacagcaagaagacgccatctgtaagccacggagaggggcctgagaagaaaccagccctgctggtaccctgatcttggactttcagcctccagaactgcaagaaaatttcgttaagccacccagtttgtggtattttgttatggcagcctgtgcagactgagacaatcatgaagtgttaatttaatcagtaagaataaaccaacctgaaagcaaaaaaaaaaaaa

SEQ ID NO: 70 - DNA, 566 bp, Homo sapiens
ggagcattttgggaggatctgcctgcctcccaaaatgagccaccgcgcccagccatgggggattttccacatacgttgaaaacatgaggatgttcatggacctggctctcccagatgctggaacacagacaggcactgccatgctcgtggtgtgccggtcaatgaagacgctacaagacagaacttccacagttcagtcccacagagaaagcatgtagggaggggtggtagaaagcaaacgacatgaccttcacgtggaagcttaagaaacaaaacaaaaaagtagcctgggcgcgggggctcacgcctgtaatcacaccacgtcgggaggccaaggcaggcagatcacctgaagtcgggagttcgagaccagcctgaccaacatggacaaaccctgtctctactgaaaatacaaaattagctgggcgtgctggcgcatgcctgtaatcccagcttctcgggacgctgagacaggagaatcacttgaacctgggaagcagaggttgcggtaagccgagatcgcgcaattgcactccagcctaggcaacaggagcaaaaacttcctt

SEQ ID NO: 71 - DNA, 876 bp, Homo sapiens
ttcctgggactcagagaaaataaatgactgcccaaagtcttctaataacaagagacaggttctcaccatgtttccaaggctggtctcaaactcctgagctcaagggatctgctggcctcggcctccgaaagtgctgggattacaggtcccagtgccttctgcatctcacactggattgcaaactttcatccttaaagactcaaattctagtttcaggacgactcttcccgtccctcacaccattaagcccttcttctcttagaggacttagaatatgcgtaaatccacctacttaactctaaagatgattagagagactgtgaatgtcaggttcccaatcagaaatttcactggaaatagtgtctaactcaaatttcatttgcttctcaataacaagaagacaaataacccaattaaaaattggacaaactccctgatagacatttctcagaagaaatacaaatgaccaagtatattttaaaaaatgctcagcatcactaatcagtaggtaaatgcaaaataaaaccacaatgagatatcacctcacaccaattagaatagctatcatgaaaatgatgaacaataacaagtgttggtgaggatgtagagataataactcttgtgtacattgttgatgagaatgccaattagtatagccgttgtggaaaacagtacataggtttccccaaaaattaaaaatagaactaccatatgattcagtaatcttacttctggttatagatccaaaggaaatgcaatcaatatgttgaagagatttctgcactcccatgttcattgcagtgttattcacaatagccaagttatggaatcaacctaagtgtccaagggatgaatgaataaagcaagatcggccag

SEQ ID NO: 72 - DNA, 617 bp, Homo sapiens
  misc_feature (1)...(617): n = A,T,C or G
ggaactgtccttatttaattccctctatatgctctgagatatgacggacatttcacagatactgagtcctatgacttgaaggtctctagccttcaaatccagtaaccaacgtagagtgaacacagaagaatcactaccattgagggctttgtgagaatcagaaatcattctccatctttgagaaggaactcccaggtgcatagcttgctctgagaaaacagcgtttaaagttcctccatcagatgggtgtgagtggggcaggtttccgtatcttcagtttttccaccagtaccggtcatcttcatcaaaagaatgccaactaccgtcaattacgactcggggcttgagtagctgcacttcctccagcagcttccttatttgcacagggtactgccatttccacaggcccaattatctgtaagttagacgtgggacaggcaaaggccgaacacagcttcatcattcctttgggactgaagttattctgcaccaaggtttagactggtcaggatgccgggtttgcaaggaaaggggccaaangaagagtgcctcacagccaatcacaagttcagtcccatgcctttcaacccccgagttttcgtcagaaacacntgttc

SEQ ID NO: 73 - DNA, 1445 bp, Homo sapiens
aaagaaaataaaactccggccgcatcacgttttattttgctcgtgatgtcgcggtcaggaattcaagaaaggcaaagcagggtctctcttgcttggggtcacctacagttgtcatcagaggctggccagggctgcattcatctgaaggcctggctgagctggatgttcaagttgacttgtcacactgctggcagttgatgctggctggtggctggagcacccacccgtggcctctcagcatggtggtcttgggcctactcaggtgtcttatgtggaagctggcttctcaagcaggagtgtcccaagacacccagccagaagctgcacagccttttataagctgaccacggaagccacatcatgtcactttcatgacacactcttggtggaagcagacacaagcctgcccagattcatgggagggggcataaagcccacctcttgatgagtgtcaaaaaatttggcccatgtttggatataccacactgatttttaaaattggattaactaattttttaaaatgttaaagaaactttttatctccacactacattagaaaatcagtatccgttggctgggtgcggtggctcacgcctgtaatcccagcactttgggaggccgaggcaggcggatcacgaggtcaagagatggagaccatcctggccaacatggtgaaatcccgtctctacgaaaaacacaaaaattagctgggcatggtggcgcgcacccgtagtcccagctgctcgggaggctgaggcagaagaattgcttgaacccgggaggcggaggtgccagtgagctgaaggactggatctctgtgtcttgggcaccggggaaccaggaagttcgctgagcagggcaggagctgatcagacatgcgcttttgatggttcatcttaaaggagagagtggaacaggggagagaagggccagctggccctgtgaacttttggtgcctccgttttcctgcctgtgagatgggagtaagcatttatctcagatgtgatcagagagacgcagtgaggcttccatgttggggccatgatgactccccagcatccacgcttaacaacggtctgttgagtaaatggaagggcttcctcaagttcacggtgagtcagtggcagaaccaggagctggaatcaggcttcttgactcctgtttcctcatctgatggcaaagaacatgggctttggagtcagagctggcctcctgctcagccttgtattagtcgggtgatcttaagcaggtcgcttcgtgtcgctgatgctccgtctcctcctctgtaaaacaggcacagtaacagtgcctgcctcaggcaggaggacatgagataacatgagcgatgtcctcagtccggcgtctggagagcacgtttacgatcttttcactccagaacattgatagccagtccagtaccttccaaacagatcagaagggtctac

SEQ ID NO: 74 - DNA, 214 bp, Homo sapiens
ttctgttactagaggagcaagcctgccaaccaagagcatacgaaaccggagttcttgccttatcagcccagctgcatgggaaagctgcctcagcaaggctctgtctgtgaatgcctaactcttcccaattctgaggtcagaaccagcaaccccattggctaagagaactgaagctatatccttcaacttagcttatcgggtaaaagataaaagg

SEQ ID NO: 75 - DNA, 539 bp, Homo sapiens
gactagcccctagagacatgcaacttggtccatgaatggaaagccaacaaacagcattatttacaataatcaagacatggcaacaacctgagtatctattgagagatgactggctaaagaaaatgtggcatagatgtatacaatggaatattatcatccataaaatagaagaaaattctgccatttttgacacatgtaagaaccttaaagacatcatacaaagtaaagaaaaaaatgaagtgctcaggatagcacagaaaagtcaacaaatattttgatatgtttctccataacagggcagaaaatgattttctaagttcaaagaaaaatgaaagtcactggtggtctctaaataattcagactccatatgcaaaatggatccgcaatgtgctcatactagaaaatgaacaactctaaatgtaaaagagctctgataatacaaactgaagcagtcctacttcatggaatctggaactaagtaaacataaaaactggtaatatgtgagaaataaatatagcaatgaacaataaagaccga

SEQ ID NO: 76 - DNA, 732 bp, Homo sapiens
agaattgtcctcagctgataggagccacttcttcctccccacctgtttcctggaggcagccaatgtttgattgatatggaggaacatgaagccagacttctagcccccaaagggtcttattctgaatttgaatttgtttatccagaaggagtgctgtttcctggctggagtgcagtggcatgatcatagctcattgcagcctcaaacacctgtgctcaagcaattctcctgcctcagcttcctgagtagctaggactacaagcatgtgccaccatggccagctaagtgttttttgtagatatgggggtcccataaatatgtacatttacaatgtgtccattaaaaaaataaacaaaaataaaagacttgaagaaacatctctatataatgtttacagagaaaaataacatttgttgttttcattgtgcaaggatatcttgaaggacagatccaagttcagttgcctcttgtatcaataaatcgaaataaccctttcatttttacctaacaaagataaaggggagagaacaaggtggtattcttacctagtgggaatactaaaaggaatgccattgttgtcaaaatgtataaggtatataaatcacgtgggttagagtaatagggaacacaattagatataatattgggaaaccattatttttccttgacaagcttgaagtattcgatataaacccttggaagactaatatgaacatgaaaaataaagattgt

SEQ ID NO: 77 - DNA, 808 bp, Homo sapiens
gtacaaaggttcacctttctctgcatcctcaccagcatctgttattccctgcccttttgataaaagccattttaacggaggtctgccacaaatgtatgcagaggcccaggaggagccaagactgaaaaccggagggcctaagtcagcgtttctcaggatgtgatgtgcagagacctcaatctgaattatcctgcagaccaccttggtcccacccagcccactgaatccaaacctttgggggtgggccctagaatctgctcttccaacaggacaaacaccccctttccactgcactgtaaagtctggggctcaccagccacagacctgactatagctcaaatgctgtgtgtctttatctcctgtgcactagggaaagaaccaggagaggacagcatagggggaagcccaggtcatcctgtgacctccccacctctgccggagtgaccccttcctctggttcaaaatctccaacaacagggtgcagacatgacctagaccaccgtgtgtggtgagattacttgaggacctgaggtagaacgctttcaggatggaaacgtctcaagacttggagtcagacccatttaggttcaacgagtggttctgccactcagtagcactgagcacacgtattatccacatctttggtttccaatcaaaggaatccagggctcctctggaaagaatgttttatatctaacggctggagccagaaacaattctatgcatgagccttggagccttttcgtaagtgacactgtaattaaggaatcacttaatgtggttccccacaaccccataaaaactctaa

SEQ ID NO: 78 - DNA, 813 bp, Homo sapiens
ttttttgtgaagtcacatttgaggaatctccagcacttaccaaggctgatgaaaaaagagaaaggccagaatcaaggctgtgcacaaatgtcataattagtacaaggaggagaagcgggaagtttctgtgatacattttgaagcagagcccctggaaaactcacatatgtgtcaacaatagtccttgatgcccctgtaacaaaacttgagcaaggcctggtgatgaagagatacaagattgtcacccaaggatttgattatacctctgttgaaagttaatgcacactcaaccgaatatggcaattggtactctcaattctatattctcgacaattacagtgaagatacaagtagaatacaatcactgccacattttttgaaattctgtgtaaactgtaatattctgtcaacattaatgacatttgaagtgtcctgtcaaaacaattgcagctactttatgtataaaacatattaaataggctcatccaacttgcattctttattaagcttattttcatattttttcctatggatgaacttaaaaataatttgtttcttaattaagggtctatgcatgaagatgctgaataatttaagacaattgttcattcaaatagttgctaattacaccctcctggcttaggtattggatcattactacattgaagaataatatgctcggctacttggacttgaaaatggtgctgacttttaatgaacacactatttatgtatattgtatcagggtgttcggggaacccaaaggatttaaaaaggggttcaagggtggtaataattaactgactgaattaa

SEQ ID NO: 79 - DNA, 813 bp, Homo sapiens
ttctggacctgtgccagccacatagaaactgcttaataattatttgttgaaaaatgttctaaatgaataatccgcagcaaggccctgagaagtaaacaccccgaaatagaactgctaagtcatgtggtcaagtgacatttaattttataggaagttaccgattgttcttcaatggcaatagataagcagagcccctggaaaactcacatatgtgtcaacaatagtccttgatgcccctgtaacaaaacttgagcaaggcctggtgatgaagagatacaagattgtcacccaaggatttgattatacctctgttgaaagttaatgcacactcaaccgaatatggcaattggtactctcaattctatattctcaacaattacagtgaaagatacaagtagaatacaatcactgccacatttttttggaaattctgtgtaaacttgtaatatttctgtcaacattaatgacaatttgaagtgtcccgtcaaaacaattgcagcttcttttattgtataaaacattatgaaatatggctcatcccaacttggattttttatttaggcttattttcatttttgttgctatggataaacttaaaataatggtgttgctaattagaatgcttgcatgaagatctgaaatattaagacaatggtccattaaatgttggctatctcgccctccgtgcgtatttttgctctgctacacagtgaggatcattgctttgtgtctagggagtgaattctggctgacttttattcaccccgcgttgtatattaggcgatgtatatcgggtcccagctattggtaagt

SEQ ID NO: 80 - DNA, 1016 bp, Homo sapiens
ttctggacctgtgccagccacatagaaactgcttaataattatttgttgaagaatgttctaaatgaataatccgcagcaaagccctgagaaaagcagggcccctggaaaactcacatatgtgtcaacaatagtccttgatgcccctgtaacaaaacttgagcaaggcctggtgatgaagagatacaagattgtcacccaaggatttgattatacctctgttgaaagttaatgcacactcaaccgaatatggcaattggtactctcaattctatattctcaacaattacagtgaagatacaagtagaatacaatcactgccacattttttgaaattctgtgtaaactgtaatattctgtcaacattaatgacatttgaagtgtcctgtcaaaacaattgcagctactttatgtataaaacatattaaataggctcatccaacttgcattctttattaagcttattttcatattttttcctatggatgaacttaaaaataattttgtttcttaattaagattctatgcatgaagatgctgaataatttaagacaattgttcattcaaatagttgctaattacaccctcctggcatagttattgtattattactacatttaggaataatatgctgtactacttggacttgaaaatgtttctgacattttaatgaacacactacttagttatattttacaagggttttcagtgaaccacagaggattaaaaaatgtcattcaagggttgtagataattaaactgactgaatataagaagcctcatatggaagtgaaaattatgtatgaattttgttgagctggaaatgtgttttactaaatgacttcagatttgttacttttaaatacaagatgaagggaatcaaggggatactttcttctcacctcaatttgttccatttgcataagctattttatctttcaatatcccttttgatatttcattttggcccttgaatacactaaagattatttaaaataaataaatgttgatgcgaccg

SEQ ID NO: 81 - DNA, 701 bp, Homo sapiens
ccaaaaaaagggcctttttttttttggcccttaaatttcccgggggccattggccaaatttatggaaaaacccattccccttttgggggaccgaaaaataaaatttcccccggaaaaaagggggaaaaaaccccccttttcccaaaaaccccaaccccacggatgaaaaaaaaggggtttttttccctttggggggaaaggcccacataaaaactttaattttggcctaatatgggggggaaaccccttgcgggggttcccccccattttaaaccccaaattccccgggcttttatagaaaaccccccccctttttcctttgtgaaggtcctgcccattccagaaccagcctaaaccccccctttgaaccggcgtcgggaataccccccgccctagttcccacattaaaccttgtgaggaaggttaggaaaacccacccggaaggggcccatttaggcgaccgggggccaaaccttttttttctctaggaatccatacgcacccttgtactaaaaaacaactctcatggggcaacccccccaccccctaacgcccgttataagcgcccgtgggcgaaccatgggcactcgattataagcgtgcctctcctcttcgggatttccgcgtgccacgggggagcgttctttcccgggcgggagaacgcggggcagcggaacacttacacacaaaaaacccacatg

SEQ ID NO: 82 - DNA, 950 bp, Homo sapiens
tcgggccgcatcacactttattttttagagtagtattggactcacagcaaaactgagagatagacacagaaatttttgtatacgacctgcccctacacatgcatatcctcccacaatatcaatatttcccaccagagtggtgtattcattgcaactgatgaacctaccctgataattcattatatccccaaatctacagttcacattattacattagggttcactaacgcaatattaattttgattaatatatttttccagtttccctagaaaagagagcctgaagcaaaatcatatctgctagcacttcattgaataatacaatcccaaagaagcaggaggggaagatgaagaaagtaaagccaggaaatggtgaacacagaatatagctttgtaacaagtgtgtttggtctcattggaggtcttcaaggaggcatattgctttttgaaatagtccatgaattatggagacaaaaataagagcttatctactgctaccaatcctccattgctcaggactcattgggtcataactcctctgcgcctctagaagttacagtctgggtatcctaacatctgggggggaactgatatccaaatccatcaggagaggcctgctcagggaaagccatagaattcattgctggttaggggagccaatgaatgaatgggtaccaagagttattctccgcgcctttatttggatcgcaaaaaacttccaaggagtgggaagaaacctcctgtataaccctggggaaagggtttataaagttggctaaggaaatggcacgggggaaaaaaacataaattctagtgagggtccagaacccttaatggcaaaaagaaagattgtagagagtaccgagtgtgtgaatcccatcgggagtatccggcaatgaaaggagacgcgcgcatttcgcttttggctaggaggtgggggacctacaggg

SEQ ID NO: 83 - DNA, 1043 bp, Homo sapiens
tagtatggacagccagtctgatgtttacttggcttctctgctccagaaataatcaatttctttgggtttcaagatccatcctaagaaaaacctcaaatgagtctttgaaagaaccaaagtgctgtttgaaagaaaactgcaatttctgccaagttggatgaatggagggcagctggtgcattttgaggaagacagaatacatagttggagtcttgcatctgaagcaggtggaggagtactaggatcagcggagttttggtcatactccttagttcttagcaatcggcacaattttcatgagtctgcagctgagagcaatttctcatcttgaccctactgatgtattgggccacataattcttttttgtgggagctgttctatgcgtcgtaggatgtttcgcagcatccctggcctctacccactagatgccattagcacctcctttctaagctgcaacaaccaaaattgtctccattattggcaaatgtctccagaaggaccaaattctccatattcccattgagaactaggggcatacagcaaagggcttgatactgaatttggcattgaaaggatggaagggaataaatatcaggagctgcaaagccacttggcattgaatgggcctctaaaattgaacaatacacttataaaatgattcccatacagactaagtcaaatacaacttccccagattgtgtaaacctagcttgtgtaaatctcatatcaatcccaagaattgtggagtgggggactattgagaatgtcttttcataaaccctgccaggtggaggagattaagacagatctgatttgatttagacacctaaagaaatctatccattattttatgtaggtgtcatggtgaaatctgtacctgttacatgtgtttaaaaaaaacttagcaatttttctaacatacggaaaacactcaacaaatgttaatcatggtattatcaccccttactttatagatgataaaagtcacaaagaagcaaaactacatttctgagaaccagagctaataaaactggatcggcca

SEQ ID NO: 84 - DNA, 546 bp, Homo sapiens
  misc_feature (1)...(546): n = A,T,C or G
atttataaccaagggcagaaacctggggaaagcagaattcttgctctggaatttgtaattggatcacccagtgaatgaccaatgatatttggactgaattgctatagtgacctgtcagatcaaagagaattgagaagtttgaaaaccaaagctattttcaagttagttttgaagaaataacaacaaagaggcttgaggagtaacactggtcttcaaagagaagtgtgcatcagttgtataggaaaacacaaaaataataaactatagagcaaataagaggaaataattagttgcctgattttccatttttcatttggcctgggntaaacttcctgatttgggattttataagacttctggggatagttttatataaatttctatttattttggcaaatttaagtgattttgtggacccttgatttaaatctatagttttttttctccgttcgccttttacttaaaacaactttaacaaaaccttataaaaagctttatacaaaaggtttcttgcctttactctgaagttttctgggaagctaatag

SEQ ID NO: 85 - DNA, 731 bp, Homo sapiens
aagctgtaccctgaccagcttgagcatcatgaaatatggattgaaggaagccaagttctgttctattaatcaacacaatgggagaataatcccaaaggcatttcagattcttcgaggcaagctagaaccttgaaggtacatcgttgcagtcgccttgggatctgttctcattgctctgacatgacagaaaataccagcagagttggaatggatggccacctgcagcgatggaggcagtgcatctgtgaggatagaagatactgactctgaaacccgaagggcagcccagtagctgggaagtcaacctcactgccccccatggctccccgcccccactattaacacagagcatgtcactcaacaacattcatatgttatgttctctgtttggcactgaggacagagacaaacagaacacacacacgtctggccctaatgtggtttattgtctcctagggaagacacataaacatttaaataaacatatgtgccaaaacaccatagatgttatgatagacccatgtccacagtataatagtggtacttaattagcagtgaagttgagctgcctttaacagtccaatctgcctttaataatccagtatacttgaaaggggagatgttgggggtgtgtcggggggtgatttaaggtctacaaattgcagagtacaataataaatccaaaggaccgtgaaataaataaaaaaaaaaaatgggcttcgttggcccta

SEQ ID NO: 86 - DNA, 651 bp, Homo sapiens
  misc_feature (1)...(651): n = A,T,C or G
gggaaaaaacacttcaagcctaaagacaagccgtttgaaactaccccatgggaagaagagaactgcgnaggngttctctggatagattttgatctctgccaggatatgaactataatgatcagagggcattctaaaatgctacanaaattgttaaaccaaggaataactcaactggacaccctttatcttttcaagattgaatgccagtgagtaagagcttcaggctactagagcaatgatggtttttgaattataaagatttgatattatctgcttgggggatgcttgtcaaccntgttgccccncggnntctaagtccttcangcttangaaacaaccncttgttacanccanctnttnattgttatgnactaattaccnanaatcacatttntnttangttgantaaagnctataactcccttttannaaaaactnttattnnttaaaaagancgcntnggttngttccaaaaaaaatccnatcttgaagtaaaggttctttngtngatttttnnattttntngnaagaanaaacnannattttgccaattcaccttttaaatncccccccggaaggtnagantttttaccgtnnaaattttcaaaancctgncnccctccttannggggaacnaccccccccccccg

SEQ ID NO: 87 - DNA, 1038 bp, Homo sapiens
ttttcagagggaattgacttcaattttgaaagaagtcctagtggataaaatgctatcaaacatcactccatgttacagagatatcttttgtgaaaggaagtcaatcaatgtggcaaacttcattgttgccttattttaagaaattgccacagccactataaacttcagcaacaactaccctgagtcaacagctatcaacatcaaggcaagaccctccatcagcaaaatgattacaactcactgaagggtcagaagggttgtccttctcagtggcatttgtatttcaacaagaaacaaagaaagcagcaggattcgaactagggccaacaggagatatttgggagattggagcactggagacttcccagggtcctgggaatgccagcacagaagcagcctgtggacaacactcacctggaaatgagactcatgctgaggagggatgctacagccccactccttgccgccctggatgccttcccgccaagttcaaagcctgtcttcctttggggccagggcgtctgaattgctttctgagggctcattactgtttttcagtagattaggtgcaaacactctgagtaaacaaaagaaaattttctactattggcagcccactgctaactgctacaccctggatatttttcttatagttaatttaaaaaaaaagaagataaagaaaggaagggtaaattggaggttgtgtggggacttggctctggctgcaaatcaacttcagaccccaagggaacttaaaagaactactagtggccacaatggctcttcagtgcagcctgtgtttactcaggagcagccaccacctccacagccccgaaggcagcctgcatgaaaatgccacattgtgcagtgatttttcagttacttcaggggcttcaggctggtagcagatgatttgtgagactgctatagatccatcagcttttgaaattctacacaggctggtatatgttgctgttgagcctcacttattcacctttccatttggcaaagcttactcaaataaacgtagatcggccg

SEQ ID NO: 88 - DNA, 1176 bp, Homo sapiens
atgctccttttgtctggaagcttcagctatatgccatctcaagttccatcttcctggaaaacccttgtaaatccaccactgttaggcttagccatcctctccttgatgaagcctatccctgacctctgcccaagactatggaaataatgttagacaaaaagcaaattcaaacgattttcttattcaaattcaaaatgggtcataaaatagcagagacaactcgcaacatcaaaaatgcatttggcccaggaactgctaatgaagaaatgtacagtgcagtggtggttcaagaagttttgcaaagcagaagagagccttgaagatgaggagcatagtggccagccatcagaagttgacaacaaccaactgagagcactcatggaagctgatcctcttacaaacacatgagaagttgcccaagaactcaacgtcaaccattctatggttgttcatcattgaagcagatggaaaggcaaagaagctcgataaatgggtgcctcacgagctcagcaaagcataaaaataaaccattcatttttgaagtatcatcttttagtctacacaacaataacgaaccatttctccatcggattgtcaaatgaaaagtgaattttgtatgacaactggtgatgaccagctcagtgattggatcaagaaagaagctccaaagtcccaaagccaaaacttgtaccaaaaaaggtcatggtcactgggatctgctgccggttatgatcctctacagctttctgaatcccagtgaaaccattacatctgagaagcatgctcagcaaatcgatgagatgcactgaaaaccgcaatgcctgcagccggcattggtcaacagaaagggcccaattcaccacgacaatgcttgacggcacatcacacaaccaatgcttcaaaagttgaatgaattgggctacaaagttttgcctcatccaccatattcacttgatctctcgccaaccaactaccacttcttcaagcatctcaacaactttttgcagggataatgcttccacaaccagcaggatgcaaaaaatgctttccaagagtttgtcgaatcccaaagctcgaatttttatactgcaggaataaacaaacttatttcttgttggcaaaaatctgttgattgtaatggttcctattaatgagtaataaagtggtatcgcaaag

SEQ ID NO: 89 - DNA, 705 bp, Homo sapiens
tctctaataaccaccgctacaggctctcctgcaggggtggctggcccaaagcagagctgccttttggatccatgacttgtaacctgccagacaagaaaattggcctgagtaatcatgtaactctatgagccatattttgaacctgtcatctatcaaccagaaaaaccaggaagaaatttaatccctgaacagacaaacaatgagctctgaaattgaatcagtaataaacaatctactaaccaaaaatactccaggacaagatagattcacagtcgaatactaccagatttgcaaagaagagctgataccatttttactgatactattccaaaaaattgaggaggagggactccttccccactcattctatgaagccagcatcataatgataccaaaacctggcagagacacaacaaagaaataaaacttcaggccaatgttgttggtgaccactgatggcaaaatactgaacaaaatacttagcaaccagatctaggcagcacaaaagttttatttaccatgatcaagtgggttttatttcttgggatgcaaggttggtttgatatacacaaatcaataaatgtgactcatcacagaaacaaaactgaggacaaaaaacacgtgattatttcaatatatacataaaaaggttttgataaaattcaacatcctttcatggaaaaaaaccttcaataaaccaagatc

SEQ ID NO: 90 - DNA, 1142 bp, Homo sapiens
atctcagcaatgctcaaggcccagctcagacctcacctcttggcgaaggcttccccagctactccagacttactgaagatttacttcactgaacacataaaacagtgagatgagattcacctattagaactgccaataggacctgaatgtttcactcttgacaccccgataattgttagcacatagtgtacacttaatttgatgatgtcatagctattccacatgcatgggaatcaaccaaactacatcaaatgaactccctgaaggaggaggaagggccggccataccactgtgttgctcataaaaattaacagtttaaaagtacctcttactactaagactgggaggctaggaatatatcttactttctcagttaccaataaagtaaaaatggggtgctgtaacctgttctctataatgtctcaagcctagcctaacctctagaattctcctaagaggcaatctcatgttggggggctgagtatcaagggaccctgtgtgacttgcacagaaaagacgctgcttctggctatcttcactttctcatcaggatggctgatgtttgaacagctcttgcatcctcccacctacccaagtagtacgctaataagcattggctactggctatttccccagatggcttttaacctgactctatagtctggaccaacgtaaacaaataagtgtggagattctacttatcttcagcctcaccttggaccgtgggaggaaatgcctagctattcctacaagaaggaaataggtttgagtatttgaagtatgtcatgctcaatgaagaactaaaagcacatgaaatgtttggcagaaaattaatagagtagacaacgtgtttcagcaaccgtagtttccattttacgagtcttccttgtgaattctagtacataatccccacccagattcctgccttttccctaccaagtttgtgctcaccacatgcagaccttcaggaatcctccggtgtcctttggctaactgaccagccaactctgttgtttatttggagttttctttttgaattatttccccaacttccaaccttttggatcaaacctctttcccgaccacccttttcccaacaaaattggtattttacattaaaataaagaccgtatctggcaag

SEQ ID NO: 91 - DNA, 893 bp, Homo sapiens
tggaatgatggctcactgaaaactgaagatgacatggaagatgaaaagggagatgagaaagtcctgcccattaatgagaggaggatgggcacaatgcggtgacctcacaggtctccaggcctcagctcagctctgatgaagaggctcatgtcatacagtctcttcagatgatcacagagaaaaacgtggtgacagagaggcagatgttttactgtttccacttctggaacttgttgcagggtatgaagagggtcagcaccagagaagatatagaatatcatgtccgcaatagatgaagccatcaaaggatggcttcacttcaccaccaggcagcactgaccaacttacggcaataaatcccgcagaccagaattacacccatcaaatgcctcactcaccatatgtcagcccagaagactcttgcagtggtgagccagtctctttatccaccaagcctgacccagcaggcaggagaggcccagtaccaagatgatcatccacaataacctgcacactgcttcgaggacggaggccagccctaacagcccgtgggcccttaggagggaaaggcagtaaagggctccttctctctttgtcctgatgaatgggcattgcactagaaagatgaacattaggagcagattatcagagccttggtccagtcaccatgtgctctatgatgacccacataggcaaaccttctggaggcaaagttccaaccaacatcctcggggggctggcattgtctgaattcttatagctcatcacaaagtgcagcaagaatgcgagtatctggtgcacttggatctgccgtcggctctgatggccaagagactaagtgccaagattcttcctacccacgatccatgtatattttgcgggcacgtgtgacc

SEQ ID NO: 92 - DNA, 779 bp, Homo sapiens
gaaatcgtgccattcagagagctgcgttgtgctcatgcatctggaaggtcttgctgttcatgcactgactcttctaactccatatcctccattcctgggtgtttgccagcaggatggaatgatggctcactaaaaactgaagaagacatggaagacaaaaagggagatgagaaagtcctgcccattaatgataggaagatgggcacaatgcggtgacctcacaggtctccctgtctcagctcagctctgatgaagaggctcatgtcatacagtctcttcagatgatcacagagaaaaacgtggtgacagagaggcagatgttttactgtttccacttctggaacttgttgcagggtatgaagagggtcagcaccagagaagatacagaatatcatgtctgcaatggatgaagccatcaaaggatggcttcacttcaccaccaggcagcactgaccaacttatggcaataaatcccgcagaccagaattgcacccatcaaatgcctcactcaccatatggcagcccagaagactcttgcaggggtgagccattctcttttatcaccagccttgcccagcaggcaggaaaggcccattcccaagatgatcattcccataccctgcattttgattttccgtggcctctgatggcccaaagcttagggcctaagatcctccctaccaaggtccaagtttattttctgaagcaagtgtgacccttatcccacttacagcgctggaacagtttcacaattttgcgaaagatattctccctaagat

SEQ ID NO: 93 - DNA, 252 bp, Homo sapiens
ataccatctctgagctggacaagagagcagatgaccccaggaacccttggcagcaatcttgcaaatggaaaccgagtgatccctgggatgcagccaacatcacagacggcagattggcaaaaatgaaaaacaaacaaaaacaaaaaatgttccctggtatcatcttagaaccactgaatcatcattggactctacattaatgtgtgccaataaactcccattttatataagtccatttgaaaaaaaaaaaaa

SEQ ID NO: 94 - DNA, 1062 bp, Homo sapiens
aaaggaagaaagcaagcaatttgaacatggactctctctgttccaagttgagggggtgtgaaactcagaagaaaggagatgaaagtctaagatgctgtgttttctcaccagcgtggatagtgaaatgtacagaacacgattgtttacagtatctctgggctgtgaagccgccgtgattgcagctggctggggcagactgaaagggtagcatcaccaaaacccaactcattttcgaaaaacacaaatccttttcactgcctgtggacaaaattactgactgacatgctaaacctattaaatatgtattttgcaaattttgaaattaggaaaaatgctacataaaaatttttacagatgctgaatgattgtaaatgtggttagagatgtgggacttgctccaactttgtctttcgtggattgctatagcttacattgaatcttctgtgggccacgtatttcacattgttcttccaaatgtaatcatttctctcttttatctgatctcctacagtctctctgtttttatcaatatctgacagcaattcccaaagatccaatatagtccactctaatatccttatgtgtactctcttctctctttgaaatctaatacctcagcagtgaaataatttattgtgctttatttagacttttattttttgcatgtgctttgatattatccttttgaaagaagttatttggaaatttaaaccaactgttcaccaaaagttatgaaagcatgattaagaatttttctctctttttaaatcccctttaaaccttcattttttgtgtgtgctatggcaaatgccacaaagtccatgggtctggcaatgatgggaaaataaagatgaatactttttagagccccagctaatgggtaaagccatacagaagatccaatgagccagaaacatcagtgacattttatttttctcagtaacccttagtttatgtggttgtcagaacctggagatgtttaattcattgaatatgaccttctggtgaaatgactatgccaccaatgtacttgctaataaataaatcaagaggcggcccaag

SEQ ID NO: 95 - DNA, 1425 bp, Homo sapiens
  misc_feature (1)...(1425): n = A,T,C or G
tatttcaaaggtaaatgcaaactaatttttaggaaggcttgtgaaagaactttgatttatgtgaagaaatcaagaaagactatacatgaacaaatctctattgggataaacaagtctcttcaaccacaatatgaacaacggaagagcagaaaccaaacaagttagcaaacttatggtggagaaagaaaaattgagacgaagactgccctaagaattctgccataaccgtagaatctctatattttaatatagcttcctatcttctaatatcaagtatctatctggctgcagcaactggagggaaaaggagaccacctgcaaatatctgcaaatacctgcagagatacccgcaaatcaatgaaaggaaaatcttgttaaaatgcaaatttgggtttttgtcagtctttgggggtgtggggtctgaagttgtgcatttgaagcaagtgctcagtgatgcctctgtggctcttccagctagtatcaggccacttgggctttctccatgtcttccatatggcctgtgatcagggtttattatttccctctaaggtgggtattttttaggggactaggggaatatatttacagggaaaaggagacagacatgtcttgatgttgctcaattttaccaaaagatatatatgttttgatttttggaaatacatacaagcaaattctcaaagctggtaatgggttacaccagtactgaagctacagccacggctcttttagtccagcatgttagggtgaaaaatgtcctggggaaacgatacacacacacacacacacatacatatgtgtgtatgtatatatgtgtatatatgtgtgtgtctgtgtgtcttatgtgtttatgcgtatgtctgtgtgtaactgcatatatataatgcantatatatgtaaagtatacacatatacatgaagtaattgcttattatgaaaaaagattttacctaagtgttattttcctcataaacacttatctaagacacggtggaaatagctattagagataactaacgtttttagcatgtgaaacaatctgactgttgaaactggagatacttgctgatctttgtgtaaagtgtagaataatcacataggtacatatgacaaaaagtgaaaaattaaagaatgtccaggaagcaataacattttgagttttataaatactttaaaaaaatcagttataatttttgtttcattataatactaaaaagtttattgctagaaaataatcttctttgattaaaatatctcataagataaaagtgaacttgtcttctctatttacctctgagacactttattcaggatttactgccattaacgggagtagaaaatataaatgttttatccaaaagtttcaaggatgttaactgctctgaagattttatgtatacattgaaataaatatcgatcgcaaag

SEQ ID NO: 96 - DNA, 649 bp, Homo sapiens
gcttggcactgtgaagatgtaattctggagctcctatgtggaaggagactttctccaagtgaaatcagagagagatgcaccttagagagatggagagagagaatccaagtcctgatgaaaagagatgttgatcagttcattcctctgtactggaacaactacatcagggataatgaatcaagacctgaaaaccatgttttacatgggactttgacaatttggaatgtatatgggagttggcaaggatgtgaaggatctgaaggttaaaggaactgcccagaggagccatgtagctcaagatgaagatttccatatggtgatgcaaattaaaacccttctgcagaggtgtctgaaaagagccaatcacttggagaaatgctcggaaactgtttgaagaaaggaaagttcggtgagaggaaggagatcgactgtgcaccctcctgcaaaccttgcaagcccttccaagaagaatttgagctaatcctttggagaagagaaacaataataacagttctaaaacaggattggagtcatgggttgtataattctatacctttactaaaactcgctgaatcgtacatgcacagtggaggaattttatgggtatgtgaagtatatctcactaaaaataaaagaagagtcgccctaa

SEQ ID NO: 97 - DNA, 690 bp, Homo sapiens
aattatacaatgaaaaaatgataataaaggtggtcctatggataaaaacaaagtgtaactcacacagcaaaagtgacaatattcctgtcactcctcagaaatgtcccagctccacgggtttccacattcaggagaatgaagaaagccattacgagtctctcaacatacgtctacagaaaatcagcctaactcacaagattctttcaatactgcaaagactttggatggcttgatgctatgggaatacacagaaacaattggattctgatagaggccaagttgaagaaccagtagtggatgaattttaagaactatcttaaataatgaccagaaattcagtaggtgggaaattaaaagcaagaacgcttaaagtggccaggcacggtggctcatgcctgtaatcccagcactttgggagacggaggcaggcggatcacttgaggtcatgagttcaagaccagcctggccaacacggtgaaaccatctctactaaaaatacaaaaattaactgggcagggtgtgtgcctgtagtgccagctactcgggaggctgaggcaggagaatcgcttgaacctgggaggcagaggtttcagtgagccaagatcgtgccactgcactccagcctgggcaacagagtgagacttggactcaaagaaaaaaaaaaaacaatgaacaaagagtccgcctacg

SEQ ID NO: 98 - DNA, 856 bp, Homo sapiens
cgcacgcatcgatatttatttatcacattaatgagggtatcagcaagatcatgaggctggttccaaagtaattggggaaagcaaagtatttatagtggcttaaagacagaagagttgagtaagaattctaatttaaattggctaatgctaatattaattggttaatatcttatcaggcattaaaactgtaactttcaggagtcatctctttttacaggaaatcacttgcatctcttgaataaaattcatttctattactatcagaaaagagtcatttgtatcagttttcatacgttagtgtctacctttacagagacaaaaaaaattctgttcatttctaaatagaaagtcaaagaaaagtactaacccctagagaatcagataatgccatgtagcctctgctggacagtacccagcacaaaactgaaagaatatccgataatcttatttgcctgtttccaaggttttgataatttttcttaacaattgcttaatatctgagctgcaaaatccattaagaaagacacagtacacatcttctgaagcttgcccttatctgacctgaaactagccgtgtccaggttagtaccccttctttcccaacaaattaatcctaagtgacactccagccaagtagcctaccatttgattggccaggtcaagcgatttcctgagaaatatatttttcagttcaaagtgtgaatcccaggcaaccagagaagttggcctcctaaacaagccctttcttattccacaagagaatgacccccaaagtatggtccaaagctaattttcttaacccttgcgtgtttttataaattacctttaagaaacagaaactaagacctcattccac

SEQ ID NO: 99 - DNA, 634 bp, Homo sapiens
aagagcatgctctaacttgtgctcgcactacagtgggattcgtggaggaaatcccaacccgaactgcagataagcccccagctgaatccaatcacgttgacccaagctcaaagaaacttcaagtgacctgcatatatgtgcaaaaggaataaaagtggttgcgggcctcttgcctttagggaaggtgattacatggatcctagcgtcactgacttcgttgagactggagccaagatcattgtctaaaccgtgtgtcagtgggtgtaaaaccaccgaatagcggtggtggcacgagtgggtcggatgacgccgagaaaggacatatgtggcgaccggcgcaccgcatgacccagtggcgcgacggtgcgaggccgtggttcccgaaaagtgagcgcccgaccctcctcgaggttccgtagacaggtgcggtgacaagtgtagtccggagggaatatctgggggaggtttaagtagttgtagacgaggtcgatagtgggtttgccatgaatattatgagttgttgcggccggtagggagttggtagaccgatggaatagatgtgtacgacgcaaccacttcgttgacgaccaccaaccggtggtgagagtatggttgtcacaattgtgtcatttag

SEQ ID NO: 100 - DNA, 670 bp, Homo sapiens
aattgcaaattcactgaagagagaacagttgactctcaagaaatacaagtttgaactgcatgggtccacttacacactgactttctctgcctctgcctcccctgagacagcaagaccctcatcactctctgcctactcaacctgaagatgacgaggatgaggacctttatatcatgatccacttctactcaataaataaatttttgttttctacctattgaaagagctctgatggtattgatacagacaggagatggaaattctggggagaagagggcagttcccggcaaaggctccaccctcaagcctgaagacctgtggccctaaatgaggactggcattcttgttttcatgccaaaaagttgccttttggtccaccatgccccctttcctgcatccatataaaccccaaacgctaagctccagaagcagaccagcaagccagccgaccagcagatggacagcagaacaatgaggcagagaaagggagaagaggaggaacatctgaacactgagaggatttcagctaggggtggtcagagaggaatccggccgctgggcagcccaactccaggagagggtcaccttcccactccatccacccattctggctccccgtccatcctgctgaaagccacctccacaattcaataaaaccagatgcgacacg

SEQ ID NO: 101 - DNA, 765 bp, Homo sapiens
cttttcgggccgtgcaagtgttgctggtggagacagctgaataaatcatggctgggaacttcaggtttgagacccttaccctgtgctggctgataatatttttagcaccgtttcaacagatgggataaaaaaataaacattcagagaagttcagtacattttccaaagtcacaaaatttgttagcagctgacctggaatgaaaaataaaggatcctgaaccaaaggctccatctgcaatgcaacatcatttctttcaggatcaccttcctttaacatgttcggaggaagaagcgttggtctcacatcctcccaagggaagcccacctctcctctgtggttgcattcaaaaccctctttcagctttgctgtggaatggctactctgtctgatcttatcactgctgcatctctgggattctggtcctcctgcaacacgatgctgctgttgctgctggcaccgctgccatgtccatctcacccaggagctggtggggcaggagactgtttttgtctttgccttgggctgtaattccttcaagcacccactgacagactgaggggtgcaaagacttcactggaggagactttatcatggggggaaattcctcaaacttagggtccatttttcaactttcccagaggtcaagggttcaggatcatccacaagaacacatacttcctcaccagtacattttctggatgttattatgggaccattaattttaattgacagtggcatctaaaaaggagctgtcaataaaaatt

SEQ ID NO: 102 - DNA, 760 bp, Homo sapiens
acctgtgaatatgttatcttacatggccaaaacgacgttgcaggtgtgctgaaagtcacaagtcttgagatgggaaaattgtcctgcatcatcctgatggattacatctaatcccatcggtccttaaaagagaagagtctttcccagggagaaagatataatatgagaaggacttgaccctgtgtgtctggctttgaaggtggagaaatgtagtcataagccaatcaacgcagctgtctctagaagcggaaactaccttcagtacagaaccagcaggaaaacagaacccttggtcctatagctgcaaagaacagagctctactaaccacagcagagagcaaagaacaattgccttagagcttccagaaacaatgcagcagatcaccaatttccttttagtctggccagttgtgtataaaccttctgacctatagtatagacctgtgagataataaatatgtgctgttttataccactaagatttttggcaatttattatcagagcagtattaacacagggaggaaaagatgacttaaattattttggggaaattggctaccaatgtagaaaacagtaaataaaattttcttctgcctcataatgcacaaaaaagttgattctaagtggattaaatgctaagtgtcaaaaaaaccacattaaaaccttttgatgaaaatgtttttatagagaaaaattttaaagggctacctgtatggtcaatacaatattgagatttgcaataaaaacagaatgcggcca

SEQ ID NO: 103 - DNA, 667 bp, Homo sapiens
ttcctgacctcaccacctctatcatacatagatgcctttggctgactaggtcccgaataaagcaagtcttcgagaacactaaaatttctaccgcgtgctgccttaagcatcacccttactgagaaatggtgatatctcttctatatcaacaggagtggtggtgaactgtaatttctaaaaggcaaaattgcattgtaaaattgctaaatgttgcaaataaggattttagagaagctatttggtcacagtagaatggagatttctgttaacgttcaatggaaggttcacattagaggtcatctcagagagatcaaggtaatattcttttagaaacttgctatgaccctctactgtaattagtgagtccgagatacctgagggaaatctaaatttgtgatagttctggtaggcctttgtagtcagaagtggggagaaattgaaagtttggatgagacttatgtctactgttattgacatattttgtccattaatagtaatgaaatagatattttgttcattaatagtaacaggatggagaaaacgtcacataatgaagacttgtagcacagttgtaaagcatagacataaaattggtgttctatacagctcaattcagaagagtccattttatcagaggaaaaccaaccattaaagacgatgccggcgt

SEQ ID NO: 104 - DNA, 246 bp, Homo sapiens
tttttttttttttaaaagccgtgtttattatttgtgattaatagaaaagttcagccacattatagtctataattcatcaaggggataaataaactgttgcatttacttaatagacaccaatatcctttggttttgtagtatgcagaacactttttcacatattgttgctttcgggtccagctacatatttatcaacatctgtatctctcttccaacagaagaacagtgaatgtgtttttgatagtg

SEQ ID NO: 105 - DNA, 877 bp, Homo sapiens
ctgaaagttgtgatacctttccatacccatcataagtctcacaactgatgctgtcataacaacaacaacaaaaaggttaacaagagaaaagcgtaacaattttattaaatcaagtttttacatgattttgggaggcttcagaaataaagacccaaagacccagggaaaattatccatttttatgcttagattcgatgaaaaattgacagctgagtggagatgtgattggacaaaagggtatgatctaatggtaatggactgagaaggagatctagccggacttctttgttcagattcttcttggcttctctacgtggcattccttcctcctagtgtggggcagaacccctctgaaacgatagaaggaagaaaggagagagagacacctttctaaacttttaagaaaacttctttttctatctataagccaggagaagcatggaaatgatatgaattgatgaaaaaggaagatactggagctcctttaaagaatgctgtcacgccataagtggaagtactgtggtaggagagagactataaaatattgatggactattgacctgaggtagcaaaggaagataaaagcaaattctctgagtgcacaaagaagctacctgtctccacagtgtggagaagaacttcaatattaacatcaataatgagttatcgttgtctgaaatacatttttcttgttaccatatcagaattgtattcatttcagtttcagagaaaaaaaacatatttttttaaatttcataattgtgttttctgtagcgtaagaacagtgcacgtggagaggtgcttcgaaatatacatcttatcattaaatcctagccattgtggctatcttcataagacagtccaaaaaaaaaaaaaa

SEQ ID NO: 106 - DNA, 1021 bp, Homo sapiens
ttcctgacctcaccacctctatcatacatagatgcctttggctgactagccgccctgtgaacaggtgccttccgccatgattgtaagtttcctgaggcctccccagccatgcagaactgtcccgaataaagcaagtcttcgagaacactaaaatttctaccgcgtgctgccttaagcatcacccttactgagaaatggtgatatctcttctatatcaacaggagtggtggtgaactgtaatttctaaaaggcaaaattgcattgtaaaattgctaaatgttgcaaataaggattttagggaagctatttggtcacagtagaatggagatttctgttaacgttcaatggaaggttcacattagaggtcatctcagagagatcaaggtaatattcttttagaaacttgctatgaccccctactgtaattagtgagtccgagatacctgagggaaatctaaatttgtgatagttctggtaggcctttgtagtcagaagtggggagaaattgaaagtttggatgagacttatgtctactgttattgacatattttgtccattaatagtaatgaaatagatattttgttcattaatagtaacagatggagaaaacgtcacataatgaagacttgtacaacagttgtaaagcatagacctaaaactggggttctatccagctcaattcaaaagagtccattatatcaggaggagacccaaaccatacaaactaaatacgatggggaacaaaaggcaggaaaacaacacattaaaatatctgaacaagaatatctgacatgaatatctccaaggatcccatgacgtaaggatcaaatacaatatttcttacactttgaggttaaaatgatacagttaacttttctatttaaaaatttcccaaatttgattggaattccacttagcggtcttttgattcctgaactcttcagaagatggcagaaagacatatttttttatgatagccggaaattccgtaatatatgccgcgctcagtcattatggcatt

SEQ ID NO: 107 - DNA, 834 bp, Homo sapiens
atggtcttgccgctcttactaagaattacaaacacttgtgaatatgaagttgtcacttcaacagctgtattgtacaaaagattttccagcatgatggttagtcctgtgatttatgattcagacagtggaaaatggctttacatagcatcttatgtaaaaatgttttcttctcccttcctgtaggctcttaagctggcagtgaatacattttctttttgacacaatgtactaattttgatattggcatatcacacttactgcaaagtacaagttattaacatgattgtatttttatacttaaaattaaggtaaatggtaatttcacacagtgcttccttcccaagtgctataaatgttttattaatgtagtttcaataagtaaaagtgttaagctcagacaagttgttatatttataaattcaacaataaaacaaaggctctaattcaaaaaataaaacagagactcaaattcctaggatttgtatgtatggtaattgtaacatgaaagtcacaatatgggataatgatcatgtttactgcttatgttaaagcatcttccataatgttgtaatgtgtcttggggtcacatcctgtttctaatatgttccaatgagaagtgaccttgagcaaattgtttaatctgtgtttcagttattagttcacttacctgttaaatgattataataatatgttcaggtagatttttgaaatttaaatcagaggttgaactaaaacctttacaataaagccctggcctcgttggcctcagcggtggagttctgcgcccgaaaatctcaaacacattaaattaatcgtcccatatctagagaaaac

SEQ ID NO: 108 - DNA, 225 bp, Homo sapiens
tcgtggtttactttattcctttcatataaagggtggaggtgggatataaattgtatcctcagtcacggatacaatttcttgggtacaaaagcctccccctgtagtcgggatgggggtggtccccagaacagcctgtcctgggtcatttctttctcctcctctttctcgtccccagggctaccttgttcttccagtctcttcacctctctgagtcttggttcgtgt

SEQ ID NO: 109 - DNA, 409 bp, Homo sapiens
tgtagcggagacatgagtcgtataatacctggcaaagacttttggagactccataatgcctttctttgaacattgggccccaagttcagaaactaaaaatgtcaaagggcccaggcatccctgcaggtgtgcctgccgcaggggcagagaaacggagtggagagccctctgccatggagggaaaccccacggcaactggacttgtccaaagctgcacaccactaccattctgttcctgatccagtgcccccatctcttagagctgaaaaacagaaatatgttttgtcattcttttgttagatttatgtggattctttgaatcacaaaagcaatttattttttcctgagcatcttcaatgtgtacttaactaataaaggcatatcttgttttattgcaaaaaaaaaaaaa

SEQ ID NO: 110 - DNA, 782 bp, Homo sapiens
ctaaggaagtcacagacaccacctgccaatggcttttggagactccataatgcctttctttgaacaatgggccccaagttcagaaactaaaaatgtcaaaggtagaaaccacaaaatagaactaaggagcctgaaatattgataaaatgattaagagaaaggaatgtgatagccctctttaaaaattttgttaaaaccaatagcgatagtaagaaaaggtgatataaagtaaaaataaaattgagcacagaaaagactgatttgcctgggattcctttcagccgtgtaatcgacacaaacagcaaagaccgtaatactcatgtttctatttgctaccctcaactgacatggttggccatttgttttgttttaaataaaatgaggaagcaacaactgtattaaattcatccgcaaaaaggccatatttgcatgtggaaaacaagtaagtgtgtgcctgaatgggtgattaggcttatgattgcccatctgcacccagggcccaggcatccctgcaggcgtgcctgccgcaggggcagagaaacggagtgaaaagccctctgccatggagggaaaccccacggcaactggacttgttcaaagctgcacaccactaccatcctgctcctgatccagtgcccccatctcctagagctgaaaaacagaaatatgttttgtcattcttttgttagatttatgtggattctttgaatcacaaaagcaatttattttttcctgagcatcttgtaatgtctacttacctaataaaggcagttccgcacgaa

SEQ ID NO: 111 - DNA, 922 bp, Homo sapiens
gcccgtgcgcggataccccagtcaggattaaaattcaagtgttggccgcatctgtgtttatttattgagataggctcggccagttacatttgtacacgaaaggccatgaacttttctgacaaaatgcaaaggggttaggttgatttataaactatatgaaataggcatttgcttcattctcctttcatttaaaatatattataaaaacatagaagtatttagattatggatagcatgtacatctaaactaaagaattaagaaaattatctagatgcctccactggattctgaaagaacattattgagatataattaatatgccatacagctcactcatttaaggtgtacaattcagtgtctcttagattattgacagagttgtgtaaccatcaccacagtcaattctagaacattggtatcaccctgaaaagaaacctcacatcccttaggcatcaccaccatccctggacatgtccctccaccttttaaatcctagggaaccaccatctactttttggctgcttaaattgcctggtctgaacatttcatataaatagagtcttgcatatgcaggcttttataagtgggttcttttactaagcaggttttggggggcctcctgggttgaccacatataataactcatttcttgtttatgggctaaaaaattctattggatggggataccagaatccataaacagcggagggcctctagaaggttttatttttgggtactggaaaaaggcgggaaaacattattgtaaaaaaattgggtatttccccgcccgggttttatttgagggtaatgagggggttcaccactggcggttacaccggtggtattccgccctaagaatatggtctttaccctattgtttaccttccaacatttcccttctttggagggtttgtgaagggt

SEQ ID NO: 112 - DNA, 644 bp, Homo sapiens
cagatggcatgccaatggaagtggtctactatagctgcactgaatcattcttcacaccactgaaagtgaaagcaaatggggagcatgaggcccagaatacacccctagtacttcacagaacttttgccaattccactaagccgacagtactttaaacaattatagattactttctctctgctttactcagtgggcaatgaccacaatgcaaacagcacctcctggaataagtaatacataacttacatggccatcagagcactggactgaaaacactggactctgctgcgaaacaaggttcccaaatcaagtcatttgcaacaactgtctatgctgagctgctttagcgagcactctggtgggcttaaggctaaggttatgtcgtacggtgtaggagaaaagctggagctctttgggtgggaaagcggtatgaatctacggatcccagctctggctacgtaataaagaaatggaaatgtagatttcttttcagggtgaaaaacatgagcatttgattgaataactttcctttactagattaagtggtttctacttatatttaattacttaaaatatatttagaataaccacctatgttagctgtggccttgtaaaaaaataaaataataaagcgggatcggcag

SEQ ID NO: 113 - DNA, 524 bp, Homo sapiens
ctggcgatcgatctttattagagaaatctgttaattggggaacggagcgggagaagggagagagcaatgggatgttaatatgatttaacacttgatgggctctgaaaacaaataaggagggggcttcgggctttagcttggcacattcgtcgttccacatacgtgttaccaaaatgaatatatgcaactaaactatatgcgagactctgggggcacagtaacacagactttgtgaaacaaaaaggcatttctcctgcttccactgtgtctcttgtggtgccattgtctgatgctaagaactcacataataacaaaaaacaatgcccctatgatggggggaaaacttgatttggcaccagccgtggtgttttccatgggaatgatggtgggggctgtggccgactgtgggaatagtgcaaatcagcacttttttgtagattttcttcaagccattgtttattttggctttggtcagatccgtggcccagcttgaagattcccactgggctttctgaaactcgcag

SEQ ID NO: 114 - DNA, 938 bp, Homo sapiens
tggcctcccagaaaaagtatcaccctcctaaaaagttgcttggaagtcagccatcagcagtgcttatgaaaatcaatcctggtcaacttcaaggctagagcttagtgcactaatcacatcagaataccagattgcttcttttcctgtagtcagccactggttatgacgtattaaaagaaaaaaagcaaagaatatacactgatgattgtaggagaaaacaagcaagcagataaggaatctggatcatcatctgaaacttctgtaaatgctgtgagaagagcttggggaagaagagacattgaactctcttcaaacataaccatgaaatgtgaagtcaccctaccaaaaggagcctctcatctatataaaaatgaaaaacaaccaggcaaaaaagaaaaaaaaaacattttgctcttcaagttaaaataataagaatcaaaagctttgtggactaactcttctacctaggcctccaaaagtgtggaataactgtgtacaatgatgcaggtatgtcatggcctttcttagaagactctcttcccaagtcactaaatattaccctcaaaaaagacatttttacaaagcgcatcatagcaagtgctcaaaatgaaattgctaaaattaaacagaattgtcaaggaccaaatacgcaaagacggctgcttcttctttgcttatactttcaggaggaaggtcaaggtacttggcttagacttttatgacccagtctgactccctaggcctatgcccttcccagtgggcattcccagttttggcagtatgagctgaggcctgtaccttgtagcagcaccaataggatctccatggaatgatccagcaatgtaatttcagctaaaatcacttcataaactaatgtatttttttgttcactttaccttatgtaactaatgaaatttaataaacacgttatctgcaag

SEQ ID NO: 115 - DNA, 764 bp, Homo sapiens
agagaagaaacagtgacctaggacggcaatgaaacacattgatcctacctttggaatatggatagaagaagaaaagtggatcaaaagtggattttagttgtaaattcagccatgacagaaataccatgaatccactgaatgcatccttcatctatatcaataacacatacagtgtgagctgtcaaattatggccagaagtgtgtatatgaatacaaaagttaatttttaagtgactagccttaagagttttagtccgagaatgtgcataattaaaaacaatgagtatttttatcagaataatctgaaaaaaattcttagaatcattatgataaaaccagtctcatttgtttaatgtcctacagcatcacaaattgtcatataacatcataataaggttaacaaaaaataaaatattattaaagacaaaaaaaaaaaacgacaaataaagtatagaataaaaaattaagaagatataaaccagccagtttatccttgttgccccccttccctttagatgggggtatattaagagcctctatctctggcgatgtataattaatacattaattggggaacaattcaacttgattttatagctattttcacttttgctgacatgcgggtatactataaaaacaaagtctagaacgcccgctaaaggatataactttagaagacgaattcatagtcttttttccagtcattctcacatgacagattgccatatcaggttcatgttcgcgggatttcttagccgcctcat

SEQ ID NO: 116 - DNA, 870 bp, Homo sapiens
ctgccgatctatttttattcttacataaagcctttctcagaagtcacccaatggacgttccctcacttcccattggccaagactggtcttcatgcccatgtctaaaccagtcactggcaagactactatggctatcttggactaattatgctttaccccctgaggctagagaaaggtcaccttcaactgaacatcaaggttcttcttgcaataaataaagaatatgaccataaggtagacaatcaacagtctgcatcgcataacaaaccccaccagatgatctgtttgaaaggagaatttgtgatcttgtaaagccacacttgcactcaagtctcagtgctatgctcatgaaactcaaattgagccccatttttatgtttcatttcttctgtagtaatgacagttggaccacagggcttgttcagagtctgagggagaagtgctcctatataactatgaatgaaatgtgaatctcttacaatctttgaaggctcatctcctacaacagaacattccttcaggttatcaagaataaaatgagtcttagagatgcggaaatattttagatgggtggattaatcaggataaataatgctaactgctgcaacagaaaagccataagtctcactagcttaaccatgagttttattcgtcaaacatgtaaagttcattgaagatcaggcaccactttcaccctgtagcttttccttctggatctggtggtttgcaagattcaacggtagaggaagagagagatggatgagacataccagctcgtgactgcctcagcccagaagtgacacatgacatttccactcagagtccatcagccagaatgagtcacatggcctaccacaattgcaagaaagg

SEQ ID NO: 117 - DNA, 397 bp, Homo sapiens
tttcgggcgatcttggtttatttgttatgatcatcactatttacttaaggttaattccatatacaacataatgaaatgcaaaagaaaagatctccagaatcctcattgcaggctttcaggccagcagacaaacaaagaacatctgccattttcaaaatattattgggctcacatcagttttagctcatgggagatataaaatcaagcataatcacatgattatgtgatggggggatatcttgatttttgccttatttctggtagatatgttcttcaggactgcccatcacttctttctttggggatctgcctttgccttacttttcgtcccaaacacagtggaagcacctgagtaaagccaaagctatcatgccacttttccttggaatttcagtct

SEQ ID NO: 118 - DNA, 826 bp, Homo sapiens
gaaagtgcttacctcaactgccaatttacggaggatctctgtggatggtaaatcagagaagagtgtgaaaggattatgagcaggagaatgacatatttggactatgtcccagagagacaacactgatgataatgaatataatcggctgaaagagaacaccagaacactgtttagaaggcaactataacatctcaaattagtgacgactgacatctgaaccatggagaagattttctaaaataaaactagtaggaatttgtgactactgatgtgtttataagacaaatataaaaggaggatttcttccttgatcatcctccatcgtttcagataccatattgggtattaagaacacaaaggagaaaaatcatgggcattgctctgacatttcaacatgacgagacaacagcaaagtttcagggcatccagaagttttcagtgctccagggtagactaaaagtgctaagaatgctgtacatgagcaaaatcctgacctcaacagaaagaggccaccatgagtgaaaatactggagacaaataactgatgaactctgcgatgacgcctgtgcctggagagttcacaacatggcaggcactagctgtacttccaagttgctggtccagggtccacagcaggaacagcaatgactgcaaggacacttttctccccaacatccctagaaatgagaaagccccttccctgccacatctaaaagtttctggagaaaagcaggtaggagggaacagacaaatactggtagtgacccaaaagggaatgagtatccctaaaagactacttaaatggaaataaagagagatcggccag

SEQ ID NO: 119 - DNA, 861 bp, Homo sapiens
taataaaatactcaacaggataacatgatacaaaaacggccgcatcgggttttattgacttttaaatgctcatatattgaggaaattagttctatgactgtcagatgtattggaaatatttttccaatttatgttactttgtttcatataaaaattattctttctgttgcataaatcatcatcattttaatgtattacttgttttgtgctatgattttcctaaaccttctccttcttaaaattttcttctcctttggcttctgtaatatgcacccagattttgttcagctgccccaaaatctaagactttacaaaaacatttcagttattgacatcttaatacaaattttttttttgctctacattttttttccaaccgatctcacaactttatctgccacttctagctttgacttgtatttctaactccagactgatgggacatttacatatgattatccttctaacacctcaaagtcaaatgtcccctcaaaaaattatttttctctcccctttggttatgattatccaatcgtcctaggtaagaaactgtagcatcatgctaaccttttatatttgtcttataaacacatcagtagtcacaaattcctactagttttattttagaaaatcttctccatggttcagatgtcagtcgtcactaatttgagatgttatagttgccttctaaacagtgttctggtgttctctttcagccgattatattcattatcatcagtgttgtctctctgggacatagtccaaatatgtcattctcctgctcataatcctttcacactcttctctgatttaccatccacagagatcctccgtaaattggcagttgaggtaagcactttc

SEQ ID NO: 120 - DNA, 400 bp, Homo sapiens
tgctcttttgaactcttgactccaggctctttgagaaaaacattacactagaaattaaagttctctaatgggaacaagtggcagaacaagattttcctttccagctctgttctggagggaccaccgaggacaagaactacagcgagaaaagggagacagaagaggatggacgttgctttgcaatcaaattgcagatttttttcccatgcttactgtgtttgggaaaaaaaaaaagtgaatcatgttcccccattcatgattacgaagcattgcatcctgccatattttcttcagtacttactgttcaatcacctctccacagaggtagttgtgctttggtaatgtatcaactttgtaaaataaaaaaattcaattagcctgcatcttaaaaaaaaaaaaa

SEQ ID NO: 121 - DNA, 955 bp, Homo sapiens
  misc_feature (1)...(955): n = A,T,C or G
tgaattcagaagtacctcaaacataacaggatcaagaaggatgcagaattgtctggacttacaatgtcaatgacccttaggccatctctgtttagctcacctttgtatctccatggaaactaattttttctccatgtctagaaaatgaatcatgggaacacttactgtgttcccatggagatctggaagcccatattaagcttttcctttgaataatagccagatatataatttcccctcttgtttaaaaggtaaatgagcattcatgaattttacaaaaatataaagtgattatgagcttgaaaatgaaaaatagaaaaaacaagtaaagatggaattgtatactaaagattactcaccattactgaattttttaaattcaaagacccataaaaaatcagctatagaatccgactaaaaccccatctagctaaaaaattagcatatagcttaacaagtagacactgaatgaaaaatagaaagaacacctaaaagatgaaattgtatactagagataactcatcattactgatttttttaaattcaaagacaataaaaaatcagatgcagattctgcctaaaacctatctagctgaaaacttagcatatagactaacaagtagacattgatagtctagatgataatagagacattaccatgtaaacaggaataaagaagttttaatcaggatttcctcattctataagaagatgttagattattcttcattagattatttctagaaaataaacatgtctttaaatgagaagaaatcaaatagttaattttctgggatgtacaatcttatatccttaagttttcttttgtgctctgataacattatattacgtttaattttctaaccttcatcttcaaaatcaaataaataaagtactgtangcgcgccacggctntccnntctncccaataataccgcgccttaaacaataaaca

SEQ ID NO: 122 - DNA, 775 bp, Homo sapiens
atttgatgtcactgatgagacagtatgtaaaacaagaaagaaagattgaagaggagccctggggagcaataccatttaaagggaaggagaagactctccaaggagaccctgaacaaatggatagagaggttcaagaagaccaagaagtgacagatgcctctaaggctaatgtgggagaagattccaacgagtatggtcacaaaagtctcacagggatgagaaagatgaggactaaatgtggcaggtgaataaactgaggcaatgaggataagtagcttgttcaagattatccagacatcaaagagcaaagccagactcaaaccctgcatttgaactccagagcctacatttttaagccctataatttacttcactggttctccaaacgtggtccagaaaccagcagtgtcagcatcacctgggaacttattaaaaatgcaaattcttgggtctcactccagccctaatggatctgaaacaagatggggcccagtaatccgtgttttaccaagatgctagtggattttgcagcatgataaagtttaagaactgccacttctagaaatgcacagcacataatatattatttgctatctgtgtattttatagctctttgcatcaatattgcttatggatggtgcagagttgggatcttgaacttttatcctctgtagtataggccatgttggggacctgtatgaaacactcaataaataaaactcgatgcggctcacttttcttttttcttccgatatagtgataatacataattata

SEQ ID NO: 123 - DNA, 818 bp, Homo sapiens
  misc_feature (1)...(818): n = A,T,C or G
gctctctaattatcaccgctacagacaggatgactgcagtgacaatggatgaggaatgaaatcagctgctcctttaaaggacatcttgcctaagtggattttgggaaactatgatcttttcagcccccactgaatatataccgaattcatctttgatacagatttcttagaatggataatgatgaacgacatacctgagagccagaccagcatgatggttaatgctctctgactctggaaacagcccacttggatttgaatcctgtctctgctactcactacttggtttgtatactcatcacaaccatgaagaagtactattattacccacatttcacagacgagaaaactaagaagtttagtgactcgcccaaggccacctgggaactggtggagctgggattcaaattttgggcagcctcatttctggatgtttctacttaccaatgctgctttctttttcaactgtaaagtcagaggcatgaactctcaggaaccaattattgtgttggaaagagcaaggctttggccccaaaaagctgagttctgatctttcttttcacctgaaagccgtgttacctggggcaatttatttaccctgtttccttatctgctaaatgaagaaaataacctacctcaaagggaggttatgagaatataatgagctggtatgtgtcaagggctcatatatatccttagtgggtgctgggtgtagaggaggatgaatgaaaagccacagtgtgagacagtgtgattataaggttgtgcggccgaantttttntttctttaaattttcagattaacgagatcttatcaa

SEQ ID NO: 124 - DNA, 597 bp, Homo sapiens
cagagcaaggtctggctgtgttgcccaggatgatctcaaacccctggcctcaagtgatcctcccaccttgacttcccaaagtgctgggattacaggcatgagccaccgtgcctggcaaagcctcttggccaaaatccccactccagtggctgccaagaagctggtctcaaaaatcctatctgttcaatggatgaaaaatccagcttccttatacaatggaatactacatgacaatgaaaaggaacaatgcactgatgcacgcagcaacgtggaggaatttcacagccattgtgataagcaaaacaagacagacacaaaagacatgctatagggattccattgattgggcatgctagaaaaggctaagctaatttagagttacagaaagcagactaatggttgttggggattggggcttgactgcaaagggacacaagggaaacttttttggacactggatatattctaaatttcaattgtgatagcagatatacaaatgtatataacttggtcaaaactcaatgaactatacaacttaccgtgaattgtgcagtgtgtgttatataaactatgcctcaataaagctggatcggccag

SEQ ID NO: 125 - DNA, 743 bp, Homo sapiens
tcactgtgctggggaaagtgaatgactcctgactgtgttcgccctggtgatctttccctttttgggtcagatggttctcttcagtttaatgatcttccatctgctgaccagcctgctaagctctgaagaagaaatttcaactaacatcagaccaattctcatctgccactctcccccagtgcagcagggcctgcaatgacatgtaccatttcaccaagccttgcctgtggcccaccagcagcatccatgcagggcaaagcttgattcagaagaataaagctcatggatgaaactggggggacattatattagaagaaaataagccaggaacacaaagtcaaacaccgcgtgttctgactcatatgtggaaactttaagttgatgttggccaagcatggtggctcacgcctataatcccagcactttgggaggctgaggcgggtggatcacctgaggtcaggagtttgagatgagcctggccaacatggtgaaaaccgctctgtactaaaaatacaaaaattagccaggcatggtggcagatgcctgcaatcccagctacttgggagtctaaggaaggagaatcacttgaacccagaaggcggaggttgcagtgagccaagattactccattgccctccagccagggcgacaagagcgaaacttcgggaaaaaaaaaaagaagaagaagaagaaagaaaaaaaagtttatgtcatagaggcaaataataaaacaggatcggccg

SEQ ID NO: 126 - DNA, 225 bp, Homo sapiens
atagctgcagttacctgagagacttttcatctgtgtaagagttggactcttttcatcgacactccttctaccaagtgaggacacattgagacggcgccatctatgaaccaggaagcagaccttcaacagacactgaatctgccagaactttcatcttgggatttcccagcctctacaactatgagaaatacatttctgttgtttataagctgaaaaaaaaaaaaa

SEQ ID NO: 127 - DNA, 944 bp, Homo sapiens
gcatgctgcgacgactctcttaattttccaccgctacacaaaattatgcagaagagcagatcagattgacgcattttgataaggattcagcccaccattgctgactttgaagatgaaggagagggaccatgagccacagaaaaccagcagcctctaggaactggaaaaagcaaggaaatggattttcccctagagcttcatcctccctcccagcacaaggtcttagcactgttttatcttcccagaaggcttttccctcttccaccctgcttctagtcccaatatcatcaccagatgagaatatgtatggattcatgaacaagaaaattgcttaaccatttgatcaagagagattggaaaatcaagatgaagcaggtctgggtgaaagagctgtgaatggattaatggaacagaaaggaggtgtggagtatccttctattacatgttaatgatcaccagggaacatccactacaatagaacatcccactaaatcaccagtagacacaagagaatatgtggccagttgactttggccagcctctgtcattagatgtcaatgttcaaacaacggtacatgaatggcatagccctggtagcaggagtgggggctatgcatggatccagcaaaacaacactcccactccacaacattgacccagccaccaaggctgacaaaatattcaaccttccagcaacagaaaccaaggatgacccttatccctgcccaggggcagcctgcatccaacaacttgtcagcacaggactataaaggccttaccctttgcctctgtgaagcatcccacagagaggtgcatccacctctgaaggtacatcccagcttcaggctcccagtcactttgggcttacccagcctcttcgtctgccctgcttttctccctccccttccttcctgcaggtttggatcctgagagcactccctaat

SEQ ID NO: 128 - DNA, 471 bp, Homo sapiens
catcatgaatataaggaaagatgaacagtgtttggggatacagccactgaagagtgtaatggacctaaagatggtgggaacacatttagttaaaaggatggctaaatacggctgtctccatcctctcaacttgagatgcagtctcccaacttccgagttgtaaccacttctcagaactattttcagaaagaggaagtcctgatgttaaaagatgctttgcttttcagttgtgcctacaaaaactgtgtcatgaacacccagacattctgaatgtaacaattactcatgaaagcttagggtgtggtaaaccttcccaacatgaagttgcaagagcttgtctatcagcagggattcaagtcaaaaagaatgctcaaagatctggtaaacgttactgttcagtgttttgaaaaaagatttgcagtttagaagggacatactttttttctcttcacggtaatgaacaccccaaca

SEQ ID NO: 129 - DNA, 1209 bp, Homo sapiens
atatgtatgaagaaaatcaacatggcaatctggagctaaacctgtttctaaatcaactgacttttcttcaaattgagatgccatgagacatttttagttttcttctcttatgaatggatatatttactttagacgaaaattactctttatgttcccatgacatatgccttccagataaattttatggtgatatcacaaagagctttcttcctcttttttaaaaatatctgcttcaactgcaaactgaaatacgtgaaatgagcagccatactggcttacaggagtcaaacctctcccagttacgactgaatatggggaagctacagtgctccaaagattgagctcacggctgtgaaagtagctcacagctgataaagtgcaaaagagaaatctacatgctactcctaggaactagtgaaggggaagagaaagagaaaaggagagagacctgtttggaataagtgaaatctgtcagctttcaaaaggaatatactttggtttggtttgatcgaatggccctatttacaagaccgcctttgatttatataaaaatctgcagaaatccagtcccaccccgcaatctggagggaacaacacactaccagcgcaactctggcttcatcacaggatgtccctggataaataaaatctagatctggctcctgtccactgctgttctaaatgagcccagccagcctggcccatgtttcttcatttcattttctggagccaaaatgactaccatctgctgtcacgaagctgtcacacaatcagtaatggaagatttctaaggaatataatggctgaagaatgaatatatgacaatccagttactatctagcaggcagagaacagcaacccatttgaaaagaaacagcagtggtgttctcccacttctcagcaagtgcattgtaatacaaatctttatttggactcaagatgttgacaggtcaattgaacagaataagtctagtttatgatgcagttgtcagaactggttaaagcaggagtctctttaccgatgtcctgagatattccaacaatttttcttgcaaaccagcaccttgaggttaattactttaccaatttgagtaaacggcaagccatattcccatctgtctccattagttccccactatttctcaatttatgatgactggggtcaaggctgtggtacaaaagaagaagcaataaagcacgatcagaacg

SEQ ID NO: 130 - DNA, 498 bp, Homo sapiens
taaagccaagattcagagaaattaagcatctcaatggaagtcatgcagctacaggaagcagagtcagacgggtctgacttcactgtctccagtgcatcatgctaaccctcctgcttctcccctctacctagttaggggctttctaacaggccagaagattagatgagagaggcattgccattttgcactgatgctatgattgtcaactccaggactcaccacactatctggctcattgcattttcattgaatgatatttccacctctatgattcggataagaatagtttatgtcaatgttgagaggacacgtaagtgtgcaatcactttgaactctaacaagaaaaataacatgattgtttaggtcttaacaggtgatgttctaagacctgtcatatattaatcacatcattctcataaaaatcctataaggtatgactgtctatttgcatggcacacatgagagataaagtcactttctgaagattatacagtaaat

SEQ ID NO: 131 - DNA, 1064 bp, Homo sapiens
taacattgcaaggaaataacccaggtcatggtgatggcaagtcctcagcagggtagagaaggaaacttggaaggaagaaggcttatgaactctagtaccttatgccactgaaaacccacacccagaacctccaccttctgacaccatggtcagctcctgctgcagctccttctgctgtcaccagaggtgtggttaagacctctgccaagagatctgctgccatcccagctgctgccagaccacctgctgcaagaccgcttgctgctgccgcagcttctttgtttcacagtttatttttctcagaagaatcttcagaaaacaagaaacatcatcccatttgaggactgctgtgagacacacagttttcaggatgacacagagaatgctgagttccaagtgatctgtcacctgacaatcgactggatgaggctgtgatcaaggcctctgccaagagacctgctgccgccccagctgctgccagaccacctgttgctgccccagctgtgttgtatccagctgctgccgcccatcctgctctcagactacctgctgccagaccacttgctgtcgccccagcagctgccgcccagtctgttgtcagaccacctgccgccccagatgtggtgtgtccagctgctgccgtccactctgttgtcagaccacctgccgccccagctgtggtgtgtccagctgctgccgtccactctgctgtcagaccacctgctgccgtacaacttgctgccgcccccagctgctgtggatcctcttgttgaacctcatattggactatcaaccatgagccagtcaccatcccatgatatgaaagcgtcatttatgtcaatctgtccatgggttaaatggccataagctttattatcctgctattccactaagtaactggtgaaagggcatccatctacatttaataccactcatttgtcccatggatctcttcccagcattcagacctcaaatgcatgatgcagttagactaagcctttaagtctctgactgttatgcttgattagaccttaaaaagacatattaactgtctttaataattt

SEQ ID NO: 132 - DNA, 1445 bp, Homo sapiens
taggtaagataaacaatagcaaggaaataacccaggtcatggtgatggcaagtcctcagcagggtagagaaggaaacttggaaggaagaaggcttatgaactctagtaccttatgccactgaaaacccacacccagaacctccaccttctgactccatggtcagctcctgctgcagctccttctgctgtcaccagaggtgtggttaagacctctgccaagagatctgctgccatcccagctgctgccagaccacctgctgcaagaccgcttgctgctgccgcagcttctttgtttcacagtttatttttctcagaagaatctccagaaaacaagaaacatcatcccatttgaggactgctgtgagacacacagttttcaggatgacacagagaatgctgagttccaagtgatctgtcacctgacaatcgactggatgagtaagattacaagtctttgaaattaaatgacacactaaattaactgaagacaagaggaggaggaaagactggattggctaaactctaacacagagaaagaataaaagtgcattccaccttttatacagattttttcccacaattagctaacttgataactgcctatctattaagataaacaataacaaggaaatagcttttatgtggtgacaacagctcctcagctgagtataaaagtggacatgggataaggagattcccacatttgaaaaactcactgtcttggaaacctacctagaacctccaccctctgacaccatggttaactcttgttgtggctctgtctgctctgaccagggctgtgatcaaggcctctgccaagagacctgctgccgccccagctgctgccagaccacctgttgctgccccagctgtgttgtatccagctgctgccgcccatcctgctctcagactacctgctgccagaccacttgctgtcgccccagctgctgccgcccagtctgttgtcagaccacctgccgccccagctgtggtgtgtccagctgctgccgtccactctgttgtcagaccacctgccgccccagctgtggtgtgtccagctgctgccgtccactctgctgtcagaccacctgctgccgtacaacttgctgccgccccagctgctgtggatcctcttgttgaacctcatattggactatcaaccatgagccagtcaccatcccatgatatgaaagtgtcatttatatcaatttgtccatgtgttaaatggccatcagctttattatcctgttattccactaagtaactggtgaaagggcatccatctacatttaataccactcatttttcccatggatctcttcccagcattcagacctcagatgcatgatgcagttagactaagcctctaagtctctgactgttatgcttgatttgaccttcaaaattacatattaactgttcttcaataaatattgatgcgcccg

SEQ ID NO: 133 - DNA, 674 bp, Homo sapiens
agaacccaacctgtgatgacaaagttcatgctcgaagttaatatagaggtcttcctgtcccaggcactttgagagccgcaggttaccctgcagacatgaccaggtccaagaagactgcacacaaccagtcctgaaaaatggcacagaaatggtgtcaagaaaccacaattacgaagatatgaatctcttaatggggcgtaacatgcactttgtcaggaagcacaacaagaagagcctggagaagatgtaggccaacaatgcaaggccatcactgcacatgccaaggctgtcaaggccctcataaagctcaaggaggttaagcccaagatgtcaaagggcatcagtccgaagcttgatggacttgcctacactgcccatcccaagcttgggagtatatttgtgtctacattgctaagtggatctactggccagaggccaaggccaaggatcaaaccaaggcccaggctgtgcctttagcttcagctgcagctgcagttccagctcaggctcccaaaggtgtccagacccccataaagcctctctgccaacatgaggacagaaggaccgatttgatcactgggctaccgtctggatggagcttctgtccttccatgctatttgtatgaataaatctgaggcaagaaaaaaacccccaaataaacacagatcggccg

SEQ ID NO: 134 - DNA, 465 bp, Homo sapiens
aaggaggagaatcagaaggtcgccattgaaactattgaattcaagagcttatcggtgcaactgcagcccaactatcaggaatcagcatcaaaactacttcctgtctctcactaactgggtaattggtcacaaaaagtggacttcagctgccgctcctaaagcaaatgcctgtcagcaataatgtacctagtaactggacaatgaaaatctgctgcagaaaaaaaaaatgttccaagaatatttctgacagtagaaaaagcaaaaacataggacaccttccacgtcatttcaatattttaaatttcatataagtgcacccaactaattcatattgaggactctaactgtaaagaattctaggaaatgtattctttttatttctagccttcgacgtacaggatggcacactagaatgcggtcagaatgaatgccgagtgccaatgatcatttacaaataaaacccga

SEQ ID NO: 135 - DNA, 942 bp, Homo sapiens
cggccagatccacatttattttgtaataatcaatacatcaagttaacatccttggtaattagcccagcaaattgatatttatagattaatgttttgtttccacaaatgatcattgcaaccattcttccttagcatccagccatatgctagctatgtcaggacctccaccagttgagactgaatcttgcaagtctcaagcaattaggcattcaaatgaatgctgtgctaatatatagattttagcattgtattttcttgggttctttttaaaaaggggaaactcaaaaattattctttgttcaataataaaggcttgacaatgcatctgtttctaagtgcatgcagtatctactcaaatctgtattggaaaattacactgtaaaatgctttggaggctttttttttttcttactcattttcagtctctcacagtctctcacttcttaaacaattcctattttctcaacacagactgcattgccaccaagctatcaagtaataacttttttagaactcagaatgaaaagaaaaagcccaaccaaacaaacaaacaagaatgatgctttaggaacccttttctcctgtaccgggcacaaaatcattcatttttggcccagggggggttgaattaaaaaaggccccgaatgccggaaggaaattttaagtgaagggggatataaatttaaataaattccctttccttggtttaggagggccccaggcccaattcaattatgaaaaaattgggttcctttgggggttaaaaccacacacatttgtctggggtggttaaaaacgcgaagggggtctcttggggcacacgaaaaagcccaggaaggaccaaggggggcttggggccttcggggaaaacccctaaaagagtggggagttggttttatagacacacttttttgaaaacgaggagaactccgttaaagagtc

SEQ ID NO: 136 - DNA, 949 bp, Homo sapiens
tctctaatatccaccgctacaggtatcctttctacacattttttataaaatcctagaataggaaggagatgtagagaacatttgttcaaatctactgcttgacaaaggcacttctgaattcaagttggtgttccagaaccatgacagacaattgctgaacatcaaactaaggagtgaacacttcatcagatctgcttgccttaacaacaaaaatagccaaaatgttaagacagtcaaactagattgattgtttttgatacaatctgtgagtggttgacccaagaattctcaatctaatcacgcctataaatacagagactgtatccacagatgcaaaagcagccagaggacaagtgagaaattcgtcagtcacctggatgcctcatctctacaatggcactgaacagcatgtgaagagacacccgcaagggtctgtgagtggcttctgggcgctgggtctcacaggaagcatctactttaaaagctgggaatgctgatcctttcagtttctatcaagaagacaaagtctggcttataatagaaaaacagattcccccaaatcattgtctagaggtgttgaatcacacatgaatgtcagcaaatgatgccaactatggatcactttcctgggggactttatctggtgtgaaccaagagaatcctacttcatgcatttttttaaacatccccagataactgttgtgctgtgtcatagaccaaaagggaaattcatttttctcataattggatttggtacttgtaggctttcctgaagacaaggaaaaggaaattattttaaattcttaaaaaacctttgactaaaaaattcaatcagcatattcaggtgcctaatctgatttcaacaaccactgtggcagagatggatgacttcgtgtaccggtacaagagaaaaggggtcctgaagcttatttctggttggtggttgggt

SEQ ID NO: 137 - DNA, 825 bp, Homo sapiens
  misc_feature (1)...(825): n = A,T,C or G
gtatgctgcaacgactctcttaatcctccacggctacacgttgaaatttatcactttccctgatggttgtcaggatatctctacttctttgattcataacaagaatctgatgcatcttgacctaaaagggagtgatataggggataatggagtaaagtcattgtgtgaagccttgaaacaccagagtgtaaactacagactctcagcttagaaagctgtggtctcacagaggtcgtcngtgagtatctttctttggctctcatcagcaataaaagactgacacatttgtgcttggcagacaatgtcttgggtgatggtggagtaaagcttatgagtgatgccctgcaacatgcacaatgtactctgaagagccttgtgctgaggcgttgccatttcacttcacttagcagtgaatatctgtcaacttctcttctacacaacaagagcctgacgcatttggatctaggatcaaactggctacaagacaatggagtgaagcttttgtgtgatgtctttcgggatccaagcttgaatcttcaagacttggaatttgtgggctgtgttctccctaatgcattgtgccgggatctggcttctgttattttgaataacccaaacctgtaggaacctgaaccttgggaactactatttgcaagatgatggagtgaaactctgtgggatgctttcgaatatgccaactttgacctttcagagctccggtttggaaaaccgggtgttgccaatttttttttggaaagaactctccttgatcttatcgggtaagaatatagctttaataacttggcaccgatacctaggtgtggt

SEQ ID NO: 138 - DNA, 845 bp, Homo sapiens
ctcttttctacttcctggaagctggaacaatggatgaaccaaatttgaaccaagtggagaagatggcaatatcctggaatatggtagagggacaagatagatgaaacctggatccctgagtgatgacgcgaaactgagccacccctacatcttggaatgctcacttttaggctattttaagacagacataaaactccaagtgctttaaaatagtatattttgaaatgtccttgttagagcagctttagtttgtttcctaagtggtacaggcatccacagaatttcatagtgagtaaaaataccatgattaaacaataaatctgcagcatacagctgtggaatttgcctgtattttcaagttattttaaatatatcacaaaacaaaatatatttttccagttaattggttatgacaatattttaaacactaaactttttctaagggtggaacatatgcagttgaactttgagagataaatgaggaagctagaaatgaagaaaccttcctttaagttatgttctttatgtctgagtttcttggttttcagaccaaatagtttccctgtttgtgccactctagctgtttttcaatgtaaaatccagcaacacattccttaaatagttgaatgataaattttaaagttataaataacttgggagaatgtttttattgtatataattaattgctagaattttattttatctatccaaaaaatcacgtagtcactctttgatcatttccagaattgggaggatacccattcatatagttttcatttcagactattgaactctcacaaagtcttccctaaattgcactctaataaaacccgatgctggccag

SEQ ID NO: 139 - DNA, 817 bp, Homo sapiens
cgatccctgtttatttatttcaagtaaaaggccacacagacacagaaaattagaaggctcgtgaaataagatttaagttccattctggttacagggtcctccctgatgttcaatcctagaggctatacctcccactcttgaagaatttccaaaccttccaggcccaggagagttttccatgttgaaagattgcaggatgggaccccataacaatcccccaaaagttcaggctgaaattacatgcaggccaagtctgtatgatgcagccctctgtaattgttgggtctcttccagaaggctctcaacacatgggactccgatgaagttcagcatgtggaaagggctgaagcttgaagcctgtgtatttgtaatggaaacacagcagtgaccccatgatccaggtctgtatctgtgctgccataaaatgtgtttctccaaacagagcagcaggagtgccagtgaggggtgggagcagggaggttctggaaagactccctcaggtagggaggtagcagggcctcctaataaaaaaccatgcacttagggagtgctatgtagtttgcaaagtactctcacatatgaggtactcaggataagcctctgaagtgggtaagacaagcattcttttccttcttcaacacgtgaagcaacagtatcacacagtaagttccattcttggccatcaaattggtgaaggttaaaaactgaaatgaattccctgtgatggaagattatgggaaaaaagacactcttctactctgctggttcgtcagtatttgtgtagcccgtggaggattaagagagtcgtccagatgac

SEQ ID NO: 140 - DNA, 515 bp, Homo sapiens
tcgggatttattttttatttctgacttttggaatgggaaagactatgctatgcctatgccatcattgtattttggaagcagataacttgtctggttttatagattcacagctggggaggaattttgcctcaggacaaatcataactcctatgagtctcactcatacctgatttagattatattttgtgcttacacttgatgctgaaatgagttaagatttctggcacagttagaacagggtgagcgtacgaatttggaggagaggtggacggagggctataaagaggtctaccaaaattcatatgttgaagtcctaacctccagtgcctcagaatgtgattgcagcgacgaagtctttagaggtattaagttataatgaagacattagggtaggccctaatccaatataactagtatccttataacaagaggaaattaagacacagacagttacagaggaaagaccatgtgaaaacagagagagatggcaatgtaagagagtcagtgccgcttag

SEQ ID NO: 141 - DNA, 507 bp, Homo sapiens
gcctcctctcccctgcccgcaatgccatgcgagctgaccttggacctgcgacccttgccttcatctgtgccgagacctacacaaacagtgatgaagcatcgcagccggaggtgggagagcctccaccaggacagtgctagcattggaactggtgctcctttaagcgtttactgcagtggaaacttggtctgtacccagaaaggcccaagatgttgcttcttgagggcatacagcttttaatgacaattggacaaatgctacattatttagcattgagacaaatggaaataaatcagcctctgtaagggggtgaaaatggctgacatttttgcttataatcttgaacttatttgggtaaactacctactaatgttttacagttttagctttatcttactagaaggtctaaagggtttttggttataagtggaaaaatgtagaatgtctaaaaaaaacaaaaaagaaggggaaataagaatttatttttcactcttaaaaaaaaaaaaa

SEQ ID NO: 142 - DNA, 333 bp, Homo sapiens
gccacctccagaaggtgaagatggaagaggaatggaaaagcagaccactatcctcctctcattctctctctcttaagccacatgttgtgccaacagaggacaggaaagctttgaatccagtacaaaattgcaatgttaaattcgactgataagaaagttatggaatccactcaagacaattttaagtgactgtgacagaacatatatatggtccattgaaaaataatgagtataataaatgcaaaacatgtcatgtttataccctattgagacagacatctcaataagctggttataaaaatctaacatgccaacactataaaaaaaaaaaaa

SEQ ID NO: 143 - DNA, 811 bp, Homo sapiens
cgtacacgcctacccatttccttcttatcagaagagtgaaaacactgcagaaaaccacctcttctgtttgtattttacttccggaaacatatacatcccatcaaccctctctatcttcagtttactagtgaataaagaaggacttaaagaaatccctttcaaaaagagtaatactaacaaaaacaaaggcaagttgaaaatgtggtggacctcaccctcagaccaggtgagccttcagattctgcacctcgctggccgtgcataaagaaggctgggacatccctgaattcacagtcagggtggtcgtctgtgtgcagaactgaaagcaaacaagagaaacgtggagccacggaggccaaggaaatctgatcagctccaaatccccaagtttggtctttttacacccctaaagacaccatgcttgctccttctccaagactcataagggaaatacaaattgacttttgaaatatccagccactgttaaactggattcagattcctccagtaaatatgagagaagaagtctgacttttgctcagtcattaaaaaagaaacacaagggttggtgtgggggatccctagcgaaattaatgcaggaggcctatcaatatcccccatttactatttgttcagaacccggccaaatttacatgttgggatttaaataaccaaatccagtcccaaaatggcaagggtgcgaaaaaccctgcccaccctgttaaatattttttaacaaaaaattcaaggggtttgtggcgggttaagtaaagaaaagaaaaagcccgatcgggcctttcctttaaggagg

SEQ ID NO: 144 - DNA, 384 bp, Homo sapiens
tctgggtttattataagagatatattacgtggacaaccttttcaaaatggcttcatctcattgaacgcgaacccatttcttcagctctgggatgcaaacctttctcccataagctggaaaccaggctgcaaggtgtgacaggtccaattaccttggtagtcattatctgcgatgatagccttctatataaggacgggcagcagtgcatgctttattagcaacaactaatccaagtaacatttgtacacagtattgggactctatgttctcagcctttaggtgagggagaggatagtcttgagagtgctggtgatgtcctatttctttattcaggcagagtttatgtttcaataaattgttgagttgtacatgatggtttttaca

SEQ ID NO: 145 - DNA, 1218 bp, Homo sapiens
aagtatcgcagaatattgtgaagaaagaaaatctgtaatgaccagaatatgtaactttcctgctttgaagaatgtgcatactattgcatctttcccgaagtgtttggtgatgatgaagcatctgtaggctttgaagtcatgcctgtccaaattacattagcatgaattcttagaatggactgttgcggagggaagtaagtgaatgtgtccaaaacacttggaagtttgcctggaatccagtgtgtgctataccagagtcctagttaggcgtggccttgaacagccctgagaatgaacatctgagaagcgtcaatgtgggatgccctgagatgcaattaagaggaggaaggaaaccatggttctattttaacatgccagcaccatgtaaaagcctactcaatgtgaagatgatgaggatgaagacctttataatgatccacttccacttaatgaataagtagaagttaaaggagaagaaaatgagatctttccaagccttcctgaaagaaaatgagaaatacgtcattggctctgaaagcacaaatgtgatgaagctgagaccaggccttgcaaggaaggctgattgacaggatgtgaagctgatgcagggccatttgttggggtgatactgcagagcaccagctgggtctgtagatagaggcaagtaatgacagtgctgcctctcacctctcccatcatcttgtgccttcctgtgtgcctaaagtcaagaggactttacttgtgtttggggccttctctgattaacacaaggcagtggcagggatgggggcagcagaaaaagaaagaagcatcttgtgacccaggaagacagtggccttggcatatttgtatataatttagaaaatcaggatctatgtaccttgcttgactcatagtaggtattcaataaactgttgtactttcttagaaaaaaaaagccatgaataaatgcatctactcgatatcacccatctgacaggaaataatgtctatgtgtgcatataggttttgtgaaatgggatgggtgacacaagaccaggataaaatatggcatgcactgatacatgcttaattgacattgtaaatcaattactttttttttcaaaagtggataggaactagagagttaggaaatgactgctaatgtgagctgctactaaatgcattaaagaattaagcaatcttcttagaaaagaaaaaaaaagcgatatcgcaaag

SEQ ID NO: 146 - DNA, 334 bp, Homo sapiens
ctaggactgcaaatcaagacagcttctctgtgtcaaagccccagcatgagctgcttcatgattgatgatccagcaagctgttacaaccattcagagagcacgctgtgtcttcatttttaccctattaacttaaatgccagggttcattggcacattacagttgctaaaattcaatctgaccaaccacatggaagaaaaaaagactgaaaatttagtcagaaatctctcggtatatacgtatccatcacattacttatgaaagttgtctggtccaaaatacaggctctgccatctgtggtaataaatctaatggcaagcttcaaaaaaaaaaaaa

SEQ ID NO: 147 - DNA, 328 bp, Homo sapiens
actcttctctgtgtcaaagccccaggtagatccgccagcatgagctgctttatgattgatgatccagcaagctgttacaaccattcagagagcacactgtgtcttcattttaccctattaacttaaatgccaggattcattggcacattacagttgttaaaattcaatctgaccaaccacatggaagaaaaaagactgaaaatttagtcagaaatctctcggtatatacgtatccatcacattacttatgaaagttgtctggtccaatatacaggctttgccatctgtggtaataaatctaatggcaaacttcagaaaaaaaaaaaaa

SEQ ID NO: 148 - DNA, 491 bp, Homo sapiens
actggaaatcaagacagcttctctgtgtcaaagccccaggtagatccgccagcatgagctgcttcatgattgatgatccagcaagctgttacaaccattcagagagcacgctgtgtcttcatttttaccctattaacttaaatgccagggttcattggcacattacagttgctaaaattcaatctgaccaaccacatggaagaaaaaaagactgaaaatttagtcagaaatctctcggtatatacgtatccatcacattacttatgaaagttgtctggtccaaaatacaggctttgccatctgtggtaataaatctaatggcaaacttcacatggttacctgtgatcgtgcttaaaaacagacacacatctgataatgccattactgtagttagaaatgtttgaccacaccgaagctttttaaaaaattaccagaaataagttaaacttcatccataaatatataaataaatgcaaacttaatggctaaaa

SEQ ID NO: 149 - DNA, 457 bp, Homo sapiens
catggtctctgaagtgcagtttccctgcctacagctgacctgtataagaggtgtagccgtcccaccagcagctccctcctgctgctccttccaccatatctctgggttcacctaccacagatgccaagccttgtcgccccatcctgcttttgcaagatggtgagatcctaaactaatggagatgatgttctttgggttgaccgttctggtatagaagttcagctgtggagcaatagaagcagcttcatgtaattgtgagaagggcccaagttcagaaacagaggcccacattgaggaaaggctgcagcatcctcacaagatgtcatggtggttccctaagccatctgggggtttagttgggaataaacagctgtgggttacattctgtaagtttcatacatcccctccacttatttcctaagctacaagaccaattcagttttcaaaaaaaaaaaaa

SEQ ID NO: 150 - DNA, 276 bp, Homo sapiens
cttgtgggtgagatgtgcagctgataagagaaggtacaagaaggtggagaagcacacgacgccctccaaatccctccagccccagattctgtgtcctgtgctgacttggagaactaactcacctgcagaaaggtcttcgaaagaaatgcctgttcctccacttcactggccgtgatatgcagactgagctgtaaccccagtttctgtttcattgttgctgacaccaacagcaataatgagtaaaaattgctatgcatcacaaaaaaaaaaaaaaaa

SEQ ID NO: 151 - DNA, 282 bp, Homo sapiens
cttttgtggactttggattccaaactttgagccaacgacagtcactttagcaaactcgagtgctgctgtgggctgttctttgaaccccttccagcaagctcatggtgttcatctgtgcagagagaggagagagggagtctgtgcaaagaattctccgcacttgagagcttccaagcatttccctcgtgtctttgtacatctctattccaaattcctatgtcagaaaattgacattgtctgaattttgagtaaaatgtaacttttggtgtaaaaaaaaaaaaa

SEQ ID NO: 152 - DNA, 319 bp, Homo sapiens
tgcagccgcaatcgctagattaagagataagagaaaagaggacttgttgtcgactttggattccaaactgaagccaacgtcagtcactttagcaaactcgagtgctgctgtgggctgttctttgaaccccttccagcaagctcatggtgttcatctgtgcagagagagggagtctgtgcaaagaattctccgcacttgagagcttccaagcatttccctcgtgtctttgtacatctctattccaaattcctatgtcagaaaattgacattgtctgaattttgagtaaaatgtaacttttggtgtaaaaaaaaaaaaaaa

SEQ ID NO: 153 - DNA, 472 bp, Homo sapiens
atgagattattttggattttctacaaacacaatgcacttcctgccgtgcttgtgttgggaaatctgccagaacccacaggagggaaagtctaatgaaagcacgcgcctgctggaaaacgaaccgggcttttgaaaagagaggggctgcgtttgtgctgacacgagcaagagacctgtattgccttaacactcccagcaatgaccacctgcaagcttgcgctgcgactcccgtccgaagacatgcgggccagtatgagcggagaggttcccagcaccgtcacaagaccctgtgctattattttagactcacctgtggctgttgacaacaccacacacatgaaatgatgctcaccagaatcaaaatactcagctaaacaaagaattgtgttggtcatgaaattattaccaggagggataaaactccagggtgagccattaaagaatctgaattcaattcaaaaaaaaaaaaaaa

SEQ ID NO: 154 - DNA, 321 bp, Homo sapiens
ggatccacaagggtgctcacaagcataacatatgaaaatttttggagttgaagtagagaaactatcagaaaagaagaatccaaataagtaatatacataagacgtttaacatcatcagtgatcaggaaaatgcaaagtaaaagcctaatatgatactgttatacagattggcaaaaattttaaaatgtgacagtaccaagattctggcaaggataagggaccacagaaactaccatatactactggtattcatgtaagtcagtgaactgctttggaaaacagtcatgatttaataaaattgaagatgcaaaaaaaaaaaaa

SEQ ID NO: 155 - DNA, 578 bp, Homo sapiens
aactgatgtctgaggacactggaatggatctcaagagaggaccaaggtacaatgtggtacagtctatgtttcagctaaagggcaccacaccaagttgaagcaagcattccacaatgtttagcgccacgtcacagatacgagagctgatgtcatgattaaggacaagataaacagccttcagaactacctgaggaaaacaagataaacacagcatgattaagttacctgcactccctcttcctaaagagatctgattattctgtttaacccatttccttaggctagtctatgaaattgggtagaaataatttagacaactgtcaaattttcctataaaagttgctgtggaatcttgtgtatttacttaatagagcgtgtaagtcacccaaagtattaaaaatatatacatgtattatctcatgtacatcttccaaaacatgctatgatatcaacagttaatggggatattgaagcacagtgagttaatgagagagtaactatttgtccaaatggaaacttgttctattgattttttaaaataaaaatgttttaatctccaaaaaaaaaaaaaaaaaaaa

SEQ ID NO: 156 - DNA, 425 bp, Homo sapiens
catgtacctaatgattctggggtacatgagtggaaattaagagaaagcgaatgggaatgaaccctccagagatcttgggacactcagagaattttaagaggagccttgggcctgatcatcactctgtcttccaacaaggagaagaaggattgtttagcaacatgagagaaaccatagaattcagatgctaccttcaatttaactgctcttgactctaacttgcaggcaggcaccatgtccacagtcctggagttcaataatcaacaatgattgggaataaaatgtctttttctgctatgtattctttacttgcaatctcaccttaagtccttgattcatgcacttgacaaatttagttttctctacataatgcagtattatctgcctctaaaaataataaactctatgaaataaaaaaaaaaaaa

SEQ ID NO: 157 - DNA, 769 bp, Homo sapiens
gctggtgaatcacctgaatatactggtcttcattctgaagagcatcagatgattgttcaaaagaaaaaatttgaattctcacaacaatcctttatcacctaagcctcccactcagaaaagctggcagctaaagaacctgcagagaaccaagggaaaggaccccctaaaataagtgtttgagcatcaagtttaacataattccttaaaatctgactgcagttctcaattgtatacataaggaacacaaatagtgtattcaacacagttacatttttctgcactgatgtatttcccactgtcttagaggtttttctcctagctattcctaggatgtttgggctttattattgtcattttctcttaagtgtttgatctatgaaatgaagcattctcaaagcagggcttttacacttggacacatggggcaggatgggaaaagttttaagaagagaagcaatttactttgccagtagtattctgttttctcccactgttattgaagacacttgtgtgtaagtgggggctttttttcctctgtgcttgtgatattaatcttttgccaaggaaatgactgtgaagtcaccagtttagcattatgattttactgaaagatcaagaaaaagagagatgggctgtgagtctgaagccctattgtaacacatgtgtatctttaatcatcagcaatatgtgagttgtcatctgtagaagataataaggtttggggtttttaccaaaactgcttaacttttgaaaaacaaaaaaaaaaaaa

SEQ ID NO: 158 - DNA, 455 bp, Homo sapiens
atgtgtgggttggtattggaaaaaggaagatagcatggggagtgtggatagagcaaatgcatcccctctattagataattcatggacaacataaaagcttcacctgagagccaaggcaacacacttcaatggactgtaacaagccatttgtggagatgcaaatgtgggtccacaggttatactttgaatagcacatttctacgtaatctgtgcgccactaaaaggaagacacaagcctcccagcctaccatcattaactccttgtggaacaaaatgaaaaaaacatagaaacaaattttgtgtgttcaaatgcttaaaacctatctccctaacattaccaaagattaacttggcaatgcatacttacctcttactaattttttaacaatatgtcttaagtggacaggaacataaatctttaacaataaaaaaattattttctaaaaaaaaaaaaa

SEQ ID NO: 159 - DNA, 479 bp, Homo sapiens
actatcgcttttgcaaagttaacagagtttctgttccacacccagtccatcatgttcttgcaacttctaccaccgtggatgtcagttgatatcaatgcagtcttactctgttgcttagtcttctttggacactaatacagtgtgtaggctgaggaggagtaagaagagaagaaattggtgttgctgtctcagatgtggcagacgcagaagaaaactcatgtataagtggactcgtgcaattcagatgcatgttgttcaaaggtcaactgtatttgcaattgtgagaaaagcataaactctgctgtcaattcttgtattttggaggaaaacatggttttgttttgcaaaaaagttatgagttttataattttcttccttcctccctccctcccttcctttctttcctttttttaaaataatgatgcaatgattactcagctggaatgctgtgactcagaagtgaaaaattagcagatcca

SEQ ID NO: 160 - DNA, 140 bp, Homo sapiens
cctagtgtgaggacatagcaaggagtgaagctgtctgcaagcccagaagagacccctcaccacaccatactggcatcctaacctcaaacttctagactccggaacgttggaaaaataaaaacctggcctcgttggcctca

SEQ ID NO: 161 - DNA, 311 bp, Homo sapiens
cttattagtatcaaacaaatactgacctactcaaggctgcattttctagacgtctgagtcaagtggcttctggttgaatttggccacgaggaatttaagcagcatcaggtgccatccctggcaactgcttccccaagactggtctccttgtgaggacatagcaaggaggaagctgtctgcaagcccagaagagacccctcaccacaccatgctggcatcctaacctcaaacttccagactccagaacgttggaaaaataaattcctgtcattacaaaaaaaaaaaataaatatctggcctcgttggcctca

SEQ ID NO: 162 - DNA, 406 bp, Homo sapiens
atagacggtttcactcctgttgcccaggctgttgcaatggcacaatatctgctaaccacaacttcctcctccccagttcaagcgattatcctgcctcaagactcccaagtagctgggattgcaggcatgcgccaccatgcccggttaattttttatttatagtagagacagggtttctccatgttggtcaggctggtctcgaactccagacctgaggtgatccgcccgcctcggcctcccaaagtactgggattacagtggtgagccactgagcccggccatattctttacatcttttataaacttactaaattttgttcttttgttcccattgcctgtgacagttatacataagaaactccatgttgaataaatattgagtaaaccactggcctcgttggcctca

SEQ ID NO: 163 - DNA, 292 bp, Homo sapiens
cataaagttgaaatttgggcatagagacagacacacacaaagggaagatgatgtgaggagccccagggagaagatggccacctgattgatgggatgcatcctcaagccaagaaaattcagcaattgccaacacacaccagaagctgcaggaggcaaggagggactgactcctctgtctgaccatcagagacagcatgacctgatgacaccttgattttgtactgatagcctgcaaaaatgcaaggcaataaatttctgttgttttgagtcacctcaaagaaaaaaaaaaaaa

SEQ ID NO: 164 - DNA, 202 bp, Homo sapiens
catctttttaatttcatggtgaaaatactcctactatggctgatttgaagctaccaacatgatgtgactttacatggaggtggaaagagacgggcacaccattatacaatattcccattatgcagacacaagtgaaaataacttcaagagcataaataataaaatgcagtaaaataaaaaaagtaaaataaaaaaaaaaaaa

SEQ ID NO: 165 - DNA, 268 bp, Homo sapiens
agaacgcttttcaaagcatgaacaacagacaacctacatcagaaccaactggaatgcttgttaaacaaaaaaaaggaaagccacagatcaactgaatcagcatctgtgaggggcagagcctgtatgtctgcctcctaagtttggatcatactacgatttgagaactgttggtgcagtataactcatctgtgttttctgttcaatctctagtagtcacaatttcacaataaattatttccctacagtgttctaaaaaaaaaaaaaaaaa

SEQ ID NO: 166 - DNA, 501 bp, Homo sapiens
ataaagctcaatatccagttcaggaaatgggaaacactgatatatgactcatcccatggaacagaatatagtctacgtggaatgtcacactgtgcttctagtggcaaagtttgcatatatgtatgtatcagtgtatctttaaatttgcctttgtgttgcaagcacttgttatatccttcctattattcctattatttaaatcaatttttattttgcaagactactggtaaagattttggaatgaaatgtttctggggaacggagtcaccctaatttaaaaaataaaaatatctcagtaatttggacaataggtttaatgtatgaggttaaatatatacctgcttattataaatatgcagaatcatttcttgtttagaaaatatttcaaatattttatggaataattacagattatttgtgttcagttggcaatgttctagccgaacaacttataattaaaaatgtaaataaagaagtgtcattagtctaaaaaaaaaaaaa

SEQ ID NO: 167 - DNA, 277 bp, Homo sapiens
tttcagattcacccagatgccttggataatttgttttggaaaacatatattgaagataccagagccacagtatgacagaagactaggtcccagaatcacaactggaaggaaagtcatgcactaatgaagaaaacaattcttaaggcttatatgagctgaaaacaaacttctgtcatgttgctgcctttatccatttttaaaagatgtttgtcatcagtggtgctactctaataaaatacatcatgagcacaataaactcctggcctcgttggcctca

SEQ ID NO: 168 - DNA, 697 bp, Homo sapiens
aaatataccccttttcataagaaaatctacaaagagtatttataagaaattggtgcatggctgtgcttcaactcctcagtgcatgatatgaaagaaaatcagatgaggttgcaagaaataaattttgtgttagacatcagagaccatttcctgacaggaaaagttgtttgtgatgtgtgcagcatgattgacaactcatattaaactgtatatggaagcacaaacattgaagaatagccaaacattcttgaagaaaagaaacaaatggagagaacttgtccttcaaatatcatttactataataaagctgtagtaattaagaaggcatggttttggcacagggataagcactcaaaccaatgaaagaaaatggaattctaaaatatgaaaattattcaaacggggctggcattcctgattgatggaaagcacagactagtcaattaatgcaatagttggtcattcatatgaggaaaaaatgaaattaggttagcttataccatacaaaattcaatcacaaatggattaaaaacctataaacaaacaaaaaactctattaaatatttagaagacactatgtgagaatatttttgaaacttgagataaatgattccttaaggtacaaaacagcaaaaaatgacaacctttattatataaaaattaatttgtgttttccagaatcacaaaaaaaaaaaaa

SEQ ID NO: 169 - DNA, 185 bp, Homo sapiens
atgttgaagaaaagaagttcacagacaggtagaccattttttaaaatagagtcatagtatattttgctgtgagacaaaagcatggataaggaaaacaaaaaggacagcaaagttctattcctctgtagagaaataactgactctcaataaatgggttattttcttgactctcaaaaaaaaaaaaa

SEQ ID NO: 170 - DNA, 416 bp, Homo sapiens
caggaaaagagaaaaacaacaacaacaacaacaacaatttcccgaggatccctgcccacattcagagtagcagatttacctacttcaaagtggagatcaaagccacactctaaggctccttatttccacaggctggcaagcaaacaaggcatacaggctttgcaagagtgtatcctaattctcttactgaagaaaagtcaacagcagagacaacacagaaaaaggaatcaaagaggccaaatctgtggactcaaaacaataagaaaaaataaatcaactttgctaaagtttaagaatgccaggggggtaggtaaatgcactgggaagtatgtgtggactatgatgataataaatctcctttcaatacaactgatatttatcagaccttgaataaaaccttggcctcgttggcctca

SEQ ID NO: 171 - DNA, 350 bp, Homo sapiens
cacccatagggcttatagaaagctttatctactgtcaaggaattctgcgtagcactgagtctgatgaaggaactcatttcgcagcaaagtaacagaacattcaatgggactacagtgaaatttgggagtcattgacatagccagcaatggatacaatgactgttggaactatatacatctccttactgttgggaaaagtgagaattcctcaccagcaagaaggatagttgtatcttataagggtggaaatacagagttatttacttgttgtatgaaagttgaaatgtgtgtaaaagggtgtatggaatctgagttgtcaaaagaataaaccgctggcctcgttggcctca

SEQ ID NO: 172 - DNA, 166 bp, Homo sapiens
attgaacgaacatagagaaagaagagccaggaaccacagagacagcaaagtaatggtcagacacacaaccctggagcctgcccaacttgtgtacctcttattatgtgagataataaaagtcttcattgtgtaaatcaaagaaaaaaaaaaaagaaaaaaaaaaaaa

SEQ ID NO: 173 - DNA, 317 bp, Homo sapiens
cattggctatggatgaacagctgaggatatggacaagctacaattattctctggaaacgatgaggtgaagatgaatgaccttcagaaatcttcacatgacaatggagcgatttgaagaaggaatgccaatatcaatctcatgccttaagcagtgtaacagaatgttctaaaggctccattgaccctaaaatatactttgtggattgtttatgttgttggcactaaacctataaagatatggggggctggggaggatgtactaataatctaggacaggctttcataaataaatggttgcctcctgaaaaaaaaaaaaa

SEQ ID NO: 174 - DNA, 398 bp, Homo sapiens
acagggacctgctgtgtactcaggctggaagcagtggtgtcatcacagctcactgtcacctcaaactcctggactcaagatatcatcccactacaggactcgatcttttggctttccaggaaacctcagtggttaatcaggaaccccacttttgagaagctttaaaaaacaacttttctcctcctaagtccctgaggctcccaaatgtgcagctcagacttttggtggcttctccagaaaagtaaattccctgacacgaaaagagttctgaacgctggattccccttttaacttcttctggtcctatctaaatcgtgacctggttgttccctactgtctcactagtttgatgatattattaataaaacaaacaaaaacaactggcctcgttggcctca

SEQ ID NO: 175 - DNA, 626 bp, Homo sapiens
atggttctacgtccatgtattcaatcagttgcaaccgcagaatgaaaacaatccacggatatggagggccgattgtaagggacttgagtatctgaggattttaatctcttcagtgggcctggaaccaattcccctgagacacagagacaatccgcggatatggagggccgactgaaagggacttgagtatctgaggattttaatctcttcaatgggcctggcaacaattcccttgagacacagagggccaagtgtatatattttattttccaaaaagtagtcataattttaaatagtttaatctcaaaacctaatcacactgatggaattagtatgttacaactcacacttaggaggtgtgattataacaggataaaataggttttcaaaagattttttatagggctaagaaaaaaagactgtgaaaaggaaaactattgtttttaaagttgtacaaatgttctaaaagctccactgaattttattctattcattccctaaataggttcatttgtatgaaagcagttatagcaaaaaaaaagaaaaagaaaaagctgtttcattaaaatggtatagccaataaaaaataaaaataataaaaatgaagtaatctaaaaaaaaaaaaa

SEQ ID NO: 176 - DNA, 242 bp, Homo sapiens
aggcaatggaacagggtactaatgagaagggaaagagcttgtcctgtaagcacggacaccctcatacttcaacccctctggccctgatgaaaagaactaccaaaggacgaagaaagaactgccatgccaagcttcttgatctttcctccttctgtcatgggagaaggagtctccataattaccttagtaaaatcatgtataaactatttctaagaaataaaaccctggcctcgttggcctca

SEQ ID NO: 177 - DNA, 493 bp, Homo sapiens
tggggatgcttgtccaaaataccagagccaaagacattccaagaaaagaaaactacagaccattattcctcctaaacatagatgcaaaacttctaaataaaattttggcctgtaaagctgagaatctgaccttgaactatgcagctcctgacgctaccagatcactttgggattcttgatagccgatttttaattaaataaatgtaattgcctgtttccaccaatgtttaatattcacctgtgttacctgatatcctgcacacatatcaaattaatgtacacaaatctttataaacaacaaaaagatgatctctaaggctccttaaatttctttgctcttgagtacgaaacctaaggaaaaactcaagaaatatattgtttataccatatagttaggtaatttattacagtgagtatttactgtcctcaggatcataattggaggatataaagaatcattaatacaaccaaaaaaatctcaaaaaaaaaaaaa

SEQ ID NO: 178 - DNA, 648 bp, Homo sapiens
cataaagaacgtcggtcctggcagtctttcagccacaaagctttgagaaatggggctaaatattaataataactgcttggattataatgaggaatcaatcaaaacacatactgttgatgaagatgccttgaacaccgtggatgctgtagaataagggattatgactacagcaattcttggctcccttctctgtttgtttaagggttacacaggctttgtttaatatctccgtgtctcagtcctttcggttgaagcacaaggcatgcttcagccacctgagattaactgctaaaccctgcagcaagccagcatctcctccctgctgcctctcatccgtcaggatctgctctggaaatgggccagtggtgacgtgtgggaatgcagccctttgtgtttgtttttggtgttggatttggtggccttggtcacggattggcttccttctttgaaactgaacatcttccatgcctttgtgattgagtgacaaaagttcaacctgcacatgccaaaatgaacagcctagaaaactgattatggtttcaggaccagctttaaaaaaaagcaacaaaacccttccagtcacccagagttctaaacataatcggttggttcccagaagtacaataaaaggaagccagaagtattaaa

SEQ ID NO: 179 - DNA, 730 bp, Homo sapiens
cattgtttgctgacacaagagtccatgaagtgcaggaggaaagagaaggaggacagcaatcagtcacagctccttccagcattcacacagtgactaccactaattacgcctctcagacctttgtttgagcagacctattttctctatgaattaatgccaagtgacctacttttctacatattattcactatttgttctgctgttttatcaattttgagactgttgtgctacacaggaataaaaaaaaatccaatacaataaaactcctctcattgaaaataatatagccacaccatgaaatataaatttattttttctttatgaaaagatagcatctgtagactacatttaggctgtgggaattagctgaaggctgcttcgttggattaataaaaacaaaaagaaatataaatatgttaatgtttagacatgaaacctaagataaaataatagactacatttctaagttttaaaacttgtttgcttataatattctagagatatttatttcataaaagagcacaatgttagttctacaagactatatgtattttctatttatattcctcttgccccattcttcatatgcattatatcatctgattttattatggctcatattttatttattcatttatgaggctgtggggatttttttcttgaaatctttgtggaatgctactaaaaaacagatcatttaaaataaaccccccaggtaaaaaaaaaaaaa

SEQ ID NO: 180 - DNA, 218 bp, Homo sapiens
cctttgtgaaatgtaaagagcaagctccctggcagaacagaccacctttctccagcatgtgctccagaaacaagaggccaggctatggtttacctctcctgggaccaagtccagcgcagcctttcctaactccatccttcccaaactagagttggggaggatgcaagaaataataaataaaggtgacaaaattcttgtgaactgcaaaaaaaaaaaaa

SEQ ID NO: 181 - DNA, 621 bp, Homo sapiens
cataaacagcactagcagccatgatacaaccctcttatgatgacagtgctgctcaaatgtcttctgagaggaagttctgttgctataccaaacaaccgtacttatctcctgaggcagttacaggaagcacagacaactgacaaatgtcaaccaagtacaccttttcacaggccatgcaatacaagtaacttttgttcactaacatcagatgacagattaaatagaaatatggctaatagaattattttccttactggataattaagatcacacaaaataatgtttgttaaagtgccttataactctaatcctcattaaaaacaagtaataataaatattaaaaagtaatttaatttcacagagaacttgccagtacttctaatgactaatcataatattgtatttagtttttgctttttgacaagcaccatgttggttgctttcacattaattatttaactgctcttatttcccattaatccccagtttattactttcattacagtctctgacttgcttatctaatggtataaaagccttctggtgacttatgaaatgctgttgcaaagctgaattaaattcaattaaatatttattagcataaaaaaaaaaaaaaaaaaa

SEQ ID NO: 182 - DNA, 319 bp, Homo sapiens
aaaaatactaatataccaaaactacgatataactaaaaccaatcctcgaatgtgacatgatatgactctgttttgcctagaagcgacatcaccatttccaggcctggccctaaaacctgacatgtgttctaaactctgctccttctgcagcaaccattgagaccctgtgttgtggatgaaagcattgtagggtggaaggagctgaggtcctcaatgacagcgtggagcacaaccaccccttcccatgccaaccacactgggctgtgacttgagtagttttggaaaggataaaaaagaacattttgtaaaaaaaaaaaaa

SEQ ID NO: 183 - DNA, 623 bp, Homo sapiens
ccttagtttggccagcagaatcgggagggatgtgatacttcattgccagctttttccaaagtaacatcatgtaatgaggaaaaaattaaaatggaatcagtctgctagacatctctactcatctccagttacttactgaccacgcatttagaagatgacgcttttggggcttttgtttgtattttctctctctcatttttatcaagccaataaagcataggcttaaagctcacccatgtcctgcacaccagatgtggttcacaaaatgctattttttggaatcttgaacaatttaaaatgaaatgcaaaagcaaaagtaaagttattgctagcagtgtacgtcccctaacagttcatcagtgtaaatacttatagaaccatttaattcaaataaagaaacactcagggtcataaatcaatttattctcactactcaagggagataaaaatgccagagtttgaattccctaaaacaaatagttttataatttcagttgctaggttaagactgtttttatatagtctttcattatcacaaagcactttgcaaattactttacagcttttctattgaatggatttgattaaagactcactgtaatgacaaaaaaaaaaaaaaaaaa

SEQ ID NO: 184 - DNA, 444 bp, Homo sapiens
atgatattgatgaccctatgcaactgttaaaaaaatgtgggcatccctttggactagtctggattcctgatgctgaggaaatcgaccacacgaacagcttctggaatttaaccagatccacaagggtgaagagagggcaagagatcatcttagagaaattttaaactattctattgtcttttgttctgcttcatgagaaagactagattgtgaaattcatcccatttctaattcccacccagggaataaaagagagaatattcatttccttttaatatcagcttaagcaaagaaaatgcagttacaccaaggaaagatgatgggagagtcacagatgattcataattgactccaaatttcattcctgaacatatctgctctcattaatagttaagacagaaaaacaaataaaatataagaagctccaaaaaaaaaaaaaaaaaa

SEQ ID NO: 185 - DNA, 818 bp, Homo sapiens
catggaaaagaaaaaggaagacactcttactggtcagaggagagaacacaattccttcagtggaaccagtaattcaagctactgcatatgccaattaaagaccaatctggggaaaggtggatgccctgggctccatctgccattcaaccactgattacggccttgtacggatggactttcagcagcaggaacccaaaatcattggtgaaataggaaagctattgtacagatattagaaaaataagaccttcacagtcatcagaaaagttatcacttaatgtcatgtgtcatcagtcctttcttgtgattgattatgtttgtatacatgcacttgaaatgtgtttttaaaagagtattataagagatatttttccagtaagtacaataagcattcaatagtagaacaaatagaacattgatatctcattattagtattgctcacatgtgtattatgaggcagaattaaagctgaaatgcaataagagccatattttatcataatagatacttttcattttctgaaataatataataaaataatgtggttggttaaagtatgtacacacaggctatcaattaagatgttttaaatttaattaaatattaaataataaaagccacaaggggaagtaagggaagtaagacaattctttctttaacatacaacacatttaaatgttttctgataattatagaaatatcaaaatcagatcaatcttcatacctcagaaaattaaatgattaaatactggagactattaaaacaaataaaactgtttattccacaactttgcacagctaaaaaaaaaaaaaaaaa

SEQ ID NO: 186 - DNA, 272 bp, Homo sapiens
agattcttgctatgttgaccaggtcttgaacttctggcttcaagtgatcctcctgcctcggcctcccaaagcactgggattacagatgtgagccactgtgcctcgcccggatgttgaatatataatcagaaaactacaatgagttttttccagtttttaaatttgtggtaaatatacataacataaaattttactaccttaactgtgtttaatatatacagtttagtgccattaaatatattcatagtattgtgcaaccaaaaaaaaaaaaa

SEQ ID NO: 187 - DNA, 1323 bp, Homo sapiens
ctaggtgttgggactttgatgggaaaaaggtgaagcaaaatgtggtaaacaggaatgaaaagccagaatgaataaaggaagccttcattgttctgactggggcctgagcagtgagcagaatggaatgtctatcaggacagccgtagatttccacagcttcctgctttcgtcagcttcagcttaacatctattattgtgaagagtagggtcttccaagtttataagaagaatcagatttccaagagcaatttacccctttcttcattctgttaggcattatttggaatggcttttcttcgatgaattcaattaacaggtgtgagccactgcacccagcctgagagattcacagagacctggcaaatgatattgctgaaccatgggcagtgaatgcagagaacagaaaagggcatacacctttggatctctgagccatcatgtaagaagttcagctaccctgaagccaccatgttggatttgccacttagagacagagatatttgaggaaccccaactgttctgggctccagctgtttgagtctttccagtccaggtcttccaagtttataagaagaatcagatttccaagagcaatttacccctttcttcattctgttaggcattatttggaatggcttttcttcgatgaattcaattaacaggctggagtgcagcggcgtgatctcggctcactacaacctccacctcccgggttcaagcgattcttctgcttcagccttctcctgagcagctgggattacaagtgcgcaccatcatgcctggctaatttttgtatttttaatagagacggggtttctccatgttggccaggctcgtctcaaactcctgacctcaggtgatctgcccacctcggcctcccgaagtgctgggattacaggtgtgagccactgcacccagcctaaagagaatattttctcaattaaaaatactatagtcttcagaaaagaatcaattaaagtgatgagaaatttcaaatatattaactacaaactgcaactttgaaaaatattgcaggcaattttattaagttctacagagaaatgtcagtaacatggtattagaaataaatatagctgataaacagattaaagtttatgaatatataccaagaataattattctgcttatgtaattttaattttggaaaaccattttgaaaagtttgttacatgaaatgttatttttaaaagaatttcatatttgaaaatagtttgaatatataatttttaagtattttcaatgcaattagtccaattttctgatcaataaatatcttttaaaagtaaaaaaaaaaaaaaaaaa

SEQ ID NO: 188 - DNA, 125 bp, Homo sapiens
attcagtgctattaaaaaatgaagccctgatggaaacagaagactcaaggaagagacggcagattgcagcagacaagattatagcagacaagattaaaatataagatcattcaaaaaaaaaaaaa

SEQ ID NO: 189 - DNA, 1270 bp, Homo sapiens
cttaggggtgagcctcggctttcagtgatactgaaatatctatgatcaaaagataaaaagcatttcacctccgagggtgaaaacaggtgatcctttcattcagctctaggaatccaagatggccttgcacacgcatacagaatgcaaatcggtcacgcagcctgagaatgcctaccctccaatgtcaacccgcattgcaccaaggaagggacaaaagacaaactcacatggccatccccaaggaacccagagccctaggcctccacgaccactcttagctggatcctcaccatgtttgaagctctgggtggccttgacttctgccgtgtggaccagtaacagaagccagttgcaaaaagagaagaatgaagtcaacatacagaggctgccttttgccaagacctttcatgccagatgggtctttgaaataatgcaaacgcatctgttattcaggtttctttttttcttcttcaagtgcttttcattctgaaaaaaatagaaaaaatacaaaaataaaaaaaattttaaatgtaaaaaatgtaaaacaagtttgtgacaaggaattatcacagaatcatgagtgcaggctaccattagaataatcagtaaataatacatatgatacaatatatcatatgctaagccatatataaaaatctcagtatattaaaaatgattgaaagcatccaaagtgtatttcctaaaaataacaaatttaaattgtaaattaaataaataagagagaaaaagttaaggaattaacaaatatttagaaactaacaagacttttttttctttttttttaaatttgttttactttaagtttcaggatacatgtgtagaacttgcagatttgtttcttaggtgtatgccatggtggtctgttgcgcctactgacccatcctctaagtttcctccccttaatccccacctcccaacaggctctggtgtgcgttgtctcctccctgtgttcatgtgttctcattggtcaactcccacttatgagtaagaacatgcggtgtttggttttctggtcctgtgttagttttctaaggatgatggcttccagcttcatccatgttcctgcaaaggacatgatctcattcctttttatggttgtgttgtattccatgttgtatattgccacattttctttatccagtcaatcattgatgggcatttgggttggttccatctttgctatttaaataaaacttcaaaaacacaaaaagaaacggttttgttgtatcggtaaagaagattacaggag

SEQ ID NO: 190 - DNA, 548 bp, Homo sapiens
agaatgaaaccacttggagagtaaaaaaagaaacctgaataacagatgcgtttgcattattccaaagacccatctggcatgaaaggtcttggcaaaaggcagcctctgtatgttgacttcattcttctctttttgcaactggcttctgttactggtccacacggcagaagtcaaggccacccagagcttcaaacatggtgaggatccagcctatgataaagaaattgaatccatcttttagtcacagttctaaagccttggggatactctggaattaggtcctctaaagagaagaatcctctgtttcagttcataaagaaccgtcataggtgctgtgagtcacccatgtgatcatgtggatttgcagaagggtcagtagaaggactggggaatgggagtgggaaagtcctccaatttgtgaatcgcaaacttcacaactttaatagtaatggaaacatgtctgtttaatgaaaatcattatttattatcaaatccaaatgttaatgtgcattaaaagattgttcttaaaacagaaaaaaaaaaaaaaa

SEQ ID NO: 191 - DNA, 228 bp, Homo sapiens
cttgaacttaactttaaagcctggatctgaaatttttcaacttcttttgttatgaagtgatttccagcaggagtgatgcaaaagctgaaaggcttcgtactacaggaagaggatatggttaaaggcaccaggatgtctacaaaacagatttatttccatctcagcaggaggcagccatgtttctctaagtgttgattaaactgttcctccatggtaaaaaaaaaaaaa

SEQ ID NO: 192 - DNA, 848 bp, Homo sapiens
gaataaatattcgttctacacaagcgaaagggggagaaagggagctgtactgtaaccacctcctatcattggtgccatccccactgactgcaaaaccttgaaggaacgaagataaacagcatcccacagtcaatcttactcacgggagttaaccctatcgaccgcatgtgcacaagaccagacgaatgaccaacctttaccccttgcctcatcacaatactaaaatccccacctgggaagggactttgctgccatttgtgatcctgcggtgcgggtactaacctggggggtgactgcacctgtgcgccctgcgctccactctgcacatgtcacgacactcacatagctcatgtagatgcctgacaaccttgctagagacaccagacataccctggggagccagccagagaactctccctgcaaagctgtatacctttgtgttcaaatataaacctggaataaagtcttgcctggggaaaaaagaaaaacaacaggcctcgttggtctcagcggaggagctttgcggtcgtttacccttaattgagggttagttgatggtactttcttactgaactcgtgggcctaggacagtttggtagtatcagcggaataaattcactcaagagggggaatacggtaatgcacagatcaggggagtaaagagttgagataaatgtagactaatggcagcaagtgccaagatccgtatagtgccaagggacggcgatagtatagacttccgcccctaatggagaggacataaaataaatgtcaatacggagaataacatcgtaaggtcgttgttaataccatggattacggtaagaggatacaacgccctcaggtgt

SEQ ID NO: 193 - DNA, 794 bp, Homo sapiens
acacttagagaattcttccatcacaaagtaagaccgatgaagaggctaattgcaacagacctctccagaagagaaaagcggcctgagtcgggattcttatgagaggctgctcatattttgaaaattaaggtggataactgatttgggggttgggaggaagaaacatacccagaaatccagaaataaaagtactatcatatgaattctctccctctctggattctgaaaacagttctataggggaggaataaactaggccgggcgcagtggctcacgcctgtaatcccagcagtttgggaggcctaggcgggcggatcacgaggtcaggaactcaagaccagcctggccaacatggtaaaaccgcatctatactaaaaatacaaaaattagccggacgtggtggcacactcctgctaattcccagtactgttaaggcttaaacacgaaaataactttgaaccctgaaggcagaacgccaaaaaagccaaaatctccgcctctgcataccgattgatttttagataaccacagattccctgctcgtaaaaataaataggcggatatattcagccagaggctctaaattgacaactatattgccttcgataaaagtatacccaaatgccgcggtcttgggtaattcggcaagagaagcaacttgcctcacttggatcaaccataagaacgaggcggcaatatcttagagtaagatgaaatatgaacccagccaattatcatattgctgcaacgaatttgacgacaataaatcagatcctgactctcgcaaaacaatt

SEQ ID NO: 194 - DNA, 155 bp, Homo sapiens
tccggacgccatctggatttatttcttgctcatttaacagttcaggatggtattctaggcttgtttttgcctctcttccacatggtgactcagtgattcaggcttctttcacattgatggcttcagcatctcctagactcatgtcatcttttaca

SEQ ID NO: 195 - DNA, 285 bp, Homo sapiens
acccatctgaatttttagtgcctttatggaatttctgtactttgaccaaccagaagaaggactatttttgttaaagaatgttcatccgagccattccaaacatgccatagaagcaactgactattgaaggagacacccttgctttgacattttataacaatgatctatgtaatacttaagactctttaaatttgagataatagaaaatgtaactcaaactagtttaaacaataaagtgaatttattggctcatctaaaaaaaaaaaatttttctcgttggcctca

SEQ ID NO: 196 - DNA, 253 bp, Homo sapiens
tgctatatggatggtattgcaaattcatatccttggatctgaaagtagtcctagaacatatcctaaggagatcatctatcaagattagagaatttccttcatgatgttgtttatcgtggcaaaactaggaacaacctgaataccagtccctccaagaagctattgaataatatgggtatccctgttcaggaaaaatgcaaacaaaccactaaaaagagtaaaataatctttattgataaaaaaaaaaaaaaaa

SEQ ID NO: 197 - DNA, 275 bp, Homo sapiens
tttttttttttttttttcttgaaacaaactaattttattattaaaaatatttttgatatttgttttaatgtgttaaatctttaaaaatgcatgttattattaaattgccatctccagaggcttattcagtagagactctgcaatttatttctgtctacttgtgacgccagtgtttcgtcccacctctcaatctcttgcttttcttcctctattgtccaccttgatcttcccttttattgctactcctttaggaaattcttttgttctgaaatttg

SEQ ID NO: 198 - DNA, 254 bp, Homo sapiens
tggtagtttctactaaccagaaaaaagaaggggcgggcgcggacctttgcctgccacaggcatcatcagcttgtacttccacttgcccatggaccagtcagcacacacttcttccattctgagcccatgaaaaccctggactgagccacgttatcggggctgcctgcctatggatagaatctactcacttctgctgacagctgttctgccattcaataaaactcctccaccttgctcactcaaaaaaaaaaaaa

SEQ ID NO: 199 - DNA, 843 bp, Homo sapiens
  misc_feature (1)...(843): n = A,T,C or G
gaatagaattagtgagattggacaaaaaagaggcgggggagggaagaggcttgacactctctacgctcattttgtcaaacgcagagtcatgtacccatcactacaatcaagttacagaccatctccataactccaaagaattcccacacactccattgtagccccacggacaaccaccagtctgtgttctcttctggtagttttgcctttttgagacagtcacataaaatggaaccacttagtatatagcattttgagtttggttgttttcacttaacataatatattaaagatttatccatgttgttgcatgtatcagaggcttatttctttttcttgctaaatagtattactttgtaaggatgtatacaaattgtttatccatttacttgctgatgaacatacagactgttttcagtttttgacaattccgaagaagtcactttacaaatattcatacacaagactttatgtaatatgttttcatttcccttggataggagtgagactgttgggttgtatggtaagtggttgtttaactttatgaaaatctttcaaactgttttaaagagttattgtaccattttgcattttcaccagcaatgtaagagaaatttagttcctcctcttcttcaacagtatttgatactgtcattaaaaaaaatttagctactctaatagacattntgtagtatctagttgtgatattaatctttactcctctgatgactagtgatgtcaggcatctttttatgtggtaaatcgtcatatgtgtatctcttttggggatggatttggtaaaatatttggccaaaattttgagggggaattcttgtctattat

SEQ ID NO: 200 - DNA, 230 bp, Homo sapiens
atccttctgcctaacggactccgactaatctggtaactgagccgtgaattcatttctctgggtcttctgaggtgttggagcaggtggttgtgaagcaacattgactccatttgatatcagaagtggaactgaggaagatttttctttatatgtagaaatctgtgcactgcgtggaaagcatttaaataaaaaacatgcattaaaattgaaaaaaaaaaaaaaaaaaaaaa

SEQ ID NO: 201 - DNA, 1073 bp, Homo sapiens
atgaatccaatcaaaggaacgcattcatctgtataagaagtattaaaatgaaatacttaaaatatataaaattttagaattaaattactacttgatagattatttaataatacattaatattaatttacgtaatataaattaattataatcataaatatatttaagctaaaattaatttcatttgtcacacacacacaacagtggccgataattgccaatgagaatgtcagagtttataattgagacaatttgagtgtcaaaatagtagatctaccaagggaactttagagcagcttaaccagtaggagatctttaaatacctgacctctttactacaaaccaaaagtcatgatgactgaaaaacgaaacattgtcagaatgtaaaattcactaaagaaaaattcagatttcctgtgagaattttccctcattaattgttattatttttgactctgtcaatcatactgtgtccttgaagaacatcagtatgctttgttttttcattgtaattgttgttgttaggagtcctgattatagtcaaaaaacactattgcaggtactttgaaattattaatagaatttctgttcaatatacatatatcaaagctattgctattgaaacaacattttgaaatcaataaaatcctggctccctgaatataatatacatgaaaacacctcaggtttttaacatggaaaacattacgcaaatgtcaattcttaacgttatttattcacatactggactctcaataaagtcatgaagttgaccttctgagtatatgtattgtacacagttaattccctttattcagagtacttttgtattacaaagtcaccataaacactgaattagtaaatacaaagccattgctcattgggaaaatgcagggttaaattcccgtgaacctcgggtcacggtatttctctcagcttatcaatacataagcttattttatgcatgtttccgtttaaatccattttatttaatacatatttcttacactaattatatgcagtattaatttataataaatctctagatgtaaagggtcaaaaaaaaaaaaaaaaa

SEQ ID NO: 202 - DNA, 370 bp, Homo sapiens
agtcagacctgaggacccagccagcttcaggtgcagtggatatgtggcatccagcacaagccttccctgcagccgtcagtgctgctgttttccagatgtgcgcccattcactgcgtgccagtgctgctgctgcaaatttggaagtttacacgtgcatcacgaagtaaaaatgactaggaagctccaacacaagccattacataaaagctgaaattttgactattcactgatttttctttcaaaagtattgatgaagaaaattcccttacaaccagagccgcattcaatattggaaagaaacttgtggataatgcttaggcatttgagaaagtcagaaggttcttattaaaataaacactgtgtaataaaa

SEQ ID NO: 203 - DNA, 746 bp, Homo sapiens
  misc_feature (1)...(746): n = A,T,C or G
tcaaatcctaagaaacaatatacttgaagatttttcactcactgcatcaaagacaagaatgaggcagatgaaaaccatacgcaaaaacacaacaaatagaaaagagattccaccaaaagcaatcatcaagaaaatgtctccagtgagattcccattgttgtgaaggggcgtgtaagtatatttacactcagacagcttcagaagtgctggcctgatgaaaaggactcaccaagagctgaagagtttggcatcacagtccaagtggttccttgttagcaatggccattgtcatcataaggctggatttaacttcagaagtactgcatgccatctggctccaaagagcaaatctatttttataatatcaaatttgcaataagggaaaactacaaacatgctcagagttggatgagcttccatttttaacatgactgactttcaccagtcttcctgggggccccaaactgggtgggctcttttcctctgctccaggccttatctgtgttaggttgtatgattaggatcctaaagtcactgaacaaacagggtacgagtctccataacagaccttntgttcatatacatctcactggctttcgctagagacgtaagagaatggctatcatcttcacactaataatgtccttcagtaatgataaagtcaaggccaaagaaactgacaggcttatatagatgtcaaagctttccctttacagtcttgacttggccactgtgcatccctttcc

SEQ ID NO: 204 - DNA, 201 bp, Homo sapiens
ccttaggtggatcccaggagcagagtaattcaagcaggctgttgtgtaggctgaattcccacctactgcatggagaaactggaacatggacatggaatagcatttctgcatggaatctgttttttttttcttctctggctttgaaatttgcatttcttttagtaaaataagctggttcaaaaacaaaaaaaaaaaaaaaaa

SEQ ID NO: 205 - DNA, 597 bp, Homo sapiens
  misc_feature (1)...(597): n = A,T,C or G
ggtgggggaggacggggcggggggagaggggtcgatacacgcgggccgcgtctgtttttatttaaaaatctattcatggcctaagatgatctgctattcattcacagtatattgagggagaaggggacataagtctccatgtgtattactgaagaattactttcctttagtatgccagtgacatcggcttctgcttgtatccagcacatgtactttcagggcctcatttaagggggattagaaaagatgatcccaaggttcattacaatccagatttagtgattctgttgactgcaggggttttgnnnnnnnnnnnnnnnnnnnnnnnnnnnnnnnnnggccgcatctgtatttattatgtaatctcagaagtgacataccatcacacctgccatattgtattctattagaagcaagacagtaaatccagcccacgctcaagtggaggggttatacaggagcataaataccatgaactgtagagtcctcagccagggctgaaatcttgaacttgtcagagaggtcattgccatacctcattggttgggagagaaattgctgtgatactgcaccattgctagttgtagcctccagaac

SEQ ID NO: 206 - DNA, 985 bp, Homo sapiens
cattgctgcaacgactctcttaacatccaccgctacacgctggagtgcagtggcaggatatcggctcactgcaacctctgcctcccaggtgcaagcgattctcctcaccctcccgagtagctgggattacaggtgcccaccatcatgcccaggggaatatcttctctggcaaataaaataactttctcactaaaacagtacggtggaagaataaatctcaagaaagctgaagatatacaagagtgcctggcttctatagtatgggattaaatctcatgttctggatcagctgtacctcagattacttcaaaattatagaaaaaatgctaatttttcattgttgtagaaagataaagagatggagctatcaaaatgagcaaatatttcttgtttcaaagaaagaactaaaactgaatctatgaatcaaatactattgactttgcatattgatccagcttaaaattttgtaactgtttaggagcatttcagtgattttttgttcaaactgatttaatgaggaaaaaatctggaatatattattttgagaacattaaaataatttgtgataatttgataccaaaaaagtatctttgttggattcatcaagccatttatgaataatatcaattccatttgaacaacgtttttaagtgggttgagtgagagaaccaggaagaactcaagtgttcacatataagcaattaaaaatgtatctggcgataattttatgggcgatatgaaaggtatagtatgtgacaataaaattagggattccataaccattagaaatgctatacttaaagtaagtgagtttctaagctcacgccagcctgaaaggtactataatgaaatttataaatagcatgaaattgtgatttcataaatacattttatataaaacgatccaaataataattgtgtacttcagacagaaagtgtaataaaatttgacaatatcttctgtaaaacaaaaaaaaaaaaaaaa

SEQ ID NO: 207 - DNA, 526 bp, Homo sapiens
attggtctgactctgtcacccaagctggaatgcagtggtgcgatcttggctcacctgcaacctccatctcctgggctcaagccatcctctcaccacagcctcccaagtagctgggactacaggggcgcaccaccacgaccagctaatttttgtatttttagcagagatagagtttcacaacactgtccaggctggtcttgaactcctgagctcaagcaatctgcctgccttggcctctcaaagtgctgggattacaggcatgagccactgtgcctggcacctcctacccttttttttaataccagcatttaaagctttaaatcttcttctaaatgtggatttagttgcatttcacaattatcttatattgtgtttttattttaagctaaattaaaaatattttctatctttctttgtaatttcttcaactcatgaattatttagaattattacttaatttctaagtatttggaaaatttttaagattaaaaaatagtttcttaatttaattccaaaaaaaaaaaaa

SEQ ID NO: 208 - DNA, 275 bp, Homo sapiens
  misc_feature (1)...(275): n = A,T,C or G
ctacagagacgggtctcatgaggtgccagcctcaccatcttggacttcccagtctccagaactatcanaaaggggtgactnaggtagaggggaagtcagcaacttatcttcaggcataactacttttcctgtatcctgaaccctcgagagggatttctgaagaaagaaagagaaaaattacaccttatccaatggaatgtagagagttggaaataaaaaggccttaaaaattgtaaaaaagggggggggaatggcctccttggcctcaggagaga

SEQ ID NO: 209 - DNA, 335 bp, Homo sapiens
caagaagggtctcatgaggtgccagcctcacgatcttggacttcccagtctccagaactgcaacccttcttagctaaggctatggattggaacacctacaagtggtttttccacgtggacctgggctttctcaaacatggtgtctgtgttccaaagaaaggggtgactgaagtagaagtgaagtcagcaacttatcttcaggcataactacttttcctgtatcctgaaccctcgagagggatttctgaagaaagaaagagaaaaattacaccttatccaatggaatgtagagagttggaaataaaaaggccttaaaaattgtaaaaaaaaaaaaa

SEQ ID NO: 210 - DNA, 335 bp, Homo sapiens
agggtctcatgaggtgccagcctcacgatcttggacttcccagtctccagaactgcaacccttcttagctaaggctatggattggaacacctacaagtggtttttccacgtggacctgggctttctcaaacatggtgtctgtgttccaaagatcagaaaggggtgactgaagtagaagcgaagtcagcaacttatcttcaggcataactacttttcctgtatcctgaaccctcgagagggatttctgaagaaagaaagagaaaaattacaccttatccaatggaatgtagagagttggaaataaaaaggccttaaaaattgtaaaaaaaaaaaaa

SEQ ID NO: 211 - DNA, 278 bp, Homo sapiens
ctgctagacacgaccacgggggatacacctccagccatacactgaaaaccaagagtgtctttgttcacatgataagtcacccacgtctgtcccaggaaattcctacccaggaagataaggctacaaagcaagaaataactttattgctttctgcagaaattttgtacaaattaattttattagataaattgctcttctctcaaagcaatagattattaactggggcaaacaactcacttatcaataaattcatttacttatccaaaaaaaaaaaaaaa

SEQ ID NO: 212 - DNA, 825 bp, Homo sapiens
  misc_feature (1)...(825): n = A,T,C or G
ccacagtggcatctgccaggcctgaaatgccttcctccaccacgtgcttatgtgattcaactacaatcttccatcaaggccacttccactggaaatccctcccagacctccccaagcaggttggagtgcaatggcgcgatctcggctcactgcaacctccacctcccaggttcaagtgattctcctgcctcagcctcccaagtagctgggattacagaaataattgatacaatgtgtccagaaaatcagtttctcaagtcagcttttctcaaagtggactctgcagacatttccttggtagatccacacaaataattttcccacaaaaaagtccatactgtgcgggaagtcagggaccgcgaacggagagacttgctgaagccgtgacagaagaacataaattgtgaagatttcatggacatttatcacttccccaatcaatactcttataatttcctatgcttggctttactttaatcttttaatcctgtcatcttcgtaagctgaggaggtatgtcgcctcaggaccctgtgatgattgcattaacctgcccaaattggttgtaaggcatgggtgtttgaacaatatgaaaccctgggcaccttgaaaaaagaataggataacagggattgtcaagggaacaagggagataaccctttaggtttgactgccttgggagccaaggcaggacagaccccatttnttttattacccaaaaacgggtaaaagaaatatccgtgaattcttttccccagtaggagattttttaattatacgccctgggaaagaatgcttccccaaggagcctttaaatggccctttgg

SEQ ID NO: 213 - DNA, 1094 bp, Homo sapiens
  misc_feature (1)...(1094): n = A,T,C or G
atccccatcacaaggaggggagggctaccatcccagctgcaaactctcattcaaggtttatgctgcagccagcagtgtccttggagtctagtccaaagctgaagagagtgaaccatggaactgggagccattggcggagaggctggcctgaaggaagggaagtgtttcagccagaatgtactgacgcacaaccaggaaaccacaagactggtgagaacctttccaaaactgagctttatgatcaaaagaggtacaggaaacagctctgccaagagtcctttctgctcccggctggaaccctgagcttctgaggctctctgagtcaactctctgaacagatgctgtcacccaaggaaccatcactaaagcatttttttgctttgctctgaggtggcctcactggtgggtgcaagtgagttactgtctctttttctctttcttgattctttcttttgacagaagttgccatgtgattactcaattctgaattttagaggccataggttactgcatttatgccctttgccaactgactattgtttggtggtgggcctgcatacaaacacgacatcccccaaactcttatcaatacctagatcccctgacgtgaatctatcaatcccctggacttaacagggtattgaaggaaagaagaccggcatttcctttattttttacatccccagccagtagtccttttcccaggctagtcttccttttgtttcccctaagaatgactcaactaggaattgcattctgatccctgtcacagatataaatcttgtctggatacaaggtcaaaataattgtgttcctgtggattctttttcttttttcaaccagagtaantacccccccccatgaaataaatcacatcatcatatggcagatccagctaatagctgagactggcaggataactgaccgtgtactcagagctaaatgatggagaaattggactggccatggagcacttcaaattgattgnttagtaatgggatatttttcccggaccacaacagaatacttctgaattgttggttctgtcatgggtacaggctcccatgacaggaaaataaagaaagatcggccag

SEQ ID NO: 214 - DNA, 789 bp, Homo sapiens
aagagagcgtgaacacagtcccgcactaccacaaattgtgcagtagagtttaccatatttgaaggtatctcagggatcagcacatctgtcctgaaatagataaggcttgccatgggaaaacaatcttaggatttgtggcgtctccctgccagcttgaacatctcccagatctatggtgaccagacatattgagaaatgtcctcctacctcctcaagaacaagattcacacctatcactacaaaacccgcttggaataatcacctatttcctctaatagtgatgataacaatagtttccttttaatttatattttcaatgggccagaactgtcctgagaatcttacaggtgatacatgaatcacaacaaatcctaatgagatgagactgtccctattccacaatgaggacaaccagcgacactgagagatcaagtaatttgccttcacagctggtaaatgacggcacctgagtttgagatcaagtctgctaattctgaaactgtactctgaacttctatgctgtgtctccaatgctctaggtattgtttggaagaaaatgttgtaatccacactgccccaaatcacctggccagctccattttgctatatgcctgaagaagaaactgactcaggaattttccttttctcaacccaacattcaacccccaagatacaggagacattggcttggcatgattgaatttgctctaaagaccttgcaaagccccaatttttctcctcacaggggacagagactatggcaataattcccaggcctctcctgatttt

SEQ ID NO: 215 - DNA, 760 bp, Homo sapiens
  misc_feature (1)...(760): n = A,T,C or G
cagaatagaatccatgaaactgaaaatggttagacaaatggagccccaaatgatcaccactagcacctaccatcgaagacccctagactgacccgccaacccattcttgcactacgacactgaagactcccctcccgaggaaacctcaactgcggagccccttctaccccgcagttcagcaggaagtagcaagaacgatcgtcgcccaacttccaaacagcacttgggctttcctgttgagaggggactgagggactaagtggctaagttggctggactccttgggtcaatagggacttccctaaggggacgttacctaagccaaaataaatcatagctgcaagagccaaaataaatcatagctgcaagcaaaggaattaaaacttcaaccaatcaaaggggactttcccctaagccaaaatgagtcaaagctgcaagctaagggattgaaatttcaaccaattatatagggagtttaagctctaactgcagcctgatgttttaaaccaatcaggcctgccaacccacaagtggatagaaaataagctaattctataggacaaaaagaggaaaggggaggggtcataaggggatataagcataagacagccaagccacaaacagcatcccttatgggtccccttccaccgcgtggaagcctttagtttcactttcgccccaacaatgtgccaatgcaccaaaaaataaaaaataaaagagtggcctcgtcggcctcagcggtggagctcntccggccgga

SEQ ID NO: 216 - DNA, 1096 bp, Homo sapiens
  misc_feature (1)...(1096): n = A,T,C or G
agtgtgctcctcttacttataaaaaaaatagtgaactgtaaaacagcctcaggcatgtccttcaggaggattccagaataaggcattgttatcataggagatgacagttccatgcatgttattgcccctgaagactttccagtgggacaagatgtggagatgaagacagtgatactgatggtcctgaccctgtgtaggccttgggtctgcatgcttctcaaattgagctgtaacactcactgctgcggtccaagccttcattctttgaagcccgtggaaccacaaactcttcaattgagaaaaaccttcgatcggaagagacttctcatctcatttctgggggcctgtccgggatttctctgaagtgaatagaatccatgaaactgtaagtggttctacaaatggagccccaaatgaccaccactagcacctactatcgaggacccctagactgacctaccaacctgttctaacaccacgacactgaagaagactcccctcctgaggaaccctcaactgcagatccccttctgtgccccagttcagcaggaagtagctagaatgatcattgcccaacttctcaacagcacttgggctttcctgttgagagggggtactgaggcactaagtggctaagttagctagacttcctgggtcaacagggacttccctaaggggacattcctctaagccaaaatgagtcatagctgcaagctaagggattgaaacttcaaccaatcaaaggggactttctcctaagcaaaaatgagtcactgctgcaaactaagtgattgaaacttcacccaatcatatagggagtttaagctttagctgcagcctgatgtttttaaccaatcaggcctgccaacccacaagcagatagaaaataagctaatcctatgggacagaaaaaggaaaaggggaggagtcataagaggatataagcataagacacccaagccagaaacggaaacccttccgggtctccttccaccacgtggaagctttacttttgcttttactttactttcactttaataaaccccgatgcggccgaatattgattaattgaatannatggtgaatattaacaaaa

SEQ ID NO: 217 - DNA, 834 bp, Homo sapiens
cattattggcaagtggaatgagaacaagaagagatccaaggctgaattctgcagtttttggcttcattccaacttgaatttatatagaatattttcaatctgtggttggttgaatccacagatgcaaaacccacagacgtgagggctgattctacgtgcaaactggccacaaaagtcctggctgtcttcaaagctgcatcctaacgagggcagagtacctgggacaatgaatctgattgtaatttacaagaaaatcacctctactgcctacaatatgatacctgattggatggccagatgctaatttgcgcccttagattcttagaccatagggtgtttcctgaaggaatatacggctcacagcgggcaagatccgcgtggctcattacgataggcttttagtgcggcaatctgggagggataggaagaacataaatctagttcggaatgccgctgtgcacgaatgcatcttagacctgtgtggctaccggatttgaagcgagtgtcatgttaggagcgcacccatattttcatgcgtaggatatatcgggatgcacagaagagggtgcgagagcgttggaggcaagtcgagtcaaagactcccccaaaacgggagataaagctctgtatacacaaatataccctgtcggatcaagtgagcatactactatgcgaaaatttaaccagctacgtgctcacccccagaatctcattcattctcctctggtgcatacatcgccttcaccaccaacatgctcgaacggcacagtggatgcgagggtcatacaagaggtgaggtcgcacgacggtgatacgaagtatatgtgctgatag

SEQ ID NO: 218 - DNA, 1061 bp, Homo sapiens
tggcacctagaaagccagcgagacagaaccgttcactcttccggaaagggggctgaaaccagggagccgagtggtattgctcagcggatctcactcccatgaagcccaacaagctaagatccactggcttgaaactctcactgccagcacagcagtctgaagtcaacctgatccaaggctgaattctgcagtttttggcttcattccaacttgaatttatatagaatattttcaatctgtggttggttgaatccacagatgcaaaacccacagacgtgagggctgattctacgtgcaaactggccacaaaagtcctggctgtcttcaaagctgcatcctaacgagggcagagtacctggtacaatgaatctgattgtaatttacaagaaaatcacctctactgcctacaatatgttacctcatttgtttcccagttcctaatttgtacccttagattcttagaccataaagtatttcctgaaggaatagagggctccaagtgggatgatttgagtagttcattttggtggcttttgttatggaaatatgtgaggatggttgaactttagtactgatttttcattcacatgacaagaatgcctacataaatcatgttgctctcccatttaagtaattactaggtttgaagccagttaaaacaaatgatagaagatattttaggttaaacaacatggttttgctttcattgacatcaaccataataggcctaaaaatataagtgcagaaaagcatgttagtatcttttatttctttcaagtatattcatttagttgactttttcaaatatattttagcttattttgccttctgataagaataggacaattgaagaaaaggttttctcacttccttaacattatgaaagaattttattttggaattgcctgagaggtaaatggaaaatatgctcagttggcccaaattctttattaaacaacattataagtgaaaatctgttttccctgctattatctgagtgctatgcttaaagaaacaaataaacatcctgacagttgacagacagaaaaaaaaaaaaaaaa

SEQ ID NO: 219 - DNA, 359 bp, Homo sapiens
ataaagaagcttcagtaaacagaggttaagcaatttccccaaggccataaagctgatgagtggcacacagcatggatgcaaattcaggaatatatggaagagggcttaagaagggtggaaatgcaacaaagcagaggaagttgcacattacaaggagcaagttggtttcctgtttcagtgcaagattcaaaaactcagaaacctgcagaagctggatttttccctcagagattacaacagacaagagcccggcaccttcattacagactcctgagaccctcagcagagaattcagccaagcccactgagacttctgactcacagaactgtgagacaataaataaatgaagatgcgtcag

SEQ ID NO: 220 - DNA, 761 bp, Homo sapiens
  misc_feature (1)...(761): n = A,T,C or G
ataaagaagcttcagtaaacagaggttaagcaatttccccaaggccataaagctgatgagtggcacacagcatggatgcaaattcaggaatatatggaagagggcttaagaagggtggaaatgcaacaaagcagaggaagttgcacattacaaggagcaagttggtttcctgtttcagtgcaagattcaaaaactcagaaacctgcagaagctggaacaataaatatctgattcgctttcaaaaagatgattattgtacatttgggattgctgcaccagaggatgaatatcaaaattccatgaatgtgcattaagagattacaacagacaagagcccggcaccttcattacagactcctgagaccctcagcagagaattcagccaagcccactgagacttctgactcacagaactgtgagacaataaatgaatgttgttttcagtcctcgaaactcatggtaatgtgttatgcagcaatagaaaactaacacagttctagaggttgggaagtccaagatcaatgtgcttggaagattcagtgcctggtaaggacccagcatctgcttccaagatggcaccctgttactgagtgctccacactggggagatggaagggaaaaagacattgacgcctttgttnacacacaggacaggagaaataaggcatagagtcccctgttagttcctccagccctttttcaccgtttaaagattttatcttgttgatacttgttaattcggaattaaggttcatcattgg

SEQ ID NO: 221 - DNA, 882 bp, Homo sapiens
ataaagaagcttcagtaaacagaggttaagcaatttccccaaggccataaagctgatgagtggcacacagcatggatgcaaattcaggaatatatggaagagggcttaagaagggtggaaatgcaacaaagcagaggaagttgcacattacaaggagcaagttggtttcctgtttcagtgcaagattcaaaaactcagaaacctgcagaagctggatcctttattgcccttgagaggacacaagttggatcaagtatcaatcaaagtgcttgccagagtaaactcttaacaccacaggactctatgctgaagggggtaaggttacaactcagaaatgtaatcagacatagaaggatgaccaaagaatatcagcagcttccacatcacaaggaaaagaatcaaactttatgtcagaactggggtttttttcagtgtgttcttaggaatattacacacacaaaagtctattttcagttactagccttcaaattttagtactcacggaaacctacactacaaatataacaaaaagcataggaaattttatttaaaataaaatttagtgtatgtcggtaggctgttactttacacataaataggctggaacaaatctgaaaagatgatatgagatgttcttacctaaatacgtattgtcataccccttatgagtcatcctccctaacaggtaaaattagggcatataaaagtctaaccaacctgcctattaggtgtgaagacaatggagataatctactgggttaatataggaaccacaagttaatactaggtgctcatgctaccaatgcaccttattagcatcaagagggaacgctggaacccaggagaagttttgccaaagtagtataccggaatcagtcatct

SEQ ID NO: 222 - DNA, 987 bp, Homo sapiens
agagtctctctatgtcgcccaagttggagtgcagtggcacgatctcggctcactgcaacctccagctcccatgttcaagccattctcctgcctcagcctccagagtagctacagctcagcatccagcttgcctgtggtaccagctgatccactgtgtggactcaggactcaggcagcaaggggtgtcttcattaagaagtggcccaggttggaagatgattttcctggtgaatccctttatcaacaaactcagagactccctgtgaccacatgtcccaaaggagacccttctatttcccggcagcatcaagagggcattgttgcattgttgagaacagacatagtaaatatgccattgcagtaacaataatattaataatgaatacattgctaaatattcataacaagtacattattgaatcaggcattgttgcttgccttctaaagtctatttcatctcttggtctttataccaatcttatagtttaggtgagattgaccttcccttactgcaaggaaaggtctgattggcataatgtataaaatacaatctcattctcctttagcaaacatagcaaacacctccatggaaccattcatcatattatgacaatctcctgggtcacagctatgggtttgtatcagtggagacaaaaatgattccatcttggatgctaatctgccatgctgacttctgatcagccccagtctcatgaatgccccctggtttctacattagttcttgtcctttgtgtaaaaacaaagcaaccttgatgttatcacacaaattataggctatgacacacatagcattcttgtctgttctggaggatacctttggttgtcttgctggagcacgtatgcctcttctctatggtaggtaagtcttgagtctagggagtcaccgggcagagatctgcttgtcttgtggctgcccaagaccacacttccatcgttaagtcttcttaataaagtctgatcggccag

SEQ ID NO: 223 - DNA, 741 bp, Homo sapiens
  misc_feature (1)...(741): n = A,T,C or G
cacagcctttgggtagtgacctcctgtactgactctgaactggcctcaggacttgctctggccaatgggccaacagcagacctaaagcaagcagaggcctggaaactacattgagactgtcctcttggtgttctctagagtcctgaggcaacaccacgtgagagaaccccggtgtgcctgatgctttttgacatgtggccaaatgcatgcccatcctgttgccccatctgacattgggccaacttctagagatatgaatgaggccagcctggatcactcaccccatatgagctggcctggattagaagaaccaccatcaacccatagaaccaagagaaataaagtatttggaacaagctcctctaacctactcagtttgggatgatggttactcatcagtagagaacttgcttcttgccaattaggtgagaacctgngcaatcaaggaaggacagaagtgtgtgtaagtgtgtgggttggcttataaaaatagttagaaggccctaatttatttcacccaggcactttaacttattaagtagagtcctgccctttccatttntagcaaagaggagagagtgaagcanagtggtacaggaggaaatgatgcttgctgccttggggaaataagggtatttttggggacatttaagccctaaaccgtccttattgagtttggagcagggtaaaatgagattaaatgggcttctacccggtggtggggtttttttttaaacggcc

SEQ ID NO: 224 - DNA, 811 bp, Homo sapiens
ctgaggtgtccggggctaggtctgcagctccaactggctgaggaaccttctttcctacacagtgaggtgtccggggccaggtctgcagctccgactggctgaggaaccttctttcctgcacggcgaggtgtccggggccaggtctgcagctccaactggctgaggaaggaacacatatcctcccaggggaaaggtggaaggtagaggagaagaatttattcctccagaacacatatgacccctagtctgaattaccgttgaaagtggggccggatacccggcttgcataaggaggtgcctcaactttaaccactgaacaggtggcctgctagacccccaaaggggaacaaactttccatcctgaaacagtctcatgggcccatcatccattcctttgtaaggcctgactgtcaccactcacgctggtcgaacgatcatcaaaactatggcggaaagatgccattagacctgggcagtaaagatgccacccagattctgtccttgcaccctggaccttccccccttccactcgagacgacaactagctacctgcccccttgccacggactagaacccccaagaaccacccaatgtacctcacacatctcgcccctcccctttcctgggcaacttctactagtacgcctcaaaccacattccagtttgtgctcatcaatccaaatccctccacataagcacggcgccgcaaccccgtgtacgattctaatacaaaccaagctccggagacacgtggctgtcgtttcatcgcgaggaatggacgaaggcgggtctttgaatctgtctggtttcg

SEQ ID NO: 225 - DNA, 776 bp, Homo sapiens
cctttgctacaatctctgaaatagctatcaattaagaagtgactggatgaccaaagtttgtcaaccaaaaaagcaggtctttgaaatatctatgaaacagagaggaagaaaaaaggaaatgggcaaaggaagaaagattgagaaggaaatagaacaaataaatttctggtttcctctgaggcaacattggacaccattatctttcacagacatatcaacttaggagtggtaaggaccttagagatcattttctgaatcctccccattttacacatgatgaacttgtgctcctcggtgaggaacaaggaaagtcacactccggagaagaaaaccgggactccagatttacagtacaattaccattccattacaccgcatggtctctcatttacttcaacaaaagacagggggtgataatccatgatttttcaccattttaaaatttatttacaatatttgtatttttcttatggaattaaaccacacttaggttgcaatggggtggagtaaagaaaatcttaaaaagggagccatctccatttcatagttacattctatggaactatgaacctctcctttgctcaatttctacatggcatgttcctgctgaacccttgagggtcaggcacttgcacagaaattattttggacaagtgcttgccctattgggacatgggcagctattatcttgattcttattcaaatgtgcaaatcatgaagtcccctgtaatagaatgtaatacagtttttgctttcatacaagtcaacccgaattt

SEQ ID NO: 226 - DNA, 969 bp, Homo sapiens
ctggacagcatacgggatttattcttttatttaaaagatttcaatcagtcaactgctgtttcacatttctttgtttgtcccaaactgcaaattagttttttaattgttcatggaatgcaaataaagtaacaatcctttcctaccagatgtgctggataggcatgagggcacaatcattttcctagccaatattttcatcaagaacctattcagaatcttagaattacttcctatttccggcataattgaactgcaaaacattgctggttgcaggtttttgtttttaagtgttcttagaggcctggagactaggatgctaggaatattacaaagagccttaaattgcggcttgaccttgtattgaaaggcaaaaactgtatttacattctattacaggggacttcatgatttgcacatttgaataagaatcaagataatatgctgccatgtcccaataggacagcactttgccagataatttctgtgcaagtgcctgagccccaagggttcagcaggaacagccatgtagaaattgagcaaagtagagcttcatagtttcatagaatgtaactatgaaatggagatggcttcctttttaagattttctttactcaccccattgcaacctaagtgttgtttaattacataagaaaaatacaaatattgtaaataaattttaaaatggtgaaaaatcatgtgtaaaatggggaggattcagaaaatgatctctaaggtccttaccactcctaagttgatatgtctgtgaaagataatggtgtccaatgttgcctcagaggaaaccagaaatttatttgttctatttccttctcaatctttcttcctttgcccatttccttttttcttcctctctgtttcatagatatttcaaagacctgcttttttggttgacaaactttggtcatccagtcacttcttaattgatagctatttcagagattgtagcaaagg

SEQ ID NO: 227 - DNA, 980 bp, Homo sapiens
  misc_feature (1)...(980): n = A,T,C or G
aaatggagaaggtgaagcaatattgttccattaactccaagaaaggtcaagaggttgtcaccttggtgaccatcccctaggcaaggtgttggggtgctaggaagaaggtggaggctgaccaattccctcatctgacaggttgtgtgaacataaggattggctctcaagatgaagcagccatttgaagcttccaaagaccactcgagcatgaccattcattaagaatttcaattttgacagaagcagatgtaacaggtttctttttatctctgttgttcataaaaaaaaactgcctaaagaagggtgaatcttctctgttagccccttaacgggataagacattcgaattaagaaaatgaaattgaagagggatgatctgcttggcataagacaagaaggagagctgagtactctgaagtgtaatcttgcatgggatttgagcagaggctagtgagaagaaaagcaaaagtaaatggtattgtgatcccggaaatgttcaatgtaatctgccaagctcatacattgctttaggggagtggatttgcaggggggaaattctaaaaacaatagtttatatcaaatattttgggatgggaacctgaagcaacattccaataataaggcgtatgccacaattcctggtctccacttgggactggtagagactgttagaggtttaggggttaccctggccacagtattgaggggttcaaggcaaaaccacatggatatcaccccccagatgactctcctcctcccttacgccacatccaaacaagtgaagtctggattttaaaaatacattcatttgtaatattatttcttggaataaaacaactatttcatacttgttgaattaatgantaaagaaaatacaaaaagactctgccctcacaccctgtattaattaattcatcttgaaaataaaactactaatggtaatcatattttaatgtaaaataaaaccacgatgcggccag

SEQ ID NO: 228 - DNA, 578 bp, Homo sapiens
agcttgctttgtttgctggcctcaagctcttggcctcaagcgatcctcccactttggcctcccaaaatgctgggaatacaggcatgagccaccacacctagtctatcagatttggcatttgctgaccttagctcaagaggatattaatgcaggcaatgatgacgctggagactgcagtgagaggaggtgttacccctcatccgaactgccattgccaggtgtttattacaaaaaaaagaatcacctgagaaatatgtgaatataccctccttacattaagttgaaacatttccctttcatcacaggtctccccaatccccaaccccttcaaccctccccaaaacaaccattttttttttaaaacaagtgaggattataaattccccatatctttttctggtcacttgaacatgtaaaaattacctggagaagatgagtgctattttacatacatgttattattatttggattcaaatttatgtgttattttccaatttaagtttattttcacaatctttatgtttaaaaaatacctatgggaatacatggagctgacccattttggtgattatgttgc

SEQ ID NO: 229 - DNA, 1101 bp, Homo sapiens
tagagatggagttttgccatgttgtccaggctggtcttgaacatctgacctcaagtgatccacccaccttggcctcccaacgtgcagatttggcatttgctgaccttagctcaagaggatattaatgcaggcaatgatgacgctggagactgcagtgagagaaggtgttacccctcatccgaactgccattgccaggtgtttattacaaaaaaaagaatcacctgagaaatatgtgaatataccctccttacattaagttgaaacatttccctttcatcacagctctccccaatccccaaccccttcaaccctccccaaaacaaccatttttttttaaaacagtgtggattataaattcccaaatctttttctgttcacttgaacatgtaaaaattacctggagaaaatgagtgctattttacatacatgttattatatttggattcaaatttatgtattattttccaatttaattttatttcacacaatcttatgttctagaaaaatagctatggtaatacatggaggctgacctcatttttgttgattaatgtttgcatacacaccttttttcatcctttactttcaacttatctacgctgttgattttgaaatcagttccttatcaacagcataaagttggtcattttgtttatccattttgccaatctctgcattttaatcagtttatttagataatttacatttaaagcaattgcaggaggacaggtccctggatggcaatggctgacccagctcttccacttttgcttgcaatcctcaggtagtctatattaagaatgaggtatcttgagataaggagatcatgtctggaacaacccagactgtgtcctaactcctagaacaaggtgtcctgcaaggcttgagctcaagataccaagtgtcacccaaggaatgtaaacccagggcacagcaggtttgggtccctcagctgcagtgcaatgtggagcaaatgcagtcaagactccatctgccctgggcagctttcctgggccgtggaggacctgcttgtcatggatcctaggctccagttgacccttgctgcctatctgtgagtaataaatccagatgcgggccag

SEQ ID NO: 230 - DNA, 410 bp, Homo sapiens
aacccaaaagacaaagtactcaagcgtctgagaatgttcacgaatcaccagatgcaataccagaaacatgtaataaagatttgaatccttgctctaaaatggatataaagctgaaataatataaggtggactccaatggcagcatcaagatgttctcccagttgtactcggaaagatatgcttctgaggggaaagctatttttttcctaaatgcatattaggtaaaaagtgtgtgtcagagataaaagtatgctgattaagaccctagtcttggggcaattagacttgcatcacagtctcccaactctatttgctaattgtttaataaattctctataccgtaatttattatcttgatggattaacaacagtaacaccatcttagaatttttaagaagaataaatggaga

SEQ ID NO: 231 - DNA, 264 bp, Homo sapiens
gtatcttaaagacagcatcaaaggttatatttctcattgtaaaagcatgaagtatgcgagagaaaacagcatgctaccattttatagactacttcaggattacaaacaatgggttgattgtatatgtggatgcagaacctgtggctaagagaagttcaactgtgtctataatatgctatcttccgtgtaagtgtaggggcaaaggaaattttccgctccctctctgaaggttccagtttgataaaataaagctcgatcggccag

SEQ ID NO: 232 - DNA, 603 bp, Homo sapiens
ctagatggagggaaaaacaccaggatggggcatggtctctgtcctaaagggattgaaggctcacctttggataccactgaagatgcgacaagcataggactgcaccaaaagatgacacatgtgcccactgcaccccactccactcaaacctacaggatcaagaggaagggtccttgggaaggggccaagataggggctctggccaggcctggactctctgcatgacccggggtttcaaggaccacccctttctgagagccctagggacctgccagcacctctgtctatggggacacctcagtgtttgagcctggctagcattacctgcagagtgtgggtgatgctggttcaccctgaagtttgagaactactgcactggagctgcgctacccattactatagccaccagccccacgcggcatgaacccttgcagtgtggctagtccgaacttgagatgtgctgtaagtgtaaaacacacatcagatttccaagacttagaaaaaaagaatataaaataattcatcagtaatcttttatgttgatttcatgtgggaatgctcatcttttagatatattaggttaaataaaatgcgatcggcacg

SEQ ID NO: 233 - DNA, 503 bp, Homo sapiens
ctgtaccagcatggctccatcatctgcttctggcacaggcttcaggaagcttataatcatggcagaaggcaaagaagaacaggcgtgtcacatggcaagagtgggttccagacatgggaggaaataccacatgattttaaacaaccagatttcatgtgaactcagagcaagaactcactcatcaccaaggggatggcactaagcccttcatgagggatccacccccatgatccaatcacctctcaccaggccacacctccaacaccgggaatcaaatttcaacatgagatttggaggaaataacatccaaaacatatcaacttgtgtccttataagaagaagaggcaacaaaggacatgaactcatcattttttatggctgcatagtatttcatggtgtatatgtgccacattttcttaatccagtctatcattgttggacatttgggttggttccaagtatttgctattgtgagtagtgccacaataaaccacgatcggcag

SEQ ID NO: 234 - DNA, 1224 bp, Homo sapiens
  misc_feature (1)...(1224): n = A,T,C or G
gcataaaagagctaccacaaacaaagtcttattgaagttccttggagaaaccaacatttacctatgaagaaaatgaagaagcataaattaaaaagcagtaattcagagttctatatacctgtcaccatgaactttctggtgtttccggtcattttccataaactgcaggccaatatccttagcaaactaacgcagggacagagcaccaaataccacatgttctcacttataagtgggagctaaatgatgagaacacatggacccatagaggggaacaacacaccctgatggagggtgggagaagggagaggatcaagaaaaataactaaaggatactcggcttatcatctggctgatgaaataatctgtacaacaaatacttgtgatttaagtttacctacgtaacaaacctgcacatgtaccctgaccttaaaaattaaaaaacagacacaattagtttatattttcttttaatttttacataaaagaaacttcaggtgcttcctttggcaaagaggaatttttgatttcatttactagcagaatgaaaaacttctttctggttttaatccaaatgaagaagggatctttgaaatttccttcaggcttttcttttttgctgaggcactgacagggttctttgaactgataaaacagactttaacccaacaaagatcaaaagagacaaagaaggccattacataatgggaaagggatcaattcaacaagaagagctaactattctaaatatatttgaacccaatacaggagcacccatattcataaagcaaggccttagagacctacaaagagacatagactcccacacaataataatgggagcctttaacaccccactgtcaacattagacagatcaacgagacagaaagttaacaaggatacccgggaattgaactcagctctacaccaagtggacctgataaacatntacagaactctccaccccaaatcaacagaatcccccctctcttcagcaccacaccacacntattccaaaactgaccacatagttggaagtaaagcactcctcagcaaatgtaaaagaacagaaattataacaaactgtctctcagaccacagtgcaatcaaactagaaatcaggattaagaaactccctcaacctcactcaactacatggaaactgaacaacctgctcctgaatgacgactgggtacattacaaaataaaggcagatcgccaag

SEQ ID NO: 235 - DNA, 1087 bp, Homo sapiens
ctatgcgcacagaggccttcctgctcttggaggtacccaggtggctccacgccacacactggcaccaatagtcctcgggcccatggaagtcctccacctgttgcctagtaacattgatgaacacttcgcggaccttcaaacctgatggtgggagagataagagacaaatcagctgaggctgttatatttctcaaacagaaagttaaggataataagcactccacgtattcctcagaagcaccgcgagttcagtcttaagtacagaaacaaagaatacacccaagctctccagtttcttccacacaagagattagaattaatcagctcagaggtgtctggtaaaggaaagcaaattaacttcatagtgttgtctgacaatagcaagaagagaaagtgaagaggcggaagtggacatggaaaggttgtttagaaaacgcatcccatgaatgacttactcccggatcacactcacaacatggggggcaacatggtcatgattcgcaatcctggtgcttgaatcaatgactgtccatgtcctgcaagtacctgaaatcatctgctggaaaatagcctatggcctgaggtcaagacatatatttgacccactggtatcacctacggggctccttttaaaggtgtttcaaacccaaacatcctccattttgagtgaaggcctaggaaaatgaggctggaacttgcaaggcactgtgttcccacaaagatatgcattcctagtctctaaatgttggtggttaggggaacaaattaataatgtttactaaacaaacccagacttgggagtctccagatatcctgatatctggagaacaaaggcattcctaattttgctttaaagataatatcaactcttgcaaaatatagtaattaagaaaattaatcctttatcacaaacccttgtagcagagcacatctccccacatatacaagcattgtacccacagtggatgtgttcctcctcttactttcaggaacatcctattctgtctatggagtagctgtactttcagcactttactttcttaataaacttgcttttactttgcaaaaaaaaaaaaaaaaaaaaaaa

SEQ ID NO: 236 - DNA, 1103 bp, Homo sapiens
actctctaattaccaccgctacaggatcacagtgattaccttacctggagacccactcgggagccctggagcctcaggaataagggggagaagactgaaggagactagcccgggcaacaccaaatccaactggaagccacggaggcaaaggcttcggtctcgtgggcaccggtcccacctagggatgaactcagctgtgagccagacctgggtcaccaatgccaaggcactgaggctctctatatggtgaccttcttatgaccttggccgtgtcctgggggaggatttctgttttgctcttgtgactactcttggggtccgctgaactggaacctaaaagccaggagctgagaaaagcctgggggcgaggctttaaaatcgcattgccaactctgcactgatggataaaaaagccaccttcaccgccggtgctccctggatacagatcagaacccctctgcatgctaagcaagctaagaaaagcaacaggacatctgaaaagccccgtgatgatggctctgggagaaactgggctaggaactcagagcaaataccatccgtatggtaactccctaattcctgggcgtgacataggcttattccgggaagcaggaagagagctttggagtgctctcaatctgttttcaatggatactgtatctgtgagtagagaatgacacgagagcagaaaaaaagggtcttctgttaaaaagtacaactagtgaattaaaagaagaaaagtcagcggaggcagagaaggttagatgagatgccctgaaattctcagaggaaaagtctgccgagattaatgaagaaagcaaaactgaagagataaacaagtgacaggcatgtagagataataagtgacaagaagaacaaatttaggagattcagtatatccattatcaaaatgtaaaccgcagcaaagctcagagcaggcgtagaaggggtttcccggaatagatgacaatttattctctcatactttagaaatctgatccataaatgcagttcttgaatcaccttgcatggtgaaagctccatatttgggaccttctctcctgttttcttaattagccctagctaaagagagactacattct

SEQ ID NO: 237 - DNA, 875 bp, Homo sapiens
ccccagcagctctgtgggtatagtggtgtgagtgtgtgtgtgtgtgacacactcagatcagcaggacgtattcgatcaccactgctagagcccaggactggactgctcacagagaggaaggaaggactgttctgtcccagactgaaaggctgtcagaccacctctgtggcactcctccccttaggactccagcccatttgctttatcctgctgtcatggttgctctggcccttaaatgggaggctggatcatgctgtgtgcagttctaaaagcagcatctcaaagagatatcaggacgatatcccaaatagaaatctccaaacaactggttgtttcactgcaaaacatcgtcctctgtaacaggtgttgccagcaagaagtgcaattccatctggagtgtgagtttctggattgctggctcaggactggaaagcccttgtctacccaccaaagccagattatttccactagaattgatgacacctttggtcttcactaaaggattggctcgccagaataatttcactatttcctacggcttggagtttctccaggaactgattcccaacccagattccatattttatgtattttatgcagctgctgaaatctgccaccattaatcatatctgtgacagagagatatggaaatggctaaaatcatgaagctgcaggttctcaatagatgcctactcctagcctgaacccccacagagggccttaaatgttaatcaggtgaaataccttaagttttttaccagctttgcctgagtgatttgaccactataagcaaggtagttcttttgttagatgaggccacctcaccacttactcaaagaaagccttttcttttgattattctctctaccagccta

SEQ ID NO: 238 - DNA, 1064 bp, Homo sapiens
tggccgatctgtctttatttataagtgacataatcacaattatgtatgccaaaaatcctatgaaatgtacaaaaaaatttatcagaactaaaaagtgagtttagcgtggtcatggtcgcagcatataagcttcacatataaaaacccattgtctctctctacaaaagtaatgattaatgaaaaaaataaaatacactgtttcccatagcatcaaaaatcaagaaatatttaggaataatttaaataaaatactgaacagataactgcaaacattgccaaaataaattaaagcaaacctatctaaataaatgagatatattgtatgcatttgattggaagatgtattattaagatgtcagttatctccaaactgatatttagattcagtataattccattcaatatccagcagggctttttgagaaatttggcaaactgattatcaaatgtatatggagaactcaaagaaccaaagtcaaaaatacttagaaacaaaagtatacatttagatcacttaccctagacgatatcaagatatactgtaaagattcagtaatcaaggtagggttatattggcacagtgatacacataagatcaatggaacaaaacagaggccagaaatataccttcatacatagggtcaagtgatatttgacaaagtgtcatggtaattcaatggggacatgataatacctttcatcaaatggtagaacaaccaggtatctatatggcaaaaaatgaacactgacaataacctctgaccatacacaaaaatgaactccacaaggatctcaaaatagtattttatatttgcaaatactggcttttatcctattaaaggcagatcatccgttgtttcgttgttccggtgaagatcattctgcttcttagtgaacagttaatttcaatgttgtggaggctgagaagtcctgtgatgtgctgttggcaaactgggaaatcaggaaagttggtggtataattcagttcaagcctgaaagcctcgttttattcccccaaattccagttctgaaagcctgtcagctagagaatgatcttcccagaa

SEQ ID NO: 239 - DNA, 799 bp, Homo sapiens
  misc_feature (1)...(799): n = A,T,C or G
ccagtttgttcaagaacctgtccatttgctcatatgaccaagggagcaagcccgcccggaaaagaagaaagggggagaaaatggccaactattagatatacttgtcataagtgctggttactttccggaaagataaagtttgggatcaagaagctcaagtttgagacccagatccatctactaactctgctattaactctgtaccattagattggaagttactagggaacattacacggttctcagaatcaccaggagaactggagaaacaggctactgaagaccaaggaaggatcaacttgaagaataaccataatttcaccaagaacaatgtttaaaaaaaggcatttcagactgtgataataggggaagtaaaagtgtaaatttccagtggatgaagatggctgtgtctcctaatcaataaccagcaaaattaaacaacaaaaaaagagcagatatgtagatattcttcaggccaggatgagggtaaatggcttgcccactgcatatggaagtgttgttctacagagactgctcttcatctactgaaaaccggtcctgtgctgttctttggatcactaagnggttgataatttttggacttctctgttcattcttgatgactccaccaccttttgtgatactctacagaaattataatatgggtaagagaaggggaagattacattttggagtcattaaaacattaaattttctacttgttacccggggcccaccttttccttttattcctaccacacacaaccttttaaggagcccaaattggaaatctcattcc

SEQ ID NO: 240 - DNA, 1409 bp, Homo sapiens
atcggccgatcgtgttttattgggaagagttggtacgttatataattcacagacacagcataagacatttgcttaggattgggtaaggaagaagaagatgtgcatatcaatgtcatttgttgacagatattgagcatctatctcacaggaaacacacttgtggcccagtggagaaatataaatttcacccggtctccatccttagagttgcagattggaaaataaatcattttcagagacccatggctggttgtcggggctttctccatagcaccctggatttcaaacgtcaggtagacttaagaatactgaagtaatgccaactgttaaagcaccattgagaccatcttaacctaatggttagtagcactagctttgggacagtatagcccaccatatgcactacttaggttacaatagagttgctataactatatatgaaagcaaggaacatatattgacagcctattatgtgcacttttgcttgtgctgcttcatatgatcaggtggccaactctgcaaggaagcattcccttcatcattttccagttgcagaaaccatctaacagacaagtaacattcctaaagccataagtagccaagccaggagttctaccctgggtctatctgactccatattcagtgtcccttcttgttaacaagtgctattgaatgatttgagaagaaaaggaaaccaagttaaaaactttgatttcatattaatctggccttgataggaatgagatttacaatttgtgctcctgaagaggttgtgtgtggtaggtatgagagggaatggtgggcctcggtaagaagtaggaaattcatgtttaatgactgcaaatgttatcttctccttctctaaccatattataatttctgtagagtatcacaaaggtggtggagtcaccaagaatgaacagagaagtacaaaattatcaacacttagtgatccaaagaacagcacaggaccggtttacagtagatgaagagcagtctctgtagaacaacacttccatatgcagtgggcaagccatttaccctcatcctggcctgaagaatatctacatatctgctcttcttttgttgtttaatcttgctggttattgattaggagacacagccatcttcatccactggaaatttacacttttacttcccctattatcacagtctgaaatgcctttttttaaacattgttcttggtgaaattatggttattcttcaagttgatccttccttggtcttcagtctaatggtacagagttaatagcagagttagtagatggatctgggtctcaaacttgagcttcttgatcccaaactttatctttccggaaagtaaccagcacttatgacaagtatatcttggtcatatgagcaaatggacaggttcttgaacaaactgg

SEQ ID NO: 241 - DNA, 1301 bp, Homo sapiens
  misc_feature (1)...(1301): n = A,T,C or G
ccattctagtaggcatgaagtggtgtttgcctgctttttttgatggaggtggaggaatagggtggaattggtccttaaccatcaattaagctgggggccttagacctctgtgaattggctgtgacaatagctaaaggaggctgctacctcatactgaagagatgtttcctaagtttgtcaccggagagggcaccgaaccaacttattgtcttggagggaagaagcagcaaggcagaagacttgaacttctcagagaaaaaaacagtctacagacttcattttatgctgtcctcacacactactgaaagctctaccctggggacctggcttgacttctaactagctgtgttatctcaggagagctcccagctgctctgagtctcagtctctcaatcagtgaaatggaggcaatagcacctgcctggctgcatcgccccacagtgctgcaatgagcatccaacgagagaaagcttgtcacctgggttggaaactaagttacacaaatgcacgcagtagcagctagaagataatgggttgggaatctgaaaagaattaaagccccccatgaatttcttctcacgcctccttccaaaggccagggactgcttcaccccgcctccaggactggtggtccaacattttccggaagctggtgacagaatgtatggtgctttctgatccccccggggccacgccaagccccgatgggagcaggggcctccctcaaaggaaaggacccagggcgcaccccttcaaagggaggccttggaggggagggcttttcaatgtgcccactggaaactgaagttaaaggcctggatctaaactataggagaaataggagcatttgaatccacacatttgaatgtggtaattagtgatcccactccnccgacccatccncaatcttctgcccatctgagagcgtttagatgatctgatgatgttaatntgaacttcaaaacgcttgagaaaaatgtccactttgctttttaaaaatggaaagaaaacaaaagtaagttactccagagacctggatgcatgtggccgttctagtgacaacacaataaggaaaataaaatccatcctaggagaggaaattatcccaccaaagttcttcttggcccttccaaaggccatttacctctgggcatctatgcagagttcactcatcacccaggaattacgtgaggagggttatgcttgctacaagggaagccacgaagagtaagacaggatcagatggaaaaataagacatttagatataatgctccaattaataaagaccgtatccggccag

SEQ ID NO: 242 - DNA, 584 bp, Homo sapiens
  misc_feature (1)...(584): n = A,T,C or G
gttgcattggactgaagcctcttcagaacactgaggatataccaattcattttagaagcctccaagggttcctggtcatttcatcttggactggacaggcaggattcaccatctgtcagctgccaggagaaccaatccttttcctacgtatctctccctctattaaagacttagtgtgaatgtcaattactcaagcctgaattaaaagagttgacacaggacaggaaaactccagtcattctcaagggaaaagaggtcctgaaaagaggaaacaaggggagacctcacggaatcaaaacaggtgttcacaggcattgaatagggaaaatgacttaagntgccccccctgagacgcatggtcagaatgattcagcacaagggatatataacaccctgaggattgaaacaaaggtagtgtctagaatgttgctgaatatgacaaagaacttttagattagaactccaggaatgaagaagatgaagaaaaacagccctccccatcccagnntaaggccactcctagctcaatcatgtgtagtcagtgactatacataccatcagtaaaataaatctagatgtggcag

SEQ ID NO: 243 - DNA, 894 bp, Homo sapiens
aatttggacagatggagcaatctttctctgctctgtgatgtgactcaacaacatggaactcaaatagtctggagacatcttcaatctcatatctgaaacttgatgtgtgctggcagttggaacctcagctaaattgccatccctagcaaccacacctagccatttcatgtggcctttctgcatggactattttaattttcctctcagaatggttgctggattcaaagaaaaatcatcctaaggaaaatgaagtggaacttcatgactttttcatgacacaatctcagaattcaaatgcatcatttttgccatatagtattggccaaagcgctcagaaaagcccacaaggtcaagaaagggccaaagggatcctcttgatagggacgttgcaaggttctagaagagctgtggaacaaataatggatattgtttcaacatctttggaacatataatatgtcccagataattagaagaatgtacatcatacaattgtattcaaattattgtaaaaaattaaattcaccagattcatatttcaatttctagtaaaatttaatttatttgtgcttggaaatcattattactccatgagtaagggagactcagaatagagttaagagctcactctgataaagcaaatgtgactaaaaattttggaagtgccatatatatagatgaatatatattcatctattaattgatgaacattaaaataaatgtagaatggatattaacccagaacaaagaggataataaactccttctccttcccttgttttgtcttttctgggttttgaagagattaaagcaattagaagttctgttgtaggaggtgactacataaagtttgttctagataattataaggtagcaaataaattacgatcggccag

SEQ ID NO: 244 - DNA, 795 bp, Homo sapiens
agagaagaatcttgaacactaaaattgaaatggtttttaaaaatattaaatggaaagagaaacatttgcaaaatcaggtatttctacctttggactgacagaagataaatgtggaatgaatatgtgagcaatggacccctcaaaataacaatgaagtgatgttgcctgaattgtactttatgtcatctctgtggatttaataattgatatttcccccaattatcatagaagctagattagattccttgagcagaagtataacttgctgatgtgtttgcatatatgtgtgcacacatgtgcatgtgttttggggataaacccacacccctggctacattttaaattcacttgagaagccttcaataaatatcaatgccatgtccactactccaaagattaaagagagacaagaactgcagcattcagtatagaggaattatcagttctaactacttaacacccacatgagatgttaaacaggatgagctttgaggccattctgatcttaactgaaatgttcttagaagaaacactgaataaacgacagaatctccaaagaagatgttttatgcaggcagcatgcaaagagagcagatcttctcctaggacagtctgccccgctaaactccagaaaattagaaaagaggtccttaaatgcttgttctcagggtacaagttgttcaactctggactgtcacaggtcagaaaccctatcgtttttatccttgcatcatcagcagctaccacggtgcaaagaacacttgcttaataaaaaatgaaaaatatatgcataaa

SEQ ID NO: 245 - DNA, 146 bp, Homo sapiens
accttcaacaaatttcctgatgttctgagcaagagtccggacgctgctgggaagattccaaggatcttgcttgatatgaagccgtagcctttttggacaactcagctttggttccatttcctgttgaaattctaaataaacacaga

SEQ ID NO: 246 - DNA, 355 bp, Homo sapiens
ctaatacaatactaaattaaaaagaaaaattgaaggcttttctcataagatctagaacaagaaaaggatgattatttttatcacttttatgcaacatagtactagaagtcccatctggagcaattagataagagaaataaataaaagctatccaatttgaaaaggaaaaaaggcaaattgcccttgtttgcagatgacattatctaatattcagaaaaacttaagactccaccaaagaactgttgtaactcaaaagcaaatttagtaaagttgcaggatagaaaatcaacatacagaaatcagtagcagtagcatttctatataccaacagcaaacaatctgaaaaaaaaaaaaa

SEQ ID NO: 247 - DNA, 828 bp, Homo sapiens
cttcgtgaaagtttcttgtagttttctttgatctgtatgacagttcattgtcccgaagagctatgtcatccttggatttgatggcttcactgtgtactcctttttatttgaaagaaaaaagaagccaactgaaaagagatctgagcgctgatccccgtgagaaaggacaaagtcacatccaaagaagccgttatgctgcctttgttcctggactctacagagatccatatccagtgtgaaacatctctctgatcacgtattagaagtcagcaaatatcattgaatgcatgaaatgaatcaatcccatggaaatttagttttaaacgtagctttattgtgaaagatttcaagcattgggaagtaaattgctgggagcaagccccccaaaatctggctataaaccagccccaaaactgcccataaacaaaatctctgcagcactgtgacatgttcataatggcactaacgcccaagctggaaggttgtgggtttacgggaatgagggcaaggaacacctggcccgcccagggcggaaaaccgcttaaaggcattcttaagccacaaacaatagcatgagcgatctgtgtcttaagggcatgttcctgctgcagttaattagcccaacctagtcctttaatttggcccatcccttcatttcccataagggatacttttagttaattaatatctatagaaacaatgctagtgactggtttgctgttataaatatgtgggtaaatctctgttcaaggctctcagctctgaaggctgtgagaacccctgattcccacttacaccctaaaaaagaaagatgggagcaggggcggg

SEQ ID NO: 248 - DNA, 914 bp, Homo sapiens
  misc_feature (1)...(914): n = A,T,C or G
aacttgcactgatcagacacttaagagacagcaggtggggccctaagagtgtgagctggaggtgcaagaagagacggaaaaaatgggccattataaaccagaagctggaactaggggctcatcaggagagcacagagatgagcaaagctcttgagtaatttatcagaccaagctggagatgccagaaaaggaagaggactgttccaactacagggagtttaatgctcagctctaagtctcttggttgtctttgtaatggtaaccacctcctctgcagggcagcctccaaggagttctgtgaganggctgttcttccagaaagtancaggcctgggccgtatgtccctgcttgctttcagggacatgtgaaaagaacaagccccaacagaaaagtaaataataagaacacncttagaaaccaaaggtgatgagaagagctaaaatccccaggacttacagagatcttgagaacaaagggcttttcgtggttgatgagatgggcatttggacaggacttctctgggtcttaagggcatggtgatcccagctggtatctatccggcttacgtttatttgatatatatatcccctccactattctgcaagctcccggggtagagggccaggtctgacttgttcagcgtgtttgttcccatgcctgctacaatcccaggcataaaaatacgtgatgaaaagaaagttgaataaatgaacaaatgaatgaattatttatgtataaatctatcttcttcacttgattgggagtttcagaaaggcgaaagccacatcccatgtctctcagccatctttctaactaggggaagtgtcagtgtttggggatgtatcagtctgttctcacactgctgtaatgacactgggactgggtaatttaaaaataaatcgagatcggccag

SEQ ID NO: 249 - DNA, 727 bp, Homo sapiens
aattcctggacagactcaccgacaggacactgaaggcagggcaaggcgacccatggacctcattctacggggtggcacagtaaccggttctcacccattcctcctagctacctggcacggtagatggcatcctccctcctttttggtgaggagttcatctttgaggtttaagcagtggtctaaagggcagggcccggcagaggatggtggccttgcagtcagtgtgtcctgtttgggatatgaactccagcccccactatccagtggtgaatacaaggactccacaaccaccaaaagatgatgctgactgagcaatgcaacaacaacaacaacaacaacaaacagctgctaaaaataaggctgcgttcaagactcaaacgtcaccttttgtgtgtgagtggggaaagggacattgcttctgaacatttggttagtaatgttaaacatctcatatggttttggttgtgtccccacccaaatctcactttgagtttcactcccataattcccatgtgttgtgggagggacccggtggcagataattgaatcctgggggtggtttccttcatactgttctcttggtagtgaataagtctcatgagatctgatggtttgataaggggaaaccccttttgcttggttctcattctctctcttgctgctgcctttcaccttccacctccccagccacatggaacagtaagtccaataaaccacgatgcggcag

SEQ ID NO: 250 - DNA, 972 bp, Homo sapiens
cctggccgcatcggcatttattattttccttggttttccacatacgatcaaaggtattacgtacagagttgctaaattccttgcttctcatgagcagtgaaccaggattttcaaatgcatttattttgcataactctctaaatggtttatgccaaggactattagtgttctctatactattagaagtagagtccttagcatttttgggtctaaccatattaagcagccatctccagaaaccccaaaaccaatgaaagaactccagccttaatattctgctcttctagaaccactcctggtaccaaaatctgtattagtcagggctctgtagagggactgaatagaatatatatatatgatatatattatacgtatgagtttattaagtagtattaactcacacgatcaccacatcccacaatagactgtctgcaagctgaagaacaaggaaagccagtgtgagtcccaaaactgaagaacttggagtccaatgttcaaaggcaggaatcatccagcacaggagaaagatgtatgctgggaggctaggccaatctagttttttcatgtttttctgcctgctttatattctagccatgctggcagctaattagatggtgcccacccagattaagagtgggtctgcctttcccagcccactgactcaaatgttaatctcctttggcaataccctcacagacacatccaggatcaatactttgcatccttctatccaatcaagttgacactcagtattaatcatcacagttttctttttaggctgtcagggtcaaattgattccaatggtggaggatgcagcctagctgggagtcaggtggaatacatggacagttgcccatggaggaatcaggcggaatagatggagagttgtccatagaggaatcaggtggaatagatggagagttgtccatagaggaatcaggagggatagatggagagttgcccgtagtggt

SEQ ID NO: 251 - DNA, 905 bp, Homo sapiens
ccacagtttctaccatgacatggtgagagggactggctaacaagagctgaataaattgtgataaccaagaagaacaccttggaagctgtttacaggatggatcctttttctgacacacacagtaagacttttacaccagaacaactccatcttgaaaaggagctgggtgaaatgaggctgagacctactgtgctgcattcccagacggatcaccaaggattcagaccgataccaatgatgcaataaagacatcatttttcctccaggaaaaaaagagaaatatgggtttagtcaccaaggaagaaggcagtaaatagctttgaacactcacatttacactctaatatatctgtgtaaaggatatgaaggatataaataatttagaaattgtgggggaagtaggtatctctaatattgaataaaaagaaaataaatgaccagatcaaatacctatgttgacttctattaacacactgtaaagatttcctcacatgttttaactatagggctgagatagttaagaacaaacctttaactttgagagaggtattgccaaattgtaatttcggaagaattaaaatccttacctgctgccataaacaaaagtcagataaagctaggtaaggaaaattgtgaagaaacttaactgctggaatttgaacaactggagttttctcatgccctatccaatactgagccttccttgttcactgaagtcccttcacttttgtatattgagactcttccttccctgcttaaaaatgttgctattttcttgccccagggaattttgttgcaaaaacaatactgtttcacttatacttctttcactgttttcacaattataaatagtctggtccaagtatatcctaaagagcacaaagaaaataaacctcgatcggccg

SEQ ID NO: 252 - DNA, 601 bp, Homo sapiens
cttgaagccacagtgcatggccagaaccagccagacctttggagttcaagaactcgagagacacagcgctggacaccatggctaccaagacgcacgggtatggctggccctcaaggaactcctacatcagaagggagacaaatggaaatgaagaattgtgtaatgagcaaaagacagataagggaatgattaactctgtctggagacctggggtggagggaggggtaagagttaatgaaaaacctctttgcccaaggcaaaattaaaaattaatactacctactatgcacatggacattaatttggtggaatgttataaagttatgaatgtgataattatagactaaaatattatgtgaatagtaacatataaactgggcttatgccctatgacttgaacctgcaaaactggaacgaatgccttaaggcaaacaattttactattgcaaaacaagggttgtttaagggaggcaattcatgggtgaagttttaaatggaaaaaaaccactcattttaaacaccatggttgatggtcttatagtgtcttaaacattattttcttatgggataaaattgatccactaggaaattgggacaaacg

SEQ ID NO: 253 - DNA, 217 bp, Homo sapiens
acaggaaaggcattcttctacttttgcaaaggaggcagaaccaaaatctgtgaagaacctttggctatacagacactccacagggaccaaatctcctgccccatcacacattcctgggaattaaaaagaatggagaacgtttacaagctgctgtactttataattgttatttctttgaaatgattctttttctttgtgagaggaaaataaaccgcga

SEQ ID NO: 254 - DNA, 792 bp, Homo sapiens
ctgaaccaccatcctcacctccaccattttgtcaagttccccaaatgactggagttatgatgaagtccaacacctgtatggcccacaccccccacatgtgaagcacattcatactgggtcacctttccactcctggacttcagtggaatgccacatcacagggagtgggcagaatacctgctcagcttctacagtgaaggaggggctcaaggtcaccaatgcaaaacccacctgaggtggatgcctcctgtaggacgcactgaagcaccaaagttctgccaggaattcattgatgaaagcagatgacatctgagataatacctggtcagactcaccttaagcccatggaggatttatctttgtttctaccaactgtacaataagattttaaaatagcacattcttaattgtctgtatttatgtatattctcctgaaaaactgttatgtaagcagattttctttaaacatgcatccaaaggaaattcccaagtcaattagttcatactaagagaatacaaacttatttaacatcaacctaagtaaaatccactggagaagataagtgtgtagcttagaattacagattgtattctctagtcaaagatacataaattaggccttaaaaagttactttggatcatgtttacttttattactgtctatctggatagataattggatgttagtgctcatccctcatattctagaatgagtttgttaggacaagatgaagttagagtgttagtgagctcttatttgtttactttgaaaatattgtcctgactatgtac

SEQ ID NO: 255 - DNA, 628 bp, Homo sapiens
aggaagatgaaaggtaacgacacagcacttgagtatttttttcccctaaagctttgctaattgtggatcaaccctggctacaaatcagtaatctcctttcatggtgatattgtcattgcagcagtttctatgctcacaccaacattcttcagaatccagggcagagtagagcacaagtgtctggggattcctcgcgaaagtcctggggttcactgtgtttgactgacctgggtcacatgcttaacagctacacctcttagaggagccacgtctcccgatgcatctagattccaaatggaaattagcaggtttgaaaaggaaaaagagatgtccccagagtgtccagagcggaaggtgagggaatatcaggcagagggaattattttagaaaagtatcagggcaagattagaattttggttttgtttatttttctctttggtgcctataataataattgacagatagtgctcaatatatttttattaagcaaatgaatgaatgaaagaaaatgaatgaatgaaaccgtatttcagtttggctgcagccccccgacgcccataaaggaaaatgtaaagtagtcagtgtattgaaagcaggcacacagaaaccaactttaataaatgctga

SEQ ID NO: 256 - DNA, 826 bp, Homo sapiens
  misc_feature (1)...(826): n = A,T,C or G
agaagtgctccgtgtgaatctcgagctgggtggggaggagaaaaaagaaaaccaaagccaatctggtctccttgcatctcgaaaaaggtcacacgatccgtcgctttgccgccgctctccggagtcccgggccacgacctcgcattcagaagtcacgttcagcatctaaaggtagcggtcctcgagtccactccccgctggagtgaagagaacaacggggaggacgccttcccagagcagctgccgccggtccctgtccccggctcgcttcaagctctgcagctgctggggcatttctgatgagggccctgggaggtacactctgaaacattccgccccttgctagtatttactcactgtcttccaacctttttgctgtggaatgcgtgctccatgctccctgtccccatcttgggaggaggcaggaaccgagatgaaggaggagcgcanaagcaaacactttatgtgcccaactggaactgttcgctttggtcaaccaacactgattgctcattcctctgtgttccctcttaaacagcttctgaaaattgctcgagaggggcggagtcaggaagccaagagcgtgggaggcaaatctcagccccctcgctgtctgtgaggctagaagcctcggttttccttatctggaaaagggggttgctgataataataattacttcacaccattactgcgatgattaaatgcagtattatatatctatcttagatactggttggtactgaggagtgttagccttggtcattagtatgcattctgtcaacaaactggtattgagcacaagctctgtgctccctgagagataag

SEQ ID NO: 257 - DNA, 714 bp, Homo sapiens
tattcttccttggatgaaaggactaggagaaagccctgcaaccccacgagtccgcccgtttgttgaaatcagttcaagatcatccaggtctgcaaaactcggctgaagcagcttgttgcataatttaccagagaaaagagggccatctggagagccaatctggagaactcgagcaaaggcagagtctttttttttcccctcttaagttatcctgattgactccctgcctatattgggcctccgcagtgcttggcccgcatcctgaaagatggcagtccaggtcaaaggccttggcctcctggctttgaaccctggcaaagcactgcctggcccacaactgctagtagccccacctaccatagctgtgcaaggctctcagtcacctcccacctgtcttaccccatgacaccgtgggggcctgtgtcattcccaaggacagctggtttacgcatatgcggaggaggcagctacccacaaagggatgtgggaaagctctaccaaatttaaaaaaaataaaaataataaataaaaagaaagaaagaaatctgccttaacctctagtcaaggagaaagtcatttcttccacaaagattaaatcctttgtgttaaagcagtctatttctttccaattcagagcctgtgagtgattctatagggtagtgaacaccataaactattaccagagaaaaaaaaaaatcggccctcgtggcctca

SEQ ID NO: 258 - DNA, 1150 bp, Homo sapiens
aacatcaggctgaagagtttggtgtcttgatttatgaacaaattatatatatgtaatttacatattataatatattatgtgatatattaacatataatatatacacacatatatatcatgtgtatatatatacaatgtatacatcctctattttaatataatatacatgaatataacacttgcattctctatattatctcaaaatgtcctctattttgatgacagaacaactgacatctactcaaaatatgactttaaaatactgctactttaagagaggccccctgaaagctaacttgtgttttgaaactgtaaccaccatcagcaaaagctattatagctaatagctctttcattcaatttttcagggttcatggattctgcagtaataatttttctgattgctgtgttacctattattggtttatttactgcctaatttgaaattctcttgcagaatattttggtttcttcccctactaagctgtctcagtgtggtttactgtacagacaacatccactgtggtttctgctgtcatcccttctccacatatgtctcacccagggaaccatctccgttttaacgcttttagattggctgcattatagaactttaaaattcactcctactaggtaatggtaactaatggcaaaagtgattttgaagaattagtaaagaccctgaatcaattcatttagcaggttcgcatgctaaagattggcatgaatactgctttgtttttgagagtgatgcttgatagaatggtgtttcattctatccaccagcctgctgaaagaagacatggatgtaattttatgtgtcatggtcaatcagcacactgttagatacagtgctgccaaggaaaatcaaaggaaaaaattcagtgatgatttttagccatgttgccaatgaaaatcttacattgaccgagtctaactttctttgttgagtttttgaacatggctgtggaatatggtcttaataaaaaatgacctattacacaattctctgttttagtccattggtaatgagaaatgaattggctgtgatgatgtcaatggtgacacccctgttttgctctaaagcgctgcttagtaaacagaaaacatagccttggaaacagatataaaataaaaactgatcggccag

SEQ ID NO: 259 - DNA, 1005 bp, Homo sapiens
  misc_feature (1)...(1005): n = A,T,C or G
tgctaccttaagaagcaccccgctgcttcggttcttacataccgtaagttggtgtgtctatagttgtattttttgtattatctgtgtctggattttggtaccagggtaatgctggctttatagaatgagttgaaaagtacttgtcctgtcctttttcaatttttatggaagagtttgtgtagaatttatattatttatttattgaatgtttagtagaatcaaccagtaaaattatctgcgcctgggaaggtttttgactacaaattcaatttctttaatagatatgggactatttgggttattcatttcttcttgaaaaagctttgacagtttgtgtctttcaaggaatttctccattttatctaaattgttgaacatattgccataaagttgtttataaatgtctttattagccttttaatatttgtaaaattctggagtaatatttctctcatgcctgatattggaaatttgtgtgttcttttttccttatcattctaactagaggcttatcaactttattgctttcttcaaaggaatcagcttttgatttcacaaacgttctctatttccttttctatttcatagatttccactctaatattcgttatttcttttanaaagcttattttgagattaatttggtcttctttttcaatgtttttangggcaacttgttgatttgtgtatttctccttgcatttcnaatccattctttcttcaggtattttgaagttctgctatcaggacaggaacatttaggattcttatgtccttttgaggaattcactcccttaatcattgttaaatgtcctttatttatttctagaatattgtttgctttgaactctacttggccttatattaatatagcattcagcttttcttctgttttagtataatatatcttttcctatacttttactttaatccaaatgacagataataacaaatgctcatgagaatgtggagaaatttaaactctcatacactgatggtgggaat

SEQ ID NO: 260 - DNA, 567 bp, Homo sapiens
tatgtggcacaggacctggaaggcaaaagacagagatgcagccactgttgaaaaaagaaaatatttcagctaaattactgaatatttgataattgggaaactccagtatttctttgcatcatgatgtaatgctgaacttgtagagagagacacagaggaaagagtgctgaatggcatcagagctggagataccaaccccctcaaagagccattcatctgatagtcaaagccacactctcccaagtgaagtacaatgggtataatgtttggccatagcaccgaacattagctatggccacagttaaatggtaggagaactggggcaagggcagcagggtgaggcaacacagtggaaactcaaaggagagagaggtcaaggtggtggaagatttcaacagtatctaataacaaagaaagatgaggaaggatgagagatgaaaacagaaaacaaggtcattagagattaataattttgttttccgttttttacgtgtgacctaagtcttctctgtgctcttcatctgcgatttgaaattacaaacatttaaataaatagtgatgcgccca

SEQ ID NO: 261 - DNA, 1003 bp, Homo sapiens
  misc_feature (1)...(1003): n = A,T,C or G
caggacttcatttcaaatgactccttgtggacaaagagaagaaattgaccttgagaagtttcacttgctgtgataggaagacgatctaggcgtgctttgggtgtggctagatttccttttacggctgcagccccgtttctcatcacctgcccctcacattcttttctctggcctgttccacagtgggcaggtctatgcaaacctactcacaaagtccgaggaagccaacaggctgaagaaagaggctgatgtatccagtttctcagaaagaaacatttaatagggacttacgaacaggagccccgtcagcatctcaggtggcggtgagacaggatgggaccctggatgatgacactgctgccaagtcaagtgttgaggtcccacgaaaaggaaactgagcaatggagcatcttccatcatcgatgaagcactccagtcactattcatcacaactcgttggctatatggagcccctcggtcctacctataaaagaagggctaaccaatttaattctccctgtcttcaaaatgagaagacaatagttaggcatgagctagctaccattaataactgttccattgggtactatatactcgcagatatggatacaaaggatggttccgggtggtgcaggaatccagctgtccttccttcaggactctgtttctccatcatcactgaaggtttacaaatgaatagcttcacgtacagtaagtcctcacttaaggtcaccaatagattcttggaaaccgtgactttaagcaaaataacatacaataaatctaaccttaaataaaatcagttaatctgatataaacgagtgaaattcctaggacacatttctgttcacaaaaacatcaccaaacttctaaataaagacccaaaacactgcaagtattaaacgttgaaataaatgtgagctatacatttaagaaaaattaataaagaccgatgcggccaggtgtgntttactctataattcaaataaaaagaaatatgatt

SEQ ID NO: 262 - DNA, 440 bp, Homo sapiens
aagcagccctattttggcaaagaagaatgaaacatctcagaggcagagatccaaatacacttgacccttgaacaatgcaagaggtatatcactgaacagccctgaacatggtgagtctaaagaacaaaagagtaaaaggaaacaagccctgggcttcttcccaatatgccaggaaagaaacagcagcaggactttaagaacactggaaattggtaggacaatgacctgtttataaaactcagtttattcttaaagaaacacttgattctatttctcttgatatctcaaactttgctaacttctaaagatggccattcaaaaagagcacgtctagtcatcattcgctttgtgtggaaaaacattttttactctacttcaaataaagaacgatgcggccggcttttcttctttttataagaacactgaaataaacaaccacc

SEQ ID NO: 263 - DNA, 1153 bp, Homo sapiens
  misc_feature (1)...(1153): n = A,T,C or G
aatagctgccagtggctctcttaaacttctttctttttctagggagatttgacacaagaagaattggagcaaaaagcacatgggtgtgttggacaacaggatgaatttgggatgatgctttgataacaaaaaatgaaggaaagaaaatcctgtgagaccaccagtggtttgggaatacaagcagctttgtttcccttgatcttttaatctttcagcaaaagacctttacaaatgacatacatccttcaaaggtggacttgactgtcaaggattgccctgataactgggaagaactccaaagggcatagatagaaaagggaagaaagcacttcttaacaaggatgaccaaattctctaaatgatattcattcaccaaaaacattttaggcactcttgtntccaggagaagtatttattccaaagttattaaagctgtatgagatggactagattaatgtccagttcgcagacttattaggttacctgaaagttataccaatccatggactataatattaaccttttccctattgaacaggtgactgaattctacccatataaacttaactataattcctccccccagaagtggtataattggtgccagctagaaatattataattgctttccaagttctcatattatccatctcagtctcttgatgtatcccgtttactaatggcttgccttgcaggtctttcaatatgctgtgctcctgccctgcctcttagtctttgcccatgctgtcccctgtacatgaaacgctcttcccaaactcttactgagttaacttctgcagatcttccaggtctcatcttaccatccttaggaatgtcatctccaacctaccctacctgtcccagattagatcagtccttcctgttttatgttttcataataccctgttcttctctttcatagcccttttttacagttataattactgaattatttgtgtctttattatttaattttattatttaagtttatctcactctctggattgtgaaccccatgaatactttggttcagatattgtaatctgccttattcatcacagtactatgtccccaggatgtaatacaaaactcagccaatagttgatgctcaataaataccaattaaatgttcaataaatgaagatgcggcagg

SEQ ID NO: 264 - DNA, 501 bp, Homo sapiens
  misc_feature (1)...(501): n = A,T,C or G
tctgagtgtgctgagcctcctctctgctgcagagagccagccaccatcgactgtgggactgagggtctggcaaaggagaagcaggacgtcctcgtctgcccagtgattaagccacgctgcttatagagaaatacttcttccctgggtgagaaggagtcagaatgaggaggtttgacttggcttactaccaggtgtatccaatgaagaattccatttctgaagcacctcatacttggcttctacctggagggaccccagttctcagctgttttcaggggctctntcctggcataaaacagatgttggaataaagggagcctgagcgggcttatctgggacaacgaaggtatttcaaggaaagctggtactttctaagggaaggaacaccctgaagaacgggctggtgagggccatccaacccagggagggactgggttcccaataagcaaacgtgacacaccctaaacccgggttcctttggccctatttgatcactgaaca

SEQ ID NO: 265 - DNA, 752 bp, Homo sapiens
cctgccgcaaccgttttattgtactttttctttttaggactggtaacgtggtttgggccaaatgctctcataggcttaggtaattctttattcaggagtttccaagacttgaagaacttgtagcatgtacaatcactttccagaaacatttgaggctgttccttttgttcaggtgatcaactagggacaaaggaacacggttcttaggtgttgtcacgtctgcttattgggtaagccagtccctccctggggtcgcatggccctcagcagcccgttcttacagctgcttttaaacaacagggaacaatgcaccttcacttagaaagtacaagctttccttgaataacttcgttgtcccagatatgcccgctcaggctcactttattccaacatctgttttatgccaggaaagagccccatatacttccacaaagatgtgaaaacagctgagaactggggtccctccaggtagaagccaagtatgaggtgcttcagaaatggaattcttcatttggataacctggtagtaagccaatctgtctttcagaaagggagtcaaacctcctcattctgactccttctcacccagggaagaagtatttctctataagcagcgtggcttaatcactgggcagacgaggacgtcctcttcctccaggagtccctgcttctcctttgccagaccctcagtcccacagtcgatggtggctggctctctgcagcagagaggaggctcagcacactcagagcag

SEQ ID NO: 266 - DNA, 418 bp, Homo sapiens
tcactgtttatttgtttactccatggtcagcaatcagggctgggcgtttttggcaggggttgttctgctggccccaccagtcaggcaggatgctggctgtatcctttatggtggcttcatttgcaagtctggtgacagtgctggctggatgctgggcctgtttctgctccaggtctcttatccacaagattcactgccatttgttgggactcggaagtgagtttacagagcaacgatttgttttggaaatgctgagtggtccttgactcctgtcccgtggctgcagagcccagtccggggactgctcccaggccacatgacatttattcagctcatcctaataatcccaggccagtcctggcctcggtttcttgggttgatagcagccttcttgacttggcatgtcactttggaaata

SEQ ID NO: 267 - DNA, 225 bp, Homo sapiens
attttaagcttcatgaagaagagaactttgtcttattcactgctatatccaaggaagaaagagcagatcccagcattttgtaaacaccgaataagtaatctgtgaatgaataaatgaacaaaagctgagttgtgttgagaaatgatgacacagatgtgattggcaagcaaacatttagattcaaccataataaataagtgtattgtcatatcaaaaaaaaaaaaa

SEQ ID NO: 268 - DNA, 1356 bp, Homo sapiens
attgaaataacagaagccatctctgatttttgaaagtacaagctgaagaactgaaaagatgagaactccttcattgcctgggagttagaatcagagataatgacacaactggaaaaccaagaggaaaacatatgagactgatattctcaaagtataatcttgaaaaagaaatgagtcaagcacatgcatggtcaggcaatgtactcatgcggtggacctctggtgttctggctggccagagtcaccttttccttgttctggtagccatagctttggtttcctgggaggaatcacctcccttaacctcagtgtacactgagattgggcacactccagcacctgaaggagacgtgtaacccaagcttttgccatgaacatatttcctctctttggccacagtgattgtctcaggagaaggcacaaaactccactctggtcagtaataatcagactgagctgcacatgaacccaggagggtgtaagactgaaggtgctgggggccatcctaagaagaggatccctccaagaattaacccaacaaaagggaaagtgagtaagaaactgagcccacataaaatttgaactccagaggtctagccacgccctaaagcccgaatttttcctagtttttagaattattatataatgtcttaaatctttttttttttaaacctaatgttaccttaaaggtgacttttttgtcctttgtaaccaagacagtcctgttgggtatactccaaaataatgaacatgaaccagagtgagatagtgagtataaagtctgaatctattgtctggcaggtgacacaaaagaactcccatctgtgctctggatgaaccaagaccctttccttgctgggtccatgtgctaaacatagagtgagttagaggaagaaggatatgatgaaagattacaaggtcatgttgggaaaaatcatctccaggctgagaggggttggcacaaactgaagtttgaaatgacacaatctctggtttatccactgccaacagcaaataaataaaggagaagacataaaatggagaccagctggtggacgtgttttagatttgcagagcatcagagctgtctgggatgagaaaatagaatggactgtacaggttctgcaccagcagaccaagcacagacttccaggaagctcttggtaggcagacttccttgggctgcctctaccattccatcaaatttcctctgaccctggtttgatatgattgacaagtattcaacatttcaaagagaaatagagggagagagagggaactgctttcctttgatcaatcagatatagttttataacaacatattaagaaaactatcaaataaagcacgatcggcca

SEQ ID NO: 269 - DNA, 804 bp, Homo sapiens
aaaattcacaagaagagaggaaatactgaggagaaaatggcagattgtgtttgctgaatttgattgacgaagaagtcaccatgaaaatcacagtgaaccatttggaaagcaaactgccaaaaaataatagttagtcatgctctcaggctggttgttttggctgttgtgggtttcttgcatttccagatgattgcaaagagctgtttctcaatttctgcaacaagtgccagctgaaattttggtaccagtttcattaaatatgtagaacaatttgagcctgagtgagttctgtggagcccatactacctgcgattcaagccagcaaccttggaatctccctgaacaatttctatggtgtccaatcacattcgcaatcactccccacactcagactgtgtatttttggctgctctccaagcccttgaggaaaacacttggagtcaatctcatccttttgatgcagtgctgagtaatgagattcattttataaagctgcattcaaacaaaataattttgaaccacattcagggacaaactttgttaaactcagtgtcatgaaataaccactcatgcatgtatcagcacaactacagatactcccaataactgaaaatttgaataagtgaagctgagtaaccttgcagaattgagaagagaacagaaaattctttgttaaggatttatgcgatgctattaatgtttgcttatagtattcgggaggaaacagagggataaacacagaaattatttataaatattactgaaattcacagtttggaccatgtaactccaattcagagctaa

SEQ ID NO: 270 - DNA, 333 bp, Homo sapiens
aagcaaatggccccgagatggcaaagccataccatgaaaagcgactggacctctgagtcacctctttgagcagagagagccagaagatcctcttcactcacactgaacagtggcacgtgggtgaaatcacactgtgctgagtttctggaacctcaggaatctttggtacagcaaagatgatactttgattaatacgccaaactccaagcttagaaaatctggatgtacagcctgtgttcttaattgcaatgttattttttctcttccttcttccttttctgaataataatacttctaagattgctgaataaaatcctggcctcgttggcctca

SEQ ID NO: 271 - DNA, 520 bp, Homo sapiens
  misc_feature (1)...(520): n = A,T,C or G
gtctctactctcactgcttcattgtaccagattcacttttccggtcggggggagactaaantaatnngaangaaggtgaaaaggagaggttcactatctccacaagagtacctatctgagggtcccacctcaacaagaacattatagagatgctgagtcaccatgtcaccatggggttggttagcattgcattccctcgggggggggcatngtcccctanttctnnanttacattatgtggcatgaaggcatctgccagtgccttccaaaccacccaaacttccaggggcagaatgatccctaaagaataagagatggggaaggaaactggaaataaaatggacgtgagactgcacaacctgggaataatgagcgtttctaacatgagaactttctaggaataaaccatcctagccatgagagatgagacaaaactcaagaccacagactcattttcttttaaaagggtttctctgaaaatttaaaaaagagagggggagagattttaaaaaaaaaaaaa

SEQ ID NO: 272 - DNA, 1186 bp, Homo sapiens
  misc_feature (1)...(1186): n = A,T,C or G
tctctactctcactgcttcattgtaccagattcacttttccttgtctttgggagactgaagtaatgggaaggaaggtgaagaggagaggttcactatctccacaagagtacctatctgagggtcctacctcaacaagaacattatagagatgctgagtcaccatgtcaccatggggttggttagcattgcagtccctcaattataatcatggtgccctattctggagttacttctgtggcatgaaggcatctgccagtgccttccaaaccacccaaacttccagggctttggactctataggctggtctacactccattcatcaccattggccagccaaacaagattgtttttctcttactacgctatagaagaatattcagaaattaacttgaaggcatgcactcagaaatgtaacttccaatgacaagaggaggaaaagaaaacaaaagttatctgagagcaagctagcagagaaattaaaataatatattctacacttcaaagccatggtgatttgtctggaaaagtgaggataaaatgagtaatgaatttaacagagatggtatttattttcacaaggggcaaaatgatccctaaagaataaaaaatggggaaggaaactggaaataaaatggtaagacaagcaaatatataaatggatctgctgtcagacaagataacagtgaaggtacaagtagtaatgccggcaattcggatatgcaaaagagaagccatcaggtgcttcttttaagtgaaaaggttgataaaaacttcagttgaattaaatttggaagagtttaattgagcaatgaatgctttacaaattggaaagcatcccaagccagggtatgctcagagacttcagcatagccatgtggtggaagaagatttatgaacagaaaaaggaaagtaacttacagaaatcggaagtgaggtgcagaaacagctggatcagttactgttggtgtttgccttatttgaacatggtttgaatagctggctacatttgattggccaaagctcggtgattggcacaagtataggctatggtctgttacatctccacttgttatagttcacaatgtacagagaaccctttaggctgaacttagattatataaggangcagctctaggctaaacttgatttaataaggtgaaagttttcaatttaataaagaaata

SEQ ID NO: 273 - DNA, 957 bp, Homo sapiens
tccccgctcagtccttcacacaacggcagactagaaccaaatgctcaaatatccttcttatataactaaatggaggtctgctggagtttgctgcgggtccactccagaccctgtttgcctgggtatcactagcagaggctgcggaacagcaaagactgctgcctgctccttcccctggaagcttcatcccagaggggcacccgccagatgccagccagagctctcatgtatgaggctcataggcagaagggacttgccttgtctcagaagagagttttgactttggagttaatgatgaaatgagctaagatttcgggaaactgagaagaatctatcctctgcattcctgaatctcaagtaaaatatcattgcgtccttagctgaagtcagaatgcctcagccgatgagcatgtcatgctcactgtgcattttctggcatctggactgatactgttgtccagaattctctacatgtggattgtgaagagcatttatagcagaagctgtcttaccaacgttagtaacaaagtacctttcctcaaagtggaatcatcctacctgttcttacctagagttcctcaagcaaaatctcatcctcattgagacatgcagaaaacataaaggaatcataagcagcccctttcccacctattattttaaatgacaaaactaccttgaaccaacactattcaaatcactgctgtcctcaagttaaggcaactcttcaggtgaccaaagaagcttgaccaaccaccatgctcccagaacatacagcctctaaagcatttcttttataagcatttatcacaaagggctaaaacactgaaagaatggcactgacttgaaaaggagtgaaaatgagtctaacaggtacagatgctaatttcactaacctcaagagcattacataatttcaacaaataaacatgcatagtaacatgaaaaaaaaaaaaaaaa

SEQ ID NO: 274 - DNA, 1196 bp, Homo sapiens
  misc_feature (1)...(1196): n = A,T,C or G
acttcctgcttggattgaagtgctgtcaagatgtgtgttaacggttgcatctctcacttgaattcccgagctttacctcacaacagcagtgcacaaccctggcacagttctgtggctgctgactttatgaagggtgataaagcatataaagcattctccgccctcccatctgtcgggcacagcacaaagctggagacgattgtggaaaattgagtcttgagagtatcttcctcttgcaggcctcagatcgctcagggcctacaatcatattacacttgatccaaccggaccaactctcaacatgcacagaatgtaatttcagttcttaagtgctttcctgcgacaagaagaagatcaagaagaaaacgaatgagatctttcttttttggctgaatttaaaggaattacatggatacctttgaggaacggaaatggaaatgagatcagctccagcccttaagacatcatctgggccgtatttctatatcagtgtctcaactctgccttggagaaaagtggatcaatttcaatgcctgacccacttaggccatttctgacaagaccacaaatattacagtcctggcttcagctttaatgctacttatgctggggatcgctgaactcagacagatgcccagctacttatttttacaaggccagtgaacatgggaataggcagcttttaacttcagcactcntaggaactgggacagagctccagatatcactactaatcaccgcatcacccaaaccaatgttagagtctgaatttttaacggaaaattcagctactgcttctagttgaatgccaacacattttaaacattttctagaagactaaagttaccaatatgctatataatataaaaattaaatataaagaataatacatttattttctttgctatctgcattacacatatgcaaacatatgtatgcaagttcaataattcaagggcaggcgagaaccaataacaatgcaacagaagggctaatagtcactgaattagtctgtgaagtccatgcaggagatttaacaacgtcctcaggattccctccttcgagctgcattagtgtgcttctcagtagcaataaagcactggtaattttgcagagtatacaattttaaaggttgtgatcagtcactctgctaagaaaactttgcaattatatgtccaataaacgtagatcggcca

SEQ ID NO: 275 - DNA, 588 bp, Homo sapiens
  misc_feature (1)...(588): n = A,T,C or G
ctccagccagggggactgagggaaggcttcccagaggcggtgaccctgacattgggttcccaggagtgaagaacattttgacaatcagcaaggagagcgttccagacaaggaagctgcatgttgagggatcaagaggtctgctgtgtgaccttcttcaagttcctgaccctctctgggctgcagtcaccttattcagaaaatggagaggcttgacaagaaaatgatgctaatctcaccctattctgggctggcattttattgagcacctactagggcgctgggcatattgctaggcccttcgtggacactgccttgaaaaatccacagcacccggagagatgtgttaattataactcaccagcaaattctctcttgagccccacctgggtgccaacatgccctatagtactggccacacctagatgaccaaggagngtcaggatgnaactctcttaaccattcgggcggaaagggnnagggaaataacctgaaacagccagaatcttgtggaaaatgcgttaaacatgnctaaagggacctaaaaattcaatggtaaaaggcctcaaaccattttaaactgatccaat

SEQ ID NO: 276 - DNA, 764 bp, Homo sapiens
cctggccgatcgaggtttattttgtgaggtgattgcaggactgcagggaacggggaacaaggcggagaggaaggggccagcccagggagcttcatcaagttgtcactgcttccacaatggcgctccatcccagggcctctggacccggggaggatagagcttggagcatcctcctaagggctcactgctggctgagggctgttcccaagaggacaggatctaattctctggcactttgacctgctgtgtgcacaagagcacctccgggaggcatcgtgtgtgatgccaatgggatgtcagaccagagggcagggaggggaaagagcgacggcacaggcagggcccccagctgctctagggagcccctctgctgctgtctgctctgctcagcacctgggatgccaggatgagactctctgcctccatgctcgctggagggtggttttctgacatggcctttctttccctgctcagtcttgctcagaagcttctgcaggggtcacccaagcccatgcaggaccttggccacaggacctctggggaacattgctttagctttctgagctctgtggcacaagagggcaggaggtgcttggagtggtctcgagtgagggggcctgtggtatctactgcacccacctcagggcctttgcacgcactgttccctctacttgaatgcttttcccagtctttatgtatctgagtttctcctcgtctttgcaggttctgcttggatttcagcttctcagagaggctgtcacggg

SEQ ID NO: 277 - DNA, 844 bp, Homo sapiens
aaaaggaaaacaaggctcagagatgataactgacctgcccagagtcaccaagctggcgagaggcactgcgaggcctgggatgccgagtttacattggcaaacacacccatacacatcaaaaaccttgcttcaagccatggtaggaaggtggagaggctgagacacaaggatgtgaagtccttcctgcatattccaaacatgtacggagggaaaggaagccacgtgctttcaaagaagcttggtttcaacctttctgaatcatcttattccagcactcgctctcttcaagtctctgctcaaacatcgtctttcactgagacctgcctgaccccgttctttgaaataactgcttccgagcttccctcccactgtgttcgtcaccactggacgcactccctattgatctgatgggtgtttattgtctgcagcctggcgctgaactgtcagtctcaatgggaacaaagactttgttggggctagatcttaacttgaattccccagtgcctaaaacagtggcctggcacctcctaaggagtcaattgaatagtttgtggaatgaatgcagatgagtgaatccgtgaaattgcttctcttttttgcctaccctgattcctcccttaaaaagtcgaattcttacagaacaatgttatcactatagtcacctaacacttctgtggcggaaaagggccaccggcaactggaaaagctaaaattaaatttaaaaattcattaacatggatgaatgggcatgatggggaatgcttaaacctggttgaggagaggagctaaaacctaaagggttttttgaaagaagtctggcttcccacaacttgccagagtaaag

SEQ ID NO: 278 - DNA, 622 bp, Homo sapiens
tgctggtcatggtccacaaactgactacgaggtctcagctagcatctgtaaacactgctgtggatcacagaattgcttatatgccatcctaaccatataccaaatgatgctttcatacaacagtgaaaaaatatttcccttggaaagattacatttctactgtcactttttgcctgcaggagatcaaggctaagggcaaggagcggaagggagacacacaagatgctcaagtctttaaaaatccccattgggagaatcacgctacaaatggacaaatcacatcctgaaacggtggactctctgaagaccttacaaaacagccttcaggcctgatctgtctcctttcccagctcgaactgtgtcttcctaaagggggttcactttcctacttctccaaaaggtggcatcaaaaaggagggagcaggaaggcacagggcaaacgctcatctaaatgggtgcctcagccctgctctgacaagggagcctgatgggaaaattgctcctaattaaatcacttcattagaaagagaccattttccagccgatgccttccgcagtctcggggggggaatttggttgggaaatagctggaaaggtgaattccaaggttgcgcccctgaac

SEQ ID NO: 279 - DNA, 589 bp, Homo sapiens
accctgcctgatgccagactgccaaatccacagaccctgcctgtgtccacactgcctcaaggaaatgcatggggtataccacgtatcaatcaagaaagagctctttaatgaagtacttaatggataagccaacttcactctcaccagtcacacaggttgccctaaagttctctggagtggctacacctcaaagttgctcatggattccctgaataacctttccacatactaatatttacctctttcactctgtggcattaagacgtgtgttctatatatcacacccacacaggatgacttcaacactcctatctgacttcaaattgaggcaaggctgtatttgttcatgtaaatttgatgtgtgaatttatctctaagaagcagtctcacaatctctcttagaccttcttgtctgcattttttgaatgaggttgcataacatgaaataatatgcaaccaacaaaatgcttataaagatatttaatgacataaggaaatgcttatgataaagttttaagcaaaaaaatgaagtttcaaaattgaataaaatatgttatttcaacctaataaaataaaacattatcgcaag

SEQ ID NO: 280 - DNA, 784 bp, Homo sapiens
ctgctggatgaggaaagacaggccatggcgaaatcccgccggctggagcgcagcaccaacagcttcagttactcatcataccacaccctggaggagatatatagctggattgacaactttgtaatggagcattccgatattgtctcaaaaattcagattggcaacagctttgaaaaccagtccattcttgtcctgaagttcagcactgggggttctcggcacccagccatctggatcgacactggaattcactcccgggagtggatcacccatgccaccggcatctggactgccaataagattgtcagtgattatggcaaagaccgtgtcctgacagacatactgaatgccatggacatcttcatagagctcgtcacaaaccctgatgggtttgcttttacccacagcatgaaccgcttatggcggaagaacaagtccatcagacctggaatcttctgcatcggcgtggatctcaacaggaactggaagtcgggtttttggaggaaatggttctaacagcaacccctgctcagaaacttatcacgggccctcccctcagtcggagccggaggtggctgccatagtgaacttcatcacagcccatggcaacttcaaggctctgatctccatccacagctactctcagatgcttatgtacccttacggccgattgctggagcccgtttaaattaaagggaagtgaccatcttgccagggagcggtggaagcctgtatagggtcagggatcagtaccttttggaccatcagcacacccttaggggcg

SEQ ID NO: 281 - DNA, 370 bp, Homo sapiens
agcaaatcactggacggagatcaagcagtttatggtgccaagaaaccagagaggctgcagaggctcagagcaccatggaagaaagctttctgcttgccagcaccgtccccaactgcccctgctgaggggctgcctttggagctggcacacgggatccctggggtcagcacagggtggcccatgcatacacccagccccaacaggacgcctggctcagtgttggcaacaaccgcctccccagggacccctctatgccctggcctggctgcttccccagcctcagctcccatgggcggggggggttccttttgtttcagcgtgcaggtgaccttatgctgggttctcatagaataaagagagatgcgccaag

SEQ ID NO: 282 - DNA, 579 bp, Homo sapiens
acatcatctaaaaggactggacctacatctgcagttaactgcacaatggaagaaacggcctctcctgggcagcctcatggatggggtgaagagacaaagcttgggagtgtagcatgttgagcacatctgctcagaggttgtctccaagcataaaaatggaaatactgatcctgtgacaacacagcctgaattttctgctttgcagatgccagatttatttttaaatggtgtgaatcaaatctgtgctgagaggccaacttcaaaatataaaagaaaaattggcaatgggaggattgtgctggtttggctgaaatgaagtgctctacggcatttcattctagtggagcgtctgactgtgaaaatccttccaattgtaattttctttggcttgccaaaagaggattatgaactaaagtcagtgttgcaggaaatgtcacctgtcctttgaaagaaaataataaatcaaaatggcttttgttcatcatgtttaaaatgaaaaaaaaaaagttgatccaccttggagtcttctctcatttcttgtcaaggcagttaaaattaataaaaacagtaccgcacaac

SEQ ID NO: 283 - DNA, 609 bp, Homo sapiens
ttttgtaagctagaacatcatctaaaaggactggacctacatctgcagttaactgcacaatggaagaaacggcctctcctgggcagcctcatggatggggtgaagagacaaagcttgggagtgtagcatgttgagcacatctgctcagaggtaacatttaagcatttaggttgtctccaagcataaaaatggaaatactgatcctgtgacaacacagcctgaattttctgctttgcagatgccagatttatttttaaatggtgtgaatcaaatctgtgctgagaggccaacttcaaaatataaaagaaaaattggcaatgggaggattgtgctggtttggctgaaatgaagtgctctacggcatttcattctagtggagcgtctgactgtgaaaatccttccaattgtaattttctttggcttgccaaaagaggattatgaactaaagtcagtgttgcaggaaatgtcacctgtcctttgaaagaaaataataaatcaaaatggcttttgttcatcatgtttaaaatgaaaaaaaaaaaagttgatccaccttggagtcttctctcatttcttgacaaggcagttaaataaataaaaccggatcgcaag

SEQ ID NO: 284 - DNA, 523 bp, Homo sapiens
agctgaaagttgaagagttgaagcccttttgcccttctcagaatgactacacttaaagtgagcttcctcaccaccaagtaccagaacaaatggtgggcctggaaaggcaattctgctctgaggaacgtgaaacaagcataaaccgaatgtgatggcagagctgtcacaccttgtggccatcgattacatttccactgactgttctatcactctccagaagggtgatcatgcctgtgctgctcccagaagacccagatccaccgaaagaaatgcaatccttccccacaggcagcctttcctgaggagaagaaggagcttctctaattgtcacatgagtagaaaatgttgaagagacctgcctctttcagaggaagggaaagtttcacgtccaccatacagtcagctctacaagggcaagcctgcctgattcaccagccgtattcacagaactatgctggaaaagcaattgtgggataactaagtttggatcaataaatgaatgtgtaaaagaaaaaaaaaaaaa

SEQ ID NO: 285 - DNA, 1050 bp, Homo sapiens
ctcttccctgccgccatgtaagatgtgcctttgctcctcctttgccttctaccatgattgtgaggcctcccagccatgtggaactgaggatccagcataatagaggccagacaggtgatttgcatactcaagagaagaagccacaatagaagaaggcagaggaggattctgtgttgaaagcaagcaaagatgggcacaatttgaccgagcttccgtaaacttctcatgggaacacctggctcatttctcctgctgggagatggcaggttcttgcatttgatacttgaatgggccagctggggtaactggacaaggtctgactctgggcccccatcacttttgctggctggcaattcttttccaccctgagcatctgtagagtcatccaactgtgtttgcaaaacttggttgtatgtgagaagtgtgtttgttttatgatcagtgtcttgggttttaaataagaatactgcaagagatgatcccactatgatccttgttaatgtacctctaggctaataagtacggagatgatcctgctctttgatttcatgaataagaaaataaaatgggaaatgcatgacatttaaaaaaattattgttattactggatggtaaaaattatttttaacccctgtctgtaggtggctaagtttcaagttgaatgtaatgcttgccagattgtatctcctgttcctcctctccttaaatatgtggttatttacttcctgcagagttcaattttagaacccatcaaagtagatccactcagactctgactacattttcatgcataaattcatagatgtcttcagaaggaattgcacttgcatatgcaaataccttctgatgctttttatttctacttttggcctgcacagtttttaattcatgcaaacacattacacaaacaaatatgggctcaataacaacatgcggcatgtgtgaattgttaattgcaaagctatgagtttgatatggccaagcaacctccattattatcaatggaggggaacaagactaaacaggaagaataaaggtcgatcggccgag

SEQ ID NO: 286 - DNA, 1250 bp, Homo sapiens
cggcccgactcttcggtttattttaaaggcatttccatgacgttgaaggcacagatgttacaactgaattttatcccaacctccacatgtggaatccagaaaaaaattctctggtcttatgattgaacaggaaatgaaagacagtgtcactctaggtcctcattaggaattcctatatttttacaccattggagaaacatttagggaaaatgtgcagccatgtttttaaaaagattcccaaaactcttgttagagaataactttgctctttctctgggagtcacagcaaactattctaaagatgcttccacctcccgttttgagcaccaccttctaacatagtgcacgctacaatgagagtagggagcaggagaggctaagaaatgctgatttcttggctagcatgcctttggcctttggttgaaactactccttggaaggttattatattccaaattccctctgatggataattgatttgtcaatctcaattttttcatcgtatattttaaaaattatcttatgttgttttgaactaccaagatcagcacactctttttcatgataacacactttggttataaatatcattgcaaagcgcacttgaacattcatcagaaacttgaagattttgttaaactatgaggatggcattcatcaggatggcattcatcagatttcattaaactatcaggatggtattcactgaataactgcaatgcagctctgccaaatggtcatctgtcttctctttgaatcatgggtcattatacaggtagatgaaaacctgggatggtagcatgcacctgatgtcctagctcttcgggagactgaagcaggaggattgcttgagcccaggagttcaaggctgctgtaagctgtgattgtgccactgcacttcagtctgggtgacagagcgagaccatgtgcaaagtctgatttacaaagtcttgtattcccaaagcaggctgaaagactgttgcaggttgagtttcccaggaagcagagtcagatggagattagcatggaggaggtttcttagggagtcttcttggtgtcacactcggcctcccaaagtgatgagaccacaggcgtgagccactgcacccagcctttttattattatttcacttccttaaagatgccactctattgtcttctggcttgcacagtttctctacttgaaatagatgctttcttaatcaaacctccacttaattcgtaggattcaccaacactcttcactttct

SEQ ID NO: 287 - DNA, 940 bp, Homo sapiens
tcaggcccatctttgtttatttttattgctgaatattgttttattggatgaatataccacaacttgtttatcattcatcagttgatggatatttgggttgtttctagttttgggcaattataaacaatgctgctgtgaatatttatgtgcaagtatttgtgggaagtacgttttcatttctctttaattctcccaatgtttaaacattgctaactaatataaaacatttttaacccaagtagacaaatagtgaatggtgtacacaaaacactactgcacactggatccagcctgtggctggccagttttccatggatatggaggttctgtggttttctcttagaaacacaaatattgagttatgctcattggctaccctgaccctttaagacttggccccagatttcattcaccatccagagtttaagttatgtggaggccatgataagaagccataatttatggcctccattgtgcttctctgtctggggatccttggcagggccaatggtaagggtttgacctttccatagcaaggttgggctctagggatggtgagaaggtatgttggcacatcttctccaatggactagagctggcagaacagttgttgtaagtgtccttggggtgcttctgtctaggcccccattacaccatgaagcaagcagattggaagtcaggtaggcttctgtcatttcttcctgggtggtctagctgttcccttagctgctccaggaaacctcctgatagggccttgcactgagatttccaggaaggcatgaatacagggaccctttattctctgtcctgaaaaggaggaaaaactacataaatggtttgggaaattaagccctatttatttcttatctttcttttctatcaaacgcagagaaaggggaaaacagttggctctggaaggtggcagaattctctgggatag

SEQ ID NO: 288 - DNA, 465 bp, Homo sapiens
atttttttttagacctcagagagctaaagactttttttgaagacttccaacgtccagacttccagtgtttgcaaatcagctattctgtgcacagtccaagatgtggcgccatttatgatagctgaaaacttaataatgtcctgtatcattttaatgactggagtgtgactttgttctcagcacaatgagtaacaaagccaaaacactggagaatacgtttacgtattcaagaaaacctcagacaaggaagaatgccctcataatacagtacattaaaatcagacgaagcctcgaagggcagaatcaccgaccctgaaaaatcagagtgtactacagaagaagacgacagcgtttgagcacatttgttgaagcagcctcctctcccttatggtacgataatcccacaccgttttaccatgctctctggccttcccagaacatcaataaaaactgcatcccctgaaa

SEQ ID NO: 289 - DNA, 788 bp, Homo sapiens
  misc_feature (1)...(788): n = A,T,C or G
ctgcaaaacataccatgccatatatgtaccagattttctttatccaatccaccccgatgggcatctaagatgttcagatgtgtctggagtttcttccttccggtgggcctgcggtcttgcttgacttcaggagtgaagccacagaccttcgcaagtattccaaggcactggagaaagaagcagcaaaaatacagaagaagtctgtgttcctgaagaacaatgtggaactgagctaccttttctgccagaaacacactcattggaaaatgcataaatctatgtcacacggaagacaaagaagatataacttaaattcctcaagagtattgtgaaattcgcatacttctttatatcccatacaggtgggagcatagacctgaacacaaagaatcctgagaaagtctgttctgaatgttccagtccaatttattttctgatctctgtatgactcaactctgggccatgccagtcttagactcagtcaaatgctggaaaagcttcttctggactaaaaaaataaaatgaatntgtaaaaaagaactnccttnaaagacctttatgttctggaaactgcaatgaaagcggaattattttcaacttactgtatctactttgatgaaaagggatgggcgtgctttccttgttgtaccatgatggaaatggttctggaattcctggttgtgtgctaacctaaacatatttcatggtaatcgaatagggtgaaccttcacactggggataagcccatctgtttggcatgtagcatgtaaaaatgactctttcatcag

SEQ ID NO: 290 - DNA, 449 bp, Homo sapiens
ttcaaccacctaggtccagtcaccatctaggaatcgatcaggtcactgacgcatcacactacacttgctaggatgaagacatggataccacctctccaccagtgacctaacttctccaaaccagatggcgctgagacgtaatgcaggcaacgagtacttgatggattttgatgttctgtataatacttgtctaccttaggtggtaattcccctcacgtttgctctgtgaccagctatgttccctgagggccgactgtccctgctgacagtaactccgtcatgggagaatttgtattgcttaggggtaggagaagtggaaaaaatgtgccacattcttaagtcaaatacagagagggactctccctttgcattacaaacccctgcttccattagaatggctaactgtcaactgagagcttactgcaagacaataaaaggcgatcggccag

SEQ ID NO: 291 - DNA, 600 bp, Homo sapiens
aagaactggagagaacaggctgtcctcaagatgtgcttctggttctggtctgctttctctgcttctatctcttatcagcagagcaaaaaggggctctttgagtccaaacagcatgagaaccaactctcgctgattcacagcctgacctgagggaaatgtggtcaacccaagaaaacagggcaactgttctacagatacctttcaacatcaaaaccccttgccactcctatttcttactccaagaacagctttccagtaggagtgaaaggaatcagcttccccttacaatgcttcaacgcctacgattctagctcccatgacacctgcagctgaccaactgaggcagtatgtcaagtcttcccaatgttgagtcgcctccaacttaaataccctctgaagaggctctcagtttagggaggcaaagaggaagatcaaggaccaactcttctccaaagagaaaagatcatataagtttcttctataaaatcacatttaaatgtacttaaaaagcccattcatgatataaagaggaagaaaaatctatccttgtataactgtcttgtatcccttcatggatttgcaataaaaccagatcggcag

SEQ ID NO: 292 - DNA, 642 bp, Homo sapiens
gatgagattcctgaagaaaattacagggcacagtgagagtgtacaagatgggaacctaactggataaagaggtggtggtcagaatttgaaattgtgcaggcttccctgagaacgtggttgagatctgtaggacaaagaaactagaaaaccagattgtggaagtagcagtgccaagaggctatttaggaagacttttctccccacccactcataaaaataacgtactagggacaagtggccttacgccctccaactaagcttaccagcctactcaacatgaagatggtaagggtgaagaccattatgatgatccacttccacttaaaaaacacaggtcataaaatgtagctgaccttcccctgaagtaggtcataagacactcattccagtggtgccctccctgtacctggaggaaagaaatgagcctatctctgaagacacaaaaacagaagaatctgaacaaacaagccttgctaaatctccctgtttattaccattagctcatagccgctctagctaatcatacttctgcacaactatccactcttcctagcataaaaacacacaggtttacctggatctccagatctttatttatgaagtctcctgtgtcacgtaaaacatttattaaataaacttgga

SEQ ID NO: 293 - DNA, 946 bp, Homo sapiens
cagtttggctggaaatggaattcttcattggaatttcttttccttgaggatgctgaatataggcccccagtttcttctgtctgaaagctggacccccagcaaaggaatccactggaacacagacctcagataaggggaaactgaggactgaactcagattgtcattctttcctgaatactaaattcctttctcagggacctagaggaggtcataccccagaaataacatttttttttctgatcatctcaaattttttaaacaaaacttcacctcctgaaccagttgcaaattagaaaatctttgaatccacctataacccatgggtccccatttcaagatatcttacctcttcaggtcaaagcaatggatagcctcatgaatgctgccacagattcctgcataaccaagtatcatcaccaagcagcactgagcaacatttttctttcttcacttttattttaattcatggttccagtgatactccagaattacacagtattcagaataattgcacatggtgattgaaaccctattgtaatattaaataatccctccttactataaaagtatatgtatagttttaggtgaaattttgatctcatgatatcaataatttatatcagtaacaagataaatattgaccagtagaattttgaagagtttgaattttacacttactttaatctatacttttgtaaaaatctatacaaatttgtacattttcaagtaaatttatttttatttcttagaaatttacttttggtaggacacaaactataaacattcttactataacaaagaatgtactactgtgaggacaaaatatgttattaaataattatataataatatattatctttattttattattcattcaagtattgctgtctttttagtgaaacaaacatgcaacataaataataaaaaacgatggcgtcctgagg

SEQ ID NO: 294 - DNA, 372 bp, Homo sapiens
tcttccaaaatggaatcagccttcaaaactcaatccacagatggaagagaagtcaccaatgatatacacctacactccaagcttctataacctctctgttccagccagctcagtgattccagacatggtcataagagacctagcccatgaccattaggttacaacgtctgagctgtggggactggggaccaaggtggtgtgagacttaccacatctccagccagaaatacatggtcaagtgctgctatgcctactcagctttcttcaggctacatcttgctatttccactggaaaaataaataggagggaggctgaggggagaaaaacagcatttctatgctaaggaggcactaataaatgcgatcggccag

SEQ ID NO: 295 - DNA, 774 bp, Homo sapiens
agacatcactacagaagagacttctgcttcccttctctacttgtgaggaaatgctacaccaaagccatctctgagtgagaaaattcagagagttaaattgaaagtgatttattaaattgcacagtttctctgttttccatgaatgaatgtctagttaacataaattggttaaaatcatacacacggtaattgaaattattacccatgaggtggaaccagagagaaataaatactgagctgtaatgcatttcactcatcccaattcattctttctgtcaactgtgcaccctctcccttctttattaagatttgtataaatttaaacaaagtcaaactaagctggaataaaggcaatgtggcatgtgtatagtcaagcaagaagtttgttttgtgagaagaataagccctcacatgcattcaatcactgtgttccagcatgaggagcctgaaaacccttcagatgattggctatttaggatagtgaaaactgatcaaagaaggaaaataaataagaaatttggagagggttgggaccttttatgatgggcaaagaaacggttggctggaaaaagttttcgaacaaggtaaaattaaaggcaatttttgaaatgtttggtattcagaatccaatcttctcaaggtgcaatgtgcatcttggggatctttgggaaaatgcagattctgatttagtaggttcatgggaggtctgtactttcttcttctcccataagctttcagtttgctgaccctgctggtccacaaccatgcttttag

SEQ ID NO: 296 - DNA, 196 bp, Homo sapiens
cggccagcatcggtatttattaattaaaacttttagtaaacaaaacggtatcaaactcagtctgataaagggcatttctaatcatataacttacatcatactttatgatgaaggactgaatattttctgtgattgattggtaaaaaaggcaaccatatcagctcttaatcttcctgttcaacactgtattggaggt

SEQ ID NO: 297 - DNA, 282 bp, Homo sapiens
ctggccgcatcaggctttattgagcagcagaacaggtttcaggagacccgaagtgaggacctcctctccacaggcaggtcatcccaacatctgcccatgtctggctgagtccaggatttttactggcttcagaagggaggaagtgggtcctgattggtccatgggcaaccatgggtgggcatcatactttatgatgaaggactgaatattttctgtgattgattggtaaaaaaggcaaccatatcagctcttaatcttcctgttcaacactgtattggaggt

SEQ ID NO: 298 - DNA, 737 bp, Homo sapiens
ctcatattccacttcttgaatacatggaaagggcaaagggactcgtggccattgaaatctgaagttttccacagtgttgcaataaacatatttgtatgaatctccatcagcacatgttcaaacaaatgttttctaaggttcttggtctgaatactgaggaatgtacaaagaagaatcgagcctgatgcctaccttccaggctcttaaaacccaacaagactggcgggtgcctatagtcccagctactcgggaggctgaggcagaatggcgtgaacccgggaggcagagcttgcagtgagccaagatcggaccactgtactccagcctgggcaacagagtgagaatccgtcaaaaacaaacaaacaaaaaaacaaacaaacacaaagaacaagatatcttattttatggatataagttatgtaagcatattattacataagtttctagttaagaatctactttaggacagataaaaataaagtcatagaagttgaatgaaaagaaatagtaatgctatccatgtggaaataaggtttctatgagaggttataattctctcatagaaattcttatatggttcttcttcttaagtgatgagaaaattggtgatgccccaatattaaatgggttatcaaagatacagagaccattaatgatgacttggacaaatctcaagtcttctgaattctcatccagtacatctactaagatctttattatgtattaataaaaggaga

SEQ ID NO: 299 - DNA, 294 bp, Homo sapiens
tttttttttttttttttgccttcaatttttgtttatttttagaaaataaatggcaaaatatatacactgtggagtctgaatctcctcatcatagagtgtgaacgatggtccggctgcgaagctgctgaatatactctttggcatgggcaactgccgtctttggtggctcaggtggaggtgggggcccttccaccaacttcacaaaataatggcaataaaccttctccatgatcccaaagcgacctctgccatggtagcggatgcgtttcaggcactggcctcgtcctgaggtgg

SEQ ID NO: 300 - DNA, 461 bp, Homo sapiens
cgaagccagagtaatacacacgtagaataaataagctgagaataatggaaagttggatgagagaattgacattccacaaaggttttacttctccatcttgggtcatctggattttggccatttcgtcacaggaaaggtcttcagactcagactgaattacaccaccacctttcctgatgcagatgatcgaacttctcagtctacataagcatatgagccaattaccataataaatatactcatacatagatagattgagggagagagagaaattatcctattgattctgtttctctgtaagaccctaactaaagtacttaggattagcataatttctctcattgaaatcacccactcgtttcaccttggctggatgtgttgagggtaacatatgggagctcatgtcacttgaaaactgtgctccaagtgatgactctgttatttgcaactgacaaccccga

SEQ ID NO: 301 - DNA, 634 bp, Homo sapiens
tttttttttttttcaggtgttttcttgtttatttgtttgttgtgaaattggtcagttgcaaaaagcagagtcatcacttggagcacagtttacaagtgacatgagctcccatatcttaccctcaacacatccagccaaggtgaaactggctggaacttaagggagatgtggtgatttcaatgagagaaattatgctaatcctaagtactttagttagggtcttacagagaaacagaatcaataggataatttctctctctctttctctctctctctctccctcaatctatctatctatgagtatatttattatggtaattggctcatatgcttatgtagactgagaagttccatcatctgccgtctgcaggctggagaatcaggaaaggtggtggtgtaattcagtctgagtctgaagacctttcctgtgacgaaatggccaaaatccagatgacccaagatgatctgaacaactttttggagaagtaaaacctttgtggaatgtcaattctctcatccaactttccattattctcagcttatttattctacgtgtgtattctccagttgtctttgtactctggcttctgtgaaactctgggccacttattctctcactgttcaatttctgcaa

SEQ ID NO: 302 - DNA, 549 bp, Homo sapiens
aactcagagttggagtgcacctagaagagatgttgctgctaatttgagaatgggtttggtctgatggtatctgggccttccagagttctgaaacagttgcagaaattgaacagtgagagaataagtggcccagagtttcacagtcttcagactcagactgaattacaccaccacctttcctgattctccagcctgcagacggcagatgatggaacttctcagtctacataagcatatgagccaattaccataataaatatactcatagatagatagattgagggagagagagagagagaaagagagagagaaattatcctattgattctgtttctctgtaagaccctaactaaagtacttaggattagcataatttctctcattgaaatcaccacatctcccttaagttccagccagtttcaccttggctggatgtgttgagggtaagatatgggagctcatgtcacttgtaaactgtgctccaagtgatgactctgctttttgcaactgaccaatttcacaacaaacaaataaatcaagatgcggccg

SEQ ID NO: 303 - DNA, 921 bp, Homo sapiens
cagacagcctcgggctcagcctcagcctcgggttcagccttgttacctgcagggtctgtgtaacctaccccagtgtaccagccacaagggtgggctggagccgagatctggtgatccagctaccacactcactccttctgctgcagacttggcagggacttgaaagagaatctacttgatccagccccagaagccactgggaagctgcttatggaactgggcaagagggcagtatagacacctgcttcgctgatagtgctgctggcagccccgcctgctattcctagcgccttttgtgctatactgcaggaccaaacagagactccagctttggtgatgtacctgctcccccttcaccttctgccataattggaagcttcctgaggccctcaccagaagcagatgccggcaccatgcttcttgtacagtctgcagaactgtgagccaaataaacctctttttaaaaataaactacccagtctcaagtattcctttatagcaatgcagaaaagactaacacacctttcttgggagaagaggacagaaacatgaatgcctttcatggaccatgaaccatgtgagatgctttccaagtcattgtcttactgttcatagaattgtctcactaaatcctcagaagtcttttaacctgggagttaattattcccattctacagactcagaaaagttaagcaacttatccaaggtcaagtagctaagaagtggaaccaggcccttttggataacattttcatcacacttgtggccttcttaaatctctatcccccaaaataattttggcatacacacctgctctctgccatttgccatacacaagggtcggctctgcttctgcaaacatccgggcccttcccctcctctggcctgtgctcagaatcagaagcagctgtgggggcaccg

SEQ ID NO: 304 - DNA, 676 bp, Homo sapiens
  misc_feature (1)...(676): n = A,T,C or G
ctgttctgtgactactctctnnaaccgtccaccgctacaactacaattataacattcatttcctggctggcgagaagaaaactatgaactcagagacattgtgctggactgtcctgatggcagtacaatccctcacgacctgctcttgtttagacatatgccaactatatacgaccttaatgtacagaaaatgctgacttcctcgtcccaggggattttataagagaggaaaaataatcatttaaaaagtgagaataaactaagcaaatgggagaataactcaaaacaatggagtctgaccgtggatgactggatctgaaaaaaaacacagatgcgggcgctaacctgtaaggaagggtaatagatgatcctcgggcactgactgcggtgacggaggcaggtgaggtgacttggaaggcaagagagggggatggcataggtgcgcgggtagcagcgcgaggacctggggaagccaggcaccagcaaaaccaggagccacagggaggaataagggcgagccccacaggagagagggcgcggggccggtcagaaggggggggggccagggagacggagcaggggcaggggaccgggcgtatgcacgcggcaggaggaaaagagccgggagggaaccggagaatgaggaggagggtaggccaggggagaaagagagaaa

SEQ ID NO: 305 - DNA, 388 bp, Homo sapiens
tgtgtctttcatttctattaagaatttactgtgcttattattattattattgttgataaagtaagtgaaatagactatttcagtagcagtgtatgctatttaaatcatcttcttgcttgaattgctgaattgacttcagaaaacgatcccagctaaacaacatctacatctcacagtagcttcatcttaatttatacaagaagcactttctgaagtcctcacattaagatttaattcagtaacactttcatcttgaaaaagtaaatggctgggtggccttaatcagaagcggacctggtaattcagtattagagatgagactggaacctgcattaattgcacccattagttttcttggcaggttcatccaatgactttcgtgtggttt

SEQ ID NO: 306 - DNA, 357 bp, Homo sapiens
tcagtgtttatttttcagatccagtcaacaagagaacaaaattcctcacaatgagaactcattgttttgagttattctcacattgtttagtttattctcactttttaaatgattatttttcctcacttataaaataaataccaggcctgttaaaactgggaaggtgatgtcagcattaactgtacatgaaggtcgtatatagttggcatatgtctaaacaagagcaggtcgtgatatgcttgtattggtaagggattgtactgccatcaggacagtcaagtacaatgtctctgagttcatagttttcttctcggcagcaaaggcatgaatgttccaagagtaagatatcataattgt

SEQ ID NO: 307 - DNA, 412 bp, Homo sapiens
caatgaatgagttcctgctgctctacaaccttgccaacatttggaattgtcagtgttctggattttagccattctattaggttataacagggttcaagatgtgtactttcatggaaaatgatgtttccatcttttcaatggttgtttggctcaaaggggtggatcaagaacaaggaacattaattggtagagagaaagaaaaaaaagtgaccaataaagaatcccctgatcactgtgtgggctgcaaatagctgggatcagaccacccatcctgctgtgtccaacgctctgtgactcctggagccatggtataaaccgaatctgcagggagtggcacacgcacacgtctttaatttccatttcctcattatcatctcttatattctactgctcaacatgaaaaaaaaaaaaa

SEQ ID NO: 308 - DNA, 621 bp, Homo sapiens
tgttctatcactagcagaaacaggttccaaatgaagatgggacaccaagaacaaagcaaggcaaacccattttactttgctgggtggcatgtcagctgcaggaattcccaatcatcctgtctgattactcctaaggacaatttgtcgcttgcagccactgccttatcactgcatgaatccatggggctggcgcaacagaaaatctggagaacatacgtcatgctattttcagtgttgtccctccccgtggtagccgctaccctcggatgtggctcaaattcttgctttccttaagatgagctttgtcctgtgatgatcatcccagccctcaagcagaagactctggacgggcatgactgtcaaattatccagacatgcccagacaagtctgaatcctagggagaacatagctgaggcccaagctgcacaccttatttactctccacaattcctctgggctcacctggaaaccaacagctttactcagtcacaggagcacttctgggttctccctctaaacacaaaactgaaactaaagactttaacgttttagaaaaaaatacgtgaaatctgaatgaactgatttgtgactttattgtgaataaatcccgatgctggccg

SEQ ID NO: 309 - DNA, 631 bp, Homo sapiens
tgttctatcactagcagaaacaggttccaaatgaagatgggacaccaagaacaaagcaaggcaaacccattttactctgctgggtggcatgtcagctgcaggaattcccaatcatcctgtctgattactcctaaggacaatttgtcgcttgcagccactgccttatcacttcctctctccctatctccaggcatgaatccatggggctggcgcaacagaaaatctggagaacatacgtcatgctattttcagtgttgtccctccccgtggtagccgctaccctcggatgtggctcaaattcttgctttccttaagatgagctttgtcctgtgatgatcatcccagccctcaagcagaagactctggacgggcatgactgtcaaattatccagacatgcccagacaagtctgaatcctagggagaacatagctgaggcccaagctgcacaccttatttactctccacaattcctctgggctcacctggaaaccaacagctttactcagtcacaggagcacttctgggttctccctctaaacacaaaactgaaactaaagactttaacgttttagaaaaaatacgtgaaatctgaatgaactgatttgtgactttattgtgattaaaacccga

SEQ ID NO: 310 - DNA, 215 bp, Homo sapiens
ataaggaggatcgtttgagaccagcctgggcaacaagagtgacacccatctcagaaaaaatttcaaaactactcggccatggtggatgatgcagcagaaggccttgcatcagagggccttcttgtgaatgcttgtaagccatcttataccagatgcaggcctcttgaccttggactccccagcctccaaaactaataaatgcagatgcggcctga

SEQ ID NO: 311 - DNA, 277 bp, Homo sapiens
tctttccatgaaaccaactggtccagaatcgaaggactccttcacagagacggatccatctccttcaaatacccagactctaatggtgagggaaaggcaacatttgaaagactgagcattttacctaaagggattttaaaaaatcaccacaatggacttttatcacaactcggatccaaaatttatggatttcccaccctcttgctacgcagaaggtggacttggaagagaagagaagtttgggagctaagaataacccgcatcttcttgcataaaa

SEQ ID NO: 312 - DNA, 273 bp, Homo sapiens
tcggggtttattcttagctcccaaactcctcttttcttccaagtccaccttctgggtagcaagagggagggaaatccataaattttgaatccaagttgtgataatagtccattgtggtgattttttaaaatccctttaggtaaaatgctcagtctttcaaatgttgcctttccctcaccaatagaatctgggtatttgaaggagatggatttgtctctgtgaaggagtccttcgattctggaccagttggtttcatggaaagttctgtcacat

SEQ ID NO: 313 - DNA, 764 bp, Homo sapiens
aacaaattcatacagtgtaacccagccaagagattcccagagattctcatcctgctcatctccgtcaccaagacgtgtgcttgtgactccagtgctccagcatgcgattgtcactcaacctaaatcccaggtcatctttcaaaatctgagccaaggaagccttaccatgaacactgaacatcaaccatgcctaattccctggcctagtgctagagccaaaaggtgtatgaacctggttccaagaagttccaaaggaatggggacaaaggagacattcataaatacataactgtcagtttggcccactgtgctaaggcacaataagaaaagtgagataatacatccttttgagtggaagggaggtggtcatcacctaccatgctggcctttcccttttctaaccacccattgttcttcctggtaatacaatttagcacctactgggtttcttacaactcctcccatgttccttctatatctgtagtcaaagtgtaagccacttgaggatacagatgtgtgtcattcttctccaggattccccaaaacacttggcatagtcttagttacaaaaccagggctccatagagacatattaactgactgtgtatagaagattcagtgggtgggaaggggaaaagactaaaaacaaaaaaaaaatgggggagaaaacaaccctgttggaaaaggaatgactaggaatggtattttggtgagggaaaagagatggttaaatgtaggggagtttattaggaggaaaacaaatg

SEQ ID NO: 314 - DNA, 459 bp, Homo sapiens
gcttggtggaacatcagtctttacttgttcttcgactgggatttacaccattggtttaccagattcttggattttcaaacttagactaaattacaccatcagctcttctgggtctccaacttgcagatcatgagacttctcatcttccataattatggtcatgctctgttgcccaggctggagtgcagtgacacaaacatggttcacaacagccttgacgacctgggctcaagtgattctcctacctcagccgcctgagtagctgggcccacaggtgcacgccatcatgtatagctaattttttattgttggtagagatggggtatcaccctgttgcccaggctgaagtaactctcgtataacatcctgactaaaataccccaatggtttgttgtgatgtccattctccttcactgcaataaataataaacccaccttgctctaataaaaaaaaaaaaa

SEQ ID NO: 315 - DNA, 441 bp, Homo sapiens
tcgtgttttattttgtctgatattaaatttgctaaacttctttatacccaacttttaaaacaatatattatctttactgtggaaaaatgtggaaaattggggaaaacacatcttgtataacacgtagaaaggctgctgtttatttgtgtgcatgtgtgtgtgtatatatatatacatgttttctagggatgctgggacaaattaccacaaactgggtgacaacacagatttattctctgccatttatggagaaaaaaggctgaactcaagatgtctgcagggctaccctccctccaagggccctagaggagaatttttcttgcttcttccagcttttggtgactccaggagttccttggcttgtagctgcataactccaatcttggtatccatcctcacatggccatggctttctctgtgtctgtgtcttctcttctgtct

SEQ ID NO: 316 - DNA, 780 bp, Homo sapiens
ctaggattggagtagaaaaggaggaagttgagccaagaagtcgggggttccatgttctccctgaagcaggctgcaagatgacctctgagagcaaaccaaaaggtggctggctgttataattcatcatgaacgcatctcactccaggcctggcccccctgacagaaggaacagccggtcttcaaaaggcacctagaagaattgtacttcttgtcctcttttgaggataggcatacctgtgtgctttgctttggccaatgaaatatgaacagaaggtacctgtgtcactttggaacagaaactttaagagccatgatcaatgatttccatgttcatttcccactgctgtggtgactacgaaagcacttgttaagatgaactctgtatcagcctggatctctgagagacttcatggagcagaaatcctccagcctatatgcgtagtgtatgtagtatgagaaaggagaaagaaagaaactcatgttaagccactgagatttggagggtggttcttactgcagcataacccagccactgtgcttgatatacttggtattactaagttatatacttaatatatacttgatgatatacttggtattattaagtatacttggtctacttacagaatattatggattatattttcggaaagatttatgttgcaaataacccagttatacctgccaggtataccacgtacttcccctatatctacggagtagccctcttaagttacagaagttcaagatttagaaagaaataaagacggatcggccgaa

SEQ ID NO: 317 - DNA, 531 bp, Homo sapiens
gaggaactcagccatcccggttaccggtggcaggatgatttcctttcatcccaacctttatttccacagtgaaatcatcatgaaggagcactgtgttggcatcctcggctacagggtgtctcattccactgcagtccagcggttctgggatcacgaaggtcaagcctccagctgcaggcagtacacctcctacctgagctcattcagctgtttggctgaacatgactgcccgggttttggcaggattgctgagatatgggagttagcctgtgagcatgttttcgaatatggattttttttttacttatcaattttgggtgtgtgtgtgtgtgtgtgtgtgtgtgtgtgtgtttgtttcttttcagttggagtctcactgtgtcatccaggctgcagtcaagtggcaaactctcagatcactgcaacctctccctccagcttcaaaggattcctctgcctgctgatgctgcttttcccccacatgaggagaacatgcagacagttataataaattccgatgtcgtcctgaag

SEQ ID NO: 318 - DNA, 153 bp, Homo sapiens
atggggacgctgaggcccagggaggagcagtgacctgctatatcacaaaccttgttaaggtgccagatcagcagaaaggcctgaaggttctccccacatactcctgttcccactccccttttccttttgtgacttatccccaataaaccccga

SEQ ID NO: 319 - DNA, 830 bp, Homo sapiens
ctcctggacatcaatgaataacctaacaaccttgggaataagcaagcatgaggaattgaggaatatggcccaaaagttgagagtaagactcagagtcaacccacccatctccaagtatagatgtgcaatttaccatcagattatgggaactcagagaggcagccacattcaaaaaaatcttgaagttggaaggaggacaacctgatattttacttcattctctattcaagactaaatttatctgctttaaaaaatccatctggcttttgtgttatggaagcccacacaagcctgcaccaaccgttctagaagcaccaaagagttatcaaatggagtaagtttcaaatgaagggacagcaagttaattaaggcctgagtttcttaataaggaatgaagcacagtggagacttgaatgatgccaaaacacatgaaagtttcaaagactaaaacagtttgtgaggaagaaaaaaagaagaagtgacttggacaattttttaggttctacccccaaaataaatatatctattcccatttgtatcaacagacaaatgtaaatatcactcaaagaatctcaaactaacattaacatgagaatgaaatataaataattctgaatgtaaagcctaagtataaaacatagtataaaaaatgtaaatataataaaactaggaataacaacattgcattacgttgattgttaagagattgtcactggttttcttcagaaactttaggcagattttcctcttctatactattcttgacaaagtataatttctttcaaccaatggatgaacaacgtccaataaagtgaaacctttctgcaaaa

SEQ ID NO: 320 - DNA, 457 bp, Homo sapiens
ctctgtcgcccaatttggagagcactggcatgatcatgtcttattgcagcctcaacctccaggtcaggcagttctcctgcctcaaccacaggcacacatgaccacatctggctaattgtgttgttagtataattgagaaaagacaaatgtatgtatggtggccacggtggcctaatccttccggcttggccttttagagagggatgtgtgtgttggagactctgactggacgtcctgatcatatgtgtggtattgaggcgagtatcccaaggtgtggaagtcctgtcgcatgaatctatccgttgcgtttagggtgggggggggaagggtctattatgtcgcatgcagtggataaaagcaagagccccagtatggagcttatatgttatagctgtgattgggtttggttttagctgattgtggttgtacgtagtcgtcttgggccgtgagagcccag

SEQ ID NO: 321 - DNA, 486 bp, Homo sapiens
acaaggtattcctctgtcgcccaatttggagagcactggcatgatcatgtcttattgcagcctcaacctccaggtcaggcagttctcctgcctcagcctcccaagtagctgggaccacaggcacacatcaccacatctggctaatttttgtattagtataattggtagagacagagtctctctatgttgcccaggctggccttgaactcttgagctcaagcaatcctcccggccttggcctcttggtgccggaactattatatgtgagaaactgaactcaactaccggaggttgtattttaagaataaaacaatcaaacccggagccgaccgtttccctttaaggaaggttaaataatgatccttggttcacggactggctgggcccggacgaaaagctgccacgagccgttatcagttatttgaagggggtgattcggtgaatcacaagaaccggggggataagcagggaaaaaaacactgaacc

SEQ ID NO: 322 - DNA, 354 bp, Homo sapiens
ttctagcatcaaggcacaggcaggtggcaggtttgattgtctggtgaaggctgccctctgcttccaagatggacccttgttgttgcaacactgtgttctcagatggctgaaagcagaaggaacctcaggccaagtgttcttgacagctcatccacagactcccactgatggcttctgttattttatttcagaattttttcctgcagtggcatgccagtaccagctgaggatcatgtatgcaatatttgcctaggatggctttaattctcttcgaggagaatttattttagtttttcccagtaagagaatccacttctcttgcccatattcataaattatcacaataaatatgga

SEQ ID NO: 323 - DNA, 439 bp, Homo sapiens
ttctagaagctgagaagtccaacatcaaggcacaggcaggtggcaggtttgattgtctggtgaaggctgccctctgcttccaagatggacccttgttgttgcattttctggaaaaaaggaacactgtgttctcagatggctgaaagcagaaggaacctcaggccaagtgttcttgacagctcatccacagactcccactggtaaagcagcatgaggatggcttctgttattttatttcagaattttttcctgcagtggcatgccagtaccagctgaggatcatgtatgcaatatttgccttctttcatcttctacctaggatggctttaattctcttcgaggagaatttattttagtttttcccagtaagagaatccacttctcttgcccatattcataaattatcattaaaaattaaacttggtacaataaatatgga

SEQ ID NO: 324 - DNA, 725 bp, Homo sapiens
  misc_feature (1)...(725): n = A,T,C or G
gtttacgtcaaggcaatgggcggccccaagtcgttagctgcgagacgctggtcttgattatttcaccgctacagaacacaataagaaactggaggctcatgttgcccggatgcagaaagaatctgaggaggtggtgcaggagtgtcaaaatgcacaaaagaaggtgaggcggcgcacttgtcagaagaactgaagaagaagcaagacaccgttgcccacttggaaaggacacgagaaaatatggcaccatagcaggcttgctgaagctgaacagatggccctgagggggagtagaaagcaaatccagaaactagaatgcagggtttgggacgggcaaatccgtttcattgcagaggcctaaaggggagccccagatacttgacccaatcctcaaccacgtgccctataatacaagagaanaatgcacagccaaacggatgacctacttcataaagtccaccatctctaatctgcattcgaagttgctcaacaccaagtcattcattgccttgtccacttctagatcaactaaataatttggcacacgtgggnnataactcagatcattaacgttaaataaaatgagaaagataggcaagacgcttcaacaacaaatccagggcctaaacaagtaaaggcgctggattcatagacaaaactccctagtgttttaaaacatttttnccaagcttgtcaaacggtctatatacctattcatcatcgac

SEQ ID NO: 325 - DNA, 758 bp, Homo sapiens
  misc_feature (1)...(758): n = A,T,C or G
aacacaagcctcctcagccagaagaagaaactggaggctgatgttgcccggattgctttatgaagctgaagaggtggtcgcatggagtggtcaaaatgccagaagagaaggccaagaaggcagccattgaggcagcaaacttgtcagaagaactgaagaagaagcaagacaccattgcccacttgngaaaggcacaagtagaaaatatggagcagacaattacagacttacagaaaaggctggctgaagctgaacagatggccctgatggggagtagaaagcaaatccagaaactagaatccagggttcgtgaactggaaggtgaactggagggtgaaatccgtcgcagtgcagaggcccagaggggagcccgcagacttgagcgatgcatgaaagagctgacctatcaggcgtaggatgacatgaaggatctgatcaggatgcaaactcaaatggataaacttgagctaaaagtgcagagttgctagccccttgtctttagtggtgggaaacacaagcccaatccttgccttttccaagtgtgacaaaacagggacgtggagtggtattgaagtgtactgcaaaggtctatgggtgttcttaattttggtatagcgtatgacctcacgatgttagccttctaaaatattgtggaacaaggtctcatgcaacaatgaaagtgccccttgctgtgacgagggacaacgtggggctggaagtgcaaggcgaagagcctcaaattatgaacaccaaaaatt

SEQ ID NO: 326 - DNA, 243 bp, Homo sapiens
ctcaccagaaaatgatatctgagcaaagacctaaagaagaagcagcgagctatggggatatgtgcaggaagagtattccagacaggaccctgtggtgggagcatcctggcttgctcatggggcatcaaggaggccagtccacctgcagcagagtcaggacagggctttggctttgtagaaacagtaaaacacccagaataaaacactttataatctggaaatcattaataaaataaatacgga

SEQ ID NO: 327 - DNA, 357 bp, Homo sapiens
acaattatgatatcttactcttggaacattcatgcctttgctgccgagaagaaaactatgaactcagagacattgtacttgactgtcctgatggcagtacaatcccttaccaatacaagcatatcacgacctgctcttgtttagacatatgccaactatatacgaccttcatgtacagttaatgctgacatcaccttcccagttttaacaggcctggtatttattttataagtgaggaaaaataatcatttaaaaagtgagaataaactaaacaatgtgagaataactcaaaacaatgagttctcattgtgaggaattttgttctcttgttgactggatctgaaaaataaacaccga

SEQ ID NO: 328 - DNA, 660 bp, Homo sapiens
  misc_feature (1)...(660): n = A,T,C or G
acaaacgcccaaagaagagtgaaagcgaacccatcatggtgaacagagatcaggaggaaaagcctgggatcatcaatcaatctccagttcatcgcagcaatcatgtgaaggaaaggattcatgactctaacaatgtgccttcagaagcctgatcacacaatcaagtggctctaattctgttctgtttatctaaatgagcagaagtgttgaaaaagatacaaacaagagaaaaaacactgtgctcagaatattttgtatttgtcggagtgacctgctgtattgaaatgggactggcttgagggagggggttgctgaaaagagaggagaatgtggaggatgaaagtgagacanacacgaatttcaacctgttggataaaaacaatagcaaatgaggcactgaatatgcatgagggcaggaaggtattttaaagtttttcaagagacagcctcctaacacattggctctgtccaattcaattagcttgatttgggctgagttgtccacctcccctgcacttgaaggtccacaggttccacccattcttaaggcttaatactaaattaaaatgttttcccttggtgaaagctacctttatccttggaacaacatacctttcttaacaaaataaactggatgccgccccttccctttatgaaggg

SEQ ID NO: 329 - DNA, 819 bp, Homo sapiens
acaaacgcccaacttgcctggaacatcaagaagagtgaaagcgaacccatcatggtgaacagagatcaggaggaaaagcctgggatcatcaatcaatctccagttcatcccaaacctactcaagacgcagcaatcatgtgaaggaaaggattcctgactctaacaatgtgccttcagaagcctgatcacacaatcaagtggctctaattccccagggcaaacatacctgttctgtttatctaaatgagcagaagtgttgaaaaagatacaaacaagagaaaaaacactgtgctcagaatattttgtatttgtcaatgtgcagttggcattggagtgacctgctgtattgaaatgggactggcttgagggagggggttgctgaaaagagaggagaatgtggaggatgaaagtgagacagacaactcagaatttttcccttttgaatttcaacctgttggataaaaacaatagcaaatgaggcactgaatatgcatgaggcagggaaggtattttaagtttttcaggagacagctcgctgaacagaattgctaattatgtctcacattgctctgtccaattcagttagcttgattatggctgagttgtcaactcccctgcacttgaggttccacagttgcagcccattctaaggcttaatactaaattagaattatatttttcccccaaaaaaaaatgttttcccttgctgaagtgctagctttatccattgtgacaacataactttctcaacaaaaataaaatggttgcggccaagcttccttttttttttcttttgtcgttacgcttaagcatgtgttc

SEQ ID NO: 330 - DNA, 646 bp, Homo sapiens
actactaaggttctgtaaatggagcgcacccaggatatgaacctgaatgagctggggtactttttttggggaagccttccagaaccgagcccatggctacctgaagattgcggagacgggatagctccataagcagaaggtcttccatggaagagaacgtgttcatgctggggacatatgactaccaggaggccctggacgtgttcctgaactatggaggagaaaacaacactgtgctcgctcgccgattagggcctgaatgagattaccctacaggttcaaaatccgtcgaaattaagagcctagccagcttattattcctccacctgcaccgactcggccaaacgggagtccacccgtagatcactccgatgaagaagaagtttaagtggacactgccctggcctcatccacactggcagagaggccactcccgatgggtggggaggacatgggcggtagaatggccactttgacatcctgttatagctgtgtgcaaaattccccctggaaagcgcaggtgggtaacaaaggggcttgagttaccctgaatcaacaacagctaaatacaggcgggaggggggcgattcttgtgggaaggtcattcaaagtccaggcacctgcatcattgacgccgaggtgaaag

SEQ ID NO: 331 - DNA, 684 bp, Homo sapiens
actacatgcaaagcacgcccagatggttactgcaaatggagcacacccaagatatgaagctgaaggagcggcatacgatttgagaggaagccttccagaaggacatggagcagtacctaggccgctgcctatcctgcagattggagagaggggagtagcccataagcagaaggtcatccgtggaagagaacgtggacatgcaggagcagaaggacctgatggacatatgactaccaggaggccctggacgtcttcctgaactctggacgagaagagaacactgggctgccccccgacttagggcctgattccggtacctgttacaatgagattaccctccaggatacacatccatgagaattaagagccaagccagcttataatagctccacctgcaccgactcggccacccgggacatcagtgagggcggggagcccaccggagatcagtccgacgaggaggaagttaaagtggacactggcctgaccacatcacacactgacagaaaagccactccggatggggaagaggacagcgacatatagattgggacatgggcgaagtttgaccacactgcaatgcaaatatggttgtgtgcgggaactccaccttgaaaagccgggcgggaactaataagggtggtggagaccctacaccagtgccacatgggggaagagcaacct

SEQ ID NO: 332 - DNA, 720 bp, Homo sapiens
aggatgaaagagagggggagagaagtgctgactgcaacactctcttattatcacaccgctcagggtcttggtgacataatcacagctcactgcatcctcagactcctgggctcaagcaatcctcccatctcagtcttccaagtaattaggaatctgttctcaagctgctgatgaagacataccctagactgggcaatttgcaaaagaaagaggtttaatggactctcagttccacaccatggcagcagacgagaggagaatgagagccaagtgaaaggggtttccccttataaaaccaccagatctcaggagtcttattatgggggaagctgccacccccatgattcaattatctctcaccgggtccctcccacaatatgagggaattatgggagctacaatttatgaggggacacaggcaaaccatattcagtgtgccaccccactcagctaatttttttattatttttagaaacatggtctcactatgtagcccaagctggactgcctacattttgagcctgcaagagactaaggattcaaggcttgagccattacacccgagtcaagagagactttatgttttaaatgtgcccactgaatgatttgagtgtgaacttgattcgtggcgcagaatgagagctgtcccagtgccggcacgttaccctagataagggataataagtatgagcttagtcgatagctgaggtgagacgaaag

SEQ ID NO: 333 - DNA, 698 bp, Homo sapiens
cttgatcaggctggagtgcagtgacataatcacagctcactgcatcctcagactcctgggctcaagcaatcctcccatctcagtcttccaagtaattaggactagaagtgtgtattagtctgttctcaagctgctgatgaagacataccctagactgggcaatttgcaaaagaaagaggtttaatggactcacagttccacgtgactgcggatgcctcaccatggcagcagacgagaggagaatgagagccaagtgaaaggggtttccccttataaaaccaccagatctcaggagtcttattcactaccacgacaacagtatgggggaagctgccacccccatgattcaattatctctcaccgggtccctcccacaatatgagggaattatgggagctacaatttatgagatttatgagatttgggtggggacacagccaaaccatatcagtgtgccaccacactcagctaatttttttattatttttagaaacatggtctcactatgttgcccaggctggtctgcactccagggttccagtgatcctcccatcttggccttccaaacactaggattacaggcatgagccatcacacccagcccagaaaacattatcttctagatatgcacactgaaataattgatataaaaagtatgatatttggggattgcttcataataatttaacaaaaataaa

SEQ ID NO: 334 - DNA, 545 bp, Homo sapiens
  misc_feature (1)...(545): n = A,T,C or G
tcaggccactctactgtagggctgctgcggtttcctgagggtctgctccagactccagttgcctcagttttccttgtacttggagattcaccagtgaagtctttgaagaagcaaagatggcagcctgctctttcctctggaatctccatcccaggaggctctgcgtatcagactctggtggcgcagactcatgaggggatttcctgatccatgggttgcaaagatctgtggaagaggctggtttatcagggttgagctaagaatgagtctcagactttgagattacttttaaaatagaaatgaagatcaagaaaggctacatttggcaaaagtgcatggaagaaggtagagaaatatgacacagtatctgaagtctggtcagctttgtaactatctccttctgagtgacatcttgcgtttcatcagccatgagtctgaagatcagcctccatggaagaatgcccgaggcaagagtttgcaggggtgtgtggaggtagtgagagttggctttatagatttgaatggatattgagagcaaaanatag

SEQ ID NO: 335 - DNA, 707 bp, Homo sapiens
  misc_feature (1)...(707): n = A,T,C or G
gaaagtgaagaaagaaaaaggagaagaagaagaatcttccagatgtgtttcagccactgcagaggagaatcttccagatgcgtttcagccactgcattacagggaacaccacttctacttgaaagaacaactgacagaaatgaagtttcaccacatttgggcatttggcagacttcctcaaaaatgaatgaagtgagccagtcacttcgggaaaacaacggacagtagctattgccagtagcaaactcaagctttcaaggattaagtagaaatttggagaacttatctatcaagcaaagtttcacagtttccgaatacttgaatgtgatatgtcttatattagataataaattatgccaatgtttggaagatttatatgtcagaaaatcaatattctccaaatgaccaatgcatgatgctataaaatcattggtgagtaaaatatttattcgaagtgcaagacagattagtgccttttcattaaaaaagagtacaaaagtgtattcatatcgtttcagattacacatcacaagaaactttaaaaatccatttgtaaagctttcgggtcgtatgaagaacaaaggatatccatagttatctgcaaaggctttttcaaccattatccatatctctgtgaggcttgccatttttttcatataccttanacaaaacatgaattgtgatatattgaatgaaaaagctgacat

SEQ ID NO: 336 - DNA, 475 bp, Homo sapiens
aaggcaacaacctcatctggtaccgtatgcaagtaacaaccatcagcaacaagcaatccagggcagtccagcaaggcgtcaggaacagccagaggaaaccttggccggatgggactcactgcaaaacggcacctggctccccactgaagctagactttcgggtgtaatggtgaaacaattcccaagcaaggcaaaaagagaaccacagacggtcagatgttgacaaaggcctcactcaggagaccatctgacaacgaatgaattagaagactactatgatagcctgaccaacatcacaggccacaggttcaatgcctccacccacatatctttctctcttaaattaatactttcccacctttcctactaaaatgttccaggaaggagaggaaatactcattggtgctgaaactgcttcttttaattgttaaataaagtctcatttgcacaccaaaaaaaaaggtgatcggcctga

SEQ ID NO: 337 - DNA, 825 bp, Homo sapiens
tagagacggggtttcaccgtgttagccaggatggtctcgatctcctgacctcatgatctgcccgcctcggcctcccaaagtgctgggattacagacgtgagccaccgctccttgtggaataaagcatcagttttgatacgccaaagctatctttgaatcctgtcctcacttcttaacagcactgtgacatgggaaaagtagagggtggatttctgcaagcaatgtgcaaagaaacttgaaacaacaacaagataacccaggacagcccttacctcacagtggggaggagtgagcaacaaagacaacaacaacaaaaaacagctcatcatcttgttattaattgcaactctggtgccttggatatgcctgattgaagacaagggacttgaaggccagcctataaacatgctatattctcatggaaaacccaatactttaatggctgtatttttgtggtttattattttattgatctcaaaggaaaacctgcagcaaaaaaagttggtgcattttcttctattatggaaaatttctccagttgcagaaataaagtcccaacctccccagtcacccggtttcagattgtacacattgattccttaacaaaaaagcaccattatatggtacaataaaagtgaatttttaaagatttatatttttgtggttctttttaaaatccaccagaaaaattctggtagaaaataatcagtggggaatgaatcattatctatattttttcacagtgggtaagacactgatgcaacagagatttctggatgtaatgtctccaagcataataaagttgccaataagaacttttcatga

SEQ ID NO: 338 - DNA, 404 bp, Homo sapiens
  misc_feature (1)...(404): n = A,T,C or G
ccatcaaattccaaacaggcaaccagagcctctgaagatggccccttcttctggggatcctcacataggcctcggaggaagctctgactgccgtttccccaaaacagcgcccccgtctgcagaaagtggttaagattggtcttagtccttatccttaatctaacgggagttagatatacttctttagacgggggaatgagacagccatggagaaactccaaccagcctgtctactgaggtggagcctgggaagttcgagccctttgcagtagggaggagctggccttgcctctattcngacgtcgggcgggaagtgctctagcaggggactctggacttgcggaggacccctgttccccccctcatttttccctgtttcacacaatcctttaaaaaaaaaaaaa

SEQ ID NO: 339 - DNA, 393 bp, Homo sapiens
aaaagtagagggtggatttctgcaagcaatgtgcaaagaaacttgaaacaacaacaagataacccaggacagcccttacctcacagtggggaggagtgagcaacaaagacgacaacaacaaaaaacagctcatcatcttgttattaattgcaactctggtgccttggatatgcctgattgaagacaagggacttgaaggccagccttcatggaaaacccaatactttaatggctgtatttttgtggtttattattttattgatctcaaaggaaaacctgcagcaaaaaaagattatggaaaatttctccagttgcagaaataaagtcccaacctccccagtcacccggtttcagattgtacacattgattccttaacaaaaaataaaagctga

SEQ ID NO: 340 - DNA, 697 bp, Homo sapiens
  misc_feature (1)...(697): n = A,T,C or G
cagtatatagattaagaaatgtaagagtttatagtcttcgaatcagtgtacctagaatttccttgctccaccactcatgttgggaaaattaagggcactttcttcaactaggagacctttgccagagcatgtgaagaccttcttggcaaacaccagccatgctcacttctcaccatcccccagtgccacctactctctgctcaacactctccatgcccctcccagagccattgatcccgttccaccagaagatcacatcttagaaatgccccagacatcgttggacatttcttcatgcttcatgagcttcaaaatcttttaaaaatttaatgcgcttatgaatctctaacaagctcctaaataacttgtatgccattgttaaaaactccaaatattaataagtattagtaaaatgttgctgttaatagtaaatcagctaagcgtcaaaatgctacctggaaaagcaagcagaatagacattccaatgttaaagggcatcaagagcaagactcttaaagagcctatgaaatcatttaagtgtgagataaaaaggttgggaatttcatacatatttagcattgcctgagaaatgtctctaagtttttcctttttcactctagaatattaccaaagctgcagttaattacatttctgctgctacaaaaacacntttttcatgcctcagtgattcatgaat

SEQ ID NO: 341 - DNA, 626 bp, Homo sapiens
agctgcaactgatgactatcaccctcccagttctcttggatattattgaaggatcatttccgtcttggaaataaagcaagatggctgtaatgtggccctggctggaatgaagcacagttgcaaccttctctctcgtgttcttgaaggattcaaagtgccttgcagtcagacgttctccttgagtcctactctgcaaccaagcctttccgagtggctgctctcttgtatactggggaagggaggatgatgttgcacacatgaggagcaacaaagcacaagacaagcacacagagcacaagttgctgaaaagggcacagacggcacagcacattctgcccaattagaaagagaaaaatggaataccctcctgacgtcagtgggcaagaggggacaaagcaataaagggccgtgcggcccctcccctttaatgagggactgactcccttgactcggtagttcaggctgggggagccgtgtcggctgacctcaaaggggaatatcggatttccccagaataggggttaccccaagaaacaaaacgcgaggaccataaaacggccatgtaggggcttttatctaagcccccgcccctgtaggtctacacgaagtgtccgtgatggtaagtt

SEQ ID NO: 342 - DNA, 496 bp, Homo sapiens
agctgcctgcggattcccaaagaactgatgactatgaccctcccaattctcttgggtattattgaaggatcatttccgtcttggaaataaagcaagatggctgccctgcaggaaagtcataatgtggccctggctggaatgaagcacaggtgcaaccttctctctcgtgttcttgaaggattcaaagtgccttgcagtctgagaaagagccagagagacgttctccttgagtcctactctgcaagcaagcctttccgagtggctgctctcttgtatactggggaagggaggatgatgttaaccaaaaggacccagcagcagacatgaggagcaacaaagcacaagacaagcacacagagcacaaggtgctgagaagggcacagacggcacagcacattctgcccaagctggagagacaaacatgattagaaagagatagaatggaatacactccagacggcagcgggcaggaagggacaaagcaataaagggcgga

SEQ ID NO: 343 - DNA, 824 bp, Homo sapiens
tcttgctccgtctcccaggctggagtgcagtggcaccatcttggctcattgcaacctctacctcccgggttcaagcgattctcctgcctcagtcttccaagtagctgaaattacaggtgtgtgccaccatgcccagctatttttctgcatttttagtagagacagggtttcaccatgttggtcaggctgatcttgaaattctgacttcaaatcatccgcctgcctcagcctccgaaagtgcttggattacaggcatgagccaccgaacccggccgactatgacattctttttcttaggaatgtgcaatctgaactcagttgctgttagtttcctttagtagctagaactaaactgacttaaatttaagagttaaggggcaagaatgcatatgggggagaagctgcagatccagccagtagagagaaaagaataaggcaaagaagcacagagagtagaaaagaaaaataatgttgcagactcaacaaaatggtgagaaaataattcttagaatcctggcagcttttagtccctgatctaaacattcctggcttatagttattgcagtcttgggatactgcaagataccagttgccttctagcataatcaatggttttgtttaaactagtagatttaagtacaatagtaatgaatatcctattaagctgaatttattgcaagaatttttttcaaatttgtatactttttgttacttgaaataataaaaattaaacttctataactatcatgtgataattatggaaaattatatatgctatatgtaatatatttggacaaaattataaatctgtaaataaaactcga

SEQ ID NO: 344 - DNA, 209 bp, Homo sapiens
  misc_feature (1)...(209): n = A,T,C or G
tagtgctgaaacantctcttaattttccaccgctacacataaggagacctgggcaactttgagtgacaccgatgggagagaaaatttcaaaactactcggccatggtggatgatgcagcacaaggcctcttgtgaatgcttgtaagccatcttataccagatgcaggcctgttgaccttggactccccagcctccaaaactaataaatg

SEQ ID NO: 345 - DNA, 206 bp, Homo sapiens
ataaggaggatcggttgagaccagcctgggcaacaagagtgacacccatgtcataaaaaattttaaaactactcggtcatggtggatgatgcagaacaaggccttgtgtcaaagggccttattgttgaatgcttgtaagccatcttataccagatgcaggcctgttgaccttggactccccagcctccaaaactaatgaatgcaca

SEQ ID NO: 346 - DNA, 296 bp, Homo sapiens
cttctggatcaaggtgctatcagggttggtttcggctgtggcctctcttcctggcttgtagacagctatcttctcgcagtgtcctgtgaaggtacgatgaagaaaaatgagagaggtgattcaagctgaggtaggctaggcatttccaattgacagctataaccttgagaagtatcctgttacagatatagtgccgaatgtttcttgcctgaagacgtactcagggattatgtggttcactctgaggcattaaatcatggatcttcagaataaagcactacaaaaataaaaactga

SEQ ID NO: 347 - DNA, 259 bp, Homo sapiens
agatgattcttcacaaccagaaactgaatgctcacacctaagactggaactatttgcagactcaacattgggaaataatcttcacatggaactttccccctgcttccacaaggatctgcaaataattacagcagcacagaaatgtctatgctttttttcagaattgagaaagctttttaccatctccatttattctcccttgtgatagaactctactgatcattaaaaattaacaagccacccagtaaaaaaaaaaaaa

SEQ ID NO: 348 - DNA, 443 bp, Homo sapiens
aaaaagagatgtacgtggaataacggacatacttcaggaaaattcttatggatactacaacaggatgaaacttagcaggacatggttctcactttgtcacccaggctggagtacagtggtgtgatttcagctcactgcaacctcaacctcctggatcaagtgattcttccacctcagctttctgagtaactgagaccacagaccctgctctcaatggataagtggacaccacccagaccagtaatctgactcaaccagttctgtgatctcacccaggaacagaagacagcaagaaaacctcacttcaactcccactatgattccatccccaacctgaccaatcagcactccccacttcctgaacccctattcaccaaattatctttaaaaactccaatccctgaatgcttggggagactgatttgagtaataataaaccccga

SEQ ID NO: 349 - DNA, 448 bp, Homo sapiens
agctgaaagtttttgcccttctcagaatgactacacttaaagtgagcttcctcaccaccaagtaccaaaacaaatggtgggcctggaaaggaacgtgaaacaagcataaaccgaatgtgatggcagagctgtcacaccttgtggacatcgattacatttccactgactgttctggatcatgcctgtgctgctcccagaagacccagatccaccagaaagaaatgcattccttccacacaggcagcctttcctgaggagaagtcacatgagtagaaaatgatgaagagacctgcctctttcataggaaggtaaagttacacgtccaccatacagtcagctatacaagggcaccgtattcacagaactatgctggaaaagcatttgtgggataactaagtttggatcaataaatgaacatgcggccgtttccctttagagagggttaatt

SEQ ID NO: 350 - DNA, 503 bp, Homo sapiens
actgaagttgaaaagtagaagcccttttgcccttctcagaatgactacacttaaagtgagcttcctcaccaccatagtaccagcaacaaatggtgggcctggaaaggcaattctgctctgaggaacgtgaaacaagcataaaccgaatgtgatggcagagctgacacaccttgtggccatcgattacatttcctctgactgttctatcactctccagaagggagatcatgcctgtgctgctcccagaagacccagatccaccgaaagaaatgcaatccttacccacaggcagcctttcctgaggagaataaggagcttctctaattgccacatgagtagaaaatgttgaagagacctgcctctttcagaggaagggaaagtctcacgtccacgcatacatgtcgatctacgagtgcaagcctgcctgattcaccaaccgtattcacagaactatgctggaaaagcgatcgggggataactaattttggatcattaactgaaga

SEQ ID NO: 351 - DNA, 224 bp, Homo sapiens
ttccatgaaaccaactggtccagaatcgaaggactccttcacagagacaaatccatctccttcaaatacccagattctattggttgaaagactgagcattttacctaaagggattttaaaaaatcaccacaatggactattatcacaacttggattcaaaatttatggattaaaaggtggacttggaagaaaagaggagtttgggagctaataataaaccacga

SEQ ID NO: 352 - DNA, 498 bp, Homo sapiens
atgtgacagaactttccatgaaaccaactggtccagaatcgaaggactccttcacagagacaaatccatctccttcaaatacccagattctattggtgagggaaaggcaacatttgaaagactgaccattttacctaaagggattttgaaaaatcaccccaatgggactattatcacaccttgggttcaaaattgatggatttcccttcctcttgctacccaggaagtggacttggtaagataagaggagtttgggagcttagaataaaccacgatgcgggcgcttccctttggggaggggtaattaatgatgcctggcttactgactccgctgggctcggacacactgaattacgacatcggtttacgatgcacttcaaagccgggtgtacgtctgttcccagggttgaggggattacacagggagaaaactggtaggctaaaaggccatttgaaggcgccgtgaacctattaaaggacccggttgtttgatatttt

SEQ ID NO: 353 - DNA, 393 bp, Homo sapiens
aaattgactaagatgtgacagatggtttgacttttcagtgcaacatctataaaagctaacatgggatggatgtgatgcagaactgtaccgccttctaacagcaagcaatgttcatccatggatacatgaattaattgggaaagaattctcatctgtttcattaagtgatgcattcccaaaacaattttaataattttaataatgattttaatgaatttgttgttttgatcagtttatatatatattatgtgacagagaggtatgacagaataatcaataaaagacatcaagaaaaaatcaatattacaataaaattgtgtggaaaagtagaaaaaataaacatagaaggaaaaacacaggcgaaaaaaaaaaaatataaaaaataaaggcgga

SEQ ID NO: 354 - DNA, 330 bp, Homo sapiens
ccgcactgttccacgctcttttatgtgctggcttatttagtaaatgtgagtgagagactctgaataataagagtcacgttatattaaggcagtcaatgcaggtgaaacaaaaaaaggaaagatcacttcggctgactggagaaatcaagagaggcttcatggggaggcgggaccacactggtcctagtgcagtctgggaagagtgttccagaagcagaagcaggcacacctgggcagggctacagtgagtttgctgaaggtcacacatctgtgctttggagggcagagctgcagggccacaggtatattcaatgtagtgggttctggcat

SEQ ID NO: 355 - DNA, 544 bp, Homo sapiens
aatttgtagctatacatttcctctgaacacttcttttgctgcatcccataagttttggagatcaaaatgtttctacctctgaagattagaactataaggaccttttccccccacttcacctcaggaagctctctttgtccttactgaaggtgacgtggagtgaatcaactcttctttcatcttggaagtaatatcttgacatgctgcaaaccaatgaaccatcagaaacttcaccgaggtttcaaacacttgtactatgtgcactacaactatggacagagtgactactggcagaaatgaacccatgtgagaattctgggatcgaagagaacaaggagctaaaggaagtcagttggatgatgtaggagggaggctcctgtttttctgacatcactgccagatgaagcaccaaataattagaaagctttcactccatttgccttggatagatttaaaggctaggcacagtcatttgtgttagttaaaatctctgaaaccttaaaaataaataaataaataaataaaatcaaaaaaaaaaaaaaaa

SEQ ID NO: 356 - DNA, 854 bp, Homo sapiens
  misc_feature (1)...(854): n = A,T,C or G
ccaatgaaccacagaataaactggtcagtgcagcttcttcttgtgcaaagtcacgcccactctgtgggtgggaaatagacagaggctggcgttcacttgctcagatgctcttgaacttgcctagtgccgagatgaccaggactgaatggcccactcaactggaagactgtgagctatatggggcaggggacctgtccgccagcttccatcccctgcaacaggaaggtgcccacagtaactatggaccacacaaaaggcctgaaggcaggagacagtgttacgactccttgatgtggtctcgagctttaatattttcagaaatatacatttgacaaatttgcaaaaaccatcatttggaaggtcattgtttgtggtacatttgcttggttttgtggattttgaataacacacttaattttaatttttgactcaatctttttgattgaagatgttgtttacttaaaaattaaaatgaaaaaagaaagaaggaaagaatggggtcctttttaaaaaagacagttacttgaataaaggcattttcaaaataaaaaaagtaatatttttcttcaaaatttatacaatgcaatcagagagaatggatatgtaaataaactctcaaataatgttcttggggtattaaagctggagaccgcaggattacttttgggacatccccgntgtgcggctctcatgtcccggagtttgaaaaaaactgatcggacgcttcctatatgagggttaatcttgatccttgtaatgactgggtggctcggtcttccgctgcggcagtggtttaagtgtttaaggcggtattcgggttacctaatcctggatactccagaaatatttggcat

SEQ ID NO: 357 - DNA, 768 bp, Homo sapiens
gatggttgatgaaggaaatcattgctcattcctgcacactgaaccgtgaaaaacaagtatagcacaatgttatgctcaccatggagtctgaataatttgatgaagatgatatggtgaaaagcaataaaatagacttcgtgaatcttagaaaaatgtacgtctctctctttcccctgcctcgtgtacaaacacaactacgaacacatatacttctgttaagtcatttgtaccctaacctaatcccaaaaaggataagcagtgacatatttgtaaaatgcataaatatagcaactgttacaacaaaataatgaataaaaataaattctaaaaggaaaaaccagtgaatgaacatacacaggaaatcctacctgaggaacattgctgtgattgggccaagttctagttcaccatttcctaacagccgaagcagagacaacatgatggattacagagccatcattttctatgaacagaaagcacaccagttcatcaacaaagataaactttcctatccctgagttcgaagaagaatttgtcaaaatgatctttatgtaagggacagggagctccataatgtcccccatagcaattttacaagcaatatagatacgttccacatggctattcctcatattgctctgacactgaagccaagcacattaaaaattgtagttctataaaggcaacgtgggaaagaaagttggaaaatgaaaagagaaaggagaggttggaggaaagagaaaaccagatctgcatggttctgcacat

SEQ ID NO: 358 - DNA, 226 bp, Homo sapiens
gagtttctaatttagagaatgcaaaaccaaaaaagagaaagttattccggagatttatgtctgaaaataaaatatttgaataatcctctttggtagttcattggctgctcatcttccagctctccatgtgtagcttggctgctccgtggtcaaggtgacttgttagagatcattttagatctgtgaatctaggagacaataaaaaattagcagaaaaaaaaaaaaa

SEQ ID NO: 359 - DNA, 757 bp, Homo sapiens
  misc_feature (1)...(757): n = A,T,C or G
tgctaccttaagccgtgacctccttgtccctgcttcagggacagggatattgaagggtgcccaccttcaatatcgtgccttaagcatttctgtggctgcccacagttcatcatcagaatgcttcttttgttcacatttattattcttggtcctagatttggaaataaagaacggcacacaggaaaagacccccctgcagccccgtctttgatggctgcctggaccacctgcaggagaagcccctcagaagatgggtccctggaacctttgcgcaggtttgctgaacctcaggagttcactcagcacatcgttcgctctcagctgccccagcaggagctgcgcagaaccgccttggaggcgtgctcagaggacacttcctcacttttataatgaatcgtgagcactctctcctcgctttggccggcagagcctgcctttctggccacgtggacgtcttcatgcagggtcctgccggccccttgacatcaacaggcatgaagctgcagccatcctctcccctccccaagttttgggcaccaccatctcctagtctcttgagactggcccctggcttctcccgttaccccagcctcagtcccatccaatctgctccccattgagaagtccaaggggaccctcttctncggctcactggccccagcccacttcttgggctccatcccagccttttccttggcggtcccccaactactctccaatcctacgtgcaactgaatctttcaatccccctggccgg

SEQ ID NO: 360 - DNA, 704 bp, Homo sapiens
tacagtagagaaggggtttcaccgtggtctcaatctcctgacctcgtgatctgcccgcctcggcctcccaaagtgctgggattacaagcgtgacccaccgcgccccgcctggaaaactttcagtgatcacccaagatggcgtctgcctttgttgcccaggctggagtgcagtggtgccatttcggctcactgcaacctctgcctccagggttcaagggattcttctgccttagcctcctgattatgacttttttaaagttatagaatacacttaagaacaactggaagaaatttgaatatgtacctctatttgatgttactaaggaattgttgttaactccttacatatgataatggaatagtatggctgtaaatgaacatgtcctcattctttaggagatacatcctgaagcatcttgatgtctttcattgattttcacatagtttatttgaaaaatacaaacacatttatagctacattaagcaaatgtggcaaaagttaacagttattgaatttagatgttgggcatatggatgttcattgttcatttaaacatttcagtatttacaaatgtataatataaatttggaaacaaaagaaaaatgacatatgtgttttgtgtgtgtgattctatttgtgtatatgtatgtgagttaatctccagaaattcaataaaaatctttgtctcagaaaaaaaaaaaaa

SEQ ID NO: 361 - DNA, 382 bp, Homo sapiens
cttagatggactttcgctcttgttgcccaggctgacatgcaatggcgcgatctcggctcaccgcaacctccgcctcaccagtagctgggattatagtcctggaaatggcttcaaaacatgactgaaatctccttgaggagcataatgtggagggtgggccctaatccaatctgtcattataagaagaggaaatttggacacaaaaagagacaccaggggcgtatgtacacagagaaaagatcacgtgaggacacagagaggtctgcaaaccaagaagagaagcctcagaagaaacaaaaccagccaaccccttgatcttggacttgtagcttccagaattgtgaggaaataaatttctgttttaaagccaaaaaaaaaaaaa

SEQ ID NO: 362 - DNA, 770 bp, Homo sapiens
  misc_feature (1)...(770): n = A,T,C or G
gaaagtgaagaaagaaaaaggagaagaagaagaatcttccagatgtgtttcagccactgcagaggagaatcttccagatgcgtttcagccactgcattacagggaacaccacttctacttgaaagaacaactgacagaaatgaagtttcaccacatttgggcatttggcagacttcctcaaaaatgaatgaagtgagccagtcacttcgggaaaacaacggacagtagctattgccagtagcatactcaagctttcagggattaagtgaaaatgcggagaacttatgtatcaagcaagggtcacagttcccgaatactcgaatgtgatatgtcttatattagataattaattatgccaacggttggaatatttatatgtcagaaaatcaatattttccaaatgaccaatgcatgatgctatacaatcattggtgagtaaaatatttattcggagtgcaagacagattagtgccttttcattaaaaaagagtacaaaagtgtattcatatagaatcagattacacatcacaagaaactttaaaaatccatttgtaaagctttcgggtcgtatgaagaacaaaggatatccatagttatctgcaaaggctttttcaaccattatccatatctctgtgaggcttgccatttttttcatataccttaaacaaaacaatgaattgtgatatattgaatgaaaaagctgacatgaaaataatacccgatgcggccgtaacgncctctttcttcatcttataggataataaacaaca

SEQ ID NO: 363 - DNA, 287 bp, Homo sapiens
cctcgaccggtttgagaaataaagggacagagtacaaaagagagaaattttaaagctgggcatccgggggtgacatcacatgtcggtaggttccatgatgccccacaagccgcaaaaccagatgatgttctacaaacttcgagaatctagtggcatctaatatggaatgattcttccaggaagacgtttgtaatgctcactcaggaaatatcagtgaatacttcagaaagcttaatttctttacaacagaagctcgtatataaaatttaatttttaataaaacctga

SEQ ID NO: 364 - DNA, 484 bp, Homo sapiens
aaaaagagaacatcaaatggaattatgtacgtggaataacggacatacttcaggaaaattcttatggatactacaacaggatgaaacttagcaggacatggttctcactttgtcacccaggctggagtacagtggtgtgatttcagctcactgcaacctcaacctcctggatcaagtgattcttccacttcagctttctgagtaactgagaccacagaccctgctctcaatggataagtggacaccacccagaccagtaatctgactcaaccagttctgtgatctcacccaggaacagaagacagcaagaaaacctcacttcaactcccactatgattccatccccaacctgaccaatcagcactccccacttcctgaacccctattcaccaaattatctttaaaaactccaatccctgaatgcttggggagactgatttgagtaataataaatctccggtctcctgcaaaaaaaaaaaaaaaa

SEQ ID NO: 365 - DNA, 776 bp, Homo sapiens
cagtatatagattaagaaatgtaagagtttatagtcttcgaatcagtgtacctagaatttccttgctccaccactcatgttgggaaaattaagggcactttcttcaactaggagacctttgccagagcatgtgaagaccttcttggcaaacaccagccatgctcacttctcaccatcccccagtgccacctactctctgctcaacactctccatgcccctcccagagccattgatcccgttccaccagaagatcacatcttagaaatgccccagacatcgttggacatttcttcatgcttcatgagcttcaaaatcttttaaaaatttaatgcgcttatgaatctctaacaagctcctaaataacttgtatgctattgttaaaaactccaaatattaataagtattagtaaaatgttgctgttaatagtaaatcagctaagcgtcaaaatgctacctggaaaagcaagcagaatagacattccaatgttaaagggcatcaagagcaagactcttaaagagcctatgaaatcatttaagtgtgagataaaaaggttgggaatttcatacatatttagcattgcctgagaaatgtctctaagtttttcttttttcactctagaatattaccaaagctgcagttaattacatttctgctgctacaaaaacacttttttcatgcctcagtgattcatgaatcctccattgtgtgtattaggcagcagctcttgtagacaatgacagagaataaaatactgggcctcgttgggcctcagcg

SEQ ID NO: 366 - DNA, 217 bp, Homo sapiens
cgccccatctgcatttattaagatattagtctcctccctactccaacttctgccatccccttccatgcccaggctgtgatcctattcatcatctgagcctcagagtcacctgatggtgtgaacagaagcttcactctggagatagatggatgggacttcaaaattccatttccatgatcactgtggttcctaatcactctgcactttaatctccttg

SEQ ID NO: 367 - DNA, 217 bp, Homo sapiens
aagctgaactgacacgaaacaaaagaagtccgttgttttggattgagttccatacttggctggcccagaggttgatctcaccaccattcagatatccaagaagaagccacctgttggatttaagaaaacccagtaagatgttgctactacggttttttttgtatgtgtgtctctgcaggtagaaacctaattagccaataaaaccgatcggccggag

SEQ ID NO: 368 - DNA, 195 bp, Homo sapiens
gtatgacagtgctcatggtgtccttgataactggatgggtttagtgactttcggccgcatcggtatttattcatttattaatctcacagcaagaggctatcttggtgcattcaagaatgttgggaagtccaacagggaagtttcgtattccggtgattctcattctctctcttggggactggagtttattcaaag

SEQ ID NO: 369 - DNA, 576 bp, Homo sapiens
aggatgaggctgtcactactacagttgggactgtttcatactccgtgctcttgtgctatgccagggggtactgtctaacccacaagtctctgccaggaatgttgctgtccacactggagtgtaagacacctgcggagctcgtctatggggctcatgttggctgaggctctgaactacagaactgcaaacaaccaagggagcgccccaggccccaggtattcctaaaccttagatcagagccatttgcagcacagagttgtgtgctgtttcaaaaccacagaccctgtatatatgcccctccattgcagaggtggatgtcttggcaaatgtaggacgaggattgaaaattaaaaaacaaacacaccgtgttcagggtgaaaattacatacattgacaatactgtctcttttcctccacaatcttactgccaccaggcagcctcagtcagtccgtgcttatttcactgaaaatgtacttaatctcagaaaagctatctatatgtaagaacatattttgttaatcaattttatgaaaacaaaacccctctcaccttagttaataaagtgcgatcagccg

SEQ ID NO: 370 - DNA, 785 bp, Homo sapiens
  misc_feature (1)...(785): n = A,T,C or G
aacaggaagggattgtttagctgaaatggaagatttgatatctgaacaaggagttctaaataattctctgcaccttaatctgccaatactcactctaaaactacacaaaggagattcaaaataaaaagaggatgataaacggcaaaaccatctgagcacttctttaatttcttcttctaacaactgtgaagtggtcaaaaggcagaaatgaggaggaaagcaaaaaagaagaagccacagggtgtaggtaatccacaaacaatctaattggtccctgggtaattgctgactctcttcagcagccatgcaatggagatttccaggaaaatgtaaatactgtatttatatctgttcaaattttgttttcaagaataaaagtactaatcagatgggtttaagtatttgataagaatctctaatctatggctgttctctaaatatttggacattggcattgctttaccatgcaggtatatttttactcagctccccccgaacacaactttaactatagcactggaaactagattggcaactgtattctcctctcgcgccctatttctcttctctcttacgtattgtggttgttactcagttctgtcagtgacaagctatatacccttgttcaattattttaccatcatcaccccaccacggttttaatttcctaaatactaatatattacaacataaaggtgtttatgcattcttaaaaaaaaataaagggtgcaggtgcccggcggccccctccnncctccccanccccacccccgcaacgctccact

SEQ ID NO: 371 - DNA, 236 bp, Homo sapiens
ttcaggattcatgactacaaccccaaatacggcacttctgcctgtgtggaaacaacagaagcaggaagattactctcatttttctctggcctttttcccttgaagcagactataaagaagaatctgaccttcctctgaaggaaaccttcattccagacataccctccctactagtcactgccacagcaaaatatcaaataaatatctaggaatcaccctaaataaaaaaaaaaaaa

SEQ ID NO: 372 - DNA, 540 bp, Homo sapiens
cttggtggtcactctgtcacccaggctggaggacagtaccacgatcatgactcactgcagcctcaacctcctgggctcaagtgatcttcccaccgcagccccctgagtagctgggactacaggattcatgactacaaccccaaaatacggcacttctgcctgtgtgaaacaacagaagcaggaagattactctcatttttctctggcctttttcccttgaagcagactataaagaagaatctgaccttcctctgaaggaaaccttcattccagacataccctccctatatccaaagaacatctttatctttaaagacacagagatgtcaagaagaatctgaacaaacaggctttgccagatcccccagtttactaacattgaaccatactcttttgttcttcaatcatacttctgcatgatgtccataaaaatacactgttttccccattccttttgggtatttattcccgaaagcttctgtgtcatgtaaaacttacattaaataaatttgtatgcttttccttgtaaaaaaaaaaaaa

SEQ ID NO: 373 - DNA, 587 bp, Homo sapiens
ctaaagctgctctttgctgggtgtcattcctgtcactgtgaggacactggcaaaccaaagagattggcccttgtctttgggactcctagagttgaggacagataatgcataggaagaatcaggtttcttacttcctggtcacaaaatggctgccgaagtccataagctaaatcctaatgattcatgactacaaccccaaaatacggcacttctgcctgtgtggaaacaacagaagcaggaagattactctcatttttctctggcctttttcccttgaagcagactataaagaagaatctgaccttcctctgaaggaaaccttcattccagacataccctccctatatccaaagaacatctttatctttaaagacacagagatgtcaagaagaatctgaacaaacaggctttgccagatcccccagtttactaatattgaaccatactcttttgttcttcaatcatacttctgcatgatgtccataaaaatacacagttttccccattccttttgggtatttattcccgaaagcttctgtgtcatgtaaaacttacattaaataaatttgtatgcttttccttgaaaa

SEQ ID NO: 374 - DNA, 535 bp, Homo sapiens
gctttgctttgttgcccaggctggagtgcaatggtgtaatcatggctcactgcagctttgacctctctggcccaaatgatcctccccactcagcctcccaagtggttaggactacaggattcatgactacaaccccaaaatacggcacttctgcctgtgtggaaacaacagaagcaggaagattactctcatttttctctggcctttttcccttgaagcagactataaagaagaatctgaccttcctctgaaggaaaccttcattccagacataccctccctatatccaaagaacatctttatctttaaagacacagagatgtcaagaagaatctgaacaaacaggctttgccagatcccccagtttactaatattgaaccatactcttttgttcttcaatcatacttctgcatgatgtccataaaaatacacagttttccccattccttttgggtatttattcccgaaagcttctgtgtcatgtaaaacttacattaaataaatttgtatgcctttccttgaaaaaaaaaaaaa

SEQ ID NO: 375 - DNA, 610 bp, Homo sapiens
gctgctctttgctgggtgtcattcctgtcactgtgaggacactggcaaaccaaagagattggtccttgtctttgggactcctagagttgaggacagataatgcataggaagaatcaggtttcttacttcctggtcacaaaatggctgccgaagtccataagctaaatcctaatgtgagtgaacatgatcaaggattcatgactacaaccccaaaatacggcacttctgcctgtgtggaaacaacagaagcaggaagattactctcatttttctctggcctttttcccttgaagcagactataaagaagaatctgaccttcctctgaaggaaaccttcattccagacataccctccctatatccaaagaacatctttatctttaaagacacagagatgtcaagaagaatctgaacaaacaggctttgccagatcccccagtttactaatattgaaccatactcttttgttcttcaatcatacttctgcatgatgtccataaaaatacacagttttccccattccttttgggtatttattcccgaaagcttctgtgtcatgtaaaacttacattaaataaatttgtatgcttttcaaaaaaaaaaaaaaaaa

SEQ ID NO: 376 - DNA, 530 bp, Homo sapiens
agaagctgctctttgctgggtgtcattcctgtcactgtgaggacactggcaaaccaaagagatgggtccttgtctttgggactcctagagttgaggacagataatgcataggaagaatcaggattcatgactacaaccccaaaatacggcacttctgcctgtgtggaaacaacagaagcaggaagattactctcatttttctctggcctttttcccttgaagcagactataaagaagaatctgaccttcctctgaaggaaaccttcattccagacataccctccctatatccaaagaacatctttatctttaaagacacagagatgtcaagaagaatctgaacaaacaggctttgccagatcccccagtttactaatattgaaccatactcttttgttcttcaatcatacttctgcatgatgtccataaaaatacacagttttccccattccttttgggtatttattcccgaaagcttctgtgtcatgtaaaacttacattaaataaatttgtatgcttttccttgaaaa

SEQ ID NO: 377 - DNA, 383 bp, Homo sapiens
cctagaatggaaaaattctatagagagaaaattccgcctcctctactgttagtggtgaagctcacataagaaagagccagctgagagtctgtcaaggggagacccaaaaccagagaaactccttttcttctttgtctcaatcacatcattctctagggacaccaattcatcaagaagcaagagttttgctgtcagttcctcctgcattcattcttcctgctgccttgtgaagaaggtgccttgcttcccctttgccttccaccatgattgtaagtttaacgaggactccccagccatgcagaactgttcacaaccttgaatggcatgttggcaataaaaagaagacaataaaaaactaccgattttcttgaaaaaaaaaaaaa

SEQ ID NO: 378 - DNA, 211 bp, Homo sapiens
tctgtctttattgtagaaaatggattggagggaggcagagtggaagcccgaaggccagtggggaggctatcgatgtcttccagatgagagacagtggtggccttggttgggaagcagtgaaggcatggagaacaggaaagagttgagatcctgacatgcattagctgtgtgaccttggataatccatttgacctcctagattcttggtttt

SEQ ID NO: 379 - DNA, 249 bp, Homo sapiens
tatccatttcgagttaatttttgtacattgatgaaggaggaccgggcagccttttctggagagcaacctcagccaaggagcggatgccataattgctttcccttttacctcaccactgggacagctctgagcactttatagagtttgctccctcaagcttgcattccttacttctcatagaagcaaaatactgcatttcttttgatctcatagaaataaaaaggactctctacaccaaaaaaaaaaaaa

SEQ ID NO: 380 - DNA, 340 bp, Homo sapiens
cggcacatcatattttattttgcagatcacagatttaaagcttttgaggaccaacatctctatcaattcctataaaatgtcccatcaatttcagtttcatagcaggctcttctgtactgcacaccatgcttatagttggaggtctggtcacacatgcataaaggttgcccgcccgttggttcctggaggtggtcacgtccaagaagcttcatcttcccaggggagggttccgcaagggtcaatagcttcattcttgaagtcagcgagaccaagaacgcaccaaaaggaaccaattccggacacactaggagtggggtgctggtggggcagggcacaggta

SEQ ID NO: 381 - DNA, 365 bp, Homo sapiens
agccttcatggtgaaagaagagggcaaaactcaacccgtctctttagacttgggaagaatatgaaaggaccaggagggacacctttcctaataacctagctgatggttcacttattagttgtctcactaagcccaaatttgtctaactggccttatttccctggagtatatcctggaagtttccattcaagccaatttaagttactttaaattaggaaaggcagaaaacaaaagcccaaacctttgtaaaggaggaggatttgctacattgttctcaattcatcacagaagaggatgaaactgagtgattacacttgctggagagaaaaaaagtccttcccccgctcaccccaaataaagcaaga

SEQ ID NO: 382 - DNA, 490 bp, Homo sapiens
cgttgtaacacttcccaatgagagacacactgtgagcataggaacaaatatttccacaagctgaggaatgagttcactgacctcaaaagcaattttggaagagtaccagagagaattggcaccaagcaagagcaaggaaccagacatcagttacggaaaatgtatccccacatcatatcatggaagcctagctcacagacactgccaatggaaattgcagaaatagatcaactgcaaaagggtcttcgcggcagaacctggccgtcccaacagcctgcggaggtttcgggttggatctcgcgttcgctccactgcttggcctgcgcttcagcctctagcgaccaaagacacccatgccaccgtcggcagctccatgctcgcgaacttagacttcagacctctgtttcactgcagtaattaaagagaccatggtggggatagggcggaaagttatgttcaataaataccttttaaatgaaaaaaaaaaaaa

SEQ ID NO: 383 - DNA, 632 bp, Homo sapiens
tcgcaagaaagtcatatcgggaaaactgcttggtgagcagttcggagttgagacactttccaatgagagacacaactgtgagcatcaggaacaaatatttctacaagctgaggaatgagttcactgacctcaaaagcaattttggaagagtaccagagagaattggcaccaagcaagagcaaggaaccagacatcagttacggaaaatgtatccccacatcacatcatgggagcctagctcacagacactgccaatggaaattgcagaaatagatcaactgcaaaaggttacataggggacccgcatgctacattaactctctgtgaataaattacatgtaaaatttgagaacatgttttcatcaaataagtatttgtgaagggtcttcgcggcagaacctggccgtcccaacagcctgcggaggtttcgggttggatctcgcgttcgctccactgcttggcctgcgcttcagcctctagcgaccaaagacacccatgccaccgtcggcagctccatgctcgcgaacttagacttcagacctctgtttcactgcagtaattaaagagaccatggtggggatagggcggaaagttatgttcaataaataccttttaaatgaaaaaaaaaaaaa

SEQ ID NO: 384 - DNA, 263 bp, Homo sapiens
ccctgggaagattacgtagccaacactggtgtgaaaatcatgcctatggagggttcttttggaacccagaagaaacagataaaggaggtgtttattcatgaaaccagcacttagaagactgcatcagcagttccagctccatgattacaagctcctcgaagacatgaaccagatcacacctctcctgtgtggctaaggccaactgcacatgtagaacggtgttcctcctatgcttgggacaaataaatctcacaaaatcaaaa

SEQ ID NO: 385 - DNA, 490 bp, Homo sapiens
ctattgcccaggctggagcatgatctcggctgaccgcaacctctgcctcccaggttcaagtgattcttctgcctcagccttctgtgtagctgggactacaggcatgcaccaccacgcccggaagaagcaccgtggggactctcactgcaaagaagacagaccattatcaacactcctcccctctgttccccaaagtcccctcctgaccgcagcatcaatcttccacgctggccggccggaggtggtgcctctggcagatttaaatgagagcatgaaggtgggacctccattactggattagtgtccttataagaagaggaagagaccagagctcactctccccaccacgtgaggatacagtgagaaggtggctgtctgcaagccaagagccctcacccaaacagaatctgctggtatcttgatgttggattttctagcctccaggactgtgagaaataaatgtgcgttgtttaaaccaaaaaaaaaaaaa

SEQ ID NO: 386 - DNA, 149 bp, Homo sapiens
atcatatcttgtcaaccatcggctacttgtacaaaaagatcagagagttcaaatggtggaggagagagctccaagggctccctcctcaatgaaactcagaaaaaattgagcaagaactgtgaaaatcaccctttttggaactcttaaaa

SEQ ID NO: 387 - DNA, 220 bp, Homo sapiens
gagctggtcccagagcagaaacaactggtgatgagatttggacttcagacaagcctagatttgaacctcacttctgctacatatcagccatctggccatctgacttcatctctctgagcccgttccctcatctgaaaaacaaacattgatgcctaagggtggttatgagaattgaataaaataaagtttgtaaagaactttgcaaataaaaaaaaaaaaa

SEQ ID NO: 388 - DNA, 341 bp, Homo sapiens
tacagtcatctcaagttctttcaatgagggaaacatcaccaacacactcacaagtattgggcctggtgaacaacccgaggccctgaagatcaggctctccccagccctcctggagccaaaccacccacggcagccaagtgacagcacccgcagagctgcccgagcctctgggaggtcacggggaggaagggaagacggaaacaccgtgacggccacttctgcctaaatcgttaggaactatttcagagtccctgcaacctgaaacggggattctccacacacctccacacggccagcagcgcagtaatcgcttttaattaaataaatcgagatcggccgaa

SEQ ID NO: 389 - DNA, 619 bp, Homo sapiens
tctccagaccccacagccaagtgaagaagatctttgcatgaacacgacctttcagctggtgaatcagatgaccagaaaaattccccacatcagttttctttatggagtgacctacacaccaagaagagccgctcagctctcaaaactgctgtcatgtagatacctacgtggataaacaagtaatgtttccacaaaacactgcaggttagggcctctgctcatggcaggatagagaaggcaaaataaagagggggctttggactgttggttttgcgtcatgtaagcttttttagtgacctttaatggggagagagactagatgctgagtttaatcacgtaagaccagctcaagacaaacggcacagttttgtttcctgtctggaaagaaaaaaaaaattactcatgcactagcaggaactgaacgctgaacactcctttggtgctagatttattggaggatttgacgacaagaatttgcttgtagttttccaccttccctgtgctattttcttagccagtcattttgaatactccccttccccatctttatcccccaaccattcctgttcttaagccaaataaaaagaaaacatcactgaaataaagacggatcggcaag

SEQ ID NO: 390 - DNA, 566 bp, Homo sapiens
aattcaagttagaaacaagaagagtgataaatagcagaacatggcatccaagagctgaaggacagctctggatgcctaacttgaccggattcatgaaagagaacaaggatgataaatacttaaaaacaaaatgaatgagaattttccaaaagaagtgaaggcaatcaaatcgtaaatccaagaaacatttctagagatataggggctacgtaaacaaactaaaaaaaaggtaaaaaattatatgaagacaaacatagttgtgttgtatgtattatatagttaaatatacgttatacacaggcacgaagaaaagaagtacaggaaacctgtcctcaagaactatttaactgtatactggaaattttaaccagtgtactaaagtaagaaaaataaacaaaaggcatacaaattggatacgaagaaataaaactctatttgattcgtggatggtctatgcacagtattccattatgtacaaaataattaaaattattagcagtgaagctgctagaaataaattgtgagtacaaaataattaaaattaataaaagctgaatgcgtcctga

SEQ ID NO: 391 - DNA, 736 bp, Homo sapiens
aagagaaaatggacaaatgacaggcttgtcaaaagttaccccatgtgacaattcaattgaaatctagggctttgtgcccccaattctcctgaatgaatacatatccatttaaagaaaataattgttctctcagaaaacttcaagatagtatgaatatcctgaggcctttcctactgcaaaatggccacgaatccctaaaggtttcagaaaatgataccccaaaatgaagatctcagaagcagctctctctgaccttagcttaccctcttgtctctgacccttccatcttccaagaggctagccacagaaactagaatcccatggaaaccagaacccttttccccaaagccagcaataaaatctaaaaatattactctaaccctccccaccacctttctgtgtaaaaactggccataaagaaactacctgacctacgttattgactgtaggccatgagacctctattccagagagggtcctgacccagacccagaaggagggaatgcatgcttagagagaccaagaagaatttaactggacaggccttgctgcgtttccccactcagtctattagcgtcaaatcatgcccattttgtccagtcatatttctacatggccgcccatactttcttgaagctaagcatacaaacagactgtttctcctgtatctctggatcttcatctgaaggattccataccatgtaaaactatgatcaaataaatagagatgctgccg

SEQ ID NO: 392 - DNA, 457 bp, Homo sapiens
cggccagcatcgttctttatttctttggataagacctctaatacaatattgaatagaagtgataatatgacacacatctttttttcagtcttaaagaaaaagctggccaggcacagtggttcatgcctgaaatcccagcagctcgtgcctgtaatcccagcactttcagtggctaaggtgggaggactgcttgagcctaggagtttgtgaccagcttggacaacatagtggagccccatctgtacaaaaatttaaaaattagctgagtgttgtggttcacacttgtagtcccaagtactctggagactgaggtaggaggatctattgagcctggaatgttgaggctgtagtgagccatgattgtcccactgcattccatcctgggcaacagagcaagagtctcagactggcagcagactccaacagggctctgagtcccagctaacaaattggtgaa

SEQ ID NO: 393 - DNA, 396 bp, Homo sapiens
aagaaaggaaagaaaggcaaaaagaaagagaagaaggcaaagaaggataaagatctgacagctgacaggaccatcgagtctctgtataaggaactggtggaagaaggattactgatccaggctctgaaagtcaacctctctgattacattgaaaaaatcagattcatcaaatgaataattcagccaacaaccactggaaaacgatgtcaagatcatgcataggaatgctacgtttcctaggatttgatatttttcggcaatcaagaattactatatttcctaaatggaaataccactagtgaaaacagaatgctatagatagaatgatgtcttttgtttctgaagtcagtatactagagctctgcaaaaataataataaatcgagatgggcctgag

SEQ ID NO: 394 - DNA, 514 bp, Homo sapiens
tctagttacccccccatcaggggaccctccctgtcaaggcccaagggaaaactggatcggccctgaaagagaaggaaggttcatgcgggcacagcaagaaggtgccaacatcacatcccacactcaagaagaacgttttccagctgaaggaggcctggggatctgctgtccccatccgcaggaagcaccgcacagctggatagggaaaaaacaggatctttaaagtcctagaggaagcaggagcagatgccgaaggagcggtgaggtggttgtctgagaagatgaccacagcagatggcagacaggaacagcccgcccaagagggctggagttcaatgcttgtcaaagccccagctggctggccgggtgcagtggctcatgcctgtaatcctggcactctgggaggccaaggtgggaggatcccctgaggccaggagttggagatcagcctgggcaacatagtgagacccccattctataaataaataaataaataaatatggatgcggcctga

SEQ ID NO: 395 - DNA, 814 bp, Homo sapiens
acaggaagaaagtatcagagagggaaaagtgataccatcccagcacaggaacaagaccagctgtgccaaagttatcagcgagtatgcagagctggagataagcctgcagggaaacctgggacttctgaggatgctcttaatataccctggcacatcacgacggaaaagggacccttctgaaaagacaaagaggtgggacatcactgcctagacagagggagactcgcagcttgcatgttcatttgctcatgaaggtcgacttccttccctatctgaccccgggcaaacacagggctacgacggcagtctgccatggcctgaatgctgctcagataacccttgatcccagcatcagaatcccagagtttattactggattccagagctcctgatccactagttctgcagcaggacccaggaatccacatctttaactagcaacccaggacctggatgcagaaggtctttatgctactttgattgacatcatgaaattggggctacaaaccctaagcaatctacgggcaagccatcctgagagtcgtttctcaacttttatcaacaggacggatttgttaacctaactgggtggcacaccttcactgggagagggtctcattagcagcctagtgctaccagttgttgtgtaactgttaacaggtgttgctggccaggtgtggtggctcacgcctgtaatcccagcactttgggaagccaaggcaggcagatcgcttgcagtcaggagttcgagaccagcctggccaatatggcgaaaccctgtctctactaaaaataaacccggatcgtggcctga

SEQ ID NO: 396 - DNA, 446 bp, Homo sapiens
cctccggacagcatctttctttattttatttttaaaagcatgaatatttctctagcacggggactgaaggtgaacttgaagaacttgaatctccgaacgttgccattgcagtgttatctgaaaagaatgtgtgagctcctgcacaccagatagcaaacatgcaaatcactcctttcccaggacacttgagtgctgctgcttcatccacgcagatgtgctgtgggccttgcagatagcatctgtttgtttattttcttcttcttattccaacaaattatcttcatgagcttccactggagggaccgctgagatggagtgtggaacaggggcaggagaggagcctggtgtgacaggccatggctagttggaggactacacccagagaccataaggaaacagagtagatgtgctaacaacaagctttcctcggattgcccagcatcagc

SEQ ID NO: 397 - DNA, 317 bp, Homo sapiens
cgtgtcgatcgcattttataattagtttgattttagtaatcatttcacaatgtatatggagataagcaattagtttaacgtaatctaaatttaaaatttttacattttcaaaatataaatgattttaaaaattaaatatttcttgttcacctgaattttgagtacattcagaaacacgatggtctgtattttgcaacatttttcctggctaggatgctgttgctccatccactttaaacaccacagcagtccagtgagaaagatcatgtttgccagttgatagaaaaatcaagctgctttggcttttgtagttctta

SEQ ID NO: 398 - DNA, 526 bp, Homo sapiens
gtcaaccaatttttcactggattttcaacccataaaaagaagctgtaaatttcagaaaaacgagagtgtaatttcaagacaaatacatcacaaaagtatgaataagaaagaaatgtgttgtttcagctaggcaggtattcctgttaatttatggagccgtttgtcctgcttgtaaaattccattttttatggaatagagaattattgctgctgtaagatgtaacaaaatggctaaatgcctgagggaaatacaataaggacatttgggttaggaatataataatattcaaaatatttcactgggaagttagaaaaagttatcccagttttcttttaataaattgaagcagaatgctaatttaaagctaaataaatataacaatctgaatgctgccatgcacaccaatataatttatttaaaagatttgccaaatgtatataacaatgattaaaaccattaatgtatgtatgtatgtatgtaacaataattaaaaccattaatgaaattccatgaaaaaaaaaaaaa

SEQ ID NO: 399 - DNA, 293 bp, Homo sapiens
atctgtatttagttttattaatgatctccagattataaagtgttttattctgggtgttttactgtttctttgtcttaattaagcttgtacaaagccaaagccctgtcctgactctgctgcaggtggactggcctccttgatgccccatgagcaagccaggatgctcccaccacagggtctttcaccgaggctccctctgtctggaatactcttcctgcacatatccccatagctcgctgcttcttctttaggtctttgctcagatatcatttttctggtgagttatttcctga

SEQ ID NO: 400 - DNA, 373 bp, Homo sapiens
cggccgcatcggtttttattttacaaattagggatggagagggataaaggtgagaactatttacaattttatttcatctcaaagcagcacattgctttagtattggtgtgcagaaaaatgaggttgccactgaagtctcttctctctcttcagcaacacttctcccactccgccccaaggcaacctgcaaaggaacagcaggctgggctgagttggacttgcctttataaagcaggcagattattccattgtttcccttgccatgtgaaactaaaaaagctgaagataagcctggacaaaaatttggccaatggactattgagtccaaatacagactgggatacgagattccagaagcaaatattttcgaagt

SEQ ID NO: 401 - DNA, 187 bp, Homo sapiens
tttgtattcaagacagagaggaacacctacccaggagctcaatcacattgcatgcacagacaccgacaaccacacagacgtgtgaacacatccccccaacgtgagcaaccgcagcataatgggactcatcccatccaaatacccatttcatctaaagtgtaaaaataataaaaagggatcggcctga

SEQ ID NO: 402 - DNA, 656 bp, Homo sapiens
aggaccagatcatcatgacatggcctcctaaaacatcctttcgagggcaaaggagacagaagaaagtgacctcctagcaactgcctgtgcaaagaagagactcaacaaaagaaaagacttctctcatgaagacccaagagcttcagggtcagaatgaggataagaatttggtactgctgacatttctacacctactcttctgtgcttttgccttgaaatcttgagaacttccctgctcaaagataaaacctcatacactacatgaaatttctttgtttttcggtaactctttctctttggtcagattcaagctgttttgagatacccaaactactgtttgctgaagtcaactcaataattaaaaacaacaacgagtgatatcaattatttgacactatacagacaaaacaacctactgcatgaattataggctacttctaccactgcccagatgaaatgggatcaaagtggacacttgcctacttccaaacttaggtaaaaatggagacagacagggtgacaaacaggaaagcattttgaccatccatatatgtggctctgtttcaacagtgtttgccatataccacaggcagctacaagtgatgtttctcattgtaaatatatttcagattgcaaaaataaaccctgatcggccg

SEQ ID NO: 403 - DNA, 575 bp, Homo sapiens
attgggtgcaggggttcccgctcccaggggcctccagaaacaggctcagtctcccagctccaggggccgacctgattggtgtaagggaagtcccgccctcttggtcatgagtggttcagaaatgagcatgtgacttgcgggggcttctgggaagtttcctcatgcccacaaaagcctgccagaaggtaccacctttctcctttacccagatggtgcctacatttgttcctgtgatttgaggaggaagctaacctggggcttcggagcagaagctggtggcagaagaggaattcagaaattagaagcatgagaaacattcaacaacagccagccaggaaacaagaatctgcaaaccgcaagaagctgaactgggccagcaaccgggatgagcatgaaagccgattttctcccccagagcctccagataagagcccagtctggaaacaccttgattttggcctgtgagaccctaaagagacatccaaatgctcctgcctggacttctgacttacagaactatgacataatacatgcgtgtcattttaagtttctaaatttctggcaataaaaaatga

SEQ ID NO: 404 - DNA, 269 bp, Homo sapiens
  misc_feature (1)...(269): n = A,T,C or G
agcatatatcattacagactatatgggcatccgaaatgaaagtttcatgaaattagctgcagtagggacctggatgggggactttgtcacagcttggatggtcactgatatgatgcttcaggacaaaccctatcctgactggggaaaatcagcaagagctttctggaagaaaggaaatgttagggtcactttattctgttacccttggtcgactgcagtctgaaaatattaaatggaatgtcncagaaataaaccatgatcggcctgag

SEQ ID NO: 405 - DNA, 295 bp, Homo sapiens
cagactgcctttggactagaaatgcaactctttcctgagtctccaggctgctggccttcaccattagattttgtacttgccaagcctccacaactgcatgagccaattcctttaaataaatctctttctgtatatatgctcatcctattggctctatttctctggaggatcctgaccaagtgaggacacagtgagaagacaaccatcatcaagccaaggagatgggagaagaaaccaaacctgcttataccttgatctcaggcagcttccagaactgtgagaaaataaacctcga

SEQ ID NO: 406 - DNA, 950 bp, Homo sapiens
  misc_feature (1)...(950): n = A,T,C or G
aataaaggtgtcctaaaggttatgagagtactgttaatacgttccagacccagtggctacaaactcttaataagcacagaagctgcttttccttcctccaagcgaaacatcataaaaattaccataagaaagcctgaaaaattcaactctggtcaatcagcactctatgggataaaagaattcactcactcactcatttctttatacaatactttagcaaatatggaacactgtgtatttgctaagcactctcccaggcactggaaatataacagtttcatttctctggctgcaaaaagtaaatattttaatgaaagtgtcctgcttggatcctcggaaattttgggagatttctcgatttaaaagcaaatgcagctactacgaaaagcagtataaggttcttcaaacaattaaaaatagaactacataccagcagnctcactgctgcatatcaatccaaaagaattataatcagaatctcagagagatattngtactcccatattgattgnggcactatntacaatatncaagatatgaaaacagcctanatatacgtngccaagtaaaatgtgtnatatacataanctggaatattattcaaccttaaaaaaaaagtaaatcctgcaatatgtgacaagaatgaacattgaggacattataccaagttaaataagccagtcatagaaaagcaaatactgcgtgggacaatttatatgagatactaaagtaatgaaattcatagaagcacagagtagaatggtgactgccagggactaggggcttggggaaatgggaagttgctaatcgacaggtacaaagtttcatttatggaagatgaataaattctaaagtgtaataataatgtattatgcacttaaaaacctcttgaggatacatctcatgttgtgtcttactacaataaaataaaataaaccaagatcggccag

SEQ ID NO: 407 - DNA, 504 bp, Homo sapiens
ttttttttttttttttttgtttttttttttttatgttcttatgcatttattatttgaaataaggttgtcaaagcattactaatatgaacttggaaaacagaaaaaaaattgttagtatgttacaattattccaaaaattataacatgaaaggaaaatttcactacaattcctggaagacaaagacattttttctaaaaactgtaacaataaaagactcttcaaataagacagtttaagactactttttatgacttttagcaaattcagttctttttctaaaggccatcagttgctccttttttgtaaattatcttgcagttctcttgttcgttccaggctgtcaaactctgagccatgttctgagcctgcattcttgactgtggcctcaggaactcatttgtatctgtaactcatttggaagtctctgggactcattggaaagttggatcttcattccgaaggctctcatgcctacctgttagttaaatttgtatgccttttct

SEQ ID NO: 408 - DNA, 753 bp, Homo sapiens
cggccggatcaaaatttattttctccagttctgaaagatagaaggccaagaccaaagtgttcacaggttagttcctcctgaggcctccctcccagctggtagacagctgtcttctctctgagtcttctttacatggtcttccctctgcgtgttcggtggcctcatctctcctctccttataacaacaccagtcatattggattggtgttcctatgacctcatttaaccataatcaccccctcaaaaatcctattttcaagtatagtgacattctgaggtagtaggggttaggacttcagcatattaatgggttagggagacacaattcagctcctaacaagggtgattgtataataaaatgaaatagtgctagtaaagcattcccagaatatatggactttttgatatgtctccaacatgtagagtatttcctggcacgcaatatgttcttcgttaattaatatcacaaggtcagaaacattgaaaaggaaccatgtagataaagtaccaggtcagcctttccaaagggcttttcatcagttcaataaagtcaacctcaattcttcaaagcagtctggacatatctgaaaatatgtcattccagtcaaaaccttgataaaataagcagcatttctgattgtgtccagaatgaatagagcttaaccaaaattatgacttaaccaaggacacacaggtcatctccaaagaggtgcaaagcagacctcacaaaatccaaaactacgccaaagacag

SEQ ID NO: 409 - DNA, 419 bp, Homo sapiens
aaattgactgaataatcccgatggtagaagaaaagaagttggccggcatccgggtttatttttatttttattttttttgtctcaatggatctgaaccagagcttcatgtttgtcagtgggtctctggcctccttatgagagggaattactcgttacaccaccatcccccacccctacaagtatgctgttcacagtgaagtccatcatcagtgtagggagtgggacccggccggggtcattggctgaaatcctgctgccactgagaaacttctcctagtcaaggtactatggtcagtgccgacagggcttccacgagctcctcccagagtgacaccgtctgtctatgtgaatcagagaaggctcttccttttccagtagtgtagcggtggaaaattaagagagtcaggtgcacgctaggc

SEQ ID NO: 410 - DNA, 441 bp, Homo sapiens
caaccgctctcctctaggaaccctttttggaaataaggaagacttctgactgctatcaggccaatccctggagggcagagatgaagaaaccatttgtcagacactcagcgggtgaaggacaaacaagagacagaatccagggccttcaacgtcctctcagtgctcttgcccctacatcacacagactccagacaagcaggactggaagaggctaagatgaccacgagcctgaccccacacctgctactggagagacccacagcctcctcatctgggctcttctggccacatggcacagcctggtggggtgcccaggaagcaggagatggaggtaggtgagacaaggctttcccagctagccgtggtggtgggaacaccatgatcagcttccccacgacatacccagcaaacaggaatcttaataaacccagatgctgcgcg

SEQ ID NO: 411 - DNA, 649 bp, Homo sapiens
ggattattgccactttgccacttccaaaatgcttcttactcctttctacacaacacgtctgtatgattgccaatgttatccttccattttacccaaggggaaatgaggctccaagataaccacgctgattaatgtcaccaacgcagtaaatcatggagaaaggacctggatgtctgaaaacaaattattttacaagtggaaaagttaacaaagaatgtacaatgttttctgaaaatgtgtaattctcttcatcgttttgaactatgacttctggaaatctgctcactggtgatggagatagtcacggaagtatcacccatcaggacacagtaagatgcagcctcttctcctccctgattactctcattttggacaaaatatgcctacgatatgtagcaagactaacataattttcctgttagaacttcaagaattaagattcagtgttgctaatccttgatttgttttctgcgatacagaagacaggccctgagactctggtgacttggtggtataaagtgaagagcactggactgcaaataaggaatcctgtactcagaaccctgcatcacagaatagccttgcaaatgagcaagcccgtctccttacctttacctactctacaaaacagaaaataaagcccgatgcg

SEQ ID NO: 412 - DNA, 754 bp, Homo sapiens
cgtgcagcatcacgtttttatttaaggccattggtttaaatccagacttgattcaggaaaggttgtagccctttgatattctttggtctttgcacacttctaatagggcaggaatttgctttagttcaaaccaattggtgcatttcctttaagtacacagaatttaaacaattgaattgatatggccactgttgaactgagtggtaccaggttggaggaaaggacattcattatatgttagtgggttgtgggctcactctctgagatggtaaacggtaggctggtagaatgttgagtagttcattctgcataacacacatggcgccaggcacattacctagtacctctatgattttcatccgctttattttctgttttgtagagtaggtaaaggtaaggagacgggcttgctcatttgcaaggctattctgtgatgcagggttctgagtacaggattccttatttgcagtccagtgctcttcactttataccaccaagtcaccagagtctcagggcctgtctttgtgtcctgatgggtgatacttccgtgactatctccatcaccagtgagcagatttccagaagtcatagttcaaaacgatgaagagaattacacattttcagaaaacattgtacattctttgttaacttttccacttgtaaaataatttgttttcagacatccaggtcctttctccatgatttactgcgttggtgacattaatcagcgtggttatcttggagcctcatttcc

SEQ ID NO: 413 - DNA, 472 bp, Homo sapiens
agtcatttgcctatgaggtcagaatggatgaagctctggagtcatgactgcagtcaagatgccgttcattgtttctttcctttttcttctttctacccaacagtacataacatgtaggattcgaatcctccaatatttgaaagctttcactgtctacccactatgtacaatccagagctttgggaatctcgttctatgccaagcctttagtcttctgttctccaagagcctaattatggggtctatttcactctgcgtccttggctttatgtattccccaccatctctgtcctgttctcacacttcctcaaatatcactcacttcacttcaacctgggccttcctctcccagaatcaagcatgatattctcagtatttatagtacagcctactgcactactaaaatattccttatgataccaaaaaaataaaataacatctgctttccaaataaacccccgaatgcgtcagg

SEQ ID NO: 414 - DNA, 489 bp, Homo sapiens
aaatcaaaatgttgtggtcaaaatgttcctgatgcaaaggatgaagactgttcttggacaaaatcaatgtcctgggatacagatacacaaaatataaaaatctcatagggcactgaagacatctatgacactgaccacaagtgtgatcttccatggtcccaactttcagaaaaggaagaatgacccggctgagggagttcaatgggactgtgttaactgacatattccaatagaaagaaacgtatgatgctttaacaacttacatgaacattattaacgtaatggctaatactttatccatgaatgatactgaagtgattccatgctgtaatataaggatttgctaaaattacattataatttataatgttacatcatatatacatattttactcatctgtaattttggtagaaataattttagcagttacttcacaagaaatgaaaagtattagaaataaaaaatttgtatattcaaaaaaaaaaaaa

SEQ ID NO: 415 - DNA, 467 bp, Homo sapiens
ttctagaagctgagaagtccaacatcaaggcacaggcaggtggcaggtttgattgtctggtgaaggctgccctctgcttccaagatggacccttgttgttgcattttctggaaaaaaggaacactgtgttctcagatggctgaaagcagaaggaacctcaggccaagtgttcttgacagctcatccacagactcccactggtaaagcagcatgaggatggcttctgttattttatttcagaattttttcctgcagtggcatgccagtaccagctgaggatcatgtatgcaatatttgccttctttcatcttctacctaggatggctttaattctcttcgaggagaatttattttagtttttcccagtaagagaatccacttctcttgcccatattcataaattatcattaaaaattaaacttggtacaataaatattaacatggttccagcttcaaaaaaaaaaaaa

SEQ ID NO: 416 - DNA, 139 bp, Homo sapiens
tcgctttttattttcatttacataaagtccactgttggtctggaaaattctgcagggcagctttcctgaaggtgaggggcttattattccatactgcttcactcttacagcatctgtatttgcatatgtttctatgatt

SEQ ID NO: 417 - DNA, 772 bp, Homo sapiens
acagcctactgcctaaatgtccaacctgtgaccaggcctcccttccacaagaagcttgttgatactggcagacaccctgtggctcttgcctgacctgtgtgcagtttattcctaccaggatggccgatctctaggagagtcttgacggagaaagaagctgggttcagcaaaagaaacaatcaataaacagataatctacagaatggtaaaaaatatttgtgagctatgcatctgaccaaaggctaatatccagaatctacaaggaattcagacaactcaataaggcaaaaacaaccccattaaaaagtgggggaaagacatgaaaagacattttttcaaaagaagacatacaaatggtcaagaaaaatataagcaaattctcaacatcactaatcatcagataaatgcaaattaaaaccacaagaatataccatcttacaccagagaaaatgcctattattaaaaagtctaaaaacaacagatgttggtgaggatgcaagaaaaagggaacacatatacattgtttttggaaaagtaaattagttcaacctttctgaacaacagtacagagatttctcagagaactaaaaaaagaactaccattcaatctagcaatctgactactgggtatctacccaaagggaaataaatcattacatccaaaagacacctgcactcctgtgtttatcacaacactattcacaatagcaaacatatggaatcaaactaagagtccattaacagaaagactgaataaagaatacgcgcaaag

SEQ ID NO: 418 - DNA, 617 bp, Homo sapiens
ttaggccaaacaggccaaaataatcttaatcccatatcttcctaaataataataatttattaatgacgttatattatttttttttcttataatccatttattataatctcacagtttctataagactaatgcagaaaaggcagagagaaggcatgactgtacttcacaatgtctcagtcctcagctgggggcaggaatcacctgaaggttcactcactcacacatttctgcctcatctcactggttgaggcagtgccaaaggtccagcaagtttagagggaaggaacataggccccacttctcaatggagagatgttgatgtcatcctataagaagaacttgaggctgggagcggtggctcatgcctgtaatcccagccctttgggaaaatgaggcaggctgatcacaagttcaggagtttgaaaccagcctgggcaacatggtgaaaccccgtctctactaaaaatacaaaaattagccctgcatggtggcgggcagctgtaatcccagctactcaggaggctgaggcagaattgcttgaacccaggaggcagaggttgcagagagccgaaatcgcaccactccactccagcctgggcgacagagcaaggtcccat

SEQ ID NO: 419 - DNA, 177 bp, Homo sapiens
tcgttttttatttgcttttattttgaatttaaaggaaaaccctttcatcatattttctcttcaattagctgaatatccctaggccgactggccctagggtcttctttcaagtccagcatgtaggagcagttgatatgaaccactttgcatccacaactgtcctgattctcccaagaa

SEQ ID NO: 420 - DNA, 572 bp, Homo sapiens
ccactgaataatggagctgaattcaaaatccatggtgttttcactttcctgtgcatttcttcaggagatacagtttacaaaaagattacagacaagagggaaaatggaagaataatttcatggatctcttaagaactgttcagaacattagttctttcaaaactgtggttgccgaaaattcagctgagataacagagagctcccttcacggatgatacaggagcaattcagatcctactgctttcacacaaaaaagtatcaaaatctaattcctaaaaatgcaaaatgttgccaagtctgccagctataacttagcaaagctttcagggatttccagtgtgcactttcatcttctcaccagccatgtgtatatacacagtgacttccaatgttccatgttttcttcttccaaagacacatttaaacaacatgttgttgctaattttgggattttgcagtgggtgcatgtaactatgaacaatcacgatgctttgcaaatcattagctatcaacatacagtggattttgcagtacagagacagcttaaagtaataaacacatgatgcggcaag

SEQ ID NO: 421 - DNA, 1038 bp, Homo sapiens
  misc_feature (1)...(1038): n = A,T,C or G
atgcaaagccggaatgcgagcagtgcccgccacacctgacaaacctgctgctgcacacatctgtactcttcaatcaacaaaacctgatgctaaaaacagaaaagggggagatgtatgagatcagtcagggtggtgggaaaaattgtagaaagatgcaaaccttcttggaaggcggggaggttttacaacagcttcggaaatggatttggctgaaggtagccaaaccctcttatctggaccttgagagcaaaggttagatagcaaagagatataaaggaattgatctaggtaagttagtttaacttggaacctggcctttaatcatccccatgcatgactgctatctccgggcagggtgactatgttaattacgcaaaagtgtgttgactcaaagcctttgtcattaaatctgtaactaaataaatgcctgcagcaccagcttgtcagggctacagctgctgactctttacagcaccctgctcggggtctataagcagccaggtcctctagcccgctttttcactggatacctgcgtntgactgcattcttacatccgttgttcggccagggtctgcagattggacctggcaacagacaacctacagaatggaagaaatatctttaagattaaaatagggtgttataatgttattttttatggttttatgggagaattgctatgaataaagactcaagcaaaagaaatacaaattaaaaagttaaaaacattaaacagattctaaactcctgaagtataagatcagaagaacttccagactaggggttcttgaccagttaaatagaatttaatgcctcattcgggagtccactcatccactctgcaaagagtttctagtattgctgaaaccctaacaaccagggatatcaacatttatactctctccaaactcagaaaaatagaaagtagcaacttttcacaaaatgataagaatatatcatttgaaattgtgagctctccaattgtactgtcagaaacctaagattctatgaattacttaataaagtctgatcggcag

SEQ ID NO: 422 - DNA, 252 bp, Homo sapiens
ctatttcacaagcatggtctttcttgctcaaaactatccagtgggttgggtatgagagaaagcaatgccctaatcacgtgatgaagcatcagtcacagcagtgtctgtaggtaccagtcaggccaccaacaatgtgtggactcaaactccgggcttgactcctaactccatggcctttctatcctgaagtgaaaaataatctatttttaagatcacagaatgccaaataaaccagtggcctcgttggcctca

SEQ ID NO: 423 - DNA, 357 bp, Homo sapiens
tttttttttttttagcacagacctattccatttatttcaataaacatttatcaagcacccatttacactccttttctgcccatgaaaacactcattttgactcaggaggaatcagacatttaagtaaagggttgggaagtaaaatgaagctggaagaacaatgtcacatctgagttggcaaaaggtattgtttctaggttcagtacagaaagtataaaagagggggcagccatctctgaggaaagagccaggtgacgggcgtgacgctgtcttcctccatctgtgctttctcttccaagctgtgttcaagatgatggtgctctttttcattccagttatttttgatgtattttcaag

SEQ ID NO: 424 - DNA, 687 bp, Homo sapiens
taaaggaagctcctacagatctgtcatctctgcagtcctggtttgtacattcatgaaagctaagtgggttcgtgcaaacatcctgtgctgcagcatcagagatgttctggggaaaaagtgacagcaggtctgagtgaggtgttgtcaagaagctcctgaggaaagctggtggatatctacatggaagatatgaagtgacacacaagaaaggttttatttcatccttgaaagtttctatgaaaatcatcttcctagaaatagaagagctgacaataacaagccctaaacctaagctaagaaacctgaatcctagttctgcctgtgtcaattaactatggaccttggttctccaaggatacaaagatgaatggatgagggtggctctgttaagttggaatacatttaagaagatgagcagtctccctcttggtaaaggaattcaagatatgtgtgaaatatttccttctttttaagaatacacagttatttggggctgaaattaccacgtgacttgagtaaaacccagtttttcgaccaaatgatgccaaggaataaatccgatttaggtcgatgccggcgctccctttagtggggttaattatgatcctgcttactgactcctgagctagtcgacagtgcggaaagcgatccattacccaggcgttatccgtctcccaaatcgggtta

SEQ ID NO: 425 - DNA, 534 bp, Homo sapiens
taaaggaagctcctacagatctgtcatctctgcagtcctggtttgtacattcatgaaagctaagtgggttcgtgcaaacatcctgtgctgcagcatcagagatgttctggggaaaaagtgacagcaggtctgagtgaggtgttgtcaagaagctcctgaggaaagctggtggatatctacatggaagatatgaagtgacacacaagaaaggttttatttcatccttgaaagtttctatgaaaatcatcttcctagaaatagaagagctgacaataacaagccctaaacctaagctaagaaacctgaatcctagttctgcctgtgtcattaactatggaccttgggtgcaggctatttccacctgctgagctgaggtgggaggatcacttaagcccaggagttcaaggttacagtgagctgtgatcatgccactgtactccagcctgggtgacagaacaaaactctgttcctaaaaagaaaaataaaagaaaatacagaaaagaaagtatggtaaataaaaactgatcggccgga

SEQ ID NO: 426 - DNA, 735 bp, Homo sapiens
cctgggcatgtaagaagcttggaaatcatcactcatgtatttacaagaagaaaaaaactgaacaaactgaaaatcattggctctccatcaacactcagaggactgaagctgcatggcaatttgacaccctgaaatctggagagacagatggatacagagagtcacagccaagatctcaccaggagcagatgcctctggagccacaaactgtgctataaagacataccagagagggtaatttataaagaaaagaggtttaattgactcgcagttctgcatggctggggaggccccaggaaacttacaatcatggcagaaggggaagaggcacctcttacatggcaacagtggaatgtgaaatagctccctagcagaattgtggtaagatttggaacaagagatgtaaaggaccctaagtaccacactggaaatagtctataaactcagttttatttcatccctgaaagtttccatgaaaatcatcttcctagaaatagaagagctgacaataacaagtcctaaacctaagctaagaaacctgaatcctagttctgcctgtgtcattaactatggaccttgggtgcaggctatttccacctgctgagctgaggtgggaggatcacttaagcccaggagttcaaggttacagtgagctgtgatcatgccactgtactccagcctgggtgacagaacaaaactctgttcctaaaaagaaaaataaaagaagatcgcaag

SEQ ID NO: 427 - DNA, 719 bp, Homo sapiens
ctccgcgcgatcgttgtttattctgtatttttatcctttggcatacatttggtacgaatacatgggtcctactcaagttccgtggtatatctcagccccaaataactgtgtattcttaaaaagaaggaaatatttcacacattccttgaattcctttaccatgagggagatgcctcatcttcttaaatgtattccaacttaacagagccaccctcatccattcatctttgtatccttggagaaccaaggtccatagttaatgacacaggcagaactaggattcaggtttcttagcttaggtttagggcttgttattgtcagctcttctatttctaggaagatgattttcatagaaactttcaaggatgaaataaaactgagtttatagactatttccagtgtggtacttagggtcctttacatctcttgttccaaatcttaccacaattctgctagggagctatttcacattccacagtttgtggctccagaggcatctgctcctggtgagatcttgtgtgtcacttcatatcttccatgtagatatccaccagctttcctcaggagcttcttgacaacacctcactcagacctgctgtcactttttccccagaacatctctgatgctgcagcacaggatgtttgcacgaacccacttagctttcatgaatgtacaaaccaggactgcagagatgacagatctgtaggagcttccttta

SEQ ID NO: 428 - DNA, 435 bp, Homo sapiens
  misc_feature (1)...(435): n = A,T,C or G
gcctgngtgtaacttattttctgtctactgctactgatcggtgtccatggaaacaaacctgtaatcaatgctatactcctagagtgcagtggcctaagactccactttgagagcacaatgaggaaaaagccatcaagggaaaagctgcttccctgttggtaccagcactgtggaaaggcttaggtgcaaggaattgtggcctcccgccaatggccagtgaggaactgatatctccagccaatagccttgtgactaagccatcttacaggagaatcattcaggcccatgcaacctttaggtgactgcagccccacccactgtcctaactgctacctcatgagaaaccctgagctagaaccagccaactaaattagaatttctaatttgtaggaataatgagacaataaatgtttgctctttttaaaaaaaaaaaaa

SEQ ID NO: 429 - DNA, 541 bp, Homo sapiens
cttctttattttctgtcttctgctactgattggtgtccatggaaacaaacctgtaatcaatgctagactcctagagtgcagtggcctaagactccactttgagagcacaatgaggaaaaagccatcaaggtctagaactcagacctcaaacttaaacattccagttgcctactggacatctacaaatgtatgttacttgggaaaagctgcttccctgttggtaccagcactgtggaaaggcttaggtgcaaggaattgtggcctcccgccaatggccagtgaggaactgagatctccagccaatagccttgtgactaagccatcttacaggagaatcattcaggcccatgcaacctttaggagataaaagtgaggcccataggggctaaataaattgcccatgtccaacgatgaaagaagcagaacctagaaagtctacaggactctgcctctcatagataaatatttgtttcatccaatgacaatattccctttatcttttttagacatcataatgccaaataaaaaccgatgctgtaag

SEQ ID NO: 430 - DNA, 723 bp, Homo sapiens
ctgtcaccgatgctggagggcaatggtgagatctcggctcactgcaacccccacctcctgggttcaagtgattctcctgcctcagcctcctgagtagatgggattataggttccggttttggctatgatgaatcagacaaagaagcttaaaagacagccaatcacattgtttaggagatgagatgcttcgaatgctattgcctcttgtcagcaatctacagcaagcaagaacaccatagcaagaaagctactctttggtgtcatgtttggaatcaaaagtaacaaagatgtgagcataaacaattcataaatttgcaccttgaaaaggctgagcaatcttgaatattgtcgattggcatattatcctgtcttgtaggagcttttcactgatatactatcaaactaagagtttcctccgaaataataaggctttttagctcacctatgagctaaagatttcatgtggtattatctcatcttgttctcagcaatctctgtaatagagactgatattcgtgcatagcatgctttgccatctcatgttgatgtatttaatcttgataacactcctgtgaagtagatgaacagccttctgtagatgctgttattatttatctctgttttaaaagccacacaactggtaaattcatgaataaactcaacaaatatgatgcggccgaaacaaaccaacttatctcacctatatcgctaccggtatccgac

SEQ ID NO: 431 - DNA, 564 bp, Homo sapiens
agctaaccacactgagcctctgtaaaccacaacattgtttctctttaacaaatggaagatttttacccacggtatcactgaccatcaaaaagaattcccatcctccatctctagagcaagagaaaacggaccgcaatgctcctacgatgatcctgtaacagaggtatcgacaacaaccctggagcctccttcaaattatgggacatcaccaacaatcaatcactaagagaagaaataatttagaagaagaattcatttttggttactcaaatataacccaatttaaaggagactgttatttctcttctctagtaagctacagacaggatctgctccctttaataagatgcttggttaataacatttatttacagagtaaaattttctctttatttccctccacactaaaatatttacataaactcaaaccacttatgttgcctattccaaccagtttcttgtcagagtgagtaggaaaattcttcattaaatgtcattgcctttggggtaaacagaacataaataaaaaaccagttttattaaggttctgcaaaaaaaaaaaaa

SEQ ID NO: 432 - DNA, 769 bp, Homo sapiens
  misc_feature (1)...(769): n = A,T,C or G
ccaagcaattctcctgcctcagcaaagatatctgcactctcatgttcattgcaggattatttacaattgtcaagatgtggaatcaacccagatgactcattaccaaagaataattgaaggagtaatggatgcctgatcatctgagattacatctgcttcacgcatacaaactgcataaggcaatgatgttgcagaggctccacatcatcactcacgttcagaacagacaggagcagcagcaggaaaggaggctggaaattaaatcgtgaacttttggattgtgattttaaaaatatatctgaaattatcatgtacatgaataataacttgtaatagaaatagaaaagataaactcctaagataatgtaaaaagctaaatattttaaatattcatcttttttatggttgagtgaatgtttgatatctcatgttatcttgattatctctgacctctaatacctgattctccactccttctatcttcttatctcctttcccaaatgtaaagtcttgtctttaattgatgaaaataagcctaaaagcttgacgatagggaaatttttttctagttttaatttgaatatttatcatcaaactgaacttacgtttctgatttgagaacttcagaaaattttgtctcttcaatgtggcaccagtgccagaaattgnaaataattgttcattttgtttcttttactacaataaactgtgaggcggccgaaaaacnacactcccctccaacccctttatcgcccactctccccctccc

SEQ ID NO: 433 - DNA, 749 bp, Homo sapiens
ctgccgcatcgttatttatttattttccttctgttaatagatttagtcattttttaaaaccataatataccaggatgagccagaattatgtgtgtctaagttcttttaaaataaagaaatcgtttcttgggtctgttttagttaggtcctttcaggttgcaggaaccaagatgtgcttaaagttacctcagatgactttagatgatgggaatttatggtaatatacagggagaaggaaggaagtccaaaaacccatgtcagcaactagacaaccaagcctcatggagacttggaatatcattgaggacacaacagcagctgattttgtcattcctcagaaataaacatccagtgtttccttgtccggtgggtctttgttggacaaggacttagctttcttcaattttccttctgttttctgtggcagctcctgttagtgattctgtttagtcttcttctgaacactaggatgttcgttatatgatgtcctgctgcctcatggcctcctcatcctacgccgtgtgtctctggcttttgctccattccatctctgctcccagcttttctttttctgtatccttacactgaaaagcctgaaccaacaggaccattattttagctggttcttctccagtacacatggaggaggaattcttcctccaacacagctcatgggtatctagtctggtttgggttcaatgtctgatccaactagctgtggccagagtgcagaattacctgttacaaaa

SEQ ID NO: 434 - DNA, 279 bp, Homo sapiens
tggccgatccaggtttatttgagaaaacataaagccttccttcccttcacattcatctgctccacatgttgcagtgtttcgaaaactaggagctcctccccttccttccttgactcgtgaactctgccactggcccttgcaggagctggccttgctttgttgagtaacagcacagagaagcccacacagtgatgaggagagcctttgatctccagaagacttgaaggctcaagtctggaggtcttggcatttatcccagagatcaaacacatatgttgg

SEQ ID NO: 435 - DNA, 714 bp, Homo sapiens
aatctacctttaaagaacagagtggatgactctgatgcaggttgaactggaccccataaaggggcaccactgccatttgttgctctgaggtgcaacctacagacctgcagaccctggagcaaaagttcatcttgcagaggtcggagcatctctacctagctccgtatccctcagacaaggagctccagagaagggctggtgctgctccccagcctggctccctaagggactgtaggaacacagccttttgctgactcccaaaagccacatgccaggcctccagttcctcctgtgtgtcgggaacaattccggggattcagctgtgaacacgagtcaacgatcttccccatgtcaagcttatcgtccagtggagaagaagaggagtgatcacacttaataggaaaaacaagcgggagatagaagcgaaaacacaaatccggcctcactgtgaaggggaaggcaagctgaagagtaccacataagaaggactcactggcagccattattttatgaagggagctggttaaagaatgatggcaaccttggaatattatgctatagaagaccccctgctttctagaaaatgctttcctgttttacatatgccataaccccatatgtggatgttggcacttggtgttttagatgagaaaataagcaagatggcggccgaaacatctaacacctctaactactctcaccgatctccacacc

SEQ ID NO: 436 - DNA, 857 bp, Homo sapiens
ctgccagatcatttctttattgttgtcattcttgaatgatggattgaacgattagatcctatgatattgggagaaatctctaccttaaagctaaaatcctgcactgtacaaggaagggctgaggaggacgctgtaaaagccgatcctagttccagggaactcacccattttctacaaggtcgaagattacttccatttttctttcactcattctttctccactcaatgcaatgtaaagaaatatcgcccattatttcagtgtttattgttaaaatatgagttcgaattttctgccatattaaaaaaaatgcaaagtaaccggtccttatccatgcatcaaaactgtcagagcctgggcgactctgcgtttgaagagatcggaggaagagaattggttgacagcaccctgggcccatcctttgatgtacaaggaaagatctgctcattgaaaccacatcactgaagctgctcatagcacatgtaacatgaagaagcacgcgagtcctgccttggtgcaagtgcttctactgctgtgacagtggttgtgatgcgggttttgttacacccgaatgcgggtgtccttacttctgcccaaggtggatgttggggtcacactcaccttggccggagagctccccataggggcactacctcgcattaccgtagagccagacacaagggtgttaaaagtgtaactctgtgttaaaatcctctggggataacagtgactaaaaagtgcattgactcacacacggggacttctgcccatccgtttgctttatatatctatgtaactacccttcctccccatagtgttgttcggcactcccaaccatacgtttgtcttccccctacct

SEQ ID NO: 437 - DNA, 700 bp, Homo sapiens
tttattgttgtcattcttgaatgatggattgaacgattagatcctatgatattgggagaaatctctaccttaaagctaaaatcctgcactgtacaaggaagggctgaggaggatgctgtaaaagccgatcctagttccagggaactcacccattttctacaaggtcgaagattacttccatttttctttctctcattctttctcctctcaatgcaatgtaaagaaatatcgcccattatttcagtgtttattgttaaaatatgagttcgaattttctgccatattaaaaaaaatgcaaagtaaccggtccttatccatgcatcaaaactgtcagagcctgggcgactctgcgtttgaagagatcggaggaagagaattggttgacagcaccctcggcccatcctttgatgtacaaggaaagttctgctcattgaaaccacatcactgaagctgctcatagcacatcaaacatgaagaagcaggcaagtcctcccttttctcccaaactagcacagtcttccaaaaaccaggaagacaagtgcttctactactgtgacagtagttgtgatccaggtcttcattccacccgaattcttcttctccattccttctcaccagggtggatgtgtaaggtcagactacaacgtgggctgagaagcactgtatctaatccaataccttcaatttaaatgagacctgg

SEQ ID NO: 438 - DNA, 800 bp, Homo sapiens
cgatacatataagactcgaaacttaatacaatactagtatcaagtcgccgtgacatttgctagtgcattattgccatattggcttttgactcctctccatacgtgccgagcgccatgattaggcgctagtcgccgtcagcggcgctacctcccttaaaaaaaataaaaacatattagtacttcgcgaaccacaatgcgcagaattaaaagtgcggggactgtttttgtttacaagcacatacagtcctgtgagcatacaagacaagaaggggcccccattctggctggcaagtattgccgggagataaagtcttgtcacaacactattgttcatggatttagtgcaggagacaacccttgaatctcaaacaccaggtaagtatttaagagaggagcacccatggcagggatctggcaataatcatccagatgtgatccgttctccaagcagaagtgcaagggttcgcaggccagccgtgccttccagggccgctgacaacatccagagctggctacacagcaaggccccctccaggcccagcagaggcggcagagagacatcccggaaataaattaaaacagactgattatcctctctgggtgtagcttaaaccatatcagaaaaattgcctagaaataaaattggatagcagccctgacaaaccagtgcaagtaattatatcaacttgatggcaataattatttttcataaaactcagttacttcccacctccaataaatgtgatggcggccgaaaaaacaaatataaatttaaaaactatcgacgaccctgccacatc

SEQ ID NO: 439 - DNA, 363 bp, Homo sapiens
ctcttttcccgctcccccatttgagagcactggcatgatcatgtcttattgcagcctcaacctccagggcaggcaggtctcctgcctcagcctcccaaggagctgggacccacggcacacatcaccacatcttgctaatttttttattagtataatttgtagagacagagtctctctatgttgcccaggctggccttgaactcttgagctcaagcaatcctcccgccttggcctcttggtgttggaattatatatgtgagacactgaactcagctacagtagttctattttaagaataaaaacagatgcggccgaaacaatcaataccatagggatttataatgtacttattttattaatcat

SEQ ID NO: 440 - DNA, 463 bp, Homo sapiens
agagatggggtctcactatgttgcccaagctggtctctaactcctggcctcaagggaacctccagccttggcctcacaaagcactgggattacagcttagatattcactatgagaattaattccatgtgataatccaaaggcaggccaaggtgagaggattgcttgacaccaggagagaccagcctcggcagcaaaagacgaccctgtctctacaaaaaataaaagtaaacatagtcaagtgcagtggtgcatacctgtagttccagctacttcggaggctgagatgggaggatcatttgagcccaggagatcgaggctgcagtgagctatgattgcaccactgcactgtagcctggacaacagagagaccctgtctaacatgaaatgaaataaaataattttaaaaataataaaaataaaataaaattatttctcttctttccaacgtcaaaaaaaaaaaaa

SEQ ID NO: 441 - DNA, 823 bp, Homo sapiens
  misc_feature (1)...(823): n = A,T,C or G
atacaaagtaaatggaatacaatttaagctttccttgagtcaacagtcttctcactaaagatcaattactacaccgtgctgaagcgtgagggaaaatcctcaaaaactactgcaataaacaaggccaatctgctacttctcatccactgaagtttggaaaacaatcttgtatagtaaagagcaacacactctaaggactaccagacaggagctcctatcagtaaaatacgtatctttacatggattctttgatattatacaccagtatttattctgttcagaggctttatttactgattttctggttctcagctatggttcaaatgtatggttcaaatgactgaaactgacactctactagtctacatctggggctgggccaatatggtaaccactgggctagccatatgtggctaaattcaaattaataaaattaaaacattgagttaagtctcctcagctgcccatacccacattncaagnacgacagccatgagtggctattggaaaatgcaccagaacatgtccgggctaaaaaaaagttctaaccagccctggtgtatgtcattaattcattttgatagagatctaggtattataaattaatccctgaattctacagactaataaaaataaatataacaagggttacgaggatgctgttaccttaaatatgaaaaaaattgtacacaatttcaaacatagaaatgttatcttgtgattcaggaaacagcaccaccttcacaggaatttaaaaataataacacagatgcggccgaaataatnaactcctataattcctctcagccgaatcctcaacgcc

SEQ ID NO: 442 - DNA, 411 bp, Homo sapiens
gggatggagggttttgtatgaggaataggatagttgcgtatttccggccgcatcggtgtttatttattttatttttgaaatcatccccttgtactcattctacactgactgttcctgggcttgctgcacagctgtaaccccagagcttcccttctgcattattttgggtcttcccacaatctcctgctagaggtttctgattttctggatcctgtgtcttcctctgggtgtttcagcctgattgatggagcacattctcctgttgctttgttttagtctctgtgtttccttttggaggctcccacaatctggtactccgttgctggaaggaatgagacaggtacttgttcccccagtgatgagaaagtaagatgacacagaagtaccgtctcaccataaacaattagaaaa

SEQ ID NO: 443 - DNA, 503 bp, Homo sapiens
aacagattgcatcatgatgaagactgaggggccatcaaggaatgctgagtggtggaatgatgggatcaggacctctgaaacactacaccagagtaaataaatgcccttgcatcctccagttcttcctggaatcccgcaccctcttcctgatttgaatggaaactcactcttacacaagggcatcctggaatcccgcaccctcttcctgatttgaatggaaactcactcttacacaagggcatcctggaatcccgcaccctcttcctgatttgaatggaaactcactcttacacaagggcatcctggaatcccgcactctcttcctgatttgaatggaaactcactcttacatgagggcacggcttcacctgctttgtctcttctgaaggatgctcattctcccatccccagtgccagccaaagaagtagccccgacaaacaactttaaagtttcccagttctgcttccaagccgtacactgttccagtcctaatataaagcga

SEQ ID NO: 444 - DNA, 318 bp, Homo sapiens
aacccttaaccaacattaagaagtctagctacactcctggagtccagctaacatggagaaaccatacagagaggccacatggagcggtggggacatgagaatgtgcagggagggagaggagtccagctgcctcataatcctaccggagcccaggcatcagccatctctgccaacctgcagcacgagtgaggacgcgagtgtgccacctggcaagtggatcctctggccccagtcaaggagctgcagctgatggtgcatggagcagagagaaactgccctgctgagccctgccaaaatcataaaagtgtgagcaataaa

SEQ ID NO: 445 - DNA, 195 bp, Homo sapiens
caaagaaaagttggaattgtaacaggaccttccggatgtgaaacatgctaggtcaccatgttatggtggtagattgtcctgggaggcagagttggcttcttgattccacctctgctgcatgccaacaaggtgacattggataggggcctcagttcactggtctataaaaaaaaaacaataaacaccgatgcggcc

SEQ ID NO: 446 - DNA, 494 bp, Homo sapiens
gtccggcggatctttctttattaaaattttatttgattgttagtagtggtattacataacataacataaaatttaccatctttaaattttttaagtgtacagctcaatattgttaagtacatttgcgtagttgtgtaaccaatttccggaactcttttccatcttgaaaaatgaatattctataagcattaaacagtaactcccaatttcctacccccgaccaggccctagcaagcaccactctattttttgtctttatgaatttatctactctaagtacttcgtatgcatggaatcatacagtatttgcctttttgactagtttcccttggtgtcatgtcctcagggttcatccatgttgctgcatgtgtcagaatttctttccgtcttcaggctgaatagtactccgttgtatgtatataccacatttggtctattcatttgtctgtcgatggacacgtagactgcttcttccttttggcaactgtgataac

SEQ ID NO: 447 - DNA, 891 bp, Homo sapiens
cctgagaggggaggctgaaaaccatttcttcctggggaggaggcaggaaggagaaatggcagccatggctccctagactcaaggaagagacgaggaccacggcaaattgcagagaatccatacatgtaaggaccgtgcactaactgtttgtgccactggagctccatggaacccatacataaagcacacctcttctcttctccttggcatccaacctgctggctctacaactactttcaacaatgagtcaaggctgtacctggcaagatggaaattcaaaatcaacaacgaaagctatttattttggttttgatcctagccctgggccttttactaagtattcagaactgatttaatgaatgaaaaaatgaatgaatggtacacatttccattgtctattctgcttcttttccctagggaactgtgttaggccatgatttccttgctgtttttttcatatggttgttttatttgcacaacgctaaattaaatcaactagttccattcatgtatttctctcttgttttataaccacctgatttcttatttttatttaaacagaaattaaatagtaaaaactttggagtatttaattttacttaattaaaaattgttttaaaaaataaacgtttacctgaaatgagtattgaattttgaaaagcaccttcaacaaacccctttttggatgagttcaataatggttgaagagggcacaattcatggtgaatgaatttgaaagtgtaatagatttaaaagtgttttaaaggggctaatatagaaaagcccaaacaaattattcaggatttaaggatattatttagaaaacatgctttctttgatgactgtttcttattctcctttgtggatgcttgagcaccactagagtgacta

SEQ ID NO: 448 - DNA, 458 bp, Homo sapiens
ccccgcgttgggggggtggaggtggctttctttctgggcccttcccggttttagggtgtggtgtttgtttaaaaaaaaaaaattaaaggggctttcaaagggggttttccttctcccactttttttaaacccattttttggggggtggcgcaaccccttttgtaacccacacctttgggggttctccaatttgttttttaaaaattttaaattttttccggccccccccctttttttacacgactctacacccatcacaattgcataagtgaccacctgggcttcctattgaccaactcctctttcttacccctccgtaatttctgttttctctcacatggttacatttcttacctactatataaacccttaattccaccccatcacggagatggatttgaggctgatcttccattctctttggctgcagccacctaaataaaacctgatcggccgaa

SEQ ID NO: 449 - DNA, 200 bp, Homo sapiens
tcggcttttattcaccacctgaatcatggttcacatttttaaaggttgggggagaagacacagcttgtcccagaagtcatgctcgggtgtccagaggcctgagtgccgatctaatcgcaagtgattagaatgtggtgccgggagggataacagcaggaagcagcaggcacaagcggggtcgccagagggacagggatagt

SEQ ID NO: 450 - DNA, 266 bp, Homo sapiens
tcccatccaatcacatggcaccagcccacattgagagaagttcttctccactcagactactagcttccccactgagatcacctccagaaatatcttcacagacacgcccagggcagtttaatcattctaatcaaatgccaaaccaacaaagtttccctttcagcaaatgatgaacaggctcactccctgctgaaacatttagaataactattgcaataattgagaataaatgatattttaccagttaaaaaagaaaaaaaaaaaaa

SEQ ID NO: 451 - DNA, 900 bp, Homo sapiens
cccccctcaatcactcatataaatcgtaatctaacctcgactaatacgtcaatcaccatctctactgcactactgttgctttcatctacctcgcacattcctaccatacgccagtaatctacaggtctctacataatcgttctgcctacgcagcccaccacacactctctcctctacaccaaccccagctttacaatcgcagtacacttacacgcgctaactcaaccacctaaaagccacaataggtaaccggccaccccctccaagataccgcgatacaaaaagatcaattgcccataaggccctatcacaagtaaatttcaaccgcagatttttttaccgccttcaaataccctttttttgccttgtgtagccctaatttacttggatttggaggatatcaagaaaatgccttgtaagtgtgagagagaccttaacggtgggtgtgtgtgaatactggcaacagttgcagttttggaggtggccaagagcacttgtttacagtaaccagttattactacaggagactacttattccctcgtgtttagataagaaatgtgtggtttaaacacttataatgtctttgtagcaaagtgcattctgaaagtgttgcatgtgcttccctctttttggggacctggaaatcaacgtaaaaagtgagatcctcgatctttaagggtctaaatgttctgccttcagttgtgcctgcttttcacatatttaaatcattaggcgctaaaaactgtaaatgcttcgttggtcctttggtcctcttccttaatgggctccaccctgatcccagtggtccagttggacaacagacactaaattaagtgctaccttaatttacttgataaagtaacttgataaatacatgataaataaactatgatcggcag

SEQ ID NO: 452 - DNA, 396 bp, Homo sapiens
aaaagcaacaaatgatcaggagaattgggggcttacccagtgagcgaagctttggcaaaaatgtaatgccgtgcagcacaatgcaagaggaggccaaggactccctgcaaaacctcaacttcaagcctaaaacagcctgaaggttgaaaaactggactgctggctccagatgaagtccaccctttcccaactgattctttctgaataatgcccacctgcacactcagaggatggggtggggccatgcaagctccctgccgggaacccagcctcttgagctcctatgtggtggggcaggagccagttcacaggcttccctctcactctgctgagagtttttctcttttccttttttttgcccaataaattccatttttctcaccaaaaaaaaaaaaa

SEQ ID NO: 453 - DNA, 562 bp, Homo sapiens
catttccgtgaagcactggtgtgaacaacagtcacaagtgggaagagcaatggaacaaggaggaggaggaatgaaatggtcctataattttagaaagagtgtgaaaaaaagaagttagacttctaggttctatttctggctctgcttctgttttcaagcccacgcagccatctttctacctttttctccattaattgccaaaggtggagaagaatatagtctgagtatgaagcaccttgtcatgcttggatgaaagatcctgtattatgacgagcgcaaaaccagaattgatcatgttgtgaaatccacactgtgttgtaatatattggtttcaagcttttcaggaatacttttgctctgaattcataaggttagagaaggcaaaattgcattttaagatgggaatgccaaagatggatgtagcccattgaaaacaggcaatggctttgagcaaagctagccccacaataacttgtaatggtagtgaagtttgtgatccatcatatgtcttttcttcctgcgcttttttcttcctaattaaataaacccgtactcgtcaagg

SEQ ID NO: 454 - DNA, 340 bp, Homo sapiens
cttgcgagtacggtttattttcattcaatattgcttttgcacatattgagatacacacagatctagtttattcattatctgccaaatagaagtctattgaatgcctacagcatgatttattcatctactctccagttgataggcacttgggttatttccagtgtttctctctcacagataatgctacagttaccatccttgtacatatctcctgtgcaagcgagtccccttctgtatgcatcttgattccttccttggttaccggtgatgaatttctgagtggttcagccacacccataatcaatgggaagaaggagaataggacttaaacctttttagt

SEQ ID NO: 455 - DNA, 431 bp, Homo sapiens
actttcctaatttttctacaatgagcatggcttttgaaatttaaaaaaagatgagaagactttggccaagatagattaagtaactggcccaagattacatggccagcaagtggcagagctggaaacctcagagttggacctcagaatttgtgctcttaatcatattttatagcctcacaataaattagaataaattaaccgttccaagcagaggattttagacttcatgcaacatgacagtacttctcaaagttgttcagggaataaaacactcagagaactcttattaatatgtttaatttcatcaaccagattcagcaaaatcaccaacagaaaacaagactatgatacatgtggacaaaaagaatcacagatataaatatcctgtgctttctcaataaatgatgctgccttactgaaaaaaaaaaaaa

SEQ ID NO: 456 - DNA, 126 bp, Homo sapiens
tattttttttattacagctgaaaactggaagaagagaacaaatattcatcaataagagaatgaatacattatgctattatatattcataactggagtgccgtaaaacaataaaaagaaataaacac

SEQ ID NO: 457 - DNA, 292 bp, Homo sapiens
aactgatagtgaaggtgctcagtgtttgttgaatgcataaatgaccaatggaaagaaggaagaaaaaagaaggaaggaaggaaggaatgaaggaagaaaggaaggaccagagagaggaacaagaccctctgcggagccagcaggtacaaatcagctcacagcctgcagaacagaaactgacagcgcgtcagagacctgcatgacagtcctggcttccactctggcctctcagtttcctcatatgttcagtgagttcatcatccttctcacacaataaagctggatgcggccg

SEQ ID NO: 458 - DNA, 386 bp, Homo sapiens
tcgcattttatttccataaactaatgaaatgaaccaacatatgtaattgcctggcttctttgtggggtcactaccccatggtgcagatttcagcaccacattaggaaacaagaagattgggctctgtagtcacagttcccgctggctgccctgttggaaggggagggttgaccatagggtacattttcccaagtcttaggtcttctcctcagctttgggtgttcacaggtgtgcagagtgtaggagttcattcagtcacagtatccacctcctggctggtgtgttcctgcaggagagtttatggtaaactgtttccctctcagcacagaagacaacaagatcttagtgactagcatcctccaggtatgacaatcagggcacctagt

SEQ ID NO: 459 - DNA, 434 bp, Homo sapiens
cggccgcataaggtttattgtctgatcacgtaaatctattctgggttcaagtgactctctgggacaatgttcttccatttaggaacttcgttatccaagctgcttgaatatttttttttcccaccatttcagctgaggtcttctcagtcaccttagcaggggaggaattctggaggctgtgcactggtatttatttcaaactgcagcctagttgtgttagatgtcacatctgctaacagcctatcggcctgtaactagccacatagctcagttcaatcccaagacatcagagaaaggtaatcttcccacgtgtctggattttggtcctatggggatgatttcttggaggctgacaaaatctatgactgcagctgatgtaatttacatggtcctgaatcaaggcaggtggattatgcattctctttgttttcact

SEQ ID NO: 460 - DNA, 515 bp, Homo sapiens
ttttttttttttttttcagggtgtcatagaggtttattgtctgatcacgtaaatctattctgggttcaagtgactctctgggacaatgttcttccgtttaggaacttcgttatccaagctgcttgaatattttttttttcccaccatttcagctgaggtcttctcagtcaccttagcaggggaggaattctggaggctgtgcactggtatttatttcaaactgcagcctagttgtgttagatgtcacatctgctaacagcctattggcctgtaactagccacatagctcagttcaatcccaagacatcagagaaaggtaatcttcccacgtgtctggagctgagacaaatttagagagccgagtgagtacaagggtagaagaagcagcaggaagagctctgtgggctctcttggtctccagtgaagtcatttctgactttgaatcacagaggtccttgaggagggctgccagaggaagtgtagcggtggagattaagagagtcgttgcagaatac

SEQ ID NO: 461 - DNA, 274 bp, Homo sapiens
tttttttttttttggggcttaaacaaatacggagtttattttgtcttgtaaggaagtatagggaggtaggcagtcatctagggctgatgaagcagtagtatgatgctagttgggtcccaggcctcttctgtctttctgctcaggcacgcaaatccagttgtagcttttaacctgatgctttatcctcccataattttaagatggtggttctatctcttgagaaatggctcagatggaaaatacacaaagattccagaaagttgagtttgcattt

SEQ ID NO: 462 - DNA, 327 bp, Homo sapiens
ctgccgatctcgttttattttagtgaagagaaataatatgagaaacagcttttataacttcttccatgactttatcccctatgttttccccatgagatctcaactctactagttcttctgccttgagggtagcttccagacttgtttggtttcttcctgtagccaggctgtggctgagaaacagctatggcttttgcgcttcatatccctccagatggatgaatcacacaagcagatggtatcattctggaaaaggctccagtgtgaacaggcccattgttcatttgggtcctgcttacagcaacaggcagatatgacaaccaagca

SEQ ID NO: 463 - DNA, 493 bp, Homo sapiens
atttaaagtccatcccagccatccttccaaagagcaaagaaagtccatagaaattcatcaacatccaggatgctcaggagcttccaggttcaacagatgcgtgagatccatagcagaaacattgctgtcctcttcagattcaaggtcagctggatttgaaggccatgatttacatgtgcagcaacaatggattcccaaatacgcccgctgcaagagacttagctccccaatcagtcagggcagcatcagggtgagctcagaactgggcacattcctcattgaacactcacctctcatcggggatcaacatgttcagatgtgccatacccaggatgattcatcgtgatcaaagaaaacaatgtgattgtggtaaatccctttatcagtgtagcttattattactaccaagaacttgaattgattcaagctacagacttgaataaacctcatgatttagtaaaataaacctcactgattttcaaaaaaaaaaaaa

SEQ ID NO: 464 - DNA, 233 bp, Homo sapiens
ctgccgatccgactttattgaggaaaagatgaatttctggttgctgaatttgtcaaaaaggtcatactgttgttgacattcctgtagtccgctttaatgttgtcagagtagccaatgtctcttggttgggctttagagagctcctactgtgagccccattggtaaggtcttcctttcaaatgccatcctagcctttgattgtcaacttcgctttgactccgagccacatcagg

SEQ ID NO: 465 - DNA, 392 bp, Homo sapiens
agatgctacacatgtgtacgtcccaaaatccgtgaattttaaatcaatgatgtccaagtttgttgttcccggagagacatcaggatcagtctgtgtaatgaccatccgctcagaacttcttaatggacgaccatttttaaaccaactaaatgttagctcctcagaaggaacagcttctacttggcaagatattttcacctcacggccaatctggatgttgtcatctttgtgataaggatctggtgtgatccaaaatcgtcctttttttaatgctacaacataaaaattccataaggagttagtgttactttcgtaactttaaggattcattcactctagataatcatctctgagctgaaataaagtaaaaccaaataaagatcgatcggcag

SEQ ID NO: 466 - DNA, 286 bp, Homo sapiens
aaatatttgaatgaatatttatcaaagcatgaagtcagtctacatcttatttttgccataaataaaaaaatatgtccaaaatgtgaacatattttattgttactgtggaatgtaacataaaagttttctaaaattgtttttcctaaataaggaagataatttcattatggcaaatatttttaaaagtcagcatccctctcctctggcagagaatctatgtaagtgatcttgaaagacagtgtaacattactcacaaaacagccagaatgaatgaaataaacaatga

SEQ ID NO: 467 - DNA, 201 bp, Homo sapiens
aaaactgcctgtaatttccaatgactaatggtggacatctactttctcggaaaagtcaaagagacattacagccaacagtttgaagaacaaaaaagcttagcaggccaagacacaacaacaaattaatgcttttcatgatgactagcaaccttcaccttgaatatatgtgattaaaataaaacctggcctcgttggcctca

SEQ ID NO: 468 - DNA, 249 bp, Homo sapiens
tcgggttttatttattcatttgtaaactcaagccagttctctattccactttttccaattatttgcttttgagagtctcaggattatccttccttcctctccttccacattttctcccctgtcccttctcctggccatgcttctctagtcccgatggtcttgtttagatcacaatgcggtttgtagattttccttcactctctctttcagaaaaaaatgccaaaatggtgttttaagaagcttttattg

SEQ ID NO: 469 - DNA, 367 bp, Homo sapiens
tccggccgatcttggtttatttatgaaagttttttattccatttgtggctggattatggtcttaaggcaatgacagcgctgctgctcggtgttaatttctgagcagtaatgcaaattgatggagcacaagactcaggccaccaactgtacagagtgattccctctgccatctgactgtgagcttagcaccaagaattcacatagggagagacagcgtgaggggccaatcttttggctctgtgcttgagagatgttttcctgccacagaagtggagcctatggtgggtgattggagtccatgttgagttccacatggttggggaggccttggaatcatggcgggaggtgagaggcacttctaacgtga

SEQ ID NO: 470 - DNA, 440 bp, Homo sapiens
acagcatgcaagagagaaaacaaacaggatcaatgaccccctgccgcccccactcccccgcagaatgcaccaacattggtatgaagcaacagtgaatccaaaactgcgtaatggcagcaacagccccaggcaaagaagtcatatcatcccagatccaataaagaatacaaccaaacagcacagatggaaggaggaggtgcttctaaaaccatgtaatttacttgtgcagcctccaacactggcttaagcattatcatccaacaacaatgaaaataacttctcagatttacagagaggtgacttccagatcttcctaaggaggtgcaaagatttgatagagagaagcacagtagaaagtaagccaaacaaagacgagtgggaagtaatgatggcagaggtgatgtgataaataaataatcccaaaagtaaaaaaaaaaaaa

SEQ ID NO: 471 - DNA, 305 bp, Homo sapiens
caggagggcacacccacattctgatacttcatcttggctggaagtggaagtttcctggtgctgtctgttttaaaactttttattatggaaacattcgtacatcacttataataaacctgtttgcatctactatccaggtttaatcaaaatcaactcatggataatattgtttcatctcctctcccacccattcgcctgtccccagaaaacccctgcatgatattacttcatccatccacgtcagtatgtatcttatttttcttagcactatcataataaaaatatcatatcgaaaaaaaaaaaaa

SEQ ID NO: 472 - DNA, 389 bp, Homo sapiens
tgataaaaagcagagttttcctgaggaagtcacttttaagctgagaagtgaaggattggagtttccaggcagacaaggaaggaaaaacattctacagaagggaacagcaggtgcaaaaacctgatggtggagaagagctctgggagaactggaaaagaaagcagagtagctgaagtagattgggttgggggagagtaggcttcattattctgaaccttacagaaaatgtaagggttggagctttttcctaagagtgcatggaagctgttaaggaagatgttaagaacagagaagtggtgtgactggatttatgtttttgtttatgcagtcttccctgctctgtgaagagcgggtcaaataaaagtaagaataaatgtagatctggccag

SEQ ID NO: 473 - DNA, 551 bp, Homo sapiens
ggtatgaagatggtttcatagcatcatccctcctcctgatggctggattccctcctccattttttttttttttggaatagtttaagtagaattgataccagcttttctgttaaaatttggttgtgaatccatctggtccaggttagttgcaagggtctgctgcttcactcctgaagtcagctagaccatgaacccaccaggaggaacaaactctggacacaccatctttaagaactgtaacactcactgggaggagccacagcttcattcttgaagtcagcaagaccaagaacctaccggaagtaaccaattccagatacaatgtcatactacatttcaacaaacattgtgctacaatacaatgcatttaaaatatttggactttttcaaactttcaacttttagaagactaacattttctttaaaatatatgttgcttttctctgttatttatgggttatttagccaacaatttgtgattgaagctgtgtgtccaagcaattggagcttctgaatttaataaaaacaaatcttcaccaaaaaaaaaaaaa

SEQ ID NO: 474 - DNA, 226 bp, Homo sapiens
atgctgtagaaccacatggacataatcacataatcatggtccttaaagaattttaaatgttttttttctttatctgatggctccattgcagacagacttggctgtgtccacaccagagcatgagaccgtcactgttttttggttatgtcagtgaactatcttcactccctcccaccaagaagcataggaatgtattcaccaacagaataaaaccagatgctggccg

SEQ ID NO: 475 - DNA, 265 bp, Homo sapiens
cggccgatcaatgtttattgattattgtttgtttgttccttttatgtctgagggtacagtggtgaaagcaaagcaagcaagtagggtagccgaggtgaccgttggggctgacagcatcttcagcagaaccaggtgagaaagagtccccgtgaggcccatggtagaggaaggcacaggcaagcactggagagctgcgagtctccgtgggaccagcagctactctgcagtggcagggaagatggaagcatcgcctggccctaggagt

SEQ ID NO: 476 - DNA, 544 bp, Homo sapiens
attccagcgtgatcattataacgaggggcacatatatgatggatgctacataaataattacatggagaataacactatgggacatgcggactcacgtggggtgaatagcagacatttagccctccacagaatgagaatacacactcgtgaattcaaccaaccatgcatggaaactctgcaaggactctgcatttcatctggagaacaatggactggaagagtacataatctatccccttcacatcaacacacaagcactgatatttaaaatgatatttgctgctacaacctccccagatgcagccacaacttactttgggtgttctttacactgaacacataccttacctgacagtgcttgctgaagggcaaatttcacaaatgtaatctttggcaaaatcccttatattcctggaaaattttgctaaaacttcatcatttttgaagactctgatcaccctacaaatggcgcaattaaacccaaaggcggcccgttcccttttagtgaggggtgagatcaagaatccttggttaattgatcggt

SEQ ID NO: 477 - DNA, 240 bp, Homo sapiens
cggccgatccagatttattagagaaagtatgaaaatacattacaagaaagcaacaggcagttcagcatgagagaagttgactgccaggagacaaagacttgctgaggattttatagaaagggacttgggaacttgcattcttctgtcagtgggatgcttgataaattgaggcatttgatggtaagcaggaagtttgtgagttatgtacgttatttgttccggagggctatatgtcctggg

SEQ ID NO: 478 - DNA, 864 bp, Homo sapiens
ccacaataagctgacaaaaagaaaagaatgtgtacatacgtgcatcagcctatgacttgtgaatgtgtttcagtattctttcaggtcctgcataccagtaaaactactgatgctagctgttgcctaggaccccatgaggaggtgactcaacaaagaaggcagttttcagatcctgatgatttcatccccctaaccctgaccaatcaacaaccacaattttctggacctacacctttcacaattcttttacaaaatgccgcccataacttctttgggagacagacttgtgggtcctttccatccccttacttggccgtcatatgatcaataaatgttttctctgctgcgaacactgttgtctcagtgcatttgtctgttacttcacagcaggtatataaatttgttaatcctctaacaatatcattgtgctgagtataattcagtttgatactcaagcaattattaaacaacattttaaaaggctttcctaaatattttcacaacttacttaaattatcaaatggctaataaaaatagtctatacaattttatcaaccaaagaaacatgtgaactaaaattcctcatttttaaaagataataataaattataacttacaaatggaacctattttgtttgtggttcacatatataatatatatacatatatgtaatatgtatgtgtataaatgattaaatttactttctttacagacaaatcataatcttcaaaactcagacacttaaaaacatttattattatataattataatattgatgactttcatttagtgtaacataaaaataaattatcataagtaggtagaacaactaatatttttagagctatatgaatactctgta

SEQ ID NO: 479 - DNA, 208 bp, Homo sapiens
ttgtcaccattccacctccacacctttctaacgacagaaccatcatgtatgtttgttggatgtcctaaatattacaaccccaagatggcaaacccctacctacaatgaaactttgtatttgggaagataactttaagaaggaaaagatgctgctatttggggaaacattaaaaccagaataaaaattggaagtaaaaataaaaagcga

SEQ ID NO: 480 - DNA, 212 bp, Homo sapiens
  misc_feature (1)...(212): n = A,T,C or G
agcacgaagaagagaaaacagaaaacatccattgaatcctctgcctctggtaatgtatggctcccagntatgcctccttcaagagcatgactgacccaattactagtatgagcaaaaggaagaaacccccaattgaactgatgaaaaacttaaacagtggcaatgaattataacccagttaaaactggatctgaaagaagaataaaagacga

SEQ ID NO: 481 - DNA, 444 bp, Homo sapiens
cggccagcatctggctttattaaatactgtttatgttgtagactttgcccttcttcagcagcaagcaactgccttctgttctgttgttagacaatggtgccgtcaaacccggggacatcagcacatctcaggcgctgacaaaccaggaacgatgccctctcatcgcagccacatatgcacgtgaacatatgtgagccacatcgccaaagctaacaggtagttatgggcaagtcttcagattttgcagtttcttcttttacttttcagtaatacattattacttacttgcataaattagccatgttggttcagatgaagagacaacatcacacgttgctactttgcttacagtttctttgcagcagaaatgcagagcagcttggctgaaaggtcccagcctgagggtctctcatgagggtgcagtcatcacctgagcctgcagct

SEQ ID NO: 482 - DNA, 264 bp, Homo sapiens
ttggccccgcacagtaatacgtatatgagagcgaactgccgcatcgtgctttatttaatagaaaaattcagggtggaacaaagacatgtagtgccctcttgttgctggagaattactatttttaaactcgacatttgtctttgcttttttcttttgtcttcaaaagtcttcaaataaaccagcaaaattcagagaccccatcctcttccttcagcagtcatgtgtttcagggtcatttccagggcaagcgagacgtcctaaaat

SEQ ID NO: 483 - DNA, 394 bp, Homo sapiens
ttggcttcttctgacagtgcttcagcatggaagcaaggagggggcctcattactgccagatctcacttcaacaaacagtgaagaaggagtgtggtagaggagagaagaaaacaaaaggatgacagagctaagaaggacagaaatgaaaagagcattcgttcagtctgttctctcattatcgtacctcggaaccttggaagattcttttttgagaattcttttcattatgatgctaggaaaatgatagactggaaaagccagaaattctgaaattctataaaacatgatctcatcaataatgtataccttccctacaacttgcagaaaataacatattaaaatgtccaattttaaagaggaaaaaaaaaaaaaaaaaatggcctcgttggcctca

SEQ ID NO: 484 - DNA, 344 bp, Homo sapiens
cgtaccgtgagcttcttcccgccgcatcgggttttattggcaggtgaactcgcagcctcagctgctggtggctgcaaccactcactaagccatcccatgtccagggctggtgggaagccctgggaaggcaggagccacacatggagttctttctgttggaggaatcttgggctgtctcaggcacatgctgagaatattactgggcctaggcaccgccttggggtccgtcatggagatcttgactacaaagcagcatggcctctggttctaggatgaaatccctgttatcataatgtgcttttgcaccattcttcctcgaatgtcgtgtccttatttattcgcag

SEQ ID NO: 485 - DNA, 256 bp, Homo sapiens
caagtggcatggagaaaggagagtatctatatgaacatacccagaagaatctaaaaatagaaaagaaagaaaaaaaagctacatattgctggacacatgaaaagcccacctgactactgataaggactcacaagtaaccatcaagaagcttaacacaaaaccggaagcagtgagccaatcatggcatgtcttaatctttcagtaataaaagttgcgattttcaaaaaaaaaaaggggggggggaaaaaaaaaaaaa

SEQ ID NO: 486 - DNA, 362 bp, Homo sapiens
ttccggcagcatcgggttttattactacttaaatcagtttccccgagcattcaggggtcagagtttttaaggacagcttggtggggtgggggaagccagtgagccaggagtgctgattggttaggcagaattgaagctgtcctcttgggctgagtcagttcccgggtgggggccacaagatcaggtgagccagtttatccgtctgggtggtgccagctaatccatcaactgcagggtctgtagtcccagctatttcataggctgaggtggaaggatcagtccaggagctcgagactgcagtgagctgtgatcacaccactgcactccagcactccagcctgggtgacagtgtgagatgcctt

SEQ ID NO: 487 - DNA, 364 bp, Homo sapiens
cggtggaccagggatacaagaaacgagactcctagcccttgagatgctcttcatgtggggtcattacttagggatcagcaatttgctaaagatgaacagattctaagaagatggttttccagcagcaaccaattttaaatctggactgtgcaccaggcacctcttggatggacagccctgaaacatctttcatgcaactcctcaggcagcccagaaacagccgggaaccattcgccaggagctgtggccaacttaataactcatccttgtattggtttccatcctctgtccttcatccgtcttgtcttttactcctacttgctggatcacacatcccaataaatctttggcctcgttggcctca

SEQ ID NO: 488 - DNA, 408 bp, Homo sapiens
agaactactttaaaagatgattcagaaacctcacagagaaagaaatgggaaaattgtcagcctgttggcaatgttaagaaaccacaaatggctgataaataatcgctgtctatcatgcagggccaagaaaaaacagaaaaacaaatgaagaaaatcacaaaaacaactgcaagaagccaaaaagaatgtggagacccactagcatggatcccagagaatgcagagttcagtgactgtctttccttttcctgtgatacacaacaaagcatagaaattttgacatttctacaaggagaactacaaaacactgctgaaaggaatcagagatgacaaaaataaatggaaaaacattctatgctcatggtttggaataatcagtatcattaaaataaacccagaatgcgtccg

SEQ ID NO: 489 - DNA, 308 bp, Homo sapiens
tccggcccatccaggtttattaagtagtcagggatgtccttctctttcaacttgcctttcccggcgtggccccttgagggtgttcttcaatttgtgaagatccataatgcagattcatgaccaggattggaactgccctcttgtggttccgttcactcctcttctctctctgtgctctccctctctgcccatctatgtgcgtttccttcacgggctcttcttcctcttgccactgaacatgagtatccctcaggccgccaccttgacatcttctcattgcactttgcccaccctccttgggaagtctt

SEQ ID NO: 490 - DNA, 218 bp, Homo sapiens
tctttaggtttttctatctacaagatcatgccatttgcaaagagggagaacttgacttactcttttccaaactggatgtccttcattgctctggtgatgtacctgctcccccttcaccttctgccataattggaagcttcctgaggccctcaccagaagcagatgccggcaccatgcttcttgtacagtctgcagaacttgagccaaataaacccaga

SEQ ID NO: 491 - DNA, 320 bp, Homo sapiens
ttcggcggatctttatttattggattagccaatataattattggcttcaggcccctaagaatagcagtatagtattcggtttaaagcacagattctgggatagactgcttggattgaattgtggtcccatcaccttctagccatatgaccttaaacaagttttgtaatgtttctgctcctcagtctttccatataaagagttcctcccaaggaaattatttgcacatcgattctagataacaattgcactgggagaaccatctgatataactgttttggaactctagagtccattgaaggcttgcaacatctaagggaag

SEQ ID NO: 492 - DNA, 446 bp, Homo sapiens
atggctcaagcaatatcattagttaaagattaacgttcggtcgcatttccgatggtcattaatcccctgtgcgtttatctccccctgtggtccgcgagccaaaaactactttacacctctgccttctcatcattatccatattactacaatacagaccctgccggatacgataagaggggatcacggcaaacatttagatgacctcccctgacagccgcccaccaccgacacagcacatattttacctccgacttcaacttcaaacaggaaaagtagcattctatatacaataaactcaaaaacatggtatgaaactattaaaaatgtaatagaaaaagtaaaccgcaaccaaccccgaacaatactatctgaggcagaccaaacaaaaggcagaagccatccaggcaaaaggcggcatgagacgaagcgtgcacccggaaaacct

SEQ ID NO: 493 - DNA, 248 bp, Homo sapiens
cggacgcactcttggtttattaacacaattttatttaatcttctcaacaactttctgaagataacagtattaccacggtgtttttgatagggaaccggaggctgagagaggttgtattcattgccagtggttacacagtttgtcagtggtggagctgggatctgaattcaggtcagcctgttccaaagtccaatctccttccagagtaagattcattccgtttagaaaatatgggtgtccgtgcccct

SEQ ID NO: 494 - DNA, 583 bp, Homo sapiens
gagcggggtttgttgcggcgggttgtttgatggaaaggggattccggccgcatcttggtttattaacacaattttatttaatcttctcaacaactttctgaagataacagtattaccacggtgtttttgatagggaaccggaggctgagagaggttgtattcattgccagtggttacacagtttgtcagtggtggagctgggatctgaattcaggtcagcctgttccaaagtccaatctccttccagagtaagattcattccatagacagtaacaatgacagtcaagccgctggaagcctagtgtctattctaggaggcgggagacagatgggcctttctgttcactacagtggaggaaccaggtctgattcatcatcgttttctagttctgaggagaaggtaggtgtgcagtaagtttttcctgggtgaatgaatggttagacactgctgatgaagagggatgctgtcctttatgcagggtgctgatgctctccatgccattctgtttcatggatgctgtcactgggagtaggatatcacgtgtcaggctgaagacacccactgccacatggtcttcaccgg

SEQ ID NO: 495 - DNA, 226 bp, Homo sapiens
tagcaactttaaatgaattctatagcttcaaggaaatgagtgctgctgacaacaaactgatccttccctagctgaacctccagatgagaacacaacatgtccaacaccttgaattcaactttcctgacagcctgagcagaagacccagagaagcctagctcttgactcatggaaactgtgagataaaaatgtaacaaagagaaaaataataaacctagatgcgccg

SEQ ID NO: 496 - DNA, 222 bp, Homo sapiens
tctttgtttattcattcattcatttatccagtaatgaagacattccagaagtcaggtactatattgtgtgatgtaacactgatgaaggaaacaaaggtcatgttttatgctgttgcttttctttttctttttttttcctgtgtcctgacagcaatggaagctggaatcataaagctggagttccttctgacacatgaagtatgttcaagagatgattgagag

SEQ ID NO: 497 - DNA, 334 bp, Homo sapiens
cttctcccgcgacccgatacatatcgggttaacgagtaccaaactggccgcatccgggtttattcaatttggccacggcctgaggatgggagacccaaactctcgaatctgaccttcctttgtaaggtgggtagggcgggaggtgagattcccccatgatcaaagctgtttgcgtcccttcgtcaatcaaacttctggacatcgccaaggaggtcgcatgacctcaggatcttcattcttcagaagcaaaacaagttcatgaatcttgcaggcaccctccagggggcataatgtgacgttaatcaattactagtgaattggtgaacaccctcta

SEQ ID NO: 498 - DNA, 199 bp, Homo sapiens
tttttttttttttattttcagaatttattcggcaaaaattcaacttatatagaatcagtcaagatatttcaggcagtggtgcaacttctgtaatgatttggctgattggttctcttctccacttcaattggtttgtctgatcatacatccagtaaatttccaatatctgcattcatgctacaatctccatgcagcctgt

SEQ ID NO: 499 - DNA, 854 bp, Homo sapiens
ccgggcgcatttcgggctttattattaccatagagatttatgttaccacaggggtataaaaagtattaatgaattaacagaaggtgttttatatttcatttattacatctcttagcagactgttttttactgtaaatgtgaacacacagttttccacttcttacttgttcatagttttctcgacaaagagtagctgcttttcttaaaattttccagttttgtagtttaaccaataatagtttcagtgacttcattacattaacacccaattgatacataaacttcagaggagtttgccttaatcagtatgttcattgctttttaaatttttttgtctttcacaaagatagaaattcagtgcagttgtttgtttattggtttagtttttctgggctacaaacatcttaatttcttgataggccagttgtaatgtgtgactaaggactatattcttcaaccattgcatttgaagcaatgggcaggtgtgggatttggaagcattatgaaagtaacatcatttgtttctgcagactttgtaattttcttctggaaaacccagattattcatagagagaagacagactcattataaatcccagttagcatcttgttggcccgcccagatgacacaaaggccagtgtcatggtcatgttctgcattcactgcctggaattgctgtgctttgttggtgcgggtgtcggtggaataccttactaaaatccggtggcttgatctccaaccacccattaatcctcgaactgtcctattaccatttcgccaagggggtaaattagaaagtcatgcattttagctcatcattggtgggtaatagccctcattgcctcgtattacc

SEQ ID NO: 500 - DNA, 625 bp, Homo sapiens
  misc_feature (1)...(625): n = A,T,C or G
aatacgtaagagagacagtcaaagaatctatggggagttggaagatcaagcaacagatcttaataaagttagttctcaaccatacttgaccatataacacactaaatgccagtttagatcacaaataatgacaatgattgaagtttttaaaaaccaaactgtttacatcttgatatgagatctggttaaacagatgtatagtataggctgtatacaaatctcacatcaaaagaaaaaagatattccactctgggtaatgacctgcatgctgaagtacttagagggaagtgtactcatgtttttgcaatttactttgaaatgcattatcatgaaatgaaacataacaaagatgtgctgatggacagacagaggacatatgtatgataaagaggatacantaaactgttaactagtaccagtggaatttgctttgtaggattaaagatatggagaattcgttcaattctttgtgggaaaaggaagataagaattacaaggaaagatagaagttaaagacagacagaattcaaagtggctcanactgggagatcgcactgaagnatagatatatnctgaaatcctatgancntcggntagcntnntaaaaactggnncnancnnagca

SEQ ID NO: 501 - DNA, 346 bp, Homo sapiens
aaattgactaagatgtgacagatggtttgacttttcagtgcaacatctataaaagctaacatgggatggatgtgatgcagaactgtaccgccttctaacagcaagcaatgttcatccatggatacatgaattaattgggaaagaattctcatctgtttcattaagtgatgcattcccaaaacaattttaataattttaataatgattttaatgaatttgttgttttgatcagtttatatatatattatgtgacagagaggtatgacagaataatcaataaaagacatcaagaaaaaatcaatattacaataaaattgtgtggaaaagtagaaaaaataaacataga

SEQ ID NO: 502 - DNA, 597 bp, Homo sapiens
agacagagcactacggaagggagccccattcccaagcatggtgtccaatacactgaaagaataactgggctcagtaatgcacctagagactcagattccagacctgcccacttgctttactatccaaaacaaccatgacacatgacttctctggcggggtgttggccaagacaaactgaactatagaagatccttgacttgccaacgttcaaatgatgaactttgaaaaatagcgaaactggctgcagagcaaaagcttttcagctctgcacaacaccaacagatggcgctaagtgtcacccttgtggagagcagagggacctcggaagggcctttggaaatctaatctggttttgagttcttggtgggaaaatgcacctttaagttgggggagtttgaagacgttgccaagacacgtgctgcagcatttgatcttttctgccgcactggcttctgcaattaacatgctttcaccagtgaaactcaggttgcggggagagcattcttccaggttcatgcctgttgtcatggagtaattataattcatgtctccgttcacagtgtcctggtttgtagaataaaatccgatgctggccg

SEQ ID NO: 503 - DNA, 598 bp, Homo sapiens
actcagagaagaatggaggcagaggctggagaggaggctgaggatgctggacaaccctgttgagaaggaaaagccggcacacaccgcggactgagctctgcctgcctcaccgacttcaaagatagcaagcgaccacttttctaggggaaaaaaactaacactcaagttgtgctgatttactaaacaggacgctctctatttgtgcttccatttgctaggggatttacatgtgaaacctcccccagtgctaatgggagttattatcctgctcaatcccctccgcacagaggacaggatgaccgcaagtgggataggacgcttgggctatttaataaaagagctcttggaattagcactctccaggtctcacagacccatgtagcctagtatatttccacatttccttgtcattttgaaatgtttcaagtcttgagacatttgaagtgttttctctaagcttaccgagggcaatgaccttgatgaaaatttggctttgccaggtgtcctggaaaaagagtcataaaatcttgtccttctttccccgctttttgtgaacacagaaatgtaactgcttgcagaaataaagctagatcgcgcg

SEQ ID NO: 504 - DNA, 302 bp, Homo sapiens
tccgggttcttgtcccaagaagaatgaggttacatggacaaccagagagtaagcaaggcagagaagaattttcctgagtgacagaacagctctcactctacctgaggagtagtatcctgagaagaagaggaagcaaccagagttctccctctgccatgtgagaagacagtagaatgtggctgtctgtagccagaaagagagacttatcgagaactaaattggctggcaccttattcttggacttcccagccttcagatctgtgagaaataaacatctgttgttgaagtcaaaaaaaaaaaaa

SEQ ID NO: 505 - DNA, 379 bp, Homo sapiens
tccgggttcttgtcccaagaagaatgaggttacatggacaaccagagagtaagcaaggcagagaagaattttactgagtgacagaacagctctcactctacctgaggggtctgaaactcctgggatcaaggaatcctcccaagatgtgcgatgcttattgaacattcaaagtaggcagatgactcaaaattcagtggagagatttaagagtagtatcctgagaagaagaggaagcaaccagagttctccctctgccatgtgagaagacagtagaatgtggctgtctgtagccagaaagagagacttatcgagaactaaattggctggcaccttattcttggacttcccagccttcagatctgtgagaaataaacattga

SEQ ID NO: 506 - DNA, 133 bp, Homo sapiens
tccctctttattataggcaagaaaaataatcttattcttcttcatgagcttcttttttgtggaattctcattcttgttcttttcctcttttgggtgtggcttgctgtttctctccctttggtgcgggtgccag

SEQ ID NO: 507 - DNA, 357 bp, Homo sapiens
agtaccattgctataccacattctcacttgatcccctttggatgaaatgaaagaaacagctggtttgactgagtagtatcctgagaagaagaggaagcaaccagagttctccctctgccatgtgagaagacagtagaatgtggctgtctgtagccagaaagagagacttatcgagaactaaattggctggcaccttattcttggacttcccagccttcagatctgtgagaaataaacatctgttgttgaagtcacccagtctatggtgtttcgttatagtaactggagaagtctaagagaatacagcaaaatggtttgaatatatttcaattttacaattaaaatgttggaagaaaa

SEQ ID NO: 508 - DNA, 652 bp, Homo sapiens
  misc_feature (1)...(652): n = A,T,C or G
ggatccagataaaggagctgaagttcaaggaaattcttattcattcaatcaactcatgctgagagatacattgctcagaaaattgtccggttaattgacaacagagtaaatattggaacctagacatgttgactcactcagagctctgcacccctctccactccttcactgctacactgtacagtcgcgagaagacacagacataggaaaaacagaaagttttccgtcgtttgatggcatgggcaggagcagtggctcatgcttataatctaagcactttgggaagccaaggcaagcagatcagttcaggtcaagagttttagaccagcctggccaacatggtgaaaccctgtctctgcagaaaatacaaaaattagctgggtgtgctggcaggtccctgtagtcccaactacttgggaggctgaggcaggagaaccgcttgaaccctgtaagtggaggttgcagtgagctgaaatcgtgccctgcacttcaacttgggtgaaanaaccanaatcttttnaaaaaaaaaaaatanttcttanctggaaaantgctnggcatttattaaaccaaaggcgggntttttaacctcnngnaaatccnnancttgaatttaaaaaaaaaaatttggacttttttgnaaaggaatctt

SEQ ID NO: 509 - DNA, 439 bp, Homo sapiens
tttttttttttttggcatcatctagattttactatttctttccatccattacaatgtcccacccataccaaattcaatttattttttagcaatttgccttcattgaatcttcccaattttcatagaagcagaggctcctgttcggcatcacacgattgacctcatggcattatcatcagtcggagtccaaccaggaaaacaggagccatattgagtcctccatttccggatatatctcttgtgctgccaatccctgagtcttcagaggttttgcagggtaagaggctgagtggctttctggctttccccactgctgtctgtagggattcaggtctctcagatctgccaagtccggggcttctcatgccgttgcttcccaggttcctacgctttgttgctgctatcttttcccctgttctctttgacttgtgggttaatg

SEQ ID NO: 510 - DNA, 1133 bp, Homo sapiens
  misc_feature (1)...(1133): n = A,T,C or G
cggccgatcgtgttttatttttataaattgtatgtttcatgagttttcttacaatatgcactcatttattagcacttacaaaaatacctttgaaaatatgttggcattacaccactctgtagctgtctggaaatttcttgaaaacagaaaatacaaattaggaaggaaaatgtgaaagtataattgttctggactcctaagccaagattaagggctgttttgttttgtttttgttttatgctatccctactggtgccttctgtttcttcttactggctcttgataccatagaaaataagtcacacattctcctgggtaatgttcctagggagaaataagagctatagagaaatcttgtcccattgcttattcagtccaactcatttctagtttgattttaactgggcatatggtaggcattaaaaacttgttgaaatgttcttcttttgttagcatgctctaaatcagagggagtccaaccactaaccttcttggacatgtcccttgttatggattacacacagaagacaggtctgacaattattttcagcacgtctcattttaaaaaattttaaaaanaccccaaatgcaagtttatttgctcttatttttatttttgaaaagagggcttttctttttttcaaattttatgtgagtcccaaacatatccaggcgggttttaaggagctgggttcccttggtgaatcagaatgtgttagattatttgagtcctctcgtaatctgcttagatggacaacgattccttgtcaaacatagtcacagatcttctttttcttggcttcccaaagtgcttagattataagcatgagccactgctcctgcccatgccatcaaacgacggaaaactttctgtttttcctatgtctgtgtcttctcgcgactgtacagtgtagcagtgaaggagtggagaggggtgcagagctctgagtgagtcaacatgtctaggttcctaatatttactctgttgtcaattaaccggacaattttctgagcaatgttctctcagcatgagttgattgaatgaataagaatttncatgaacttcacgttgtttcctctcaaactcttgttttcttttccctctgtagtagataataatgataatttgttac

SEQ ID NO: 511 - DNA, 422 bp, Homo sapiens
tgaggccaacgaggccagatgtttattacaatattacttataaagacagttaccaaagactaaatccttgaatctttacatctttattcttatctacattttttcaaatgttctatggttcctttatataattaaagcaattcagtgtaagtgttatttcttaaaaactctattccatcttgaaggtctagtttaaggatgcatctttcttcatgccttcctcagtcatccagtggttcctcttccttggcatttcaggtgcatctaggtctgggtctctcagctgatatgagtgactgaagagaaggcagttgaggtgtctgatgaacagtgcatggccaaaaataatcctgtgatgatttggagaattaggcaggcaccaagaagtgagccaaagtttcatcaggtagaaatgctggagg

SEQ ID NO: 512 - DNA, 306 bp, Homo sapiens
tttattggcaataaaatgaggccatgagaggggcggcgaccctcccaaatgacatatgacgagttgaaaatgctgagtggtccctgggtctccacacctgcagcccagagcctcgcgtggatgccctcaggttgctagtgtgtcctggctccaggctgcagcctgtctgtgagggggaagagaggtctgcagaagaaggtcatgaaatggtgaatagtggcaggagaagttcctgagaagctgctggaggcatagacactgagctggacagtttctatccacagtcttctttaaaactccaacaac

SEQ ID NO: 513 - DNA, 337 bp, Homo sapiens
cggctgatctacgtttatttttctcatgcaacagtctaaatagggaagggggcatgtagtttggtggtggcttgtttctcatgctcatccagggactttaaactcattcctcccacttttctcaaggtcttaatctgcatggttgaaactggatcatggacacaaccacatttcaggtcacaggaagggaaacagagatcaagaggaagagcagaagtgcatatccgacatgtcgaggtccagacctggaatcagcaaacatctcatgttccagttacgttccatgcagagactcaggagtatagcttctattatctgtagcggtggaaattagaga

SEQ ID NO: 514 - DNA, 867 bp, Homo sapiens
cctgggcctggacttgccctgttagggagaccctgaagttgagcttcacctctgcatgtgtataacaccaagcagtcacactacaagaagggaccatagtgatctcagtcaactccctcatataacaaaggaagaaactgaggccttgcataggcccagctgggacttggccccagtgatggaggatgatgtccaggtcccaactccccggcctctttgctcttccttcccactggcccagcttcaccaggagctgatgagttaaccaatcctgaagaagttttcaaggctcatccacactgtaatgtatgacaggatttccttgttaaaggctgcatgatattccatcactatcagaccatctgtcaagggaccttcactttgcctagagaaggagaagatgacccctgggtcctgaaagagaagtacaagttaggaggaaggaaggctggatagaaataagtttctaggcaagcagatactatgtgccaaggcctacagacaactcagcagcaattgtgcttagcacaatgcctgggcacacaataagtatgcaagggctgctaccttctggactgatttggccccagactgcatcatgagtcagaaaaaccactccgttccagtcacgatatggtcacagaactttggtgtttcctcaactgcagagaggaacaatatctaacttctctctttcctgagaggagtcctgtaaggattcaaagagatcagaaggtgctaaagttgctgctggaatccagtcacaatccctcacgctgaagatatgaaaggacagaggccaatatcaagctcctcacacaacttcaatttaaattaaacttcctttaatgaaataataaacgtaga

SEQ ID NO: 515 - DNA, 132 bp, Homo sapiens
tcaggcccgcatcggggtttattgcagcaaaagaatatataccaaaatcagccaaaggaagagatgcatggggcagagaataggagaattcaaaacgttgagcatctagtcgtcctctcccagtgttaactg

SEQ ID NO: 516 - DNA, 457 bp, Homo sapiens
tcacaggttggaaagcttattatcttttgcaactacaggctactggaaaaagttttcctcttcctatgatccccgtcatggtgaattcagcgacataagcagctcctgagctactggaaaaagttttcctcttcctgtgatccccacgatggtgaattcagcaacataaatagctcctgcgcacacgccaggcagggatggcgaagaacacacaagaaccctcactgcctccaccaaaagggctcagtttaggtacaagatagcaagtgacatctcgaaatgaggaagaaggatgtttcataataggtgactttttaaaataaactcctccgtgccaggtgtcatgtaccttacatgtattaactcaattattcccctctactaataaacccgccgcaggcgagcctgaatagtgtattatataatacacatccccaaaaccctctcgctcaccact

SEQ ID NO: 517 - DNA, 137 bp, Homo sapiens
tcgcgctttattaagtaagaacagaaggggtggacttttacaactaccctgccaggatttgtgtgtttcaccgtaccctcatgagcctgtgtctttcacgtctgtgtctttcacataaatgacatcctccatgaggg

SEQ ID NO: 518 - DNA, 152 bp, Homo sapiens
catcttggtttattaagatataatccactaaattgttgtgagtgatagattgcttcagagaaaggtgctcttcatttatctgagaatcagaggacgtttcctataatctcttcctcctggcactgttgattggtccagagacaggcacaatc

SEQ ID NO: 519 - DNA, 255 bp, Homo sapiens
cgtatcctgatcatcatctactagaacagcaagagaagataaaactggatgtgcgagttcaaaggtctacattttgcaatacgagagaacagctgaattgaactagggagacatgaatttgtcatgaataaatcttgcagaaggactgtattcaaactatggagatatgatatacagtgaatatatttgtggttagcaaaatgatgttacagttttatgataataaatttcttataaaaaaaaaaaaaaaaaaaa

SEQ ID NO: 520 - DNA, 454 bp, Homo sapiens
aatccaagttcaaggggaaaagtcaaggactagaatcacaggtcatagcatcattcagttaagcaggaaactaagataagcagtgttccatcataagtcttactcagggaaagtaactttatcatctgcagtgcacaagaccagaagaatgaccgatctttacccctcacctcattataacactaaaacctctgccaagggggttcttatctgccattttctgctcatgtgatgtatgtgttagcatgatcccttactacacctgagcatcctgcactccaccccatacatgtagtgatgctcacctacttcttgaattattaatgtcacctccttaagacactgcaatgcactcccctctgggagccggctggagaaattttgctccagtactgtctcccttgtgttccagcataaccccctaataaagctttgtctgggaaaaaaaaaaaaa

SEQ ID NO: 521 - DNA, 210 bp, Homo sapiens
agggaggaggtgtgatcacgaaagcagagcttggagtgaggtggccacaagcccaggaacaggagcagccaccaagcaccggaagaggcaagaaggaaattctccctggatcctgcagaaggaaccagccctctgacaccttgacctcatgaacctgagtttgggctctggcctgcagaattgtaagggaataaacctcgatcggccgaa

SEQ ID NO: 522 - DNA, 658 bp, Homo sapiens
ttttttttttttttttttgtgctttctatttaaaagttaatgttttgttttgcattatattttttttcctctctgtgttggaagcaaagacagtaatgggaaaaggggacaagaaacggggcaaggatacactgaaggtgatatatatgatatatatatatatatatcttcatagatggtggaattataaatggattacatatatcagatagaattaagtgtttgcaaattaaggcttgtttatactcttttgcaagcaatattttaaaatctgtttgtttattttttttattttttggaagccaagccagcagttgtttaaaattcatgcctctgcataatatatgaagactacatagatgagttttctggagatttctccttgacacatttagtttctccacgttgcttgtagaaaggatgattccattctctcaataccaccttccaccaggagaagccattttctttcctgaaggtcaacctgtttgactggtgcccatatatagttaagagtttctgaaggaagaagggtcacgcttaatagatttgatgagtccattaagcctggcttccatcttgttgctttgtttgtgcatttatttccattttggtatcttagcagtcatcttcttttagcaaacattgaggtttcagt

SEQ ID NO: 523 - DNA, 504 bp, Homo sapiens
cccagggtacaatgaggagccaggggtcgcacacatggaagagagctctcaccagaatccgatcatgctggcaccctaatttcaaatttccagcctccagaactaagacttgtgtgggagaccagaatatgccttaccatagcattaaggactgttgagctgaaggcatttaagaagaaacagatacagcagagctctctgccctccctctatttgcctgaaagcaggacacagatttataaacacaaaaggctccaagaaatggaattttattaaaagatggaagaggaggatatttgagagaaggggaactacctaatactgaaaactaatacagtccaggatacatagaagatgatcaataacacttattcaatctaaattaccctatcagcaagtggagaattctctctcgggagtgctgttttctttcctgccagtcagctctgtcaggttgaatagaaagcgataaataaagaggaaaagaattcaaaaaaaaaaaaa

SEQ ID NO: 524 - DNA, 677 bp, Homo sapiens
gattatgaagaggaggtgaaaatggtcccactaaggacaacaatcagcaccccgctatgagaaggagggaggaaggaggagccacgagtcttctgggagagcagactcctatgaggcgcaagtctcctggcccctcttgccacaagccaggccaagaagagactccaagaggacaattcacagagactggggagagaatggcgctccatttcctgaggccatgctgctgccgatatattcagcctctacatctaaagaatggccaaggaagccgccgtttgtgcagctgtggatggagcttggacgttcaaggcatccatgcatgtgcgaatctagtggtcagagaccaggcaaagagtgttcctcaccgcacctccacgttctcacacagaaagccgagcagtccgatgattctaaattcaaatctggtcttctaggtcatcagaaagcatagaatcatccctggataccttggagagagacagaaggaaggagtattgatgcaattgatgcactgcacctaggaaatgttaggccttatagggagacatatttcttcctctaagagaaccatctgctggaacagatctctgcctccaagaagctcatggtatacgtggagaggcagacttgcaaactattaaaagcaaaagtaaaaaataaaactaaaataaaag

SEQ ID NO: 525 - DNA, 815 bp, Homo sapiens
  misc_feature (1)...(815): n = A,T,C or G
catccaggagacaggcaccgattagagatccgtggttgctgctaaacatgagatgcctagatgcaccagtgctgacagaccgggcagcgcacatatgggcatgcattttagatgggcagaagcctgcgtacacgcggcaggggtactaggaaccacgtccaattctggattggacatcctgctttcttgggaaccagcattcttgtttgcctctatggaatttagattactcctatgcagaaaggcaatgcttcttactggcgtacggttctatgccatccagattttaatgagatgccgaatgtatgctgcatgtttttgtaatgtacatgtaggatacagttcgtgtgcaatacagttctttacggactgcagttccattgaccggggaagtgtacattctgaccatattaacataactagatctgttgctagagtattcatatgaacttgattaattgattgacatccttgctttttgtttagtaattcaacggatggtgggtgtttccttccttattntcgctggcccgttgccttagattgtatggctgtcttacgaattgctttctgtgcttctttctctatagatttgctgaattttgatttaaatatcttgtctttgttccttattttgtacatctttttctatgacatcctcaacatcctctatttatagtgctgacttcgttcttataacgtttgttagtttctttgttgttgcctagctacttcaagaccgtataagtgctgcggctacctcatctttagccgggatctagtctcacactagtggactacatatgtaaagtaag

SEQ ID NO: 526 - DNA, 444 bp, Homo sapiens
gattatgaagaggaggtgaaaatggtcccactaaggacaacaatcagcaccccgctatgagagggagggaggaaggaggagccacgagtcttctgggagagcagactcctatgaggcgcaagtctcctggcccctcttgccacaagccaggccaagaagagactccaagaggacaattcacagagactggggagagaatggcgctccatttcctgagcatagaatcatccctggataccatggagagagacagaaggaaggagtattgatgcaattgatgcactgcacctaggaaatgttaggccttatagggagacatatttcttcctctaagagaaccatctgctggaacagatctctgcctccaagaagctcatggtatacgtggagaggcagacttgcaaactattaaaagcaaaaataaaaaataaaaataaaacgcga

SEQ ID NO: 527 - DNA, 799 bp, Homo sapiens
ctggccggcatctgtatttatttatcatttttataagaagggtgttcatggtgattgctgctagttcctctgctgaaacaagcccacaaaaccgcaagagcagctcagcattctttgacctactcgggaacccaattaaaattaacaggccttgcatcttcatatatcacatgttacagattgtaaatactcatcccatttaagagcaacagaataactgggttcataacaaatctccataagtctaactgatatttaccagttagggaaatgtgacaggtaatggagaagagactgagaataaaggagcctctgcagtatgatcatcatttcaccctgtctagaaatactgctgtgtcatttctttgctccttcagaaagcccgggagttcctgcgccaattgtcaccgatgttgcttccactggctggaggtgctgactactttggctttttcccttgggaggtcagacagaggtcatgtgggaagcatgctttgtttacccagagaggacctcctgttctgccccttggcatgtttactttcctggttgcctacttggaaagccctatgactgctggcagggagagctctggtcactttcactaccttctcagattttcagctcttggggcttcagtaggacctgcctttcagtaactttcagaggcatggggagcccttcctttgagtaccacacgcaactatgttttctggaatccagagtagcagagtaggcaggtatattgtgaagagagaaactcagagggagaaggagcaagggtatccggaagttttaa

SEQ ID NO: 528 - DNA, 492 bp, Homo sapiens
ctcaacttaggtgatttgaggaaaagcgaagcagcaccctccaggagacccacccctgtctccctgtgagtgcagtggatctgcaagacccaagctggacgctaagccacccagcacctcctggtggcattcctgcctgtttccaccctgccatgctgtggccctttgttcatgagtgttacccttccttcctcccttcccttctcttctccttcctcccttcccttccccttccttcccttcctttcgtgctttccttctctctctctctctccctccctccctctcagcctccctccttccttccctcctgtgtcctgttggaatcgagggctttggtgtcacgtaggcttgggtttgaggccagctctctcatttgcaagttacgtgactgaccccccaacaagtttatccagacttccagcaagcctgaagaaatacctcctttgcaaaatttctgtgaaaattaaataaaaattgatgcgccctgag

SEQ ID NO: 529 - DNA, 198 bp, Homo sapiens
acccggaagccctcacctccagttgtcccgccttaccggatccaaccaatgtacagctgacacatattgattgatgtctcatgtctccctgaaatgtataaaagcaagctgtaccacgaccaccttgggcacatgtcctcagtacctcctgaggctgtgtctcgggcgcgtacttaaccgtggcaaaataatctgaga

SEQ ID NO: 530 - DNA, 512 bp, Homo sapiens
ttcagggcgccatccgtttttattttgaaaccaaaagaggccagacatagtagctaacacctgtaatcccaatgatttgggaggccgaggtgggaggatcattggaggacaggaattcaagaccagcctaggaaacacagcaggaccccactgctacaaaaacactttttaaaaattagccaggccttgtggcacacatctgtagccccagttatccaggaggctgaggcgggaggacccctgcgggccaggagtttgaggttacagtgagctataaggcaggtatgttggtctgcctttatgttgggagggaaaagcagtggtcttcgctaaactcctgtcccttccggcgctctccatccccacactggtgcggccactcctccggtttgtgtacacaacgcttctgaagccaaagctgtctcagcatactgtgggtgcacacagtccaggcctctgtgtcccctcaggccaggctctcccactccaactgggttcacttgcagccttca

SEQ ID NO: 531 - DNA, 231 bp, Homo sapiens
atcactcctgcaaagagctaaaacacctataaggtgaaagaagaaaagagaaatgagaacatctggccaaacttgctttcaggtcgaggagatagccagcacagtaggatgagagggacctgggatcggacttccacctcaagttttacatctgctgatatctaaaatccaaccattagaaattcattacttcaacagaattttttattcataataaaacatgatcggccg

SEQ ID NO: 532 - DNA, 311 bp, Homo sapiens
tcaggccgatcacggtttattttcatgaagacacattacaaaacatggtgccttctatgggagggcaaacacaggaagatcccattgatctcaccgaattaaagacacacacaccagagttcagagaggtgaaggaggctggaatttcgtggcgcagtaccatggcgattgtgtgggcttgatgaaatcttcctggaatgagcctcctttgttttccctcaggcatggtcttcctactcatggtccaagttggtggctcctcctaaaagagtggctcctgccaaatatccatacctcaagcagttgtaaag

SEQ ID NO: 533 - DNA, 182 bp, Homo sapiens
  misc_feature (1)...(182): n = A,T,C or G
ttcagttgctccagaacatgtggncagcatcctgacacgggtctggtgctcatgggctgagagctgcaactttgctgagagctgaagatgatggaaattaaccacaatttattgtccaagcttgaccttggaagttgtaagtcttcaataaactccagaattccaaaataaaaaaaaaaaaa

SEQ ID NO: 534 - DNA, 371 bp, Homo sapiens
cggcccatctcgctttattgagattattgtgtgtgtgtgctatggtttgactgtctcctttaaaagtcatgttgaagtgtattgtcattgtgacagtatcgacaggtgggatccttaaagaagtgattaagccatgtgggctctactctcctgggtgggatttgtgccctcataaaagggccagttgaaccctctcttgctctcgcattcctctgtcttgtgagaacagcgttcctctcttctgaacgatgcagtgttcattgcagcatctgagaagcggagactgttcataaaaaaacagtgtaacagcaccttgatcttgaactttccagtctccatagagtgaagatcagagaaatatcctcatgttt

SEQ ID NO: 535 - DNA, 425 bp, Homo sapiens
cgaattcattgatactacgtcagttttacggttttggcgtgcggccgcatctagctttattgagaattattgtgtgtgtgtgctatggtttgactgtctcctttaaaagtcatgttgaagtgtattgtcattgtgacagtatcgacaggtgggatccttaaagaagtgattaagccatgtgggctctactctcctgggtgggatttgtgccctcataaaagggccagttgaaccctctcttgctctcgcattcccctgtcttgtgagaacagcgttcctctcttctgaacgatgcagtgttcattgcagcatctgagaagcggagactgttcataaaaaaacagtgtaacagcaccttgatcttgaactttccagtctccatagcgtgttctcacagtgaagatcagagaaatatcctcatgttt

SEQ ID NO: 536 - DNA, 344 bp, Homo sapiens
tttttttttttttcagtgttcatcagaatagaagtttatttcttgcttgggtttggtctaaataagtcttcctgattgtagttggatctcccccaagcagtggtccataaatccagctaccttccatttcatatctctgatatcaccaaggatcctttgcatccatggagaaaatgtggcccactgcttcatcacttccgctcatattccatttggtgagatcttggtattttggtgagatcaggctcaccagggtgacttagtagtcgttgttaagtagttctgaacttcaattttctcatctggatcggtgcgttaaatgagagagtcacagtagcttaaac

SEQ ID NO: 537 - DNA, 774 bp, Homo sapiens
aagaagcaaaaccaacaaaggccatggacactgaaatcagacagatttggtttcaactatttctttattctcccaatcatgtacttgaaaactgtttgtctatgagaaatttccagagaaactatctaacattgtaagtgaccattattaatttttgtgaatactgtaaaataacggtgtagtaaaatcaattatgatctgccctaaataaacaaaattactgtaataaacagaatacacagaaaaaaaaaaaaaaaaaaaaaaaaaaaaaaaaaaaaaaaaaaaaaaaaaaaaaaaaaaaaaaaaaaaaaaaaaaaaaaaaagggccctaggggctaggcctgctttctcggtgggtcttttcatggggtgctgctttaatcattgctctcgagccaccactccctgcgtatgagtgtggggcgttggatagtcattttccccatacgcgcgtagccggcggccgggggctttatgcgtttggctgtgccccgagtcttttgtcctacgtatgccctggtcaccccaacgcccccatactgatgttaagttcgcatagtggtccttggtgcttctggcgcgcctttgagttaaaagtcagagaattttgacgccctgccggtgagtgaagactaagggctcttttattgttcgcaagatccgtttatgtactctattatttaattcgattgttctgccgtcgtcaactgctgaactccattggaatttggatatctctcgagctgaaagcgcgtggtgaatacatatatagag

SEQ ID NO: 538 - DNA, 352 bp, Homo sapiens
gtcaggccgatcttactttattttctcagagttctgaaggccggaagtccaaaaccaaagtattagcagggctctcatccctccttgcctcttccagcttctggtggctgcataactccaacctctgctgctgtgtctgtgttttcccttcttctggctgatcaaggtgtcacaagaccatactctttctgaatcccgaaggagagtctttcttgcctcttcccagcttctggtgtttactggtgctccttggcatcccttggctggcagttgcaattggcctccttccatccctgcctccattgtcacaggggttctcccttcgtgtgtctgtcttctgtaatcagaactt

SEQ ID NO: 539 - DNA, 243 bp, Homo sapiens
aagttctgattacagaagacagacacacgaagggagaacccctgtgacaatggaggcagggatggaaggaggccaattgcaactgccagccaagggatgccaaggagcaccagtaaacaccagaagctgggaagaggcaagaaagactctccttcgggattcagaaagagtatggtcttgtgacaccttgatgtaagcctccagaacactgagaaaataaatgttaaaccaacaaaaaaaaaa

SEQ ID NO: 540 - DNA, 249 bp, Homo sapiens
ctgcagcaacaactgcttgttgtgactttctgtgggactctgaggaatgttggggatgatatcacaggaaccaatgggtggctctgggaagcccataattgtgcgcattcatgggagcttaactctgattccaaattgatgaaagaccaccatgtcagttatggagccccccccaatcctttcaacatgttcactgatcacgcctggggtgagaactaggaacacgtgaataaactcagatgctggccg

SEQ ID NO: 541 - DNA, 782 bp, Homo sapiens
cgcctcatcaggttttagttgattattatgcaaactttattgtgtagttgctttacagtgtcaatggtctatgtgcttaagtgtgtctttgtggtggccagtaatggtcttttatttccaaagttagcactcccttaaggacctcttttaaggcaggtctggtggtaatgaattcccttagcatttgcttgtctgaaaagaatcttatttctccttcacttatgaagcttattttggctggatatgaaattctgggctcgaatttcttttctttatgaatgctgattataggcccccaacctcttctggcttgtaaaatttctgctgaaagctctgctgtttcctgatggagttcctgttgtaaatgagctgacccttctctctagccggctttagattgtttgctttcattgctacctcaaaaatctggagactatcggcctcgtggatgggcattccgtatagtgttttgtccgggtcgggtgcattaccgaaaatgtgcgagcccccttttcacacaggtaggcggtgcttcattcgtgacgtcttgccccttaggggttccctgacgttatgtgaaagtgactctccatttttgcgctcgctttccccccccacctttcatatccttgttttcctcattgtcgcgccgtatactccgtttctctccctcgcctctgtgttcccgtgcggttgtgtgcgctgatgtcgtctacccaacccccaccgccccgctgttcatttccactattcatctttaatcagtcgcccgctgacgcagc

SEQ ID NO: 542 - DNA, 577 bp, Homo sapiens
attgtctttattagcaattttctggggagcaggttgagctagtaatgttgtgattcagtactcttcaatcatttctctattagtcattgttattacataacaagcaactataaaatctccttggcatataactgtctgcatttatttcttgctcacacaaatgcagtttggatgagatgtttctgcttcagactgtggaggctgggatggctgggattcaaaaagcaatcagctataaaggcgaagctccagaggtctcttgtcccttctccagcttggtgagccacctgggcatgactttcttttaatagtcccacttctcagttgcaatcccgaagctggctcacccttgagttctattccattcctcttctattctgctcctattcgccttgtctgatcggtgatccacacacattctgcctctttgtatatctcagcaaagacctttcttccagttgctgtacaaatattgccaagtcttttccatgtaaagacagattccacaagaagattttctgggcaagttatcacacagttccaggactgagcggtggttataagagagtcactcagc

SEQ ID NO: 543 - DNA, 285 bp, Homo sapiens
ccttgtggattctgggaggccagcctgcaaaaacttcctacggtgtgtggatcccaaaggcatgagggagggcctctcaaagggaggcagcctcagacccctctaactgtgctggcctcctggaagcaccaggagagaagcaattcgaagagcagcccgattccaaaacagagagcaatgacctggtctatcttcctcgcggaagcctgaagatggaagaaattcttaaaaaggaaacccaagaaagccctagcctcagggtttcaaagaaataaagaaggatgg

SEQ ID NO: 544 - DNA, 251 bp, Homo sapiens
ttcatctttcctgggctggccctctgcacactggcacctgaaatgcagcaaacaatgtggctggatgctgaaggtgtgaccgaaatggagctgaacaactcacactctcagaaatgctttgattttactttggtttgtgctcagggcaaagattttggctttgcctttctcctccacagttgtgaattcattttaaataaaacgcaaaaggaaatcaatgtccagtgtcttggctgaaaaataaatattga

SEQ ID NO: 545 - DNA, 715 bp, Homo sapiens
cgcgggtaaagtattacgtaatcccaacatacactacaacaaattttcaggccgcatcgggttttattttttaaaaaagaatgatagtattatttgccaggcattttctaagtgtttagcatagattcatctctacctattaggggtggaaataataataacttgtacaaggccacatagctaatgagaggcacagatacttgaaatgggccttctaattccagacctcaagctttaaaccacaccaccacagcatctcaaacttcaatatccttgcaaattacccgggaatcttttttacatgcagatgcagattctgtcggtctgggatgaggctcagggaatgctgatgctgctggtcctgggatcccgctcagagtaggaagacacttctgcctcatgatacctgtgaaaatatttcatattctcccttttgtgccgtgtgtgcgttggattccccagtgggtgtatagatgaatttataatttatgtggctggatggaagcctcttcacttcacctggctttggcacctctgtcatttcttcatttactgttttttctagcatacttttaacttctttctgtactttctctttccaactgctgtccacatgccaccttggcctctcaagtagctgggattacaggtccatgccaccatggctggctattcttttcattctggtcttattctattcgagttttattcaaaa

SEQ ID NO: 546 - DNA, 259 bp, Homo sapiens
aaatatattatgacacaaatcttcatacagattagagacacatgaaatacctgaaaattctacttccacctaaggaaaagaggagaacaaggttcttaattcagcacaagtgctctccaaaattctttcctcagaacttcagccgttcagagggtggagagtgggaggagccagaagatcaggaaaaataattaatgagtactaggcctaatacctgggtgatgaaataatctgcacaacaaaccccgatcggccgaag

SEQ ID NO: 547 - DNA, 435 bp, Homo sapiens
agacagggcctcactgtgttgcccaggctggtctcaaacagtcctctcaccttggcctcccaaaatgctgggactacaggcttctggtagaacgtcaggagaaaatgacatcaccttggaaaggtctccctttgagctgctcagttgaccagcggctgcttgctgtgtaggtatgcgggctccagtctgacaggcctgaaacacacttaccttcgcaaatgtctttaccacatgctaagcgcgcctgaaaaggagcctgggattctgggatcaacgcagccaagaacactctgtcccatcttccatcttaataacgaaacgctgactgcctgctaaaagatgcacaatttattttacatatatgaataggatgattgtttaaagagttccagctggttaaatttaagttcctgcaataaaacctgatcggcctga

SEQ ID NO: 548 - DNA, 216 bp, Homo sapiens
catgtgatgatgtaccttcctcctcttcaactttgaccatgattgtaagtttcctgaggtatccccagctgtgcagaactatgagtctgcgagtcaattaaatctcttgtctttaaattaaccagtcccaggtatgtctttatagcagtgtgagaacagactaatacagggcctgtacaaatttgtattgccaaaagatttgtaaataaaaaaaga

SEQ ID NO: 549 - DNA, 886 bp, Homo sapiens
aagaggagtagcctgttaggaaaagcaaattcttagagcaagacatgaacacatctctttcagaaacgcgattttacttgctctaatgaagaaatggtggtgacaattctagaaaagaaaatgccaaagatggaaaacctttaaaatataacttaaaggtgaagaagaccacctggaccggccaccatgcaagatcaaagaaaaggcccaaaatatggcaaaaaagcctcgggagccgatgcaatcaactggaagaaagggtatcagtgatggaagatgaaatgaatgaatgaatgaaaggaagcaagaaggggagtttagagaaaaaagaataaaagaaacgaacaaagcctccaagaaatacgggactatgtgaaaagaccaaatctacatctgattggtgtacctgaaagtgacggggagaatggaaccaagttggaaaacactctgcaggatatccaggagaacttccccaatctagcaaggcaggccaacattcagattcaggaaatagagagaacaccacaaagatactcctcgagaagagcaactccaagacacataatttggtcagattcaccaaagttgaaatgaaggaaaaaacgttaagggcagccagagagaaaggcaggttacccacaaagggaagcccatcacactaacagcggatctcttggcaaaaacgctacaagccagaagagagtgggggccaatgtacaacattcttaaagaaaggaattttaacccagatttcattatcagccaacttagcttcataagcgaaagagaaataaaatcctttacagacaagcaaatacttagggattttgtcaccaccaggcctgccttaaaaagttcttgagggagcccttaacttggaaaggac

SEQ ID NO: 550 - DNA, 651 bp, Homo sapiens
aaagctacaggactcagcaaacatgcttagatatctgcttcagtgtgaaacgtataatgaaagaagacttcataagcagctgtttgtggagaagcttgtgttatacaaatatgacacagttaatgaacagaactagagagcaatctgctacatctgtcttcaaaggacaaggaagatagcaatcaatactgtatttacgacggcatttttcacctgaaaagtttccacttatctaccggttctgtctaagaaagacaggctttttttttacttaaaattgctgccttgctgcttacctattttaggggtagcagcatgggtataaacttagtaggaatagttattaatgtgtagagtgtattgattaatatctctttgaacaaaacaaatggaagtgtgcctaacccctgtttctatcactggctgagggaaagaaggcatttccgtagctggagcaggtaataaaatacagagccagagaagagagcactatacaggaatcattttttaaaggaaagaagacaaagtgtgccaattccattttaaagatgaaggagacaaagattctgaagggtatatacccaaagatataaaaaccgatgcggccgatatcttatcttatctatctcgacccgcacttccaccccccgc

SEQ ID NO: 551 - DNA, 669 bp, Homo sapiens
cggccgatctgtgtttactggtttattatgaaggatattgcaaaggatacagatgaagagatgtgtagggcagaaatagtgggaaagggtgtggaggctccatgccctccgtgggcacaccacactctaggagcctcacatggtcagctatggagaagctctctgaaccaggcctcttgggtttttatagaagattcataaccacagcattccttctcccagagtatggggcatgaccctctctggaattagggtcccacaatcagaaaggtggaggaagattagagtacggccttaggcgggtgaaaggaggacaggaaaaggccagagagattctgtttccccaaggcctgctcctgaggcctaacacagccaacatcataatcaaaggctctaaacagggctgtgggagttatgagcctggaaccgtggacgaaaacctacatatggaagaaatacttgaggtcatttttgccagcagacagagaagatggcgaagtgtagccgggacccgtggtgtgagtggagtgggattcattgcaaggaggaagatggaggtggctctgaggacctgtaatcccagccctcaggaggttgttgaggcaggagaatagcttgaacccaggaggcggaggttgctgtgagccgaaatcgcgccattgctctcaa

SEQ ID NO: 552 - DNA, 558 bp, Homo sapiens
  misc_feature (1)...(558): n = A,T,C or G
tggccgatcgtgttttattgaatggtggaggtggctttcagcaggatggacggggagccagaatgggtggatggagtgggaaggtgaccctctcctggagttgggctgcccagcggccggattcctctctgaccacccctagctgaaatcctctcagtgttcagatgttcctcctcttctccctttctctgcctcattgttctgctgtccatctgctggtcggctggcttgctggtctgcttctggagcttagcgtttggggtttatatagatgcaggaaagggggcatggtggaccaaaaggcaactttttggcatgaaaacaagaatgccagtcctcatttagggccacaggtcttcaggcttgagggtggagcctttgccgggaactgccctcttctccccagaatttccatctcctgtctgtatcaataccatcagagctctttcaataggtagaaaacaaaaatttatttattgagtagaagtggatcatgatataaaggtcctnatccttgtcatcttcaggttgagtaggcagagagtgatgagggtcttg

SEQ ID NO: 553 - DNA, 576 bp, Homo sapiens
aactggataccaaagaagtcagtgctgtgggtgctgggtgctgaagaatctgcatggactgcaggagcctgttgccaaaaaacaaaccccacacctaggccctgggccctgggaaagttgaggacaccacagaagctggacactggagaagccaacttggttgcaggagccttctcaataagcactgagccaagtttcactctcgttgcccaggctggagtgcagtggcgtgatctcgactcacggcaacttccgcctcacgagctcaagtgattctcccgcctcagcctcctgagtagctgcgattacaggcgcccatcaccatgccgtatttttagtagagacgggatttctccatattggtcaggctgatataaaactcccgacctcaaggttatcctccctcttcagcctcccaaagtgctgggattacaggcatgagccaccgtgcccagccagataagtgtatctcttttgtatgacctagcataagttccaataaatagataataaataccgatgcggccgaaactacttatctgctccttaagaaaatcattaacaaaccggcccgga

SEQ ID NO: 554 - DNA, 670 bp, Homo sapiens
tgcgtttccggccgcatcggagtttattgtaatagagatacacagaattttgtgcccccaaatagagtaaatacacttgtcttaaatatttatagctcattcacaaaattgatcattttctatgccatcaggcaggaaataataaatttcaaagtgcaggtatcatgcagatacatgtttctcaggatgaggaaatccagctaaaaatgtgaaagaacaacaactaaaaaagataaataaacccccttatatttggaaataaaaaaacttgtaacaatttatgataaaagaagttgacaaatttcaaaactaaaaaatatttagaaatagctaaatatggctgggtgtggtggctcacgcctgtaatcccaacactttgggaggccaaggcaggtggatcacctgaggtcaggctttcaagaccagcctggccaacatggtaaaattcccatctctactaaaagtacaaaagttagctgggcgtggtggtgcatgcctgtaatcccagctactcaggaggctgaggcaggagaatcacttgaacctgggaggtggatgtttcagtgagccgagatcacagctttgcactccagcctaaacgacagagcaagattctgaatgagttcttctgtctcgagtggatgatccaggcagctaatttcagcatcca

SEQ ID NO: 555 - DNA, 334 bp, Homo sapiens
acacaatcggagaaattggttgttttatcaaggctttgactggaatgctgtgcttcttttaaagaatcgaagttgactcatagaaacaatgaaatcccttggggaatctggcttcataccttgtctacacagagtccttgtacaagtttcttgatctctgctgaaagaaaggaattaacttctttctggctcgaagacctctggaaaactatgatctccttcagtatctctaacaccaggtcctgtgattcaaactacgcacaaccagtaagaaaaagaattcagcatgcatgctaatggctcacctcctttcttatgtttattacacatcaat

SEQ ID NO: 556 - DNA, 187 bp, Homo sapiens
tcttggtttattgatgtgtaataaacacaagaaaggaggtgaaccggtagcacgcatgttgaattctttttcttattggttgtgtgtagtttgaatcacaggatctggtgctaaagacactgaaggagatcctatgttttccagatgtcttcgacccagaaagaagttagttcctttctttcagctt

SEQ ID NO: 557 - DNA, 317 bp, Homo sapiens
ctggccgcatctagctttattgtaaaaagagaacatacacgagcatcaggaataaggaaagccgtgctgagtggcccaggtcagtctgctgagaatgaaaccgaccaggtcaattttagagagatccctccacgatgctatccaaagcatgcgtcaggccatcagcagtggtggtgactcatgcctgtgatcctaccactttgggaggccaaggctggaggatcatttgaggccaggagtttgagaccagcctgggcaacatagtgagacccccgtctcttttttagttttcccaggaatcacagcttgctgtacac

SEQ ID NO: 558 - DNA, 622 bp, Homo sapiens
ttctgcatgtataatcctaagttaatttttttctagcaccttgaagatgtgatttagtatctaatattttttggcttgaatatattctaataaaaagttcgtagtaaatattgtctttgtttagctggacatgtttctgtttttctttcaaatgaccttaagggtttctatcttgttctgtgtttttaggcatttaaagtgttttaggcaatttaaaagttgcctaaagacattgttgagagcgtgatggttatgagcaaaaacaaaagtgatccagtgatgatactgaactttcaagcattaaaaaaatgcaattaaataaatattctacctataatggaactttcttgaggtaaagatagatttgaatctgaagatcaaagagtcatatcacatggcaggagatacaggtgggtggtgaggattccaagacagaccttatgctttttcttgttttatttttgttatgtgctcagaatggcaaacctgaggtcagaagcagtctatagcttgacagaggatgttttggtcagaagcaggctccagtgtgacagtgggtgtctctggtagcttgagccttatgataatattgcaacacaggaacaactcaaaggtgggaatt

SEQ ID NO: 559 - DNA, 418 bp, Homo sapiens
ttttaaatgctcaatcaatatttattgaataattgaataataaaaagtgagagaggttaccatggagagttaggtacacaattttcttgttttttctacacttccatttccattatggtaaaatgaaaataataatagtgttgatgccggtgggctggagaggtccccaaaagctgatgggacctcaaatccagctggtgtccagtcttttgacactgctgaggttggaagaagcagctttcatacaggctgtggatttggtggttcttccaatggagagaaccaatagacatcgctttaattccatccagggtcttagcaaggatgtcacaatcaaactcttaattttgttttggttctggaggcatcattctttgagactcttttgccactcttcagttcttctgctaacgctgag

SEQ ID NO: 560 - DNA, 532 bp, Homo sapiens
  misc_feature (1)...(532): n = A,T,C or G
tagaaaaagcacatgtccctcttccagaagttgcagcaaaagtctcaaacgcatcatcatgccacaggggccacatgcccgtacctgggggagttactctagccagaggaagacaatgctctgatgggctttgacctaagtaacaagctccatgtctgagccaggagtggacaccaaccaaagccccaggctggtgatgaaagatggaatgatgcccaaacagaaggtgcaagtaggggtgcaattatccagtccccgccccccaagaaggaaagaaggaaagaagagctgcagcgctcggggagcccagacctaagagctccaagccagggctgtgacaccctttttggggctctgcagttcctggtgtctccaagcttccagtgggataacacaacacgaaccccctccccagatgccagcctatgaaccctggattttcccagcttccagaaccaagagctaaataaagcccgatgcggccgaaattctccttattcntaataatcacacttatgccaacccttcactc

SEQ ID NO: 561 - DNA, 290 bp, Homo sapiens
ggtctcacagctacatgtgttccgtgcttgcagcagggtgctccagggaatgtgacatggtcatgactgctgtttctaattactgccctatcaggaggcagaggaaggagccagcctggtgggccactgaggaaacgctgacgttcctgattgtcgggtagctggggctggtagggcctggctgatgcctgcctggtcacttgggagtgagcccttgcctttccccaaacaaactcaacatctgaatgattgacaagggcacagcaatcaataaatcctgatcggccgaa

SEQ ID NO: 562 - DNA, 202 bp, Homo sapiens
cggccagcatcggtatttattatcttggccaccaagatcattgccattcactcaagacaagaaaggattctctggtttccttggtggtgagtttctttttgatgttttatcagagctttgtggaactgtggttgtcatcctggttatgtgctcaaaaacttggcagcagaagcagtactagtagtagtaacatccatttatt

SEQ ID NO: 563 - DNA, 452 bp, Homo sapiens
ttttaagctagataagcatctgccagggagacatccctcaactattctcccatgtgacctttgttaaggtgaaaggatcaggcaagacatcctcattcttgtggctgtttagctgacctctatcaagaccttatggcaggaatgtcatgtttccataaccttgaagataccaagtatattatctgctctgcaaagagataaagaacagggaggatgttgccccacagaggatccaacaggggagtgactgtcctcggtccctaggagagacaatggaagatctggttgctcgacaccatgcacaccagcagcactctgatacatatggtgtttatcctttcctcattctttggtgatgtgctcgttgatgacctgtggagcatatccagaatgtttttggagctgttagctattatgtcctaaaaaataataaacgcagatggcgcgctgaa

SEQ ID NO: 564 - DNA, 395 bp, Homo sapiens
gtctcactttgttgcccaggctggtgtgcagtggcacgatcttggctcactgcaacctccgtctcctgagttcctgattcttatgcctcagcccctggagtagctgggactataggaatctagcgcttcaggattatgtgcactcttgctaatccaagtgttatccctgaaccagcagcatcagcatcaccagagaacttgctggaaatgcagaatatcagactctaccccagacctacttaatcagagaagcccagagagattcatatgcacattaaagttggagaagtcccatactcatatactagcataaacagagtatcctcaaactcataacaaagaaacctacaaaacatgaagtactgtcctttcaattaggggcagacggattggac

SEQ ID NO: 565 - DNA, 772 bp, Homo sapiens
gtctcactttgttgcccaggctggtgtgcagtggcacgatcttggctcactgcaacctccgtctcctgagttcctgattcttatgcctcagcccctggagtagctgggactataggcatgtaccaccgtgactgggaatctagcgcttcaggattatgtgcactcttgctaatccaagtgttatccctgaaccagcagcatcagcatcaccagagaacttgctggaaatgcagaatatcagactctaccccagacctacttaatcagagaagcccagagagattcatatgcacattaaagttggagaagccccatactcatatactagcataaacagagtatcctcaaactcataacaaagaaacctacaaaacatgaagtactgtcctttcaatttaggggcagaggattggacattttattttattttttatgggggaatacagctaaaactgaattgcttcaataaagtctttgacaatttaaaagctgaaaacagaacatcatcacaagagcgcccacccgagtacatccccggcacgctcgccccgcgctcgcgtgtttaaccttctggcgcgccctccaacggaccggaacgcccccgcctccttggcgcctcgttgccctcacgggggggggttcctggccccgttttttctttgggggggggtgaattcagaagctccccacactgaaatcccgtgaatctggggcgttgggggggggggacgcgcttcaccctcctttaaagcgcgtgaagcgcttttccacg

SEQ ID NO: 566 - DNA, 500 bp, Homo sapiens
ctagttctggaggctgggaagtctcagacaaggcgctggcatctggtgagggaattcctgtggcatcataacgtggtggaaggcatcacatggattctacagtcaagaaaccttagctccagcctggatacatagacaagatgtcaacagatatctgggagaaatgcctggaaccaatcaggaagaaatatgaggtccctaaaatagcagcagcacaactatcctggcctcatcaagaaaagtagcagcttaaaaacaacctgttgtttttagatggactctcatcctttctaatccaaaggatcaatgttattagatatcataatgacatcctttcaattgccaaaacatctactccacataggtcacccttaaacatgtaattttatattttcctttctgcctaagtatgaagttatacagaaagcaatgcttcttctaaccctattatgtttatactttgcaatggaaacatgaaataaacccaagaaacatgaaaa

SEQ ID NO: 567 - DNA, 355 bp, Homo sapiens
acttcttcatttgtccttactgcttatattatatcacttatcatttgttctactttattttataactgtgttaatatcctttcctgggcatatgttttcctctgattcaaaagaatctttagaagcaggggccatatactcattccctaggtattttctgccagaggtaacagacttcagtctataaatgcctgattactaacatcttacattatgggttactaaacaggccgtttagtctgttttcaacaacgtcccagaaatgttttcaaaagttttatttcagccttatacacaagcaccctaaaacccctaaaaattctgacaagaacaataaatagagatgcggcctgag

SEQ ID NO: 568 - DNA, 395 bp, Homo sapiens
ttttttttttttttatcaatttttggaaatttactgaagatttttggagttaagaccagggataaaattcgcagttcatgtcattttattccttgtctcacatctgcagatagactgagattttgttgatcaaagctggaatcagcaggggttgactccaaactgctgattagggcaagggcaactctgtgtatttgtcatcttttttggtccaacaggaaaatcagtgaaggctcttctcatgttggtggcagaagtgagaagaagggcaagtagaaatatggaatgtctcttaaagtctggattcgcaacagggacctagtcatttctgttcacattctctggacaaagaaaaggccaacatcagaagaccaggaaaacgtactgtccgaaat

SEQ ID NO: 569 - DNA, 139 bp, Homo sapiens
tggacattgagatctctctccatcacctagaagcatcattctactactcatgatgaacaaaacccagcaaaaaccaaaagccatatctaatgctgtggggtagctacctttgaccagttaatagaaccggatgcggccg

SEQ ID NO: 570 - DNA, 515 bp, Homo sapiens
aaaccaagatgacaatggcaatttgttaccttctggaaataaaggagcaattaagggagaagtaaatcttcaaggattttcctaaatctttaactcgttttacagcagcctattaccaagtgctactgtgtatattggcttcatttggaacattgtcttacctatatttgacacttaataactttggtgattaattgattgactgaacaaccactggcaaaaagagtaataagacgtaaaaagtaatcgttgagcacattttaagacaacgtgattaatgttctttgtagaaacttaagaggatccaacagtccacattcacagaaatattgtaagaaacagatgaaataaagatttatgaaaaggctagtgttttctgtattcaggctcttacttagttacctaggtgtatgtagtgtgtccctgcctcattgatgacatcaaaactgcattcttgtactcagttctgctaataaaacctaaacttgttttgctctgtctgaaaaaaaaaaaaa

SEQ ID NO: 571 - DNA, 247 bp, Homo sapiens
tggccgatcttgctttattacccctttgtttaaataacaaaaagtactgctggggggccaattgtagagctcacaggccacatcaactgatgaactccaggatgctattcagacctcagtattttctagaatactaaaaaatgctctttatttcatagtctttcttccatcttagagctttattgcaggaggtatatcatgtagaaagcagcatttgagttggcagctgaaacaggattggagctct

SEQ ID NO: 572 - DNA, 413 bp, Homo sapiens
cggcggatcagtctttattctctctccattgatgtcctttccacagacatgtacacacatgtgcacacacacacagggacacacacagacacacacagctgtgttctccattcagctcctgatatccaggtcacacctcctcctgggtccggcaccggtgggcaggaggctgcctgagctccctctagtagaggctgtgttgggcacagtagcgggcacacagctgctggtggtagtgcaggtggtagtccttcaccagcttgcccaagatgtagaggaactcatcgaagcagatctggttgtccttgttcttgtctgcggcctggaacaactctgtgatatagtatggctccttccggccctgcaaggaaatgactcctcactccaatcgtcagtgactaggactctgaatg

SEQ ID NO: 573 - DNA, 264 bp, Homo sapiens
ggggggtggggtgggggaagtatgaaaaagggaacgctgccgcatcgattttattgtagatatgtattttatttttaatgtatgttgtctcagttttttgtgcattaataggtattgaaaaggaaaaaaacagtgttggtaattccaagtaggagaagccaggcagtgcatgttgagatccttctaaagttgagcccatataacaggtgaaaccataatgaagagtgtaaggtgaaattctttcacttccaggagctgataatc

SEQ ID NO: 574 - DNA, 171 bp, Homo sapiens
tccagctttatttttatttgtcaagacatcttataatttctggctcttcttaagcaaagcagcatctcggttccaagagagtattgtcatcaagaattgagtgttcaaagcaacacaaaacccaacaataacttctgttctttgtacactaagttgcagtctcctatgcgg

SEQ ID NO: 575 - DNA, 240 bp, Homo sapiens
attatcaagtctgccgtgatgtctatctacatttgggcaagaatacaaatgaaggttcacctgaaagttatgaaggaggctaagaaattgttacataatacgtaatataattttctaccatgtaaaatataactctataaaaacagaattgaagcacatgtggaatgatatgttttttatgtcactgaaagtccacaaaatatcaaatacagctgtatttcaatgataaaaaaaaaaaaa

SEQ ID NO: 576 - DNA, 118 bp, Homo sapiens
cttcctgtattaacatccttgcaagtggtacctgcctctctgaggatccagctacgcaatgaatctgagaaagcttaaaatcggaaatgctgctctagtaatggttctcaaaccctgg

SEQ ID NO: 577 - DNA, 269 bp, Homo sapiens
cggcccatcgccatttattataattttattaaattattgagtttatttttttctttcatctatttactcagccaacaactgagcctaggacatctctgaacatacagtggtgagtggcacagcctagaccacggtgactagattgtctgcggcagaaaaattgtcttttgaattttgatcccaagattggtgatggtgagggatagtcttcttctgtctagttgtgacactttgggcaacttaaattctatacattgcttgcttcttat

SEQ ID NO: 578 - DNA, 137 bp, Homo sapiens
attttctaagttacattggcaagaaacatgtgtcaaactctgtccatggatggggtgtgagtgaaagaattcctgcatgcaagtcacaattactggttgaggtttagatggactgcactgtgtccctgatcttactg

SEQ ID NO: 579 - DNA, 465 bp, Homo sapiens
cggccagcatctgcgatttattataaggcagaaggtgggggagaatggtgagaccacctgggtcagatgggaccagagcagtgagtagctgggccggctgagggattcattcaaattcccagggcagagcatctgaccctctgccaggggaaggcggggcatcttaattgacagctccattgtatctcggcatggacgcccattgtccaagcccctgccacctaaacaaacaggccacagcagagtaaaacagggaagccgccttgttccagccggacctgaaggccccatgtacaggcattgccccgtttcttccatcagcaaatctttgttgggttggactgtgggtcatacttcatggtaggtagaagaattccagcagggtaggggtggaagggagtgcaaaaacatgcagtctggccttgccttgtcgagtttgcaagccagagggtgttaaataggtga

SEQ ID NO: 580 - DNA, 283 bp, Homo sapiens
acacacctcaaatgacagaatcccacatcaagctttctctcctggggagttaacccccctggggctaacccttcacaaaggcgggatggaagccagtggaaaagtacccagcttttcctcctttacctactgttcagagatcccagaagaatcaaaccctggtgtctgcagcagtgagcctgtgtgtttccttatctcggcttttcctccttctctggatcatctcccaaacaagcaaatcatgcatctaagtccttgtacttaggctctgcttcgtgggaga

SEQ ID NO: 581 - DNA, 262 bp, Homo sapiens
taggaaaaccaaaaaactcattttaattgtagcagtcaagtcccacagcacaacagttttaacaaggtcaaacaaaacagctcttcccttcctagtcctctgttatttttgtggtttatttatatattcagtaacaacaccatcaacagcaatttgaactcttctcttcttgagacatcgatgccagggtggacgtctgaacaagagtttttgcatatcagccaaccagatcgttgtccaggttaagcaaggaaaatgttgt

SEQ ID NO: 582 - DNA, 210 bp, Homo sapiens
ctgtctcaacttcgaaacttgaccgaacttctttgtgaatctgaaactttcagtttgatagagaagtcatgccagctctctgatatgagctttgggagcctgtgtgaagaaagtgagtttgatctgcaactcctcccagcgccagagctgggcaccgaaatagcagccagcttactgtaccatgacaatgtcatatctaataaagtgaga

SEQ ID NO: 583 - DNA, 591 bp, Homo sapiens
acacacaagcctaaaagatgaacgatacggtgtttatacttctccctaggaagagccataggccttgggccccatcaagggtctctggtggagtttcagtcaagaagtcagcttgactggctctggaatattggcttccacactggctccttgcatggctggcaggctgatgctggctactgatggcaggcctcagtttctctctacacaacccatggctgcttggatgtcttcccatgcaactggcttcctccagagcaggtgattcaagaaagagcaaggcagaacctagaatatttttatgactaaatctcagaagtcactccctgtcattttgttggtattttattggtaacacaggcagccacaattcagcacaggaggggactacacaaaggggtaaaaaccagggggcaatcgttgagggtcatcttgaaagctgagtactgcacttactcttttgcattgtgattagttttgtttaatgtcataccatcctgagagggaaaattcattctggggttctctttttcatcttttcatcttctacataatcagcatgtggtaaatatatgatgcatgtttagtaga

SEQ ID NO: 584 - DNA, 249 bp, Homo sapiens
ctccggccgatcgctttttattttttcgtctggcagacacaggtagatccaagtatcttcagattccaagacagttaggatatctcagttcagactagccacatttcaggtgctcaatagccagatatggctggtttccaccatctaggacaatgcagttctaaggtttcaaagactgtaatgagatgacttctgcttggggagcttttctccaatctgctccatcataaattccatgagcattcattt

SEQ ID NO: 585 - DNA, 168 bp, Homo sapiens
gagagggctcagcaaggaccaaggagaggaggtgggaatgaatttggcttgtctggagagcagcaaggaggccagcgtgtccaagatgtggaacatgtcacgtgatgtcagcccctcctataagggccgtggaggctatggtgaggagtctgagccaataaaacccga

SEQ ID NO: 586 - DNA, 332 bp, Homo sapiens
ccaagctgagacactctcttaatcctccaccgctacagccagatatggggcattatagaggcatagcaacaaggaatactgtctccaggagaatggaaaattaccatgggctccagtctgaggcttcttcctgatccaccaagttcctgagaaaataagatgggaagaaggagacagcgctccctgctgtgggttcccagcttgctctcatctccaactcactatgaaatgcaaattcactttctgcttcaaggaaccgtaagttccttctgaaatgaccatgggcacagaagaataaaatgcaacacaacgtctggacaaaaaaaaaaaaa

SEQ ID NO: 587 - DNA, 326 bp, Homo sapiens
gaagccctgagccatgaaataagaggtctgactatgctgcagaagagatcataaggagagatcctgagacttcagggagaggaagacagagtgatccagggcagcctatcattccactcacctgacacaggcagcaagcatgtgaataatgccactgtggcccggatcagatgggtagcagactggccaccagcaaaacagcactgagttagttatcccatgtggtgcagaagtatagctcatttgagccccggctgaatttctgacccacaaaattgtgacattaataaaatggttgttattttatgtcactaaaaaaaaaaaaa

SEQ ID NO: 588 - DNA, 214 bp, Homo sapiens
cagtacaaaccacaacaccttcaagtttatggacacagtgactttttgttttaaggacataggggaagagaggtggagaagaatttccctatgaccagaatgatcctgaagggtgactggtagaatgaatgggtctgcacgacccagcaaacatgtgacatttgcaaaaatgtatagtgtacaaggctacaaaacaaggcttaataaatatgga

SEQ ID NO: 589 - DNA, 138 bp, Homo sapiens
aagaagcagatgacgcactcaaggggataatgtttttaatgtaacgaatggaacaaaagaattattgcagaggtgaggtcaaggtgaaaggaaccaaagaggacatgatgaagcacccagatccagcaagaatagaaa

SEQ ID NO: 590 - DNA, 421 bp, Homo sapiens
tttttttttttttgtgcttcatgctttatttttcacaaagatcttgtttgagacttggcgctatttttcagtcaacattgtttcttcagagacgcgtgacactttcctccttaagcacaggtaaaacagcatgcggttcctaccccatggacacttctcttggcagcacagggattaacttggcatcaattacactaagtgctatttaaggagggaggaggtgtaacctatttgggaggctgaggtaggagaatcgcttgaacccagaaggcagaggttgcagtgagctgagattgtgccattgcactccagcatttgcacatggctggggaggcctcaggaaacttacaatcatgacagaagaggaagcaggcatcttcatcacaaggtggcaggagagagagtgagcgcgcaggaacaa

SEQ ID NO: 591 - DNA, 282 bp, Homo sapiens
tttcatgtgtctgcagtcctctggtggctcagctgggacttggatattgtaaaatggcctcacttaaatgtctgacagttgtccagctgttgactggagcaacaggggtaactgggccaattatctcgcattaactctccgtctagtaggctctacctagctcactcacatagcagtggtagggtttgaagagcagaaaggaaattcccaacgggtggcttggatgagtgaaacctcatgattacttttattaccttccttcagttgcataataaataaaga

SEQ ID NO: 592 - DNA, 274 bp, Homo sapiens
agctgaactttggaagtggccactggccactctgaatgagatgcggtgcaccggcaggctttggaaattaatttcctttggatgctcctcctcatgttacgattgaggcccgtgtgttagctccctcgagccaaaggtgctcagagggagggggagcaagggcttcctggcatttctggattctgtggagactcccctcgctcaggctgcgtttgtttcctctgaccgaggatcgataagacatgattttaaaaataaagcctgatcggcctga

SEQ ID NO: 593 - DNA, 311 bp, Homo sapiens
aacaaaagtgaagtggtggcaaagtgctggaccagatgttagaagtctccaatttgctctcgacaacaacaatccacaagtaaccctgagaaaagtcatctctgtttccccactggtaaataatggtaagaaaaatagtgcctagtggggcttacgtagaggactgggaagctgaactgtgaaaaatgattccaaggtttctggtcaccatggctactactcttttgtacccagttctttgctcctcaaggagccttgttttctatacttgtgaatatttcaaccaactaataaagatgtgatcggcaagc

SEQ ID NO: 594 - DNA, 771 bp, Homo sapiens
gaagatacagagtgaagatgagaaagaaaatctgagactgaaggtgtaatggacatttggtataccataccacgttgattctgaacaaggagctcaccttacagtgataaaaataaagccatgagctgataacccagagaattcactggttctatgtatctcttcatcaaaaagcagctcacctcttagagaagctgaactggaaactccattagagtgtcaactgggagacaaaactttgtgagagtaaaacactgatctacaagataaaatttatgctccatctggctgctgagatggttgaaaattaaaaaaacacaagaaatctacgcctcccactaatgacccccattttcggacacgcaccacccccggcttcgccaccccaccggggagaacggaggagcaaacacaagccggcgaaacgtgtttccggtcccgcccctgcaggagccgccatcccacgcccgcgagtaccctcactgctgcgcctccacggcaatgccctacccccggtttgaccatccacctgggtcggatgttccccgccgcgctctcacccacggccccggacgccccaccacccccgagtcggccggcccggacactaacaccatacccacccccgcctgccgactcgcactaccaccgcactgcctaccccgacactgcaccccgccccccagccaggcgccagcgccaccagcggaacgcggcgtgcccagagaacgccgctcgtggcacactgccgtccccgcgccgtgacaggcg

SEQ ID NO: 595 - DNA, 302 bp, Homo sapiens
agctgacctttgttctgttggggacaccagccagattctaatggatagtgtttttcacatcctcagctcatcagccaactgacagagataatccaggaccattagttaaaaaaagaatcattatcttttggttaatctgaataaagtgaaaaaaaaaggtgccagtgacagaccaagggctttacaaactgtagttaaagaaatattaggaaaaattaggaatccaacttacaagggacgcgaaggacctcttcaaggagaactataaaccactgctcaatgaaataaaagaagatccgcca

SEQ ID NO: 596 - DNA, 775 bp, Homo sapiens
ccttgtgaataccaaaccagagcttgttgaaaggcctatgggaagctgttatgtctatgtatctactgcttctcatctaaggatcccagaatatttttggacaacagactcaacagtcagagaaagaatcattggaaagtcatgaaacagagtgatattccagctaccttgtgattctgtcaccacatctgactgcgataacattccaagaataatggctattacttcattcttctcaggttgaaccagaaaataaagaccctacaagaggaacagaagcttctttaatgattaaacttaccaaacttgaagatcttgaaacgaaagactgtactatctaaagatttttaaagtacccaagtagaataattagcaaatcattactgaaagataactcactgacattttctgacatttaattaggtttaagatctgaaataatgggatgtgctatattgacaatgaaaaaatagatttcaaaaggttgcatacttcagtgtaatttattttagtgtctgaaaaactggttttatcaaaaaatagtttgtcttttaaaaatggcccgtgttagcaattaaaatgaaaataaaatccactcggtttacttacatgtgaaacatattgagcagatctgcattagaaattgaaagactttcaaatctgccttaaatgtgttgcactcttgataccattttctgtactggctcattggaaaatatcttacataggttgggattgtggttaattaaaacaggaaaaaagaaaaaaaaaaaaa

SEQ ID NO: 597 - DNA, 243 bp, Homo sapiens
atgagcagaagggtacaaatctgcctttgggaaatacatctgaaatgcagagataaacaagtttgcatctatgaaaggagaattggagagaggggagaattgaaaacacaccagtggttagaacagaagaggaaagtccactgccctttaagttgaaacagaaggaaagacatgaaggaaagccttgaatgaaatgaaataaacactgaaaccatactcagaaatacatcaaaaaaaaaaaaa

SEQ ID NO: 598 - DNA, 463 bp, Homo sapiens
ctctgccctctctcactagctggaatcccgtctccaactctctgcagccgactccatctgcgcatcactccgatctgtattacagtgattactccggcgtctgcatctcgtcctgaggtcctgaactttgggatggcaccgaccatctgtgactgtccgactcaaaacatcggtgcctggcacaggaagcatctcattctgtctctcctcaccccccttatgcatttcacccatcaccaaggcccatagagtctaccttgcagcgtctcaccaattcacctgtctctctaaggccactggcacctcatgccagccctactaatgggctccttccttcgcccctcctccagtctagtcaatatgttaccaacgcattatccctctccactgctctgcccttcaatcatctgtaccacaaaatgtgactcaataaattcaagctgctattccaaaaaaaaaaaaa

SEQ ID NO: 599 - DNA, 168 bp, Homo sapiens
tcactttttatttccagcctagagactaccaaaacttcacaggacatctaaagccacttccagctggcagaggtggccattttttcccatgcatgcaggaacagagtggtgagtctccagccttgcacagttctccatcccattgctccaatccaagacctagctctg

SEQ ID NO: 600 - DNA, 877 bp, Homo sapiens
gcatgacttcttattaccaccgtcagtagtcctcagcgaagccaagttgggaagtcaggcacatcagctccactttggtccactggtttcctaggcttttgggctcacacatccaaagagattgaagaccttctgaaacagttaaagagcaagattcaatctgacatccccatctacacttaagggcaaaccataaacccttgagaaggacgggaacacacccggagaggcataggaggaaaaggcccaaaggaacaccttggttaaaaaagtcgctgcctctgaagtccttaaagtgattcactgtctcttcaggtgctgaatctgagagtgctgtaggcgatgaaatatcacctgccatcttacacatgcatcagaaatggacagaaggaggaaagaaaagaaggtgttcacataaaacaagacttcagttgctgtggaggcaggtgagcctcacatagcttctaatttcatgcatcagagtacagaaatcaggttcttttgttcaccttttagaatggatgtcatactaatcacacagctggggacatctttccaattgtgtgacgtctgctccagaatgatggtctacttcaactcggacaaggcaggagagtgacccgccacccggggctccaaacagagccctgccctttcagccacaacatgcagcagcaccaggacctctgggtttgggccctggacacactcagcacctttgtctcagctctcagaccttctctggaccctcctgtcctcgtgtctcacgcagagcctagcacagatgaggcacccactcaatcctgacccaagaagtacatggatacccacgttcacaccacataaacaagggaaaaagttattcaataaacgtaga

SEQ ID NO: 601 - DNA, 944 bp, Homo sapiens
tcagagtttattgaataactttttcccttgtttatgtggtgtgaacgtgggtatccatgtacttcttgggtcaggattgagtgggtgcctcatctgtgctaggctctgcgtgagacacgaggacaggagggtccagagaaggtctgagagctgagacaaaggtgctgagtgtgtccagggcccaaacccagaggtcctggtgctgctgcatgttgtggctgtggaattggggcagagagcacaggtagcaggaaagtgtgtgagttaggctgcatgtcacagagaccctcaaaataatagtggcttaaagagaagtttattcctctcatctgcagagtccagaggtggcatggctggtgggcacaccacactgtcagagacctagacttcctctgtctcgttttgtgcatggctctgttcccaagtcacctcatggttcgcgatgagaaaagcatggcattcatatttaacacggcgaactttgtgctaggattgggacacaaaaataaactccatgtggttcctgccctcaaggatcttaggtctcttgggagagacagatgcctggatgaccgccctccatctgaggttgattggaaggagccctgtgtgagaggaacacaggcaggcaggccaggcagcagagctgacatttgggaataaaggaagtctttatgaaagaggtggcatctgatcttgatcttaaagaataattagtatcttgacactcatctgggaggctgtttgagggagaaggatactgtgaagggaggtacgaagacctgaaagggcagggctctgtttggagccccgggtggcgggtcactctcctgccttgtccgagttgaagtagaccatcattctggagcagacgtcacacaattggaaagatgtccccagctgtgtgattagtatgacatccattctaaaaggtgaacaaaaga

SEQ ID NO: 602 - DNA, 526 bp, Homo sapiens
tctgagtttattagtaatttggatgtcctttttcatgaagtgcccactttatgatttggcccactttctattgtgctgcctgtcttctgtttctttcatattatttgtagaagttcacaatatagggcgcgggcgcggtgagtcactcctataatcccaacacctttgggaggcgcgagggcgggcggatctcgaggccaggagatcgagaccatcctgactaacatggtgaaaccccgtctctactaaaaatataaaaaaattagcccggcgtggtggcgggtgcctgtagtcccagctgctcgggaggctgaggcaggagaatggcgtgaacccgcgaggcggagcttgcagtgagatcatgccgctgcactccagcctgggcgacagagcgagactccatatttgccagttctcttggtattcccattttatggcttttgtgggaatgcagttcatgcttgtctgctattttatttaatttgcctccttgtaaattccagactgttgaccagtgtaattaatc

SEQ ID NO: 603 - DNA, 847 bp, Homo sapiens
ttgtaggtctgctgattgatgaaaatggagtaatgagaacagatgacagaaacaaaccggcacaacctgtcaggtgccaggtggcacctttaagatgtgggtgaagaaaactctaccatagaggaaagtagttccagattaaaaaaaaaaaatggtcacctgtagtgatcacatcccataattcctgttagtctcactgtgctatatggttccaatccccacttccctttctggatcataggttgcaaggcttccctcataaacggactgaagaaaatagggcaaatccaaaaagctgatatgaagggattaagtctacacattggcttaggaaaaccaactgcttaaagctggattagtaagacaaggaagtatggtcttctacaaactcaagaagtacgaattaatgttgatgcttagagtcttaataaacactgacctgatcaaccctccctggagttttgtgcttatttttgggcaccacagtttaagagagatgctggcaatctggaacactccctaaagagaagtatgaagatggagaaggacttaaaaacctgcgacatatttggaaagtgcaaaggactaagaatgcctagcctataagttttaaaatacaagtgttgctgctataatatgatatacgcattccttaaaaaattgcattctagtaaattacatactaaaaataagagacttatgaggaaaatatagaccacttaaggcctgcacaactttgtaagcacagcactgacaaaaaccaaagtaatttcagtaaaatattaatgtatttaagatgctatattcccaataataagtgatacaataaataaaccccgatcggcca

SEQ ID NO: 604 - DNA, 815 bp, Homo sapiens
  misc_feature (1)...(815): n = A,T,C or G
caggaaagtttcattgnattgagcagcagngactggacatctctaactgcagccaaattctgcanattctcagagaaaacagtttgcanaggagtgagaaancgncnttcaagaaanctttcctggtntgggtggacatagccngaagtggatttgaatatctgtctttacaagtcaaaatcnataccangaagntctaatgaaaatggtgncactcancaaatctataaggnaaatncattctaaagacttaatgaatncattcccnacaantgngaacattattaatttcctttcattnttcgcaacctacataattaaattaanaaattatantttaggtcagactgtngngaagagattcntatttaangtaatcngtctttagaanagcctgttcctantcanntttgttgncctttaannaacatntaagcactatctanagtagatgaaaancntcggccctgtnatgctgggnnggaagccccnanccagnccngcccctccntttnantatctnngtgtaaatnttggnaaatggcnnaaaactctgaggatnantttcttctntnngnnaaaagaggnggnatnttnantncntattacccttattggtctttttgtgcggatnctnntnanttccgagnnaacnacnntcctttacccaaagtctaaaacngaactttgctaataagattggtaccgcccnnttnctttaaaaaggtntaantnataaatccccattataaacccntnngcnccgtcctnnncctnngaaatcnattttntcncnttnngaggcggactaggtt

SEQ ID NO: 605 - DNA, 302 bp, Homo sapiens
tgggtgccgaccggccgcatctgtgtttatttaatgtttacactttaattaatccacacatgggaagcattctttcagtgacaaaaataaaaggatgagaaataaaacaccttttatatcaaggagtggtgagtgcactgtctactgggtggctttgattggagctgtcattgatcaccttgagctcaccagcctccgagtcacatttggatataaagctaatgtacggggtgggggcagaggtttcagcttcccgccttcgaagagtgcagcgtgctggcaattgctgtggagcatggatt

SEQ ID NO: 606 - DNA, 744 bp, Homo sapiens
tcgttttttattttgagagaaggaaaactgcttaacatgaacgggaccccgtcttgaagcactcgtggagctttcatctatcagtttaattctatcctgccatgaaccaatccttggcaattctcactagcaagctggagagcctgaacatgaacaaagtcagccataggaggaggccattgttgactctttcccaaagggcacagtcagtgacaggggtcttcggcaggcacctggcacacagtcacatccactacaggaagtcaccggggagacctttacaggaaggttatgggagggggtctgcttcactcactatcgcggactgggaggactgtgatggggaaagtgatgaataattccctcttaaaacgtgaaaatcttaaagtttcaccggtggtttccggatggtatatccagtagcgcgggtaaattcagaaagtaagtggtgtttttcgccccagatcccttgtttcgaagtccgtcgtggtaatggagcttgacggagttatagttttcgcgccccatgatccaagggataccttaatcaccgcaatggggcccgtatatccccagggttcgttacgcgatgtttatacgattctcgtcgtccgtcgccgtatgagattggtggtggtcctagaccgcgtaggcaaattaaaatataatgccgcttgcatctttccttgtcgttgaatactctcgcgtccgcgtatggattgttcaggtttgtgtttgcttgtc

SEQ ID NO: 607 - DNA, 358 bp, Homo sapiens
tcgtaatttattagattcctctcaccacaatctcatgttttcccgtggacttttatgctcaaacatgccctatatggatttaacgtttcttgttccattagccacatcttcaactttgcttccaccgaccagcatgagtgtggttttgcattttgataattctttagtatccaattcgtgaccctcccctgattttcagcttcattaccctcacattttgctgacaggtggtagtggtgtgccctgatttgtttggatgtgtccgaggaaacagcccatcaaaaggagagaatgtatatgatgagtccaaaagaatggagctagagtgaaggcccacagcagtaaatggccatgagaa

SEQ ID NO: 608 - DNA, 846 bp, Homo sapiens
atatgctccaatccacccctgggggcagccagatgagagcctgccagaagaaaggactcaccacagggactacagctgaaaacctgaaacgtcctttggcaggaaagcacaaatatctggtgagacaggatgagaacatgaaacctctgctacggccactgcaagaatattggttattacacagtgtccacactgtgagaacattgactttgacattctagaggagggcagaaccacatatagaagaagcctggatccctgaatgactgcatggattcaacacagcacctatacacacacctgccctctgtgccccgataatctacactagaggacgatgtgagcaatacataaaatgttattatgttaagggatgtaggggttgtttgttacagcaatctcactgatgaatcccatgagatctactacatgccagaaatcatcacaggcattttatttaccttattccacttgagcttctcagcaatcctaagatataggcattatatttggtctattttataaagaaaaaaaatacaattcagaggcatgaagtaacttgtccactaaagcaatggagaactgcattcttcagtctcactccaccgttacttgatctgttttgatattacatcatcagcctgtatagaaggacattaaagaaatagctataggaaattgaaatttttttactagcacatagaattattatttattatatcacacaaatgtctttttagggagagccattaagtccccctatctcaagcccaataccaggaaaactgcttctctgatcaactggtatgtttttatttcaagagacaataaatcacgatcggccag

SEQ ID NO: 609 - DNA, 819 bp, Homo sapiens
tgtaacatccagctattattccgtttagattgagacatgggatgcttccggccgcatcaccctttattgaccttgcaaaatagaaaagtaatgtgaaaaacagtttctgcagaaatacctttagttatgtttataacaatttagctgttatttctcattagtcattatttctcattttccaagctgtgatttagagcaatagcgtaagtataaatcttcagatacaagtcaattcctctccactgaaggctgctatccgaaagtatctcctttataggactccagggatgtcaagaggtttctgaggtcattgattccattatatttttctgttgaataagtccttcactcctaccctgaccatcatcctactaccaaggcattaatcttgttataatctgtggaagaaatattactgggctttgatcattctttgcaaatctaccatgagttagaattttggaaatagtggaaaattatacatcgtgtgatttttttccacaaagaaaagatactggctattcccctattagttgatgtattgtacaaaagactagcatgacacctggcataacagttcactcctaagtcacgaattcagactttcccaacataattgttccccaatgctgagcttaggcggggagagccagacagtccggtgacgtaggcgaggggatcccaggcctcgtagacccgagtggcggtgtgaatcgccaaaggataacacacccccatctgatttttgtaagattgggagtggaggctctcggagttcatgacagcgctcatacgtggaactggcggggagaccaatct

SEQ ID NO: 610 - DNA, 321 bp, Homo sapiens
tgtacctgctcccccttcaccttctgccataattggaagcttcctgaggccctcaccagaagcagatgccggcaccatgcttcttgtacagtctgcagaactggtcggctctgcttctgcaaacatccggcccttcccctcctctggcctgtgctcagaattcagaagcagctgtgggggcacgcggctgtgccctttagcccatggtcacaggagaaatggcctcagcagaaagactccagaaatgacagccatgctcagccttgggaggttttacaaaacaacagcccttacctccccttcccctgaaataaatctgga

SEQ ID NO: 611 - DNA, 556 bp, Homo sapiens
cggccagcatcggtgtttattaggaacatgatcaagagagttgacagtttttctgatattcaataagatttttgtgcgggacggtatttaatattctagctctaatagtctatgtgtttatagtaatcataatcatttgttaatatgctcagcaagcagtatttatagtcacctggggaccaggactttattagatgttgaggagattataagtgaatagccataaaccatagcttacaagagcttgcagtccagaggagaagacagccaggtaaacaactaacagacagatatacaagtacagaatggctagtgctgggcaagatccatctgcctatgtactgctgagatacttgtttaaggagtggtatagtctgaatgtttgtgtctccatggatgggatttgtgccctcgggaaagaggccccaaagagctgtttccctttctaccatgtgaggacacagtcacaaccataggcgtcatctttgagaaggccagcactgactagacgctgaatcttccagcaccttgatcttggacttcccagtcttcagaa

SEQ ID NO: 612 - DNA, 218 bp, Homo sapiens
cgtaactgcggagccggggctgagttatttggctactggaggtggagcgcggccctgtcctcccttctctgctcacaactgaggatgctgcacattgtggggtgcgaaagtccgcacggcctatctgtcatcccgcattatcaggaagacgcgccacttccatgccgggctgcaaggctccagcaaattgttattttatgggagataataaaggaaga

SEQ ID NO: 613 - DNA, 715 bp, Homo sapiens
  misc_feature (1)...(715): n = A,T,C or G
cagacaaagctttcagtaagatgcaacattccctcatgacaaaaaaaacctcaacaggcaaggcattgaaggaacatacctcaaaatcgtaagagccatctatgacaaacccacagccaacatcatactgaatgggcaaaagctcaaaccattccctttgagaactggaagaagacaaggatgcccagtctcaccactcctatccaacatagtactagaagtcctagccagagcaatcaggcaagagaaagaaataaaaggcatccaaataggaaaagaagtcaaactatctttgctcatgatatgatnctatacctagaaaatcctaaagactgccaaagggcacatcgaatngataaacaacgtccaataaaatctcacgattcaatatcaatttataaagatcaggatttttaaccaccaacaatatccaggctgaggaggaagtcaagaacacaatcccacttacaatgtgcacaaagaaaatgaggtgcctggaaatcggggaaacaaggagggaaaggtcttaacagaaaaatacaaacactgggcaagaaagacatattcataggccttgcaaaatcgagaagaggggggtgacaagcgtgcatcattgagggctcctgtgaggcgggctgggacaatatatagggatcgccgggagaaaaacacacacacccaaaacggggggggagtggaaaatgggtggagggcg

SEQ ID NO: 614 - DNA, 291 bp, Homo sapiens
ctggccgatcgatctttatttaatgtttacactttaattaatccacacatgggaagcattctttcagtgacaaaaataaaaggatgagaaataaaacaccttttatatcaaggagtggtgagtgcaccgtctactgggtggctttgattggagctgtcattgatcaccttgagctcaccagcctccgagtcacatttggatataaagctaatgtagggggtgggggcagaggtttcagcatcccgccttcgaagagtgcagcttgctgggaactgctgtggagcatggatt

SEQ ID NO: 615 - DNA, 463 bp, Homo sapiens
tgaattgacgtgacccaggagtctgtgttacagaatgctaatgttctttgagatggtggacattctaaaagttgtgaaaaaggaccagtgttacaggagctactagatgaaaataaacatccacttgaggtgcaatatttctcaggaatcatgatcaaaaagacactttgattggaccaaatattgactgtgttcagcatgatggatttcccaccgcagatccacatcccaagtgacagctttagaagacatgaagacatggctgaaactttatccagtgaaacctagttcagcagccagaacaagaactaccacgttttcaagagatcttcatggctgatcccaggtctagaaatggcatgtcttcaggtggtagtatcataaattgtcttaaattaataccaaagaaggatgcggcagataatctatatatataatttatgaaccgcaaccgcgaaatcgc

SEQ ID NO: 616 - DNA, 422 bp, Homo sapiens
tcttgctctgtcacccaggctggactgcaacagcatgatcttggctcacctccgcctcccaggctctggcaatcctcccacctcagccttcagagtggcagagactacaggctcataccaccgcacctggctaatttttctaatttttaatagaaatggggtttcactatattgcccaagctggtctcgaactcctgggctcaagctatatgcctgcctcagcctcccaaagtgctgagattacaggtgtaagccaccacatgaaatcaagcccggccatgcttgatttttaataaagcatcgtatctctctattttacctgaaaaaagatcccctcccacccaccttatatttccgaaacaataaaaaagatgcggccgctaattctaattcaaatcgccaaccaaaccccgaacgatgcg

SEQ ID NO: 617 - DNA, 326 bp, Homo sapiens
cctccgaggaagaccggccagatttacggacagacgaaacaagagcgtctggcacgcgtaaccctgtgttatttgatttttgcctaatatacactcgaaataaatgcatattgagtggaacaaatgtctagaaatcaaaataagagacagttcctctgtgtactatccaaaagagctcaaggacatttagggaggcaccgacttcctggttaagaacacagacctttcagagcaggcaggataggctcaagtcccacctctcccatttgccagctgagagacttgtgagcaggtctttttgtctttctgaacctcagattcagcat

SEQ ID NO: 618 - DNA, 604 bp, Homo sapiens
ctggagtggagtggagcaatcacagctcactgcgggcgcaaactcccgggctcaagtgatcctccctcctcagcctcccaagtagccgggactacagtttcccctcctgccactgttcctgcagatttcagctccatgggagcaggaatcttgtttcctcactgaacattatgttctcagctcctggaaaagtgcctgttacagagcagaagctttcaaaaggcttcaaggccatcttcaggcaggatgtaaagaggcttcactttatcacccaggagtgcagtggtatgatcacagctcactgaattgtcgacctcctggcctcaaactatccttccatcttggcatcccaagcagctgggactacatgcatgcaccagcatgcctggctaattaaaaaaaaaatttcagtagggacagaatcttgctatgctacccaggctggtctcaaactcctgggctcaagcagtcctcctgccttggcctcccaaagtgctgggattacaggtgtgagccactgtgcctggcctactgcctttcaatgtaaagaaaaactaaaataaaatgaaataaaaatcagccatggtatataacctgcaaaaag

SEQ ID NO: 619 - DNA, 160 bp, Homo sapiens
tttttttttttttcagtgttacatcaatgcctttattcctgtcctgatagccacacgttgacatttaggccccaggttcactaggctttggtctgcacaccagctgccagcctctgacaagttgtgccagcatccgccccaccatcagggttgcttgtgg

SEQ ID NO: 620 - DNA, 826 bp, Homo sapiens
cggcagatcccggtttatttatttgatcatttataacacgaggagacctagcaacatttcagaactgaacggttagttacactgtgttcctgtctgcagttcttcctgctattatccaagccacaattaaggagtaacatttcgtgggagtccctaactttaatactttcctaggtttgtttggaaagtgcttttaatttaactgcaccagaaataatgtaaatgtgtctaagttcaaaacaaaagaagtaagccttttggttaattcagcgttgcacatcagagattttcatttatgaaacagtggggtggtgagccacagatggggaacaaaatcattccttacccaacagctatattttttttttttttgaaacggagtggagtctcgctctgtctccaggctggagtgcagtggctcgatctcggctcacttcaaactccgcctcccgggttcaagcaattcttctgcctcaacctcccgagcagctgggactacgggtgccccccaccatgcccaagctaatttttgtgtttttcgtagagacgggatttcaccatgttgggccaggatggtctccatctcttgacctcgagatccgcctgcctcggcctcccaaagtgctgagattacagggcgtgagccaccgcacctggcccaacagctcttttattagcttttaaagatcttaagcttgacacctttggctaacaggatttcttggtgcctaatgtaacaggcttttcatagaacttggtatccaacttcgtggtcttccaaccatttaaaagctgtgctggcttttctagagaacctcctgtacgg

SEQ ID NO: 621 - DNA, 694 bp, Homo sapiens
tgctgaccccaacccatgtggctgtagactttatgctcccttccaaactgatggaaaacagaagaagcacacagcagctgccactggaataggagccttcagacgttggttttaagcctagttcagctgttaactagctatgcggccttgaacaagttatttaatctctctttcaatatccttataaagaaaatggagaggataatagccggtccccagtgaaataatggatgcgaacaaacacactttgagaagtgtgtgcaagctggtttcatcatctcttaaacatctcagatataagaaggaagttgctacctggaaataaggaggtagacggcaaatagctaagtaaatacaccctaaaaataccactttgatcttgggccaatgtccctgaatcatcatcctcctcaaagatggaatgaagcaaggtccttcacagtctggtctctactaagaaaaccccattttactgagacactgactttccccatgattcgcttttattcagagccaatatccagctttgtccacagggtgcccgctgcgttgcttcactgaggtgaggagtgggttctgagcaggagcatcgtcggggaggagtgggaacaggacagagggaagggctgattcccaggagcacgtgttcccaacaaggccctctcataacgttcacagcactcgggcatgttga

SEQ ID NO: 622 - DNA, 362 bp, Homo sapiens
aatttgtagctatacatttcctctgaacacttcttttgctgcatcccataagttttggagatcaaaatgtttctacctctgaagattagaactataaggaccttttccccccacttcacctcaggaagctctctttgtccttactgaaggtatttaaacagaaacaacttaatggatttggatattaaaaaatcaattgaagaatcaaaacactataaaaattgccaatgaaaaagctagtaataaacatattttggaaagaaaattttaaaattcatgcaataaaggtatgatgagaccagggagtgaatgaataaacaataaaaataaagatagcaatttccaaaagaaaaaaaaaaaaa

SEQ ID NO: 623 - DNA, 617 bp, Homo sapiens
ttccggagtatatgagcaggacgtgcaggtttgttacatagaaaccgagaccctgaccagatggaaactgctgactgatgtcacatagacctcagacaaaaggaaactgaagcctgaatgaactgctgttctttgttctaaatttcttcctgagggacctggaaagacagtcatgactgcaggccatcagtcttgataacctgaccactctgacccaatacataatggctgtgacctgactctcgcttagcaccccaagattgttaataggtttccttatcttaactaatgtaggttaaagccaaaccttgacatctctttctgctgaccccatgtttttagacaaagccttcctccattaacccattgcaaattaaagaatctctgaattcacctaagacctgtaagcctctgcttcaagatatcccacctttttgggccaaacccatctgtaacctccatgaatgaattcatgattttgcctgtaacttctgcttttcttagatgtacccttgtctttaaaaacccttgcttgcaagccactggggagtccagatcttaaacaggagctgcccattctctgtgcttggtgccctgcaataaatgccgatgtggcg

SEQ ID NO: 624 - DNA, 808 bp, Homo sapiens
  misc_feature (1)...(808): n = A,T,C or G
ttccggagtatatgagcaggacgtgcagaaaccgagaccctgaccagatggaaactgctgactgatgtcacatagacctcagacaaaaggaaactgaagcctgaatgaactgctgttctttgttctaaatttcttcctgagggacctggaaagacagtcatgactgcaggccatcagtcttgataacctgaccactctgacccaatacataatggctgtgacctgactctcgcttagcaccccaagattgttaataggtttccttatcttaactaatgtaggttaaagccaaaccttgacatctctttctgctgaccccatgtttttagacaaagccttcctccattaacccattgcaaattaaagaatctctgaattcacctaagacctgtaagcctctgcttcaagatatcccacctttttgggccaaacccatctgtaacctccatgaatgaattcatgattttgcctgtaacttctgcttttcttagatgtacccttgtctttaaaaacccttgcttgcaagccactggggagtccagatcttaaacaggagctgcccattctctgtgcttggtgccctgcaataaatgccttcctttctctcatttgaaacctcggtgtcagtgtttggctttgctgagctgggtgggcaaacctaggctcagttccacaacaattacgatatcatcatcatcattagagtcatgaagaagataagaatggaanattatgctgatgtgctgatggtgacacctccacattccatattgatccttccatacataaggttcggggctatacatta

SEQ ID NO: 625 - DNA, 290 bp, Homo sapiens
tttttttttttttatataaaagaaataaaggtttatttctcacattatcctatgtgaacattgtgggtttattggggattccattttgtagcatcctcattccaagttaaaggagcaaccactttctggtaaattgctgttacccatggtagaaagagagggatgaattgtgcactgtttcttgaagcttgcatccagaaagcacacttttgttctcatttcattggctcaagcaaatcagatagccaaaatcaattccaaagcggcagatggagcaatcctaccatgtg

SEQ ID NO: 626 - DNA, 218 bp, Homo sapiens
tcaggcccatcccgttttatttataaaatttatctactacaaattgagttgctttaattcttcactatccttctgagagagattagaagaaggaatgacaatgtctgcttacatgggagaatactgaaagaaggccaccttaaatcacatggtgtaaattcattggtggtcaaagctcagcacacttccgcggtttgtcttctccatattgcttcctt

SEQ ID NO: 627 - DNA, 357 bp, Homo sapiens
atggaaggaaaaaaggaaactcaaagagggagagaaagcaaagaaaaggaaaagaaaaagaaaataaataaagctgacaaatcctgacaccttgtgatttgcctacaacaaagaatgaaaatcatccagataagaagcaaacttccctgacttttgttcttccaatagaacagacagcttttactgatataaattttaaaaatggaaattaagggctacttacttcttctcatttccttttgagggaaaaaaatcatgcctcaaattggtaatgggtagacctatgagattagcttataataaaagtctgaaaaaagatttgcagtccacaaaataaaaaccgatgctggcctgaag

SEQ ID NO: 628 - DNA, 161 bp, Homo sapiens
gaggggtcagggtccttctgctgcagtacaaaagtcatgtgtgcaggccagctgccaggagagacccacaggccatggagactgacaccaactactgaaactgatcttgctctgtctcttcttgtgtgaataaagcattgttccatccaaaaaaaaaaaaa

SEQ ID NO: 629 - DNA, 567 bp, Homo sapiens
ccaagatgacaacgagcccagctgaagctgacatcccagcaaattgcatgacaaattgcaaagacgactaacccacaacctactcttctggaaaatacaatttaaataaaataattttaagtgattttcacctgttttcaaagtacatgatacagtttataagtattaaatttaaaaaaagactaaaatgtacttagtgacttttcatcattattgaaataaaattttatcaatttaaaatatagagaaatgaaaatatgttaattattttatggctttttccccttaatcttaaaatacgattcagaggtaaagttgtatttgttttggctcaacatgcattatttacttcaaattaagtatatcaaaaagcaaaagtgcatgcttttaatatttctctagtaacttaaagcagattatcaaaattactgtatttataatcttttgtttattttacaatgatttatgagattaattaacttaaaatcaactgtatccaccttctggaggctttatgtaaaacaaattaaatagacattttaggcattgaaaaaaaaaaaaaaaaaa

SEQ ID NO: 630 - DNA, 816 bp, Homo sapiens
  misc_feature (1)...(816): n = A,T,C or G
aaaaacagactggagatcatctaaaactctgaagacagatgaagcttttaaaaatggagtaaaatactcccataagcaaaatgtggagcatgtttccttctctctacctgatttatccagaatgttaaaactatctgagtatgatgctggaattgatgaagctgaactagaaggagtaaatatcttcactttaacaaaataaaatagcttctactttctttatgattattatatcaaaatataagcattattttaacttaattcagtaatcgttatatttcaaaaataaatctatttaataatataattattcatcattataacaaatgtttaaattttatgtatagatttgaggctgttaaggtcatgatgacaattttatcctatacattttatagcaaataaatatccatatatgcagcaaaacaatattaaatctatcaaagcatgtggttcctttatagaatcataaacatcaagttttattctaatttagttgaggctagtttatgaggcaaataaatacttgaattttttaaatttaaattttgctaattcattataattcatcagccatagcattttgcctgaaaaattacgcctgcgcatacttatgacgcccaacgcgctgccacaagcctgcattcctggcgctctcacgcgtgacctatcaccccnggccctacccccgcaccccgtcccgcaccggccctgccacgacccacccaacagcagccgtccgcgcggcgccccgctctctgcccgcggcccgcggagtccaacacccgacacccgttcgctgcccacacccgtcgc

SEQ ID NO: 631 - DNA, 758 bp, Homo sapiens
ctagaaaaaacagactgggagatcatctaaaactctgaagacagatgaagggactaccttttccccgttttgtgttcttctcaactttgttgaaaatcagcaggctgtaaatgtgtggatctatttctgggttccctattctgttccgtggctccatatgtctgcttttcggagtatgatgctggaattgatgaagctgaactagaaggagtaaatatcttcactttaacaaaataaaatagcttctactttctttatgattattatatcaaaatataagcattattttaacttaattcagtaatcgttatatttcaaaaataaatctatttaataatataattattcatcattataacaaatgtttaaattatatgtatagatttgaggctgttaaggtcatgatgacaattttatcctatacattttatagcaaataaatatccatatatgcagcaaaacaatattaaatctatcaaagcatgtggttcctttatagaatcataaacatcaagttttattctaatttagttgaggctagtttatgaggcaaataaatacttgaattttttaaatttaaattttgctaatttattataatttatcagttatagtattttgctgaaaaattataattgtacatacttatgaagtacaatgtgctgttttaagcatgcattaatgttgcttttaaatttcacctattaaacagtttttgaaatagagtaaaattggaataagcaagaaaaaaaaaaaaa

SEQ ID NO: 632 - DNA, 320 bp, Homo sapiens
atgtacgcatgagaaacatcttccctaagttcacttgtcctcttgggccaaggatgctgatgttccacatgtctatggagcttgccttttacccccagagccagagaccatttttaaggatgacgcatatttggctatataggtcaagaattcaacactataggaatcccagctactctggaggccgaggcaggagaatcgcttgaacccgggaggtggaggttgcaatgagctgagatcgcaccactgctctgcagcctgagagacacagcaagactccatctccaaaaatcaatagataaataaaactcgatcggccg

SEQ ID NO: 633 - DNA, 286 bp, Homo sapiens
cattcaggcagttatatttcccaatccccttgcagctttcttggtggagtctgtgagttgttttggttaatgggctgggaatggaagacttgtgtcactactgtgccaaagcacagaggagttggggtatgagaatgccatacgctctcttcctctaccgtggtgacccagaaggctttctgttgtgattgcagtgccgtggaatggaaaagcctactttctatcacttcctggaggtttgtccggaaccacagctggctttgagggagtgagaaataaaatgtga

SEQ ID NO: 634 - DNA, 227 bp, Homo sapiens
agcacagtataatatatatggcccaggtactgcggggtctccacggaagagaaaggacaatatggaaaatcttcattcaatacttaatttctcagtgcccacattccaaagcaggcacagaatgagctggacagacctcagcctgcacctccaccctgcttcttccagaaaatcacagaaataatatttcttggtaataaaataaaggcgtggcctcgttggcctca

SEQ ID NO: 635 - DNA, 239 bp, Homo sapiens
tgaggccaacgaggccatagttttattgataaactgaggcatggggagcatcgatgactgatcaggcagatgggttggaattcaaggtccagtctgtggcttcaaggcgaactctgctgtgccccttggcagcatcctcctgggctactcaggcatctcattcctgcagatggcaagaggggagctcagatcactcctgtcttgtcaaagggaggaggcgatagcctgaaacagattcc

SEQ ID NO: 636 - DNA, 262 bp, Homo sapiens
cggcagcatcggcttttattgtcaatccacagtgaatatctttcacgggttatcttgggtctttcttaatctaccgctcctttcacatccatgctgtgaaagcaggggacaaaggcagccatctgggagctggggatgctgatgagcaactcagaagtggcgctcaggggtaggaggaggtgtgacgagcaggcacgctggactcatggttgctccttggggtggctgaaacagcacttcctatgcccagcacatggcatgt

SEQ ID NO: 637 - DNA, 244 bp, Homo sapiens
tttttttttttttgaaaaaaaaaaaaagaatggctaacaagtttatttgaaatattaatatactaggtgatttcagaatattaacatgttaaaaaagaaatatttgggaatcgaataaatacaatgattctctgctggatctggatctatatccacgtaaatgagaagaggagacgccatgggaaactggcccactgttctctttactgtagcttcactgatcatgttattggttccaatgaat

SEQ ID NO: 638 - DNA, 549 bp, Homo sapiens
atggagtgttactctgttgcccaggctggagtgcagtggcttgatctcagctcactgcaacctccgcctcctaggttcaagtgattctcctacctcagccttcctaataactgtgataacaggcttcttcttcacaatgagagcttcaaaacggaaaggcacttgcatgccagcatatttgcccagctgtgcagtaattgtcttaaatgtgaactgatggaagaaaaacaaacaatgagagactttgtcctcaaccccagacactgacaatgaaaccatccaaagcaaaaatgacattgagagtgaaaataaaacctagcccaacctgaatgagtgttctgtttgtttttgaaatgagatattctatctcaaaaactgttgaggcttactctggtgtctccaggttaaggcttgaaataaaatttatagagaatttcaaatgattatttaaagaaatttgacttcttctatggtctaaattgctttaatatttactattttgaatttttattctttaggtgaataaatttatacataataaaaatgaaa

SEQ ID NO: 639 - DNA, 597 bp, Homo sapiens
  misc_feature (1)...(597): n = A,T,C or G
gggaatgtaaattaaaactgtaatgaaatacaactacatgccaactggaatgggtaaacataagactggccatgtcaagtgttggctacatcagaactaacgacttcccacctctgggtggggtgagatccatctcaggaggcaagtgatatgacagaagaaaaggcttcttcttcacaatgagagcttcaaaacggaaaggcacttgcatgccagcatatttgcccagctgtgcagtaattgtcttaaatgtgaactgatggaagaaaaacaaacaatgagagactttgtcctcaaccccagacactgacaatgaaaccatccaaagcaaaaatgacattgagagtgaaaataaaacctagcccaacctgaatgagtgttctgtttgtttttgaaatgagatattctatctcaaaaactattgaggcttactctggtgtctccaggttaaggcttgaaataaaatttatagagaatttcaaatgattatttaaagaaatttaacttcttctatggtctaaattgctttaatatttactattttgaatttttattctttaggtgaataaatttatacatantanaaaaaaaaaaaaa

SEQ ID NO: 640 - DNA, 558 bp, Homo sapiens
ttcagttgcctaaaagccatgaatctgaaccaagtcctggaatgtgaagtctgacaaccacaaaaaaactatatcctcggagcttgcttgccactcttcgcggccatgggaagaagccctcttatcacctctactttttataattcgtgcaagtgcttctcattaccaatacctcacttaggttacttttagcttcagaggatctgagaaatgccattttaaaaatacacttgccctgttgtaacagagaatttaaaaggaaaaaggaagaaatgtcataaacaataaaccgttttacagataaaaaaatttatctctacctcaatatggaacatgaaaaaacagaactataatatagagagaaaaataattaaaattgtgtaagtctagttaaagataactaaaattttattccactgggttgtaattatctaaatccattaactgcaaaacaatatatctttctcattcacatgtgtaaaaaaaagtgtcaacatacagaaaaatttaaaattgctgaattaaactttattattatgttttggaaaaaaaaaaaaa

SEQ ID NO: 641 - DNA, 280 bp, Homo sapiens
ctgattatgtatattttcttttctgaccaccctccacacttcaacttgaaatccacagtgccttccccctcaagctgccagtgaggtgaatgcaatcaccgttatcagcaatgctttgtataagcaactcacaaaccctgctatgatggatttactgcagttgagtgttgtagacaacaggaagaccaaatggagtggagagattgatagaaagatcatttttcttcatcctaaataaacaaaaataaatccttctaaaaatctgtcaaaaaaaaaaaaa

SEQ ID NO: 642 - DNA, 379 bp, Homo sapiens
tcgttatttattatctcacagattccagtttagtcttggcttagttggatcctctgttctgagtttcataagccagaatcaaggtaccatccgaggctggggctgtattccagactcacatggatgtaggtaaaactcatttctttgcagttgtgtaactcatggttggtggcttgcttcttcaagtcttcaacaaagacagtctgcttctttaagactctggactgagagcaatcctaagcctataaggataaaacaattcaaatgacagtagatttctcatctgaatctatggaggccaaatggaagtgatacagcatttttcacatcctaaaagcaaagaattgtcaactccgaaccttctaaccaatgaaaatat

SEQ ID NO: 643 - DNA, 310 bp, Homo sapiens
aatctcactccatacctcaggctggagtgcagtggtgtgatccctgctcactgcaaacttgacctgctaggctcaagaaatcttcccacctcagcatcttgaggagctggaactacagatgcagtgctggaggtgaagcagccacatggtgaccaggaggcaacaagcatgaagacaaaagccacatgctaacaaagactgaatgaagagaaagagcctgttgggagcattctatgtatacttgttagccctgtagatttcttttatgggggaataaaataaaacctccatttaatgaaaaaaaaaaaaa

SEQ ID NO: 644 - DNA, 387 bp, Homo sapiens
gttaggctaattcctcaaaacactattttcacctcattgctcctttgctcaaaagcctacttggtgcatagttcagcatccaacacagagaaggaacacagctggactctatttcctagccttcctttgcaggaggatgtggccagtgaaatgtgggcagaaagtatgtgcaccacttccaggtatggttgtcagaaacctgctgccttacataatcattcgtcttctttcctcttctgctgtgactttagaagtggtgaagatggcacagccacaagatggaaaaagacaaaactgcttgagagattcacccactaggaacacctattttgaacttgacataatcaagaaataaacttcagttgttttaaggcaaaaaaaaaaaaa

SEQ ID NO: 645 - DNA, 881 bp, Homo sapiens
cttgccgatctacttttattgacactttctggtaaactcaagatttgagagcagcaaaagctacagaatgggtgccggtagcctgggaggaaacctcaaagacagtattggagcactttttgaatagatactacacatcactaatactctggatagaacagggatcaatatcaggtgattttaggctgtggagtggtgagatgcggtggaggaacaatttttaaagtgagcaaaaaagatcttttctctcagaaatattacatctatccacacccaaagtatatcttttttcttttttgagatgcagtctcactctgtcacccaggctgtagtgcagaggtgcaatctcagctcgctgcaaccgcagcctcccagattcaagtgattctcctgcctcagcctactgagtagctgggattacaggcactcgccaccatgcctggctaatatttatatttgttgcagagacaggattttgccatgctgctcaggctggtcttgaactcctgagctcaagtaatatgcccatcttggcctcccaaagtgctgggattacatggatgaaaagatacctaagaactgaagtttttattttgaacttaaccatgggttcttggttatatgttggtaaaaatgggtttttaaaaaaataatctcaaggttttctggacaaacaggatttcccaatagaaaaacaattttgttcttcaagaattgttcgagaatggggattatgtgtctttattttcaggggggcggcttggcacctgggacttgaggtacaaatttgtagcgggggtaataaaaaagtactggggctaaattcaaatggtgggtcaaaccttgtctgcgtacatttagctgggaggccctcgggcaag

SEQ ID NO: 646 - DNA, 288 bp, Homo sapiens
ttcgcgcgatctgtttttattctgaaaaagaagacaaaaaggaaataggctagattaaaataatcctgcagtacctagaagtgaaggacaacacgtacatcttaatacaaaaaagaattgaaagccaatccagaataaaattactccctcagtatttctctcagttggctggattaaattatagttatcttttttgtatgttatacaatcttctcaagtagggttacagtcacaattgagacatgaactctgtgtgtgtgtgtgcgcacgtgagtatgtgagagtgtg

SEQ ID NO: 647 - DNA, 247 bp, Homo sapiens
accagccaaaggatctcagagaaacacctgctcaggactactcaacaagtatatggtggagccacctgccaacctgctaccttaaactgtcattcaaactatctacatggagcagtgaacatggacttggtgagaactagaatgcaaataaacttcatctatcttccatgtcaactatgttcaactggtagtgactgcttgaagcatcgtgttaagaaagattctgaggtcacattctagctcaaga

SEQ ID NO: 648 - DNA, 221 bp, Homo sapiens
atttgcaggagcattgtgagctgatcaaggacagagaagttcctggcctttacagatcctcgttggcatacggatatctgcagtcatcggtcacctcttgatcccaattccttccttttcccctcctcttaacataaaaggaggctgaacgttttactgacttaagatggtttcttaggaaactggtctgtcttcttgctttgctggctctccaaataaag

SEQ ID NO: 649 - DNA, 262 bp, Homo sapiens
ttgatctcctgagacccaaactctgagacagagccagccccctttccaaggagtttattaggaaatgctcttgggatcaacccttgctggggagagatggaagcggaagtgaagagagagaagctgggctgtgaagcagtttcaagaaaatctctcctgattctgtgggatggtttgaagctggccctcgctctaacagggttgaatttgcaaactcattaatagaaataaaatgtgtggcaatctaacaaaaaaatgcgga

SEQ ID NO: 650 - DNA, 657 bp, Homo sapiens
atattttctaatattctgtataaatacaggaagggaaggggccttggccgcatcagtatttatttaaaccttgctaggaatagcaagttactcgagagtaaagtacagatttgatataaaaatggttaaaaaggagctcccaacttgagcccaagtaagaggggagaaatgagaatatgtccctccagaaagatgagccaaactggcaggagtgtcctaccattgaagaaagcctggagcacagggagtgtcttccgtctcaagtataacaatatttttcacagatactactgttttcccactgagacctgccagatggcatctcaggaagcatacaggataggggtaaacaggtaaaccccagtttgcagggaatgcagtgaaactcacaaagggcatgtttgagtgacagccctgctcaagggaaggtgactgtgactgcagagcttcgtttgtggattgtttcagatacatgtagagtcagagttaaattgcctaatcaagccttgggcaatggcgggctcccctcctccagcctagctgccaccttgcagtttgatctcagactggtgggctaacaatcagtgagactccatggttgtaggaccctcctagccatgtgcaggatataattctcttggtgtgctggtttttcgg

SEQ ID NO: 651 - DNA, 456 bp, Homo sapiens
atttatcatctcagctccagatggctgagactactgaaggtctggcttctatccagaccttggatagaagggccacaaatccattatggcctgccaatatctgtatttgatatgcttcaaccctctgcccagaataatgcagggaagtggagaaatgatgcttatgagacttctgaactgaagcttaaagaaagaggtaagcaggaagaaaagcattagactgggaagcacaaagacaacacgaacttgctggatttactctgacttttctcaggcccagttcagtctgacttatgtatttctactcagtttagaaaagacccattttatgccactgcactccaaataagtcatttaatttatgacgaataattttatttataatacagaatccccccaccctattacttatcgctgcaatcctgaaaatgaagtaatgttacaccataatcacaa

SEQ ID NO: 652 - DNA, 178 bp, Homo sapiens
ctttaaaactatccacaaatgaagatatcattactttgcagattttagcagaattatcgtgtttacagatctttattcaagatcagaaatgtaacatttctgaaattaagattgaagggcttgattctgagatgattatgaggccttcagaaactgaaataaaacgcgatgctggccg

SEQ ID NO: 653 - DNA, 740 bp, Homo sapiens
aaatcagaagagatgcttctcaaatgaaagaatcaactgatgatatccctgcaacactcatcagagcagtttttaaggaagttgaacgtattctaacatcaaacgtacaggtggaaaaattgaatagattcaatcctagaattttaatactcttcacaagagaatggaatcttatcttcttgtttccgaagcaactctgggaaattacaatattaaaatactaatctgaaactgtcaccaccaaccacagacatcagagttccccatgaatcccaacgcattaatgggggaactgtttggcctttatattggcctttgtcagtaatatggctaatactgaatagtttgattgattacttcaacacaatgtttcatattaaatgtagagatttgggtattttccccctttctctgaacctataattttttatgtccttaatgaaaatttgacataaataaaacaggaatgtgtactgtatttcataacaaagtggcttacatgaccaaactttattaaaaggaatgtgttctcgaataacattcttcccaccacaaagatgtatgcaaacatagtcagagttgtatcttatgacaggcagaaaaataaactcgagaacaaagaaatactttttccttctttaatcattcagttaacaagggaaaataaacctaagcatacttttagtcttcattgtgagaaataaaattctttacattttgattcttcaaaaaaaaaaatc

SEQ ID NO: 654 - DNA, 707 bp, Homo sapiens
  misc_feature (1)...(707): n = A,T,C or G
aatacaatgcctccatcttgaaccatgatgacaatggccacaccttagaggtggaggagtatggttaatgaagaactcattgggacagtgctgccatgccaatcctgccatactgacctttaagctcttggagatcagcccatgaacagtgacttntcagaattttacttgactttccagtcttcattacttcagtaggaaaataaagtcctgaggaaaaaatggtaagtgtttttacctggatttcttcgagtagccttgagaaagagaccacctgattntgctaacaatggatgcccaacattaagtgttcacaaaatattatcttataagtcctactatacttttgaatattacctttgcaatgtgctcattcccagttgaaggcaagaaaacccaagcgagagtaggattttatttttgtgtgtcgcctcacatatgccactcaacaagacggataactgcaatcagggggatatataacatattctctggctgcaggtgcgacctttggggctaccctaactcaccgcgcacgataagggtattgaccaccaactaagattttgattcttctcatctcccgatcggacatgtcatgcggaggcgtcaaggagaggacggtcgtccggatcgagtaattattaattgtgagggtggtcaatcagtgttacactgtaccagcaatacgtgcccgccccaccacc

SEQ ID NO: 655 - DNA, 290 bp, Homo sapiens
aagctgaagatccaccgtgcaaggaagacatcaaggagatccctgctgtacataggaatttgaatgagaatttcccttcaattctgagacactataaatctgacatcatatagtaatatgaaaggtgatatttcacacataaccaaggcacaacttctcttttcagtaaatattgctaaactcaaaaaaacctacacatatgacttaaatgatagatataaataaagctggatgcggccggaaaacacctcttcgctaaatcaattaaacataagtgcaacaatcacaca

SEQ ID NO: 656 - DNA, 224 bp, Homo sapiens
tgccaacagagaaaacacaatctacttcacttctcctcatctgtcgaaatggcaaagacgtttaccacctcgaaggagtgcgagtttccatttactggtgttaataaagtcttctgagtgttctcataaatcaactataacgccggcactattcatagcaccctgttggagcttaatacatattcaattaaaaaacaatgacaacaataaagccggatcggccg

SEQ ID NO: 657 - DNA, 325 bp, Homo sapiens
attgatatattctctaagtaggtttgagaggttaatgacaggcgcaatgttacctgccgcatctgcctttatttcccctctcacacttcagatggaaaccggcttttccttcagaagacaggaaagccctaaagcatcaagggctccatcctctctgctggactggctgtgaggtcaggggcagcggtggaaggaattttccttgttcctcaatgcttacatttcatagcgaagggagaaaaatacgttctccttggaggaaatgtagagacttcctggggagttcagctatgaggccattaggaaaattcagtagtctgggaat

SEQ ID NO: 658 - DNA, 376 bp, Homo sapiens
atgcttaacaacattattctgagaaggtgcccataggctttctgagactgcccccaggatcgatgccactgtaagatgcagaaaagggcaacctgtatccaaaaggtgaaatcaataaatgcatgaaaaaaatgcatatggcagaagagtctctctctgtggccaccactgccctggacccatggtgattactgcctggaaactgtcaatgttcacttaaggcccaaagtctcttcagtcagattgtggtgaatgctcccagttgtccaaacctggataaacccatgggaatgtcctacacgcagaagtgtgtgccacagagaaaagaatacatgccgaaatcacaggccagatgaaataaagtatgatgcgcccg

SEQ ID NO: 659 - DNA, 459 bp, Homo sapiens
aattatcatcatgccaaacaaattatcatcggtgccaatgatgtgagaattgagcagaaagagcaatgcaacaggttttcttttctggccatgccaaggtggaaggtgatcttaattgaagaaagaatgctcaaagcaatgctatgtcttatcaacaaatacttaccagcatgtacattgctgctcagaaacacatttgatgatggatcagaagtttcctcctatttaatgtggtgataaaaataacttctaagtaattcagttcatagaaccatgaaggactgggtttgagattatgctttgaataccataaagtgatgaacacagagactgagaaaaaaagaggaggagaaggagtggaaggataaatgtatgtaagaaaaaaagaagcaaataaaagcagatgcggccggaatcctacgtcttaaatacactctactaatgttcattaattcatta

SEQ ID NO: 660 - DNA, 652 bp, Homo sapiens
  misc_feature (1)...(652): n = A,T,C or G
cggccgatctcggtttattataacgggtacaagtcaggaacagccaaatggaaaagatatataaggcaaagtatgtgggaaaggatgaggggcttccatgcagcctcctggaatgccatccccttaatatctccatgtgttcaccaacccagaagccatcagaactctgtaattctgggggttatatggaagttttattacatacacaattgattacatcattggccattggtaactgctgtgatctgattgcatccccccaaatttgtatactgaaacttaatctccaatgtaataacattaagaggtggggttttaggcagtgattaagtcataatggcagagtcctcatggatggcattatggctcttataaaagcacttgagggagtggggtcttctcttctgctcttctgccatgtaaggatagttcatctcttttgcccttccaccttccatcatgttaggacacagcaagaaggtcctcaccagataccaaatgttggtgccttgatcttggacttcccaacctcaagaactgtaatcccagctgctggagagggtgaggtgggagaaccacttgaacctgggaggtggaggttgcantgagctaagatcgtcccgctgcactccagcctgggtgacagagtgaa

SEQ ID NO: 661 - DNA, 316 bp, Homo sapiens
ctgtgttgaatgactgaaaaaagaacatagcctctgagaatccctgatgacaaatatataatgaaaagttgggccagaattcataccacatatatgtcctggaaaacttcaactcaaaatgttaggttaaagcaaactcacataggtatattctcttggaacccggaataaacaaacacatctctgaagaaaacaagtcactatgaacaacggccaacagaaacaacaaagtataaagtcagatctacaaagactatagatactaggattatgagcaacgctataaaaatgaatatatcaaaataataaacgtgga

SEQ ID NO: 662 - DNA, 456 bp, Homo sapiens
actgctgtgctccttctgattgaaatgattcaggagatgtctggtcaactcatccgtgctgctgtgtccacaaccaactaagcatggctgggatggactgcctggtgaagaaggacttgatttataattggcactcattggaaaccaatgttaagacttttggatccacacgaggtcttggagatcctgcagcctaaatctctgggactcagtgtcctcatctgtaaactgaggaggttgtcgtggactgcccagtcattccatgctgggattcagccagccccaggacttctgaatccaagtccaatgcttgctctatcctagcaaattctccactctttctttaaatgccagctgtcatctatgtctcaaaaaaattaaaaaaaaaataaattccgatgcggccggacgcccccttcatcaattttacttaacccctccgccgtcacatactaa

SEQ ID NO: 663 - DNA, 628 bp, Homo sapiens
atctccgctctatgcaaattgagtgtgagaaatatttggaaacatgactggcataagaggaaataggtgttcagcttaagaggaatggtactcaaggtgctacatttaaagaactacacctgaggaacttcatccagatctcaacatgatttaaatgatgacactcaggatttcaactaaatattgtgattgatggggcttttgtgaccttttctagggatgaaagtattttaattgtgggaaaaatgtatatgctatatgttcagagtgtagagtgtgtttgtttaaaaaaatttctacaaagtttttgatattcttcccctcaaaaggtggaagaattattaattcttaatttctgttatctggcttcttaattatgaagcatttaaagaattgcttcataatacagtatagatgacacaatattacaaacttaaacatcatattaataacaacattaaactatatcaataattatatgtaaagtaactaataactccaattagtcatcagtaaaatgagagctgaaatcacttcatcccaataaaatggttaaaattcaaaagactggaaatactaaaattcaaagactaattacatgtcacatttgagactaaaaaaaaaaaaa

SEQ ID NO: 664 - DNA, 306 bp, Homo sapiens
gataggggagtgcaggcgcgccatctgcttttatttagttatttatttatttttgttttcttagatttgccctttagggcaaatgaagtagtttgtaagcaaacctgagattcaacaaacttttcagggccttgtaagttctgactttgcagtgctttccacgagacgatgggtgacgaggagcttgtcatctttgcagagcggtttcagttttctcatacttgtaactccaagggctaattgattgaagttgcacatgcgcctataatgattgagttcaaagttttttcagattcgcttccttgt

SEQ ID NO: 665 - DNA, 399 bp, Homo sapiens
ctacgtataccgcactgccaccacttctacggagaaggagggaaaaccacgctagaagcacctctgcctgggttttgataggattgcaatgcaagcaagacatagtctggtgttagcgaattctcagccttgaaggaaaacccctgggaattgcagcgacagactcctgggctagcctacttgaagatgagacaccatgtggagcagagaagccttcccagccgagccccacagaccaaaccgggtttctagttgcaagatcatctatccccagtggagctgccagcttactggagagtcagctgagccaacccatgcctgaagaactctcagctgacccagagaatgatgagaaataataaacatgagaaataaagtttgttgttttaagccactaaa

SEQ ID NO: 666 - DNA, 243 bp, Homo sapiens
ctatctgctgcacagaaggtatacatcaattgaccccgccaacaccctaccccaagaagagtacctggtggaagatcccccagtatctgggagtaatggagttttctcgcatggagttcagaagatggtaattctgactgggttttactgacactccacatgattggggaaaccaaaacaccctcacccagaaatgagccttcggagtgatgaaaaattaatctcttctgcccaccctcacct

SEQ ID NO: 667 - DNA, 578 bp, Homo sapiens
atacaggatctcactatattgaccaggctggttttgaactcctgacctcaagcaatcctcctgcttcagcctcccaaagtgctgggattacaggtgtgagccactgcatctggccagatgatgaccttgacctctgattgctgccacataactggaactcagagaccttcttgcacatctgtggaaaggggagtttgctttgaactgcatttcctcaccagcgtcacccattccttaagagtcaggttgataaacgagtcaatgctgagcccaaaccaggcaggattaatcatttcctcctccacattgctgctgctgctgctgctgcatcctgtgtctgagtcatttcctcatctttaatagctaacatgatgcccagtacaaaataggacctggaacatggcagacagtcagtaagtgctgggtcaccttcaggccaccctggaccatccagctctagctaagccatcagctgactacaactacatgaatgaacccaggagataagagcagaagaatcacctagctgagcccagccaaactggcagcatatagtatcatgagctaataaacaccga

SEQ ID NO: 668 - DNA, 164 bp, Homo sapiens
tctgtatttatttgacatttctagagaaagcaaaactgtagagacagcagatcagtgactgccaggggctagagacggaggcaagggttgatacaagcaggcaggaggttgctttctgggctgatggaaatgttcttatgctggattgtggtaatggttcacaa

SEQ ID NO: 669 - DNA, 422 bp, Homo sapiens
actaaaaaggtttaagtcctattctccttcttcccattgattatgggtgtggctgaaccactcagaaattcatcaccggtaaccaaatgggtctttctaaattctgaaaacaaatcctggctgggtgtggtggctcacgcctgtaatcccagcactttgggaggctgaggtgggcagatcacctgaggtcgggagttcgagaccagcctggtcaacatggagaaaccccgtctctgctaaaaatacaaaaactaactgggagtggtggctcatgcctgtaatcccagctacttggatggctgaggcataagaatcacttgaacctgggaggtagaggttgcagtgagccaagatcgtgtcactacactctaacctgggcaacagagtgagactctgtctcaaaacaaataaataaatagaga

SEQ ID NO: 670 - DNA, 530 bp, Homo sapiens
ttaggttgtgtggatgccggccgcatcctgttttattgtcttaattagactctgccacaaggaaagccttttatttgaagatgctcctaaaggagtggatggttttcctgtttgtcgtagttaatatttagtgtcaacttgattgaagaatgcaaagtattgttcctgggtgtgtctgtgaaggtgttgccaaaggagattaacacttgagtcagtggactgggagaagaagacccactctcaatctgggtgggcaccatctaatcagctgccagtgtggctgtgatttctgcttcctgtaagcacttaattggattcttctcagaaagatgtccagaaattgctggcaaaaatctatgtctgctctctctcaataccaatgcacctacatgtggctgtctcctaggtaataacaatgcatctttgccttctactctccgaataatttgcaaatatccctctttgtcaaaatacaactgaggttccactggcaaggggatttagaaattgcagttttcaggttttgtgcc

SEQ ID NO: 671 - DNA, 235 bp, Homo sapiens
attccctagagacaaagccagtttgcctgacctctcaaccaaagaaccctgacaacttactccttagctagtatctccgtatatataaagatgtcaacttcatcatcagttcccagaaaccctctccaactgagtactgtattgtatgtaatatgaacaaaaactatgaaaggaaagaaaattgaggcccagagaatgcaaaaaatgattaaattcagaggcaaataaattgaga

SEQ ID NO: 672 - DNA, 420 bp, Homo sapiens
agtatggctgtgtcgaccaggctagaatgaagtggcacgatcttggctcactgcaacctccaccttccggattcaagtgattctcctgtctcagcctcccaagtagctgggattacagaaagttactggaggatgtgttccaccaaaacaatggaatgaatcacaggaatgaggatctaataaaggagagaagttaagggattccaatgattacaatgatgagaaatcccatgggaatttcagctccatcaatccaggtaggagaaggatgaaggtttcctctaagagagtcatctccaagaaaaaagacaaagaaattgctggatgtgactgaccccattggttgaagttttacagcttatcccaaagaattaaaatgtagtggtggcacataaaaactaagcactgaataaagaatga

SEQ ID NO: 673 - DNA, 180 bp, Homo sapiens
tcggaatttattaaaattctattttatttccaataatagtgtaatacatgaacaacacaaattggagtcgaaatatgatattgtcacgattgattgaagatagccaaatgagttaatctctgttgctctaatacagcagaatcttcagttatttctgttagtgtcataaggattttaact

SEQ ID NO: 674 - DNA, 297 bp, Homo sapiens
agaggaaaatcctcccttaccttggcccattaaagtatgcgggcagaataaattgttaactccaacaactggcaaatatactgagaaccgaagttctcccactgaaaagaagaaaaatattgctgcacttgctattattgaaatatgccctattataaataatttcttgtcctaaattctcatcataaggcacaaataacattcacctggaaaatgcaaagaaccacataactgacgcacaaggcagaaaaactgaaatgaaaataaacaatttacaaatttgtaaaaaaaaaaaaa

SEQ ID NO: 675 - DNA, 312 bp, Homo sapiens
aatggctgacagtgagaaccagaagaagtcacatctgaaccactgcaatcaaaaatgttcagaagcctggctacatctgtctccactttctaaaactgaagtaaatttcataaaaagttcagaatttcaaatgatcagtaatatttactatatacctactatgtttccattttcatagtttacattgtgaaggacagaatgtttcaaaaggcatagatgatatatactctgcaacatatttgactttttaaggctgggtatatattgaaagaaaagaaataaaattgttgcataaagtgaaaaaaaaaaaaa

SEQ ID NO: 676 - DNA, 896 bp, Homo sapiens
cattctcattgacatctaaggcaaaacagtgaggacctggcaaaacgtttttgctttgctgactgtggctctgttctcttcaggagccatggctgccaatattcccaagagagaatgaacttttgactctgggcatcatacaaagcctcaagctgttccctgtagagtgaagagcttggatggagttaaggacttcagtggttcttgctaatgctttcaggcagcttcacctgtatttgcatcatccaggcagtctgcgcctgagaagcacacagaacagctaaagatcacggcttgttttgaatatgccagccaggattcctgggaatctgagtattggaatcaatgtctgacaattttttttctttaaataacccccaacagctttgccaccaccagttgtcacctgtgtgtttttaagccatcgtgtccttgaaaggagtgccatctcttacgtatcctgtttattttctcaggtgaaatgatctcacaaaaacatcttaacttaatgaaattaccagcctgtaccaaaaagctttctgtttgaatagggcatttctttacttcccaagtagctttgcaatgagaaaactgatggtgatatagctgttgaccttaaagatgcaatatttgtgaactttctcaggagaaggttgtgctatttacctggtccttcagtgaaatatgatgcttccttacagaggtagaaacgctttggattttagatccacaatgtgacaggtttccttactttcattgcccactgcctgcattttgtttggaagctggaacaagagagctgctgatactgtttcagtggattcctttgttgtgttctcttctcaatttgaaaaccataagaattgctatacaataaaaaaaataacagttgaact

SEQ ID NO: 677 - DNA, 646 bp, Homo sapiens
cgtctttgatggattggatgaagcccttccacattgttaggacagcctgctttactcagcctactgattcaaatgttaacctcacccagaaacactctcacagacacatccagaatagtgtttggccggatgttggagtaccttgtggctcagtcgagctaacaccaattgagtggttagaaaagtgctggccactactcccacggcttctacttcctggcggcctctccctgaggacactggtgagcagtgaggaggatgtggagtccagagctgccagcacaggggtttcagcagagaaatagtggctactcctattcaaaaatggaaagcaagagcatagataatgagaatgctcctcatagcctgcctgctcctcagaagtcagatactgaacattttgttatgttaactaaaacagaacaagagatgaacaaaatgaaactcctcttgtcgacttgtggacaggtagaacatctcagtggccatttaagctacttagtcaaatgactcactttctacccttttctctaagttggtgactctcatctttctattttcattcctgcccaaaggttgaatcattttgtacaactctctgcagcacattgttacttgtatgtcctagtgtcacatggagctcaat

SEQ ID NO: 678 - DNA, 915 bp, Homo sapiens
tgataggactattttgaaaaacactggtggcctttgggtgatgaagttaatgataattgtcacctttttctcatgaagtttcttgaactttgacaactttaagaacaatattactgatactgataatatgtcatcttgttctcatgttctgtgattctgaagaagcaagaactgaccaccatgtacatcagctggaacctttctggaatccacacagtgtaataatccttaggaaaagctacctgggattcagctgttacaatcagaaggccacgaacactcaactggaacctttcataatcccagtaaaaggaaagattcagctcttgtcctgattgcagactttgtgctgggggatgccagctgccatattgtgaagaccctcaagcatccctgtggagaggtccccatggcacagaaatggactctcagcccaaaagccaacaaagaaccaaggcctcaagccagcagccatgggaatgggaatgtgccatcttggaagccaatcctgcagccccagtcaagccttcagatgacagtagccccagccaatatcttcactggatcttactgagagactatgtgccagcatgaccctactaaacaactctcaaatttctgaccctcagaaattgtgtgagataataattgttttttgttttaatatgctaagctttaggtttgtttgttactccaaattagacaactaattcagaatgcaatatatacactcagccaggtcaactcctctgcttcttgatgcctggggagagtggagagagtgatggatccccattattattgcacccagggtacactggtctgggtttagaatgtcttgtgctttttcaaccttctgttcccacatttctcagtagtatgtatattaaactctcttcaataaaccccgatgcg

SEQ ID NO: 679 - DNA, 534 bp, Homo sapiens
tgtgatttgctgctcttaccattaagaggtgaaatctctttcctcgctatttgaatatgactgtgcctggtgagtgacactgaacgaaagaatgcagcagaagtgatggtgtgccaattccaagtccaggctttactctcttgagattcttgcaaacaacgatgtgtgcaaatccaggatggcctgctggagggagacaagtgaaccatcaccatcttcaccctgaccaacagccagccaatcattagacgggagtgaggacatcctaggccagccactgacctgatgactgcagatccatgagtgagctctgctcagatcagctagatatggctggcaccaaaagaatgactcagctgacccacagattcatgagttaaatatgtcccttttgttttaaatcactaagtgacttaatgagtgataaatggcatagggtttaaaccatcttgttatgaagaagaatagttgaaccacttgctctgagtagaagtcaatgtaagtcacatttacaataaaaaaagatcggccgaa

SEQ ID NO: 680 - DNA, 592 bp, Homo sapiens
  misc_feature (1)...(592): n = A,T,C or G
accgcaatgctcctacgatgatcctgtaacagaggtatccgacaacaaccctggagcctncttgaaattattgggacatcaccaacaagtcaatcactaaaagaagaaataattgaaaaaaagaattcttttttggttantcaaatatatccccatttaaaggagactgttttttcttcttctctagtaaactaaaaacaggatcctgctaccttataataagatgcttgatatataacattgatttccggagtaaatttttctctcttttcctcctcccgcctaaaatatttacagaaactgaaacccttatataacccttgcccaaccaattcttggatgaaagattagaaaaattcttaattaatagtgttcggttttaggtgaatcagaaattaattaaatgacaagccgccctctttcttttataagggcaagttaataaatctccttccctacctaatcatacctcatctgcataactgagagaaccaaatgacgtgcctgttagagcttgctctgtgtgtaatatagaaatgtgttatagccgatcaatgtaagtcgaacttttaaggctggtatggcgctaaag

SEQ ID NO: 681 - DNA, 578 bp, Homo sapiens
actttttaatggaacagaatattctggtgcttttcaaaatggctacatttccgctccgcctgacagaagcatgagaagatttttctctgatattcactgtgagaacctggccacgttcctggagccccagcgttggttgatgtgaaggtttctgctcacgggtttcttctccaacttctctgtctataaagctaacttctgggaggctgaggcaggtggatcacgaggtcaggagatcgagaccatcctggctaacacggtgaaaccccgtctctactaaaaatacaaaaaattagctggatgtggtggcaggcgcctgtagtcccagctactcaggaggctgaggcaggagaatggcgtgaacccaggaggcagaggttgcagtgagccgagatcgtgccactgcactccagcctgggcgacagagcgagactccatctcaaaacaaaaaaaaacaaaaacaaaacaaaacaaaacaaaaagctaacttcttctggtcagctcattggaatacttattctattttggggaatgaagtgtttctagattctggaattgcaataaagcccgatcggcca

SEQ ID NO: 682 - DNA, 333 bp, Homo sapiens
tcggggtttattgaaacagaatttaaccctcagatgacttcatggtgggagcaggtgaaccaatgagatccattgctggaatgcacagatgggaagagggagattggaattcaagagatccaaggaagtgaacgtcagaggtccccattcagtggctgcaagaggcctcaggccaaggccaagtggatatgggcacctttgcaggctcttccactaggacttggggttccgctcctcttgtctcctctctgagaaactgcttcccatgatcctgtcaacaggcagtcaacaagcacctgagcggtgaataattaagagagtcgtctcagcttc

SEQ ID NO: 683 - DNA, 444 bp, Homo sapiens
atttcaagttccacctataaagacaggaatgaggaatacagaagacagttcacacatctacctgatacagagaggctgatagcagattatgcttgtgctcttcagagggacattttgcttcagggacgactatacctttcagaaaactggctatgtttctatagcaacatcttcagatgggaaactacaatttctattgctttaaagaatataaccttcatgaccaaggaaaaaactgctcgactcatcccaaacgctatccagatagttacagaaagtgaaaagtttttcttcacatcttttggtgccagggatagaagttacctcaataattgaaattctaagtagaaacttcaatcaaagcaagatctatagttacaagttaagatgttaattataatccccaggataatcaccaagaaaataaataaaaataaaaaaaga

SEQ ID NO: 684 - DNA, 814 bp, Homo sapiens
tagaatgtgcatctttatttttcttgaatatttctattgtctaaataccttagtaaagtttactgcttctacggacggcctaaaagttctggcaatgaaagaagtaaagtgtgaatttgaaatgattttttcatttcaactttgttgtatgttgtagacgcaaggtcaaaaatttacatcaggtatctgaatgtgtagcatatacaactgagtgttgaaagaagacaaaatcgttttcatcacgaagaatatgtgctcagtaagaatcagaatgttcaattgtgtgaaggtgggagatgggaagattggtattatggcctggatccagaaatcagtcttccactataggaaatgggaatttaaagatgatcagaagacagttgggagcagagtgagaataagaaccctcaactgctgtctcacctttcagatcacgaagaagttttttacaatgagcagaacactcaacctgaaagcagaatggattgagtcactgcagcgtggcagtggaatggtgtttgatgttggcaaaggaaacatgtacttctagactggacagttttcccttagtttacagtttccaaatagagacatcactttgaaataacatggagaacatacatggatgtactgaacgaagaataaagtctgtgttgcagtcctgtctccattgacttttacaaatatggctttggatgaatcacctaagttttatttttgagaatttacgcttaccatgtataaaatgatattgctaatatgtttgctgcctaccccattgggttttgtaggaataaagccagtatgcgccaag

SEQ ID NO: 685 - DNA, 683 bp, Homo sapiens
  misc_feature (1)...(683): n = A,T,C or G
atctttctccatccctttcctttgaggctatgaatgtcattgcgtgtgagatctcttgatgacaacatacagctgtggcccagcctttctactcctgaatatttgcaaaagaaaaatgaaagcatatatccataccatgacttgtacatgaatgtccatagcagctttattttcaatagccaaaaactggaaataatcaaacatcaatcaatacgtgactggataaacacatagatgtatagccatgcagtggtgctcagcaatgaaaaggaatgaacaactaattcatattatagcaaggacgaatctcaaataattatgctgagtaaaagaaacccaacaagaaagagtatagaatatattattctattcacatgaaattccaagaaaatacaaagtaatctatagtgtcagcagaaaagttgtggcctttagactgagaggtgaaagagaatcaggaggggaatattacagaaggcatgaaaaaatgttagggggaatggatattgttcattattttgaattgtgacaatgggcccacaaacgtataaaaatggcaaaacttatccgattgngacactttactgattgaagatatttgatgtcacttatacttcaataaaaaatgttttctaaataaagaaggatgcggcccgttcccttaaaggaaggaatattcatga

SEQ ID NO: 686 - DNA, 643 bp, Homo sapiens
  misc_feature (1)...(643): n = A,T,C or G
gagcaagatggggagcgtcaaaaacctaactccagnatttgctngggttcttccaaactgtagctgggaaccttantcccaggccgatgcccctctaacatnttgcagctttgggccccagggagggaggaaagacccacagagggttcggacaacagcacttgactgatgccagagcagagatccattttgttaacctgacaaagcgcacagggctgcgccgagcttatttttctttccaactttctacacctggttttataaaaactgtgaaaggtagacatacagaacatccagtggaaaactccaccaggccatagatttaattatatcataagaaccacaacatcgtagccttgtataagggggacctcacaaagagtatccggagtcatacagagggttaaagggggacaaagttttatcaacctctggggactgaggataaaggagtggaccaatggtgagcaagattaattcactctcttgtaaattacaatttctggtcaaatatggtatacggagataaatgattgccaaaccaatatacacgcaatagggtaaactctccgcctctttagggtacnattccatatgcgtggcagtgtacgagacaatatgtgttgatgcgcagataataccg

SEQ ID NO: 687 - DNA, 575 bp, Homo sapiens
  misc_feature (1)...(575): n = A,T,C or G
gtacaggtcccctcccagctgctttcatgggctggtattgagcatctgaggctgttccaggtgtacagtgcaagctattggtggatctcccattctgacgtctggaggatggtggccttcttctcacagcttcactaggcagtgccctactaggcagtagggactctgtgtggggctctgaccccatatttcccttctgcactgccttagcagaggttttccacgaggctccacccctgcagcaaacttcttcctggacattcaggaggttctgagagctggaacatgtgcaatgtatacatgatgaagtaaagtaaaaccccagattntgaagatttgatatcaaagggtaaaggggatcggtacagcagtaaaccctgcaggatacaggacatcgggtcaggtgcagtgttaagcaatcttggacaacgaagtttttataaatcaaatccctgctctgggaagagaaaaatcaccttgcattctgaagtacaaatctacaagcaggtttactgggtacctttggaaagggtacttaccttgacagcaaaataataaatcccgatgcaggcgtt

SEQ ID NO: 688 - DNA, 781 bp, Homo sapiens
  misc_feature (1)...(781): n = A,T,C or G
ttgttaagctatcaaatcagctattctccaggatctccctgacttcttttataatatgttgcttggaattagaaaaccagatagccaaattgattaaaatgatgtctaatcaaagtggggagcatctctgattcatgactggtgaaattttccattaggaaagtgcaagaaacccccaccaaatggaaaatgccaactgctatcacatagacctcggagaaggaagacctggggactgaactctggtctntgttcttnattctgcatttnttcctgaggggccngnagagaancacacccttgggccaaaccaatgtctaaccttcatgtattgatttatgattttttctacaactactgctttcccagaatgtgtcctttaccttaaaaaacccttgctaataaccatctggaacgtatgggattaaacgttatctaacccaactacttgtctggattgtcaccattcaataaatatccaatctatcatcttctcttatataaggacaattaatagtgcttatacactgatctaatagactttattaataaactaatcatataattatattcttttacattaatagttggagtcatgtatatacaattatttgcagttgttccttttaatcacttctgtattgagaataaaaaatataatatattatattgagagagattgtttgacatagtatagtgtctatttgcagacgtgtaatgcatataagatattgtataatgtaatcataagtacctgatgaattattcatactgttatcct

SEQ ID NO: 689 - DNA, 807 bp, Homo sapiens
  misc_feature (1)...(807): n = A,T,C or G
cacctgntagaatttggctataaatctgttctgggagattcatggaaaagaaggaaagtactctgacaaatacagatttctgataacattaagattataccattggaccaggaactggatcctgaattcttctaatttcctgcaacatctggctacagctctccaactgagaacaacaattgctctattcctgaaaccctacaacctgaagctggaaaacttgatgtaaaattcacccttgcaatttttacacccttgtcttgtgccctatatgggccacacagaaaatttactaaaatcctttcatgccatantcagagacattcaaactgcaaacaacgaggacatattaatgattttcctgctggggagnggcttttccctcaagacatcagaacaggganntttccatcatagtaggactcttanctcttatttttnntgcttgcgcgggcctaccctttttgctggggggataatgccatacatacaaattcacaagtcacagcttttgggaataacttgaaaaaatgtgtgatctgcccaccaaatccaatatttccctaacccaaggggattttttatcccctagtggagtacttgagccttatccttgggcccctattgtaaaattataccccaggttcttttataaaaaaaatttggtgtaccctgttaaaaaaaaaaaaataattcctatcgggcgttttcttttaggagggtaatctattatactgagtaccagactcttaggttaggcattaggcgcgggaagagattcatcaactaaagggagatacgggttcg

SEQ ID NO: 690 - DNA, 659 bp, Homo sapiens
  misc_feature (1)...(659): n = A,T,C or G
atactcatttcaatacaccaatacctctaggatgcttcatgggaaccactttgccaactcacctttctcctttccactcctaaaagattcacctttcaggccgggcacggtgggctcatgcctggaggccgaggcgggcagatcaccagagattgggagttcaagaccagcctgaccaacatggagaaacactgtctctactaacaataggtggcgcatgcctgtaatcccagctattcgggaggctgaggcaggagaatcgcttgaacccaggaggcggaggttgcagtgagccgacagcctgagcaacaagagtaaaattctgtctcaaaaacaaaacaaancaaagattcacctttccctctcagtctcctgttaagccatgtctctctgagaaagacttacccagttttccatccaggatgatccagattatttgctctcaatgggggcctagaccctttgaaagtatgtgacattatgcttatgagcaattaataccacaataaatgtatttggccattccaaaaaaaaaaaaggacgtgtataatgtttggatattgtccccgaaggcgcccgcttaccttaaaggaggtgaatccagaacctgcgtgcggtggggagagcggataagctactcaaaggcggaatacggattt

SEQ ID NO: 691 - DNA, 564 bp, Homo sapiens
  misc_feature (1)...(564): n = A,T,C or G
ctcaggccagcatctctttttattatcagataaaaagaggttaccattttaacagagatgattataatggtttttatcactttacagaaactctttaaattgctttttaaaacgatatggttgacgtgtgatggcattaaagaaatataatggggaggtgttgatttgttttctttaattttgtttgtgcatgacttctcttcatctgctgacatgaaaataaacactaagtaccacaaattactagagcagcagagcttgctgttctgaaatagtccaactcttcttacgacacccttgctttcttcttcaacttctgtggtacctgaaacagatggaggaagaacctgcagtcatcctcaatccctagatttaaatccattaacatctttgggtgttgcaattgtgaagccatgcatctgcatttacatttctgcagttagggtgaaggtgcatgtgtgcttgtaggtggaccatgaatataggaagtagggcttggaggaggaggttgcagtgagctgagatggcaccactgcactccatcctgngcgacagggtgggatt

SEQ ID NO: 692 - DNA, 467 bp, Homo sapiens
aatcccaccctgtcgcccaggatggagtgcagtggtgccatctcctcctccaagccctacttcctatattcatggtccacctacaagcacacatgcaccttcaccctaactgcagaaatgtaaatgcaattgcaacacccaaagatgttaatggatttaaatcttgggattgaggatgactgcaggttcttcctccatctgtttcaggtacaaagcaagggtgtcgtaagaagagttggactatttcagaacagcaagctctgctgctctagtaatttgtggtacttagtgtttattttaaagtcatgcacaaacaaaattaaagaaaacaaatcaacacctccccattatatttctttaatgccatcacacgtcaaccatatcgttttaaaaaagaaagtgataaaaaccattataatcatctctgttaaaatggtaacctctttttatctgctaataaaaagaga

SEQ ID NO: 693 - DNA, 124 bp, Homo sapiens
gagtgacattggttgatgaccccaagcatggcccccgccttgatccatcactgcctttgcaccaaatgctccctcagcctgctccaacctgattactgaccatggcagtaataataaagaccga

SEQ ID NO: 694 - DNA, 247 bp, Homo sapiens
tttttttttttttcagttaaaagtggttttattttctttattttggcatacctacagagcatgggaggaattgcagtaaaaaatccttgccaaataacacactgccatccatccatagagagcagatttttggaatatccccacagcatccatagaagaagtaatctgaaactgagcccaggaggtcaaggctgcagtgagctgagaatgctgccaccgcactccagcctgggtgacagagtgaaac

SEQ ID NO: 695 - DNA, 607 bp, Homo sapiens
cttctccataccatcctcatggagacttgaagtgacaattgacaaagcttggagcttcccacagaaaattccagcctgttcttggtgcctgttgtacatgggacagaattggatggtgggttggagtcaggctggggctcaaatcctggacctttctctctggaacccaagactccccaggttgcagaggtgacagcttctgatgtttgacacagaggccagtgaagataaaaataatgacagcatttatgggaggccaaggcgggcagatcacgaggtcaggagatcaagaccatcctggtcaacatggtgaaaccctgtctctactaaaaatacagaaacttagctgggcgtggcagcacacgcctgtagtcccagctactcgggaggctgaggcaggagaattgcttgaacctgggaggcagaagctgcagcgagccaagatcatgccactgcactccagcctgggtgacagagcgagcctctgtcctcaaaaatcaaatagaatatataaaataaaatacaataaaatcaaataaaattaataatgaggcgtccgtaaactcgtgccagcttaccattttcaccctgacccctttatgtgaaa

SEQ ID NO: 696 - DNA, 313 bp, Homo sapiens
ctgatattactcaacacccctgttggtggttggcatcattcctggaggctgcaaatcaaagttgtcacaaagtgcagtaggagaaacccaagagtgctgctcagtataatcatctttatgtggtattagtgcacctctctgctcaagccatggcaaatgttcaacgacctgctgcatcactggtcttggctcatttcttacctccagggttgactctggctcatttttaaattaatctgtactttggaggttctaataaaagatttatgctgtaaagtgccaacaaaacaatctatccttaaaaaaaaaaaaa

SEQ ID NO: 697 - DNA, 140 bp, Homo sapiens
tgtcaccatcaagtgagaaggggataaaagccacctgctaaggctggtacagcaggaaaagcctggcccctgtcggcaaggctacgtcatgatgcttccgtaacaactccagacagcttacccccagacttatattaccg

SEQ ID NO: 698 - DNA, 400 bp, Homo sapiens
ccacttcctgaacctctaaaccccacctgctgacagcaatctgcgtggttctcttggctaactcagccctggtaataccttactggtcatggaactgtggtgtggaagggacaggaactgccccagtgtcagtattcagatccagctgaatatcccaccaagagctgaaaggaggattggaggtgatctctggcttccctacatcgtgcctgtcatctttccagaatgctgtgctctcaaagggttacatccacatcacaggggctggtcctcagctttggagttggtcacttatttctacttgcaattctgctcagcttcgattttagagaacaaaagtctgatgtgctgctttcaaaatgtagatataatgatgttaaataaaaaaatgatgccgccg

SEQ ID NO: 699 - DNA, 594 bp, Homo sapiens
tttggtgccggcttctttcccagctcctggaaaatttcctttctttagtttgagctcaactatatagtctggggaccccagaaatgctgcatttctaataaggaggttggcagccaggctgcgtctttcttgaactgtgtgagcatggagccatcgacctcaagcctactccccacttagtcaacagaaggcttggttttcaacctctgcccaaagggaacaccccaccgaattcctgtttccagtctgagaatttctgtttggggccttggtgctgtgttaatgaaagactcatgggaaatataacagctggtgctggtacccagagcagaagagctacaattgattggaacatggagggctccttgtaggtgctataaattgcattgtcgggttagtgtaaagttactaaaataatacctaagtctgtttcctcaaccattcgaagctaatatccagtccgtgccgatgcccacactgaagaggagggggcgggaggcaatgaatgttcagttggaacaagaaaggaataaaacccgatgcggccgaaacctaccccgcccagcgatcacgctgctgtcgcccacataccaa

SEQ ID NO: 700 - DNA, 229 bp, Homo sapiens
acaaggaaaaacagaacatttctgatactctgcatattgcttgttaatactcagtactatcttcatctttcatagatcatctttggctcacaagaatgtaaaagcttgaagctacactttcctagactctcctgtgactagagtcccgatatatttcaccaggagaagcactaggactatttgtggaagatagaagaccaaaaaaaaaattggcagcaataaaccagga

SEQ ID NO: 701 - DNA, 296 bp, Homo sapiens
cccacaccacatattgagaaaactagaagagaatgaacttggccagaggagaatgaaatggcttgatatagatgaagatgcagctgccataagtgatggaaaccacagtaatatgtgaagaacaggtgataaatagaaacatgaaaagcagaacctgcagctgaggatcttctgtcagtcccagaaggatgaatgttgttattgctgtgtgttttctcattactgacttctgcatttttccaaaactacatgtaaatgtcagagaaatttgaactgcagcattcaataaatacaga

SEQ ID NO: 702 - DNA, 267 bp, Homo sapiens
tcagcatttattttttttctcggtggggaggaagaaaacactactctcttaggaagagcacgagaaagtgaagtgtacattgagtggcgttggaagtgaaggggttccagaaaaaagttggagagggtggaagaatgttggttcgtggaaggggggtcttggcgtttcctggtgtctgcaggcagcgtgatcttctgcttcaattcccttacgtcgatgttactgattctgtccccatcttcgcggttgtctcctgcatcagcacaa

SEQ ID NO: 703 - DNA, 432 bp, Homo sapiens
cacgttacaagtgtgcctgctctcctgcctcttcttttagcgcctccacctctcctgcctctgacactcctgagacagcaagaccaaccccttctcttcctcctcctcttcagtttacagaagatgaagacaagaaggatgaagacctttatgatgatccacttctatttaataagtaccctcctgcaattaactaggaccatgaaacaagccgtagccaaacagctgtgagtagaaatcacgtgtgtccctttgggtcagtagaaaaccctccagcattctgttcctctgccagggcagtgaggagattatgtgttgagactgtggaaccagaagacaaaagcaacctcaatgaattcccgcgtagcagccaaatcccccgaaactcagacggactagagtgattttgtgaaagcaagaaataaaatgcga

SEQ ID NO: 704 - DNA, 183 bp, Homo sapiens
ctggccgatctttatttattcacatcaagttaagtccaaagggcagatggctagagaaacgatacagtgagaatagataaaaattaatctgattaattcaagaaattctgcattgtgatttgtactccatgtaaagttcacttgcacagacatcttctcaacccactgaaagcttcagtcatg

SEQ ID NO: 705 - DNA, 188 bp, Homo sapiens
caggccagcatcgggttttattcacatcaagttaagtccaaagggcagatggctagagaaacgatacagtgagaatctgagataaaaattaatctgattaattcaagaaattctgcattgtgatttgtactccatgtaaagttcacttgcacagacatcttctcaacccactgaaagcttcagtcatg

SEQ ID NO: 706 - DNA, 491 bp, Homo sapiens
ctggccgatcttgttttattttatttactttttgtttaatgaaccctccctgatttctacagtcattcaagcttgctgccacccaccccaccccacctcaaccatcagcaaagcccaccaggaaaattgccaagagagacactcatcagctcttcagtgagaattttgccatgcttctgcctttggtaactccagattcttccagacaaaggttgactccatcactaaggcatgttttatgccatccagtttaactttgcaggacctacttctcaagccaaggaattgcaaggccacattatgtagcagcttgagttagagtctaaaaggagagccagttgcaccccaggattaccatgattttttcctttttcttttcttttgaggtgggcatgagataccacggtctggctctgaacacaatctctggcagctgcttatgattctctcaacactaatgatgtgatcaagtcttcgagtgaattttggag

SEQ ID NO: 707 - DNA, 778 bp, Homo sapiens
  misc_feature (1)...(778): n = A,T,C or G
cctagtctgcagacgacgtctcttaatctaccaccgctacacgttattgacagctgggaaaaggcacacacctccgactgatggtgacccagaaagaaatcatagagaagcaaatttggctccactggtttgatttttccttccttcctccttacacatccaaggaggatttgctctggaaatctcttgctatggaatgcctaacaaacctgaaccaggaaaccctttaccaacaggaagtgacccagtctttctgcatggcaggtggccacgctgccacctgctcccttcctgttagtcatgactccaagggtcttgacagagggtagtgacaggcaactggagatctggaaagaaaatctctcttcaaagcaggtttgctgtgttgcaaacgccaggggacatcagtcacagagacctgaatgtacacagcaccccctggagttggcaatgcggaggctctggctgttgatcccaaagaagatttaaattgcagtccattatatttttctctcagacttctgtttctttgaatattccaaatagattaaaatataatctggaatcttaagtgccttagtcttatttaggtaacaatactatctaagaaaaactctagaagaattcacaacaaattgctaactatagttatctctggcagaggaagtagcatgggaaaggcgtgggaaacttttttacttatgactttttttcacnctgtgtacttatgtataatttgtgtggaatacataacataataaaccatgttccgtccagg

SEQ ID NO: 708 - DNA, 419 bp, Homo sapiens
ctggaaagcactagggaatacaatgtgtaacccctaccctccaggagtgttatcacagcctaaggggaagacaaacagtcttgatgtatcattacaaaagaaggagaaggtggtgatgaacttctgcccataaccataaagtcatttcacccacaaatgaggataactggatgcatttcacaagagaacggaagcttttgccaccttgtcttgctgttgaaaaattaaacctgcagtgcatgaggaaagtagattattcctggaaaaataccattttctctgaaaactgtccatgccaccagttccaaattctgtcagatcactaccttctcaacagcatataaaaaatggatcaacaatggtaacactgagtaagagttagcaattatgcatagcactaataaaagcagatcggccag

SEQ ID NO: 709 - DNA, 302 bp, Homo sapiens
caactactctaagggtgaggaaattagaagaaaacattgaagcagaaagagcagcgcatttggaatcaaaatttaattctgaaattattcagttacggattcgagaccttgaaggagctttgcaagtagagaaggccagtcaagcagaagctgttgctgatttggaaattatcaagaatgaattcaaagaagttgaaagtgcacatgagcgagaaaagcataatgcacaagagagctttgcaaaactaaatttattagaaaaagagtatttctccaaaaataagaaactaaataaacatcga

SEQ ID NO: 710 - DNA, 1115 bp, Homo sapiens
gcatagctgcagactgactctcttaatcttccaccgctacacgcaactactctaagagtgaggaaattagaagaaaacattgaggcagaaagagcagcgcatttggaatcaaaatttaattctgaaattattcagttacggattcgagaccttgaaggagctttgcaagtagagaaggccagtcaagcagaagctgttgctgatttggaaattatcaagaatgaattcaaagaagtttatagtgcatatgagcgagaaaagcataatgcacaagagagctttgcaaaactaaatttgctaagaagcaccaggccttcctagtagagacatgtgaaaataacgtgaaagaattggaatcgatcttggacagctttactgtgtcgggccagtggacatcaggcatccacaaggacaaagataaacctcccagcttctctgttgtccttgagagattgaggcgtaccttgacagattaccagaacaagctggaagatgcatctaatgagctaaacagcatgaatgatgttaaggaaaaggcatgtaatgaacttgattctacgaaacagaagatagactctcacactaaaaatataaaggaacttcaggataaactggctgatgttaataaagagttaagtcatttacacactaaatgtgcagaccgagaggctttaataagcactttaaaagtggaactacaaaatgtgctgcactgttgggagaaagaaaaggctcaggcagcccagtctgaaagtgaactgcagaagctttcccaggctttccataaggatgcagaggagaagctaaccttccttcacaccttatatcagcacttggtagcaggctgtgtgctcataaaacaaccagaaggcatgctgaataaattctcttggtctgagctttgtgcagtcttacaggagaatgttgatgccctgattgcagacctcaacagggctaatgagaagataaggcatctagagtatatctgtaaaaacaagtctgacacgatgagagagcttcagcagactcaggaagacacctttaccaaagtggcagaacagatcaaagcccaagagagctgctggcacaaacaaaagaaaggagttatcgcaaag

SEQ ID NO: 711 - DNA, 422 bp, Homo sapiens
tttttttttttttatttttagggtgacaatgtgagcttttaatacactctctactgatcatagcataagtgaaatggattaaacataatttgatggagtgtctgtacagaattatttccatagtcatacttgatatgactcttcatctaaagtaaaccccaccgagattaatatttaaaatggaaagctaaaactcaaagtgccatgtgacaacacttaagtgaaaatttattagacttgtcatttctgttaattattgtcatttcagctaattaatagccattcctgttggttattagatgtgtcgtttccccttctgagctgccatctacagttgctgattctggtttcatcgcataccctcaggcaatgggtcagtggcaacccagtggatcctcacaccagaagaactattcttcatt

SEQ ID NO: 712 - DNA, 223 bp, Homo sapiens
aattgccaggaggcagaggggctatgcagccagacacagagcaaagttcattccacggaaacgacagcaaggactcctccgcagccactgctggactccagaatgtgatgaccaccatgagaactccaccagctgtgatgctgagcctacctctgctgcccttggacactcactcccaaataaagttcagattgctctctctgattaaaaaaaaaaaaaaaaa

SEQ ID NO: 713 - DNA, 149 bp, Homo sapiens
atggaggcttctacaaagaccaaatcctagaaggtaccaccacagcaaagcaggcagtgacttccagctgtaacctgcagaccaccaggtcccccttccgtgaagggtccttgatcccagaaataaatgtttcatttcttttgtgaaaa

SEQ ID NO: 714 - DNA, 248 bp, Homo sapiens
tttgtcatctggtcacctgtttggagaatgagaaatgtcagaatacagaagggaagtgcttactaaccacaccagagacagggccttgctttgttgtcaagctggttttgagaacttctggcttcaagcaatcctcccacccagacctcccaaagtgctgggatcacaggtgtaaagcacagagcacggcctaaaatagtatcttaatattattagaaacacttattaaataaatactgatcggccag

SEQ ID NO: 715 - DNA, 595 bp, Homo sapiens
cagttctggagagtaggaagtccaagatcaaggcaccagcaggaccagagtctgatgaaggccctttcctcataaatgacatcatctaggtgtcctcacatggctgaagagcgaaaaagggatgaacaccgtgtccagatctctcatggtctaatcacctcctaaaggccccacctcttaaaaactgttccattggagattagctttcaacatgaattttggaggtacacagatattcaaaccatagtacttgctgagattttcctaaaatctgctaaaatatcatttaaatttggactatgtattgtgtttattgtgttggtcagtgcattttttgggatctccttactactctatgcattacggtttttattttacttatgtaacattaaaacatgcccttcaaaatactctgtagttacattttatctttcttcaccttctaacacaagaacatggatcttcaaaatctccacttacaagtttaaacgtgtaaaacacattaaaatggttactattatcaattttatgtattatacagagggaattaattatatgtaattaattaaataatattaaaacaaaaaaaaaaaaa

SEQ ID NO: 716 - DNA, 368 bp, Homo sapiens
ccataatctttcacctgggttccttagctcttgtgaaggtatcttcatgcatggatggtagttcaaactgatgtttctttgaaagactctggccttgtcaaaagaaggacgtaagaaggcacgatgtattatacttgggaatgatagaagagactgacctggtatttccacccggaagagggaaaggattttaactacaaatacaggaatccagcagatggcatcagagaacactataaaaaagaaacgatttgcaacagccacctctcttccaaaacaattccttacttctgtggtctgcaaggcggttttttgaatggaacagaacatagtaatataggaaaacacaatgaagcgagatcggccag

SEQ ID NO: 717 - DNA, 459 bp, Homo sapiens
tactccccattgtcttatcctcaaatacttcctctctcattatttacatgactagtctgacctctaaacgctaagtatttagttattcaagagacaccctacatattgattttgatgtgatttctaaactacatcaacacgtggatgattttaatgctgatgattcattccactttgaaaaacaatggtgtgggccaaatacaacatgtttatatgttagtttctgccagtgactatcagtgtggacctcttctttgtacctcagttcgataattgttgtatagtaatgctttttgacagatggcaatccatgatagaaacaacataaattttgttagaaataatttcttattaatttctaaaaggattatgaattaacactgtgttgtgaagtatggagtcatttattaaagaattattctaaaagcaaaggatgggaaataaaccgcgttcggccag

SEQ ID NO: 718 - DNA, 695 bp, Homo sapiens
  misc_feature (1)...(695): n = A,T,C or G
gggtttttcctggactcccttccccatttgctggcttaaggtagcttcccggagccacaccaggggccacatggtgaggacagcaggtagcggctctgtgagccagatcctgaatgtccactgctcttgccaacatgaagactttccaagatttatgagagaagagactcacctatatgaaaggattgtgtcccttcaatccaagggcatcatactnanctgccaaaaagattggatctggcttttttagcagttaaatgggtcttacacttccggctctcaaagtactcatgtcctagtgttcattcagcccttcattcaacaaatgtttactgagcacctactatgtgccagatgttgaagtccaaagaggtgaacaatggaaagacatcagctgtgagtcagtggggagtgtctgaggatggaggcgctatggctccctggagatctcttggtgtgtccacatgccgggtgggtccacggacaggagctcttctggtgctcccctcactccccacccgacccatgcagtacccaccctctgcagctgggccctccagctggctcagctcagccctgtttcatgtttagtcggtctttgatcttcactctttaactaaagccagagccaggtgaaacctgattttatcctttctcaaacgtgactaagctcaaaagaaagagaaggcttatat

SEQ ID NO: 719 - DNA, 438 bp, Homo sapiens
gggctaaagtcctatatgtggaatttttggatccaaaacgttcagaaatggttgaataatcatcctttgtaacctagttcatggaggatttttttgaatgtttcaggcaagaggagtcctcagaatccttctcaactcagcatttaataagaatgagaattgaagaagggtgaccttcatgacactcattagtacacaagagacagggtctcactatgttgctgaggctgaacttcaactctggggctcaagtgatcctcctggcttggcttcccaaaatcttttatcatattaaggaagtatccattcattactattttatgaggcctaacaaaatcaagcatgggtgtgaatttttcaagtgtttttccagcatctatgaggataatctatgcggtctgtctttcttgatcaattaataaactagtatccggccag

SEQ ID NO: 720 - DNA, 121 bp, Homo sapiens
tctgcttttattccttaaagagttaggcaccaacaatattttgtatttgttaatttatttcttctcacgtttccaggcatttcttctccttctaggtgcccaaatgtataatgaatcccct

SEQ ID NO: 721 - DNA, 851 bp, Homo sapiens
ctggccgatcgtgttttattcatggctggaaagaaattacaaaaaatactttgaaagccaaaatgattttgaaataaagagccaccacccaaatagattagactgtgaaatctcttggtcccatttaacagagtggaagccttccacaaagatgtggctatctctgagacaaatccctcacgacagttcaatctatgctcccagagcatttaaatttaggatatcatttacacagaagcggggtaaatctgatacattcacagactctcactaagtgaagtcatatttgtattcagtgctagatgatactagctgctacttgcgaaaagtggtgtcgtttgctgaaatttctattttaaacccaacattctttgtgagaatagttagtctgtgatgttgtgtcctcagctccctgccacagttgagggaagggcaaccctcattttctggaagtgggtgacagatgtttccttcatgatagaaccaaactgtccatcagtgtgtttttgaaggtcttctgctgacacctggaaaccatcagttgtatttgcaggtaaagaattctccccaacaagggagaaattgtagtggtataaagaagctactggagaagacaaagaacacactgtcttcatcttgcagttggaaactggttatgttttctccagctactccaaatagcagctgaaatctgagggaatagtccagagtaattgtaatttcagatgagactgaatctggagttcaaacaatgtgaccatattgtttgtgaccatcttttctgaactacgttttcacaggttggcttccttcaatggccttgcttcaaggttacatgcttatttgttatg

SEQ ID NO: 722 - DNA, 885 bp, Homo sapiens
  misc_feature (1)...(885): n = A,T,C or G
cataacaaataagcatgtaaccttgaagcaaggccattgaaggaagccaacctgtgaaaacgtagttcagaaaagatggtcacaaacaatatggtcacattgtttgaactccagattcagtctcatctgaaattacaattactctggactattccctcaggagtcgtgacccacagaatgggagaaaatatttgcaaactcctcatctgacaaaggatcaacaacctgaatatagaaggaactccaacaactctatagaaaaaaaatctaataatccaatcaaaaatgggcaaaagatctgaatagacatttctcaaaagaagacacagaaatggaaaacaggcatatgagaaggtgctcagcatcattgaccaccagagcaatacaaaataaaactacaatgagatatcatctcaccccagttaaaatggtttttatccaaaagacaggcaataacaaatggtggcaaggatgtggagaaaagggaacccttgtacactgttggtgggaatataaattagcacaaccactctggagaacagttgggagattcatcanaaaactaaaaatagagatatcatgtgatccagcaaccccactcctagatatatccataaaagaaaggtaatacaaatatatagagatatctgcactcccatgtttactgcagcactattcacaatagcaaagatttggaagcacctaaacgtctatcaattgatgaatggaataagaaaatgtggtacatacacacaatggagtcctgttaagtcataagaaagaatgagatcctgtcatttgtaaccacctggatgggacttggaggtattataagtgaattaggcaggccccaaaaggcaacttctcatgtttcactcctttggg

SEQ ID NO: 723 - DNA, 565 bp, Homo sapiens
cgccacatcattctttatttggtttaattcttaggctcatgtagaattaattgagtcttacatttcttaggtgtgtttcaaatctggtcagatttgtcaagagtcctggtctccagctttgatcttcaacttctttctttctttttttttcttttcttttctttttcttttttttttttgagatggagtctcgctcttgttgcctaggctggagtgcaatggcgccatctcggctcactacaacctccacctcccaagttcaagtgattctcctgccttagcttcctgagtagctgggattacaggtgcgtgccaccacgcccggctaatttttgtatttttagtagagatggggttttgctatgttggccaggctggtctcgaacttctacctcaggtgatctgtccacctcggcctcccaaagtgctgggattacaggcatgagccaccacgcccagcgggatcttcaatttctaataaagaattccctcctgacttcttacagtttcccccaagaaggctttggtttcttctgggcatctttatctccatcctgctttgggc

SEQ ID NO: 724 - DNA, 289 bp, Homo sapiens
cggccactgatcgagtcactccatccaagtcagaagcaccgccaaacgcacctcgaacttttggactccgcttcattttctactctactgtgactatttcaataacttcatatcttcattttatggtgggggggaggtgtctggaatgttggaattgcttataagccattttattaccctctattatgactttccgaactcctccaaagtcctgtgagctcactgaaatatcttggtatgcccaatgcctttcatcatgtgatacctagagcactcaaataaagcgaga

SEQ ID NO: 725 - DNA, 297 bp, Homo sapiens
  misc_feature (1)...(297): n = A,T,C or G
atgctatccggtataccacattacatataattgataagaagactttttccccatctggcttttggacttgtgtgagttgttgttactatcttatgaccataaggaaaagaccctggcaccaaagtcgacatgctgagaacggcaggaaagaatctaggttttaatatgctgtagatctctgggcccaccaacagtggaatcaacctttctctggacatcttgatatgtaaacaatacacccgtatgcggccaaccctcttttcttttccttttttctccgtaaatntgccaccctct

SEQ ID NO: 726 - DNA, 772 bp, Homo sapiens
attttcttttccgtgatcttcttcaaggacgagaactttatcattcagccttctatgtccgtagtgctcatctgctcatcacacgccccacatcctttgtcccatagaatctgcaaaaaggaagagaagactgtattcctcaaaatatcaaggacgaggatactgtctgacttgggaataaaccaatggcatatacgaaggtgcttaacatcactaatcactggggaaatgcaagtcaaaaccataatgacatagctcctcacacctgttaaaatgactattatcagaaagtcaaatgataagtgttcattgagggtgtggagaaaatggaactcttgtacactgttggtgggattgtaaattggtgtggccattatgaaaaacaatgtggaggttgcccataaaactaaaaatagaattcccatatgatcagcaattctacttctgagtgtttatccaaataaattgaaatcagtatttcgaattgatatccacactccctgttcattaaggcattattcacaatagccaagacatgaaaacaacctaagtgtccactgatgaatgaagaaataaagaaaaggtggaatgtatacatatacaatggaatactgttcagccgtaaaaaataagaaaatcctgttatttgaagcaacatagaagaaactggaggacatttgctaagtgaaataagccagacacagaaagtcaaatactgcatgatctcacttatatgtggaaactaaagaggttgaactcataaaatcaggaa

SEQ ID NO: 727 - DNA, 1079 bp, Homo sapiens
attttcttttccgtgatcttcttcaaggacgagaactttatcattcagccttctatgtccgtagtgctcatctgctcatcacacgccccacatcctttgtcccaatggcatatacgaaggtgcttaacatcactaatcactggggaaatgcaagtcaaaaccataatgacatagctcctcacacctgttaaaatgactattatcagaaagtcaaatgataagtgttcattgagggtgtggagaaaatggaactcttgtacactgttggtgggattgtaaattggtgtggccattatgaaaaacaatgtggaggttgcccataaaactaaaaatagaattcccatatgatcagcaattctacttctgagtgtttatccaaataaattgaaatcagtatttcgaattgatatccacactccctgttcattaaggcattattcacaatagccaagacatgaaaacaacctaagtgtccactgatgaatgaagaaataaagaaaaggtggaatgtatacatatacaatggaatactgttcagccgtaaaaaataagaatatcctgttatttgaagcaacatagaagatactggaggacatttgctaagtgaaataagccagacacagaaagtcaaatactgcatgatctcacttatatgtggaaactaaagaggttgaactcataaaatcaggaagtaccaaaggaggttcccaagggctgggggtgttggagaaatgtgggattttggtcaaaggatacaaattttcatttataggatgaataagttctggagatctaatgtacagcatggtaactatagttcataacaatgtattgtatccttgaaatgttctgagagagtagatcttaagtgttctcatcacacattaaaaaaggtaggtatatgaggtaatggataggttacttagcttcactgtgataatcacttcacaatgtatatgtgtatcaaagtatctcattgtacactgtaagtatacacaagttttatctgttaattctacctcaataaaactggcagggagagaataaatccaagaatgaataaacccgtatgcggcaag

SEQ ID NO: 728 - DNA, 489 bp, Homo sapiens
catggagtctcgctctttcaccccagctggagtgcagtgacacgatctcggttcactgcaagctccgccgcccagtagagacgcgtttcaccgtgttagccaggatggtctcgatctcctgacctcgtgatccgcctgccttggcctcccaaagtgctgagattacaggcgtgagacaccgcgcccggcacttattgctggaagtctgtccttcatacctgaggaaagttatgtgaagagccttttgagataaaaagaggaaacagaagacttgagcaatactataaatcaacaagatttaacttataaagagcattccacccaacaacagcagaatacatactttcccaatgtatattaaacattcttcaggataggacacatgaagattataaaacaagtctcaacaaaattttatagtttgaaaccataagaagtgtcttctctaaccccaagaaataaagatagaaataaacaacgttcggccag

SEQ ID NO: 729 - DNA, 994 bp, Homo sapiens
aatggaatcaatggtctggaagagcacaggagggtaatgtttcccagaagagatgatgttagaaaaaaatgtgctgcccctgcagcttttgatgcactttcttattggtctacaggttgttttctttcttgactgtgatctggaaatgtacaaccagaggatctcaataaatgctccaatgtgtgaccagctaattttattaacatcagttctctatgaaatgatgctgcatttactcggtaacagaatgaagtggcataaatgagaggcggtggacactaacctgtgactgagagagaggagctaccaccgatgaagactggtcatttgggtttcacatttctctgtgaatgaacagttttgaaaaactaagcctcgtgtatctattctcctttaaaagtactgccttcctaaggaaaacaccctcaatgtattcattttgtttcagttctttgtctggagctgttgctacaactgctttaatgagagacaattttttttttctgtcatccacagtgtcttttgcagccctcttttgaattaataaaacgcattttcaaagtgttttgttggacttagaagtgctcttataatcctccacaaagtgaaactaaccataacttcatgaacgatttaataaactagtatccagttattccaaagagccatttattcatttattaagccaattattaagccttgagacacgtaattacctggaatttaagagactatattctcattgctcttaccaaaaactatcacctcaaatttcacttgcaagttactgtctgcctaactcaagacagttatttgtgataacaaagaagtttatcaccattctatgtaaaagagtctgcttgtcaaaatccatagtatgtttgtcactgttgctatgggacacagcaatggaaagtaatcataattgctgttttaaatatgtgacttatatcagcatttgccttagggtaatttaaataaattatgcgtaaaa

SEQ ID NO: 730 - DNA, 530 bp, Homo sapiens
caatacgatgtacagcaaagggagccttggtgtcacagatcagatggaaattctctcccgtcttgtcagtgctcatgacgtccatgaatccagcaggaaacaggacaccggcgataaaaagttccctttgtaaccagaccagctgagaccagttacaaagcctaccccaggtatccgaccagatgactccaaaaagacctcaggcttcattataatctaatttccatgctaaatgacacttccaccagtgtcatgacggttgccagtccccgtgacaatgaccagaaggagccataaaaggacaaaaacaagggagcccctcattccaagaagtgtaccgcccagttccagaaaagacatggatattcctcctcttgcttttaatgtccagccatcattaaggaaaccctatatgataaccccctcacccctcactaattgagaagttgatttgtgagccaagctcccgcttctcaattccatggccatcgaataaagcctgcaccacttgacactcaaaaaaaaaaaaa

SEQ ID NO: 731 - DNA, 319 bp, Homo sapiens
aatagaacatgtcctcagttgaatagctctatggtcctgctctataaatcaagttatgagtacaacacagaaaattccaatgactaattatctaatccctcccacacctaggatagtcagttttctacagctagggtaccttaataagacaacgtaagaaaatgtgaaagaggaattctcaaagtggttttctattggattatatctttttcctgacctggagtggaactccacactttctcttgggggttctcggcttcccagatgatgttgctatgcagtttaaacagcagtgtcatgaataaaccatgatcggcca

SEQ ID NO: 732 - DNA, 595 bp, Homo sapiens
  misc_feature (1)...(595): n = A,T,C or G
cggccagcatcgagttttattttgcatgtttttaagaattttgtagatcataacattctatctattattattttactgtatgcttttgtttaatattccatttgtgagattcttcatgtgcataggtatggtgctgagatatactattcaggataaatcatctttaacctttttcactttgcttttcccacctaaaagtataatgttaaagttcactactatttcacaggactcgtgttttaaaatgtccggttgctcctctcttagtgctgcatgtccagacctctgtctaaagggcgaaatgacctcctggccttcctctctcgatatcagcgatatcccctggtcatcccgcattgtacananactttggttgttttaggatcattattctcaggttttacagttctccatttcagtcagatgatggtttcaaagtgagagtttatgttttttggcagttntcagcttgttcaataatcattttccatttgccttcctgggccctccattggttttacattctgttctcaggccagcattttgggaggcgcaggcgggtggattgcanaggtcaggagtgtagatcaaaaaa

SEQ ID NO: 733 - DNA, 252 bp, Homo sapiens
tccacttttactattatttgtgctgaggtcacatgtttctgtgttggagtgcatggaggaaatgcaggatgatgtgctatttacatctcttcccaacaccacattcagggagtggaggtggcacgtagaagctgcccatggtgggagtttgtaaactgtaatcccagctacttgggaggctgaggcaggagaatcgcttgaacccaggaggcagaggttgtggtgagccgagattgtgccattgcactccag

SEQ ID NO: 734 - DNA, 194 bp, Homo sapiens
atgtctccaacggctggggaggagccttatttctgtgctgagggtggtaggaatcagggtggaattgtggccatgccttcctcctgtctccgctgcctaagaagttatcatccaagctccattctcagttccccctaaattgctgccctactctagtccatattttcaataaaacactggcctcgttggcctca

SEQ ID NO: 735 - DNA, 757 bp, Homo sapiens
gattgctgcagacgactctcttaactttccaccgctacacaaagctgccatggagccttcattgaacccttaccatgggacagccactgagctaagagcattgcatgcatgagctcacataatcctcacaacaccaaatggagatatcattagctccatttcacagaagaagcaatcaaggtttacagagaatagagaacctggcaaagtcatccagcctgtgtgtggtaaaagattatttgaattaaatactttccgcctccaaagtccttgctgttaactgagccgtgctgcctcccagatgggcacagtcattgctcccttcatctgaatttcctcttctctgggcatgctttttctcacatgggtaagtatcaaaaactttggctgttctcggattttaagccttctggtttcctttaaagcagttggagaatcctatcttttggtggaagttgtccggactgaatggcacctcaatcaaaaactcccgctttgcatcccagggaaactcgttgtcccttccactcctcagcagtcattcaggcattaaatatttataggatttcattcctgcaaaccattaccatcagtggtagaactgaactgaactcattgactggaaaaaaaaggctcttggttcctttttttttttgcttctttagtccagtcccttggtttatttgtctaatggctgtgctggtataacaccgatttagttattattgctactataataaatcaggattgctggcag

SEQ ID NO: 736 - DNA, 154 bp, Homo sapiens
gaagctgaagcccacagaggataagaagcatctcaaggcatcacagaggaataatagtaaaatgggggccaagaaaccattgattttgactccaagtccagtgatcttcccattataccatacaacaaattatttcaaatgtaataaaggcaga

SEQ ID NO: 737 - DNA, 811 bp, Homo sapiens
attacaatgaaccttattcataatgtcataccatgactgcgtatgaaaatacagcatgatggaggagaatcatcactcttacagtttcacatgaggaatgcaacacctacgttatcagatacgtgctctaggtgccagggttttaacaaacccaaccaaagaccaaattccttgcctgcctggagtttgcgttgtagtgggatgaggaaaacaataaacaaatgccgtcagaaaagggtacaaaccagtaaatagtgctcagtgatggagataaaaagtaaataactttgggaaagtggtaaacagtgttggaaacacgtcaaaactttcaatatcgagcgatggcggtcgattcccttaagcgagggtaaatttctcaatcctttctcactgactcattgcgctagggcgatcgtgtggggcgaacgggtatatttttttaaaggcggttatagtgttattccacagaatttagtgtattacccttgcactgggttttgtgtcttttgttatatctatttttccgggccgaatcgctgtcgatgagtgagatgatggagatgaagcaggtgtgccagatgtggatcgagttcccggaggtatgtctttgcgaacgtttaccacttgagtatagggttaatctattatcggtattgcaatgtgttacttcgtatgtatacataccgtttagcaaaacgtcattctatgcaattagctatagtactcagttgatattcgcgagagtactattctatccactgtcgtcggtctttccttaatacctattactatacatttattcatgtgtatt

SEQ ID NO: 738 - DNA, 367 bp, Homo sapiens
ttattttaattcattcattcaaccaaaaagcattctttgagcagggtttgagtctggggttgcttacagaactatgcaggaaagagcgtggactcaggaagtcgactcaggaagggaagtcttgaataaattatgagtccgaatcccacccagcaatagcctagacatgattgtaatgcagcatagaatttctctattttgtgatttatttgacttcagttaataagcaccagggaaaagcaactgtgtgcgcttcatgctgagatgactgtctctatgagggaatccaaacagagctcaaagcagcagcgagccagcccagaggcttcttttagtctgctttcaaacttctgaatacagcagattt

SEQ ID NO: 739 - DNA, 405 bp, Homo sapiens
tttttttttttttaagtttaccagtttattacaaagtgtatcttaaaggataaaataaacagccagatggagacaaacatgatgaggtctggaccggtcccaagcacaggagcttctgtccccgtggagctgagaggcatcaccctcctggcacacagatcagttcttggtcggcatccatgtgttcagcagtcctcttgggccttctatggagacttcactggataagcatggctgaccattgtgcagaaatagcattggacaaaaagggtaaggtctaatatgaataggcagagtaggaaaagcccgcaagtcctgtctgttcacattcttcctggactctctgtgcagcagttcatcctccagggtatggggtagaaccctctttagaaggagggtcttagg

SEQ ID NO: 740 - DNA, 595 bp, Homo sapiens
ctgcggcggcatcaaggcgccctcttggaagcagagcgaccttcactggacagtgagccttctggtatcttggacttctcagccttcataactggcttcttagtctcttcttgcagtcacccagcctggggagcgggagagtttctccatgctggagtcggagaacatgaaacagccagatcactgtgagaggaaattgaaagcttttatgagggcaaagagaggagagaaaaatccaatctgaaagcttggaccttttgggcaggaaacagttaagagcccactagatgcattgaactgccaagaccaccgcaatgttcgtacaaagattagacagagaacagatgtggagtaaccagaatccttcagagtaagatagcaacgacataaattaaccttgtcaagggcctgacaaagggaccacgcgctttttgaagtcttaagagtgaagccatttttttatggactctccaaggttatatacctttagctaacagaaaaagtttaattagagccagttgtttacagggaagggaagtgagcccagtggggctatcagggtgactgcaaagaaaataaacagtgatgcgcaagg

SEQ ID NO: 741 - DNA, 300 bp, Homo sapiens
ctgagcagtgccagagagtagacctacagacacggaactacgcaggctgtctgcaccactaaacggaaatggatgtgtgacctgcggctgatccatcaaacagaacactgcctgaagacagaaagccggagagtgtctgcaaaatattaccccacccccgccattcattacccctgctatcatatgcggaatgcataaaacttgcatccatgtgttgatgttaagctgcctcaaatccatgctgaatgtagatgggatatcaatcaaaaataaatgagatatgtaagaaaaaaaaaaaaa

SEQ ID NO: 742 - DNA, 195 bp, Homo sapiens
gcatggaactttaaaaattgaactactaatgtaaaaataagccaggaaaaaaaacaagaggaatgaagaagagagaagtacccagaaaccacatgaaaatgtccaaatatagaagtggacgtgaccaaaggtgaatttctttaatttgtccagaaaaataaagcatgtgtttctggcactgtaaaaaaaaaaaaa

SEQ ID NO: 743 - DNA, 658 bp, Homo sapiens
cggccgcatctccatttatttttgattgatatcccatctacattcagcatggatttgaggcagcttaacatcaacacatggatgcaagttttatgcattccgcatatgatagcactgcaaagacaagacagtaaaatacatgataatatacggttatgtggtgtgctgcaagctgaaagggcaatcaatttttgtgactgcatgtatgaagatgtatctttctaatactgtgtgactcgggttatttcatttatttatttcatcaattttgttcttttgttttcctagagatttctaggaatgacaaactgatcatggtttaatacaaactgtgaatcttgtcctctcctgtgtgtgacttacggggtaatgaatggcgggggtggggtaatattttgcagacactctccggctttctgtcttcaggcagtgttctgtttgatggatcagccgcaggtcacacatccatttccgtttagtggtgcagacagcctgcgtagttccgtgtctgtgggtctactctctggcactgctctttggtcacgtccacttctatatttggacattttcatgtggtttctgggtacttctctcttcttcattcctcttgttttttttcctggcttatttttacattagtagttcaatttttaaagtt

SEQ ID NO: 744 - DNA, 230 bp, Homo sapiens
atccctctaatgattattcagtcttctcttcaatgaaatatgctaacgcctgatgagagagcatctttctttcatagcacagttaacaactgtaattcttcaaccagctgttctctaaggattcccctgacaagctcttattttcattgcattatttctttgttctccttgtctaaactgtacacaagttacccagattttccactctggcccctttcaataaagagaga

SEQ ID NO: 745 - DNA, 779 bp, Homo sapiens
agcatatgtgctagtattttgggaaatcatatcatcattcctatgagattactaaatgtaccttagatttagtgactcagtatgagatacaattgccatcacatatagactaaaataaaacataaattgaacagaatagtttaagcatatttgtctgtgttttttgagctcccataatgtatacaattgaatctttgagaatatttgcctcaaaccccaaaattattttcaaatgagagattatatttctatatgctcatactgataataattattttctcagtattgttcctaagtagcacaggtaaggatcaaatgattgtggtacatagaataaattacattggtaatgagcagaaagaagtgtgcactcgatcggagcagggggtccacgcctgagaagtgaataggggggtggatgccggcctttccctttagggagggtgaattagtaaccctccgcactggattctgtggcctggggtgttggggtggggggaggggttcaactcccttagaggcggttttccgggtttccacagaatggggggtaacccagggaaaaacacttgggcccaagcgcgccaaaagggcccagaccctctaaagggccggcgttttagacattttctctataggccccgcccctcgaagatcttcacgaagattagcccttatgtgaagagggggagaccccacacgaattataatatcattggttgctccataagaacctcctatgcactttttatgaggcccctgccgctacagtatcgcgt

SEQ ID NO: 746 - DNA, 749 bp, Homo sapiens
taataaaaataggaaccattacaattaacatatttttgccaacaagaaataagttcgttattcctgcagtgtaaaaatccatgcttgaggattcgatgaactcttgggaagcatattctgcatcctgctgtttgtggaagtgttttctatgcaaaaagttgttgtgatgcttaaagaagtgctagtcagccggcaagaggtcaggtgaatatggcggatgaggcgaagcttcgaagctcagttttaagcgttggttgtgcagtgtgcggtcaggcattgtcatggagaataattggaccccttctgttagccaatgctggctgcaggcattgtagttttcagagcatctcatctatttgctgaggatacttctcaaatgtaaaggttatgctgggattcaaacagctatagtggatcacaccggctgcacactcctaacagcgaccatactatccggaccacacccgcacttgggaagtgctcatgagtctcctatcccccctacccccgccgtgcctcccctgaaccttgcacctcctcccccccatctccgccatccctccctcgaccccaaaaagcttcatcgctcgcttccttctcttcgatccccactccctaccccccttcccccctctccccccacccctccttccctccccctctcccccacatctccccatatcgtcccccccctactcttttctctcccccccccacccccctcacctacaccccctctcaacctcccc

SEQ ID NO: 747 - DNA, 556 bp, Homo sapiens
ctagcggaacgactctcttaatctaccaccgctacacggaggaaaaaaggaaatctgcaggcacccaacatggagaaatcacatgcaactttgttttacatccttaggctggatgtagaggaagctggcatggcatccctgcacaaagactggaggcaaagggcagcctcagctgtggaaagagctagaaactccctgaacacttgtttgagatcagcagagcaacttgccatctcaggggtcttgggtgaggaaaacgttctcccatgagaaacccaaactccagacctgcttgagcgtagagagttgtatatgacctgcagaaacccaagctgaaaaatttaaactggagacttatgtagaaacccttagggccacagcacaggcaaatgtgactcttctcttcaggcccttccacaaagttgatcgtgcaagaatcccacaagaaaggagagaacaccccactgaaaatgagctcagatttaaaaattccaggtgacaagatgagtgagtcaccatgaataatcagcaatttcaacagagtgattagcaaccc

SEQ ID NO: 748 - DNA, 811 bp, Homo sapiens
  misc_feature (1)...(811): n = A,T,C or G
aaacttatttctgaaataaaaaaggaaaacatgatcccggagagagttattacacaccagatattaggaatccaagaaaccaagccaggagcccagcagtcaaggttggaaacccaagacaggagcccgacagtcaaggttggaaacccaagacaggagcccgacagtcaaggttggaaacaaaagacaggtccagccagggtgatgacggtcaagcccagaaatgaagattgttctcttcttttcctactggaatgttctttaccaaacagttccctctacatttaatcttctcagtgcacttacgtttaatgggatcctatgattaaccggcacaagagcaaaatgatgctagcaactttagttttaaattgctacaaaatgtactattttgtagttacatactatacaaaacacacttgaaatcaagtgctcctacaacaaaaaaaacccatctgactaaatcaccaattttggtggtttttttttgtaattttgttcattttcaatcttcatagcaaatgcatttttttgcttcggggcctagaagaggtaatttttctcaaaaataagctaacattaatatgtgctgggccactatatgatggcttggcttttaagtccaaggtagttggcggcccttgtcttntaagtnctctgtagagtgaaaaggcttaccaaaatccaaaccaccttgaaataaagaaatccgaattaggaacatcaccatttctttgggtttttgttaaagactttgctatgttacccaatgaagaaatgcagtattttcacctttttcgatgaaatgaaa

SEQ ID NO: 749 - DNA, 266 bp, Homo sapiens
tcgatatttattagccagcttgcattcatcgaagatagattggagtgtcagcaaacctctggcttccctcttcccggagctcagccaaaccagctcatcagaattgtgcctattgatcaatggccaacgcccttggcgatagaagagattggcggtgatatagggggccaggagggagatctctggggtgcatggtaatgttccgtggcttggtccaacagctagatgcactgatctagtcactttggaaagttttttgcgctttt

SEQ ID NO: 750 - DNA, 362 bp, Homo sapiens
ttgaaaagacagaaaacacaacttctatggaagaacctctaatggaattacccaggaggaaagggggctcagaaatccagcaagttaccaggataatgaaatcatgtatttaggtgctcctggcccgagggatgtaaaatgcaacttactccagctcatcctcggagtcgtagcccactggcccggattcgatggcaatgacctcattcctcgtctgactttgtttccaggtgctacttcctgtggacgacggcgattcttttctcttcttcttcccaaaaaaacttcttaaaagttttgaatttagattttttctttcctatacagattagagaaaaaaataataaatgcagatgcagacg

SEQ ID NO: 751 - DNA, 412 bp, Homo sapiens
tttaatgatatcaacttctgcatcctgaaagactcagatattttgtttttacaagtctttcttcagaaatgacctgttccatctctcatgctgctacaggcctcaagagatgttgcaatttccattatcaccctctgagaactcggtgctgccatgagagggaacttaggatagtctccttgaagatgaaagccaatgcagaaagagaagcccagacaacaagactaaccaccagtcatggaagtgaggccgccatagaccatccaggcctgggagagtggccaggtggtgcagccacatgagtgactccaggcaagaaacgtgaacgaactgtccggctaagcccagcacaacctactactcattaatcatgagcaaataaaatagttgttacaagcaaaaaaaaaaaaaa

SEQ ID NO: 752 - DNA, 513 bp, Homo sapiens
cagtttgaatatgtcatcccactgcctttggccttcatagcttctggcccaggaaagggaagaattacatgaagacacatggagaggggagccaaggggagaggttcagaagcaacaaagcctgctgatatcttgatcttggggtctaacctccagaacggtgatgaaatgtctgttatttaagccattcggtctgtggtattggtgacaacagtctaagcagactaatgcaagccctgacacagactttatgcaatttaattctcttttctcagtcatgattttctcctccgtaataagctctaattatcagtgatgaaaattaaatgtgtaaatgtgtacattattgtttaaagacaagtaaagaaaaccaacacccttgtttttgtttaacggatctacctatttttaggaaatgtttaagcagatgtggattttttttttaacacaataaaatactatccttttctcagctcttttaaaaaaaaaaaaacaatggcctcgttggcctca

SEQ ID NO: 753 - DNA, 683 bp, Homo sapiens
actctgcccaccccctgttcagacccattctccagccccaagcagggattccacactgtaggaggagagattgatgacccagagggcaagaaaagaaagtgtttcagaagactctcaaaatgctctgccctgaaaacgaggggttatgatggaatagattcagtgcctggctcattgtgggatatcaacaaagagctgaagaaggaaggaaagaagaaagaaaggggaacagacaagagatagggacacagggaaagaggaactcagcaacaatataattttcccaaatttatcagcaaaagagcacctggagtttggagtctggagattatcgttcacctaccacacgtaggttgcccacttaatccacctgagcctctttttacgaatccaaaggcaaaatattttcaacacagatttggtaataaactgggtgctctgacatatggttagcagtattgtgaattggtacatctcactggaaaagcaatttatcagtacaaaatcaagagtattacaaattatgcacacttttgactgagttctgattttctgttctacaaaataattcccatatattaaaaaaaaaaacacttgtacaaatattaaaatagcctgagtccctgatgacattgtggtctctgaactgttttatataagagaataaagccgtatgcggcagg

SEQ ID NO: 754 - DNA, 161 bp, Homo sapiens
aagagggcaggtctattcacaggagctctgaggtgtcggagaccacactcagactctattctctgatcttctgagagagagcttcaccctctatgcatggttccaatgtatcacttgcttttcccaaatgcctgccctgaggactacaagctacgacacca

SEQ ID NO: 755 - DNA, 686 bp, Homo sapiens
ttatagtctttctacttttagtctagttaataagaattagctatcttaagcaaccaacccactcacaccactagtaaaaggcagagtaagaattttattctagcgagtcagaacctcaccccgaaaggcaagaaatttccagtggggggaattgagcctcaccccaaaaggtgagaaatttccagtaagggaaattgaaccttggactctaccccaaaaccatcaagatgggaaatggagacaacaaaaatatccaaaaacggataaatagataaataatttgtggtatgtccatgcaatgaaatactattaaccaataaaaagggatttgctactgatacacacaatatgagtgactctcaaaataactatgattagtgaaagaagcccccaaaaaagacattatatattgtatgattcaacttataaaactctagaaaatgaaaactattttatagtgatataaattagatcaatggtcacttcaggctacatggagagacaaggggcagcagaggaattacaaaaggatgccaaaaagtacttggaggtggtggatgtattcactatcttaattgtggtgatggtttcaagggcgcgtgcacgtcagcatttatcaaactgtacatgttaaatatgtgcagtttgcatgtcaattatacctcaataaaagccgaatgcgtgca

SEQ ID NO: 756 - DNA, 319 bp, Homo sapiens
gggcaccctgccccccccccagaaagatggagaaaaatatctggcagctatggcttataactggaaaattaaaacactgaagagaaactggcaaatgctttctccttgggaactggcatttctgcagccaattaaagaagaaaagcaaagtgatgttcaataacaaactcttctcattttattagaaatcatcaaagactgaaaaaatataaagaatttttgtgtgtgaaccatgcaacaaaacccgggcgcatatcaaaatagtttccattataactccccaaataaataattatttcattatgcaaaaaaaaaaaaa

SEQ ID NO: 757 - DNA, 845 bp, Homo sapiens
acggccgcatcgctttttatttttcttccattttttggcaattcatttatattttacaaaagtatcagttcacaatgactggaaatttaaatgctggttcttcatcaaaaatagtttgagaaacgctgggctagtcagtacctgtggagataaaagggtacatcccccaggcctgcccttggtctctgatttctctgtgcaaggaaatggtgattgggaaaacgagagtgagctgaaacctaattcatccaagcgatggttctaagggctaaagaggcccatatgaattcacaggtggagatggcttaccctttgaagaatgattcttttcttatcggcacaccatttagaaagaactctctcgactttgtattgatgtcggggtgacctggggacgggagatccacaaaaaggggcaaatgtgataaaattagacgttcccccccgccgttgtgttgatgatatcatcggttaaagaagggtggcaatcactttgaggtacgtaatatgaaagaaaaaaaccccgtgtgttttcagaatatggaaactactcccttgttctcctaatttaggaagaaacgatgatttcttcgtggtcgtttgaaagtagccttgtatctttgttttccaattattttttttacgaacgaacgttttgttatcggcgcacgcaagaatatccgtggtcccccaggtaggctgctcgttgaatcagcgaagattgttattaatttatcgttctaccgacgtgaactagtccatgtgatgtagtgacagctcgtcgacgtggcgtatccgaagctactgttgcattttgtagttgtcagttcgcggcgggggcgtgg

SEQ ID NO: 758 - DNA, 790 bp, Homo sapiens
atgtgtcacagctccactggcatgcagtctccctcattgtgataaatcaatgaatgtaacttgttggattatagggttgttcctggtggttttggctggttggttgaggacagtggtaaacaagtagcaaagacaatattgccgcagggggaaatgctggcatcagtgctgctatctagcaaatgagtcttgggctcaatgtagttggaagttggctcttagacttgcacattaacttggggatccaggaataaggctaacgtagactcaagtccataatgaccctgggacctggtagaagtaaattcaatacttctggccaaaagcatccacagcgtgggcccccaagattcccacagataaacatcaaccaaatatgagctcacaatgaagattttcaaacactcaagaaaaaagtcaaccatagtgcaaatcagtaggatattgatactgaaattatcaagtatagtttacaaaataaatgtctgaaatgtttaaagaaataagcaatgaaataatctaaaccataagaattttctcaaaatattggcctttctattccttgaacaaatatattaaccaattgcacatattggggttttttttgctggaacattaatgccatccttcatttaacttgtttactagttattggctgtgctacccccccatgaccccaaggattggaaattcccaagggctggggttattttcggcatgttcactggtttatctttagactttaaaacagggcccggcaaattcctaaatttttggtgacccaaaggct

SEQ ID NO: 759 - DNA, 565 bp, Homo sapiens
  misc_feature (1)...(565): n = A,T,C or G
cctagctgcaacgactctcttaattttccatcactgtcatacagttggacagggagcaataatgtggatcaacaagagcagcaatttgaagaggacagaccaaaaaagagttcctttctgaggagccccagagtgcctgccaagcccataatccctctctgcagagtcctttagtcatgagacactgtgatctccacccaaaccatgtctgattggaatagcaacgaattccaggttcaatgatagccaaacatcagcagtctttgaggtggtctggactaatttctcttggggtgttggagtatgaaggactccaacatggatgttggatcatacatgacagcaagagaaagacgcatganagctggccctaagtgtggaagctgtgatgggaatatgaagagagttgacaatgactgcagcagtagaagcaaaagcaaaaaaattttgtcaacattctccaatttgaatttgcttggacaaaacannaacaaaacaaaagaattttttggctaatataaccaggaagattaggtatgtggttaggtaggatgagaagcaagaa

SEQ ID NO: 760 - DNA, 1349 bp, Homo sapiens
ccttgccctgagtgatgatgaatcatttggtcttcataatgaaaagaacatgccccagataccacttgttcatgactgaggagatgcacaaagcagaccagaattcaacacataacacaaagcagaatcattcctcctgacccccagtccatgaataagaaataaatgtttgtcattataagctgagactttgggttgttgttatagatcttattacagtaataactggctaatacctatgaaaaactgtagcactaggagatcagcagctgctctaatgatgcaaccaaatcttgagtgcttatgtgctccgaagtatgtgttccctgattccttctttaacattctgccattatgtttggagtgcgtatcgatggtattctctacccagaatttctctcccttctttggtggaagtgtactctctttctcttggaaatctgttctttgtctcccttgcaaaccgtgtagttctactgaagactgacaatcatagtacacagtgagcacactgattagtccagtgttggttaggtgatctaagcaggaccaattagagccttccctaggatttttttagcgttggagctgcaggggaccatgccccctctcttttcatgcacaatgcctgttgacaataagagagaatgaagcaaacatgggggaagcatgggtataagacaaagacagaaatttctaatttctgggtgggttttattcctgcttctcatcctacctaaccacatacctaatcttcctggttatattagccaaaaaattctttttgttttgttttgttttgtccaagcaaattcaaattgggtttttgttccttaaaaccaagaatgttgacaaaatttttttgcttttgcttctactgctgcagtcattgtcaactctcttcatattcccatcacagcttccacacttagggccatcccttggtttcctctctgctttcatgcgtctttctcttgctgtcatgtatgatccaacatccatgttggagtccttcatactccaacaccccaagagaaattagtcacgaaccaggatagattcagaccacctcaaagactgctgatgtttggctatcattgaacctggaattcgttgctattccaatcagacatggtttgggtggagagggcagtgtggtacaaatcacagtgtctcatgactaaaggactctgcagagagggattatgggcttggcaggcactctggggctcctcagaaaggaacagcaaaacaagcctgttcttttttggtctgtcctcttcaaattgctgctcttgttgatccacattattgctccctgtccaactgtatgtacagtgaagggttgg

SEQ ID NO: 761 - DNA, 660 bp, Homo sapiens
atcacctggttttcatcattgcctgaaattactatcaaattctggatcaactgataccatgaatgaggtcttggactttgggaaaacaactcggagccagagattccttatctgtcaagtgggaaaaatgatctcgacataagctttggagaagattcaatgagataataaaagtgctttgtagattcctccatgtgagaattaaggtaaaagtagtacgacctgctaatgggctctcccaagaggtgctttcagatttggtcttccaaagaatgcatgaaaatcagaggttgaagattctttacgctgagctcaaatttagtacctctggaaagctttccaaactcttttctagtgttggcattgtatttttcaagatcccactgcctactgcagattcccagctctgacccagagatctgaaagaaaggaccatgctcacttccgcaacatgcagcaccatggaaagaatgggaagcccatgacacagattggcagggataccactgcacatctactgcttcatagtctagttctttgctttagccttctctctgttataaatgatgtctaatccatgtaatgaaagaaaaaaagcctgcaaatcttaagacatctggtttttttcttggtatgaaaataaaacccgatgctggccag

SEQ ID NO: 762 - DNA, 859 bp, Homo sapiens
cgcattctctcttgactgccaccatgtaagatgtgcgtttcaccttccaccatgattgtgaggcctccccagacacgtagaactgacacggatgtcttttcccaggccctgtgactctggatttcatgaagcgacaattaaggtgtcagccaggactgcagtcatctgaaagctcaactgggagattatcttccgagatcattcaaagacttagcggttcctcacatgttgttggacacaggactcagttcctcacaggctggagtcttctccacaggagagctcatgaattgtcatctgttgtccaccagagggggcaagtaagagagcaagcgagggtgagaggtagccagtaatacggaagtcacaggtctttggtaactaatgatatcccattaatttgttatattctgttgcttacaagcaagttacaaaatatagcacacactcaagggatagatagatatagatgtagaaatatatataaaaaaattataagcttggagatacacacacacatacacactcacacattatactagaaaacaaaaatcactaggagctatgttagagttagaggctacctcttgtacctttcacaatcttataagaattttgtgcgtgtgtgtgtctgtgtgtgtctgtatgtgtgtataacattctttcttagacttttggtttttcaatagatttttaaatttaaattgttgtatgtttttgttaagacattttagtataaatataaaatatatttggatgatgaaatcatagtagacataccatacatatactcaaatatagcaaataattgaataaagtttccataaacactgtcaacaaaataacacgtatcgcaaag

SEQ ID NO: 763 - DNA, 785 bp, Homo sapiens
  misc_feature (1)...(785): n = A,T,C or G
tgcctgccttggctctgctttctccaaacctgtccccatcggtcagctggggtggacgagtgttttccatcttgcaaagtcattgtgtggggaagatgagatattccacgtgaagcccccagcacggcccccagcgcagcctccttccaggaatgttggctctgaggtcgtcttccgcgtgagttttcatctgtcacttgtaacaggagtgctggtgggaaccatggtgcagtgtggtccagcatcacctgcacggcttggaagacggagatcgcagagccgggtcccagggtgtctgattcagtgagtccagaggcgtgcctatgtgtggacagacatcgctgaccgaccataacctcacatctgccaaacagacacggnctcagaaattaacaatggatgtttgtcttcaacgaagcttccgcccgacacatcangtncagtgctgtgctgggcggagccacaggaagcctggaggcctggctgaggctgctggatttgtctctgggtccctggcgctgatgatcacaggcttcanacncccctggagctgggcaacccgtcagtagcgtgtgtgggtgcgtgcgtgttgtttcttgtgcttgggggtgcacgtgaggcaattggttcctccttccgtgtgcctgtgccttcccttgagtgattcctgggcacccgccgtggggaatcctcgtccacgttttttggccgtagggtgaggtgactttgtccctgttcacgcagtcttttcgtagcccacatttgtgacgtttgtccccccctct

SEQ ID NO: 764 - DNA, 767 bp, Homo sapiens
ctggccagatcatgctttatctatattcaaagcttgacagcttaaaacatggttttcaccgacatgcccttgttcttgtgtgatgggggggggtgtctctgcaataaattcagaattcgattgtcatgaggcagcttaggcgacctctgatcaacacactcactcagagagttttctaacctacaggaaggaaataggcccagggcgtgctcgcatttctttctctttctgagcactgccctttcagtgctgtacctaattttctttatcatagccaatgttccctacaggcaggagttcactgacagtggggtgtgaaaactttgtatccgagcgcggacattaatcctcctgcccctctggagcaacaacagggacgggaagggggccagtctgggcaacatagtgactgaacaataatcacagggagttcacagaggatggaatctcatccagttaacgctgtccctgaccctgaaacacacacacacacgctcgcacactatacacacacgcgcgcgcacacacatgccactcgtactcacacacacgcacccacacttgcgcccgccgccccacgcccgcacagactcgctcacactcactatacacgcgcgacaccaccgatgagactcccaccctctaagcccacaccacatattcccacccgtggtctccttacgcgtaagcaccagcccgcgctgctccccgctcaccacgccggccgcgcagcccccgctacctcacacacgtccaactgtcattat

SEQ ID NO: 765 - DNA, 726 bp, Homo sapiens
aggaagcataaaaaatgaaagatcaccagacttcaacatctgagacccaaacattcacaagactccatattaatcaactctggagagcaacatctaaactcaatgatgagcaaagagagaggagttgattgattccttgaagcaattctgctttgataaccccttgatgttggtttgactcatgctcctgtcatcatgaagccccctattgtgtgaactaattgaaacctcacaaaatggtgtcacttgaatagcattactcctgcctgattgtaagcaactctaattcccaatgtcaagatcacatttcacttcacagttatatggatcacaacatgagagggattaatttctggttgattaccctctgcagctataacatgaaatgcaattcatagcaagtgggctcttcgcatgtttgctaatctgccacattggcaattgttttgaggatcctctgaagaattctaatgagcatttaaaagaaagtttgcttatgaaatataagccaatgatgcaaataatgttaaaaatggtattttgtgagattatgtatatttttgtgtgctgtgtgtgtgtgtgtgtgtgtgtgtgtgtgtgtgtgtttacaggattaattcaatcaatactcttgcagtttgctgaacacaatattcagtatatagtgcattcagataaatcttttgggggatgtaaaaatttaagaaataaaatctgttccgccag

SEQ ID NO: 766 - DNA, 324 bp, Homo sapiens
gtggccggatactgtttttatttcatgtgtagaacatacatctttcaaacttcttttcttgaataaagccctcatacagtaggtagtcattcgaatctctctagttttaagaattgatttaaaatgggaaccagaaagaaatattagaaccaaccattggaatagttggatttatcttttttttctttgcacaggtcctctggtgatgttcttgagacgttcaatttcttgttggccaggatggtctcgatctcttgacatcacgatccgcccgccttggcctcccaaagtactgggattacaggcatgaaccaccgcgcctgg

SEQ ID NO: 767 - DNA, 962 bp, Homo sapiens
gctacagaaaaacatcatgagagaaaaaaagaaacaaaagccagtctgaagaaatggttacattattttctacaatggcaatttcagaagttgtttttcttcatgcaggcagagagatgaagaccctgctgggctcagtgactggatagtacttgctaccaaaaggaaggcaccctgctttacacatggaagacttctaaatcagctcagatacctcatccaggatccccacctacctgccctggagatttcctgcttcctactttgtcagtgggactatcatttctgcaatgaacagatcatgtcacttatttggaggtagcgttttgtagcagggaagtcaatatatttgggttctaactggttagctttgtaatccttgaaaattcacattgttctccttgtgaaaagtaagccctcaactaataaaacaccttaatacattgttaaaaacatagactcacacttttatccttgtatcacctttccttcaaatattaacccacaacccaattcttctataattcttctatttagcctatcttcttccaaatgcttacatgttcataatttggatttctcagtgggcacttacttatattaatttacttacaattattctgttattgaagtgttctatcttttcatttgtgctctgagcacaaatatagggtgtcagagtagggtgtcagttgtaagcctaaaacctggactgtttcttgatgataacaggcgtatgatgaatgcttgttcttgctgttaaactctacttttatcttagatatgcttccgatgctcatttcattatagtttccctcaaggagataatatctatctatttttacgtgtgtcctctttctcaaattgtgaattattctttgtatctttcctagtgcataatctgttgcctagtcctgagtaaaggatcaaataaacatgctaataaacttggatgcgtccag

SEQ ID NO: 768 - DNA, 357 bp, Homo sapiens
caaaatacatgggaaaaacaaaacaaaacagtgaaccaagaactcaagggagaatcttttgagctcattttctgggtgaatgcttccctcttacccgaccaccagaacagaggagcttccaggaagttagagaattgaaaaatagagaaaaagaatgagtcacaagaggatcttatcatctgactaagtgggagactggataaaagccttgtaaaatcattgcagcttatatacatgtgtatggttatcaagtagcattctatttctcaaattaagcatataccgcaattattttgtgagactataaaattcttctagaaagaaataaagaacattaaaattctaaaaaaaaaaaaa

SEQ ID NO: 769 - DNA, 831 bp, Homo sapiens
ccccccatcggggtttattgttatttagtagggagctcagagaatcttaatatgtattatatttaaattttctataaataagtgaactttttatacagcaaagtagattgagttgtttgtatatgccctttcctaatatcactatttcttgaagcagagaatatattgaggtaaatcctcattagaaaatttattacgcaaaatttaaccaactgtagttgtgatcagtgctattgatggtcagtgtgctatgggtgtgaagcaggaagaccttttcatatgaagagggtactagcgtctgttgctcccctctttgcgtccatgtgctataatcattcaactcatacttataacggagaacatggggtatttagttttctgctcctgagttagtttgctaaaaatgatagccaccagccccatccacgtttctgcaaaggacacgagcatgttgcttttttttttatgaccgtgtagtagtccttggtgtacatgtcttacattttttaatccagtctgttattaatgggcatttagtttaattttatgtctttgccattgtgaatagtgctgcaatgaacatacatatgcatgtgtctttatggtagaacaatgtatatacctttgggtatataatcagcaatgggattgctgggtcaaatagtagttctgtttttagctctttgaggaatctccacatggctttccacacactaattaaactaatttacactcccacctatagtgtacaagtgtttccttttatctccaagcttgccagcatgttattttttgactttttaataagtttaagagagccgttgcagcttc

SEQ ID NO: 770 - DNA, 332 bp, Homo sapiens
tcagtctttatttcttgaaccctcgttgacagatttatttttaattcatttccagattattctattttatttttcatttatctggaataaatccatctcctgaagtttgatgttggtgattattcttggcattagttttcttgataaatatcagaatctgatgtcatagcctgatttggggtgagagcttattggtttggttttctccccagcactcacccattgttgtctagtagctcagtggttttctccatcttgctccaccactcatggagttagtcgtggtttggcccagatcttgaccattgagctatgtctacttcttcccattc

SEQ ID NO: 771 - DNA, 840 bp, Homo sapiens
  misc_feature (1)...(840): n = A,T,C or G
tgcatcttgctctcagataagaaggctgatcccttctctactgctgtcaatcgagaaaagttgatgatttttctatggcagagtttgtttttttctcttaccaaggatgagtgtattgtcactgaccagataactaaccttttagaggccttggtacaagtctctcactgcccaattctgttcaagagaattttcctctgcccttgtgacatcagaanccaagccaaaagactgagatgaatgtcatggaagtgaccctccaggcagcttgcccattcccttgtctcctgtactcaggcggttggatctgaaagcagcagaggactcatcccttgtggtcccaaaggcccatgaagtcactctgcacagtgaaggacccagagtgcacngttttaaacagaaaacatttattttntattttttttcagaaccagaagcattaggtttgggtcatgtattccactcgctgttcctgaggaagacactcagcatctcttctgatttgtgacttattctgttccaatgaggttggtgccagtagaagcacagtaactaaagtaggcaattttctcaaagctgcagcctttcaccagcttgtgccttgttctgtgtgcaaacctcaggccctcatcacttgcttattttgtattaggagctgcataacagtgagaggaaggaaagagagggaaaagaacaacatgcaaagccaaccttgactttgttgatgccagctgattggaagggctgctattttcagggagggggattagggattctgtntagagataaactgggattgngagcctnttngggcctggnatctttattgctgngnaaaaa

SEQ ID NO: 772 - DNA, 370 bp, Homo sapiens
gatttccctgaagtcatgagttcctgctcagctcctacccaagcacagaagcagcccagaagtgttgggagagttatcttcctcagggataattctcaccctacagaggatgagagccagtgtgactgttcattgcccaagtatttcttggaggcatttcatatactactcacagcttccatgggacattttgcaatgtagattttcattaaaggcctgatgatttcaactggttgctgtcacacgatctcttcatcagtccactttcaggttactgagagtagtgcttttcatcctttgtcaccaccatatcaccagcacctggcacaatggaaggtcgtaaataaatatttgttgaaataaacattga

SEQ ID NO: 773 - DNA, 896 bp, Homo sapiens
gagccttcagaattgtgtgatctgattattccctaatgatttgggatcccagagaaaacctgaaaaactggtgcaggccattatggaaagcaaggtgtcacctcttcactttgctgattgcttcctttgctgttcagaagtttttaacttgatgtcatcgcatttgtccatttatgctgtggttgcctatgcttgtgctggtgatatggtggtgacaaaggatgaaaagcactactctcagtaacctgaaagtggactgatgaagagatcgtgtgacagcaaccagttgaaatcatcaggcctttaatgaaaatctacattgcaaaatgtctgaggagatgaaagaaaaggaaaggggaagtcagattagtcatgaaaactcacgccatttatcaatacaattcaaagtccagaaaataccactactcattaaagaaacaaatatttagggaagagacaccactagtaaaatcgaggtataattttagtatttatgtaatatataggtattatatagaaaagtattaattttaaagaagtactttttatcagaatattaatgttaataaaaatgatggtgtatcaattcagttttcaaagatagatggtcacctttctatgagaataaatagctactgtttcaagttctgtgatctaggaatcaaggttataatgttagttgttttacaatgaaagttatagtatccactgtaaagacagggatttttttatgtgaacaagattataaaatggaaatagatacatatatatccaagctttggtctccattacataaactgaaatctataaaataaatttaaaactcaacttgaaatatacatatggtgaataaaaacatggcctcgttggcctcagcggtggagctctgcaggtgg

SEQ ID NO: 774 - DNA, 247 bp, Homo sapiens
tttttttttttttaactgaaaagtggaggttatttatttggcatggttggacgaggggaccgtcactctgtgtttcctgggctggttttgctcttcagtagctcattctcaggcaggctttctccacattctagccacatagcccatagtagcttctgctttacacaagccttcgcatctgtgatcccagaagaagacagattctcctttctctgttggtccagctaggacgacttcttcttgaact

SEQ ID NO: 775 - DNA, 816 bp, Homo sapiens
caccagggtctcagactgggaatgtgagcgtctcccttcaagtttgctgatgtgatgggaagaaagttgagtaaggctcctggatctcttctttgggacaaacctcattttgtatttttctccatggccacatttgagatggaccataaggaaatgcctttcatggatgcacagcagttttctctattccttgttgcattgagttcagtgttccagcaaatgacctgggaattgaagccttacgaacactttctagcagttttcagtgtttctttagcagtgcactttcatcagaaacgtagtaaatgtcctactcatttactccggccaatttctttgattagtaaccacaggtagaaatgttgtctaggcaatgtctgtttttcttctaccctcacccccgtaggctttaagtaaataatcattccatggagggaattgaaaacgacagcatcaaattggagaattatcattttttatttcattatggctgaaacatcccatttaagcagataaatctttgattgaaagtgctagagagaggctttagatcataaacttttttttttccctgaaacggtgtctcattcacagctgcttataacaacttctatttggcatacagaggcaatattgttgaaccattaaagtttacaaagaaatcacactgaatttttattgtatgccagtgattgagtgttccttcacaacttgagtgtttaacaaagtggttttccttttcttctctgctggaaaaggagctgtccccaaatgatgttggttttctctttacccaatggcttgatgaataaaaaa

SEQ ID NO: 776 - DNA, 875 bp, Homo sapiens
tggccgatctttttttattatacagctaatatgataagtttgtttcatgttatccccatttgatcaagaggaggacagtggttcagagaggttaagttatttacccaaagttgcacatctaataagtgatgaggcctggatcccacactctagtctctctcactccatgccgttaatctccatactatccctcactctccatcttgctactacaactcatttattaaaaatcacattctgggcatctgtagaccagattcagccttctagtatggaggagagaaggcaggagaaggagggagacgtgtttcatctcatgctattctcaccaggttgctatgtcagcctgttgtaaatgctcttcagaaacattcagagtccgtccagtggaaaatgccttttcacatggaaatggcaagaaatctttttcttcccaaggtttcagcttgaagagtacatggtggacctttccagcttctggcctttgattgtttgatatgtcagatccaagttgattaggtggcccaagcttgtagttctcagacttatgcctctacccagagggccccaggctgggccttctgtagacatagctggcatcagcaaatggcctttccttgggaggtcccgtggtctttccttggctttgtgtttaagggcattctccccccccatatctatgtgtcactctctgagtctcagtctctttccctctgtgtttcttgctgccaggaaggctggggctgcatagtctcctccacctggaaatatatagattgctctcttggctcctgcatctgtctcttgaagataagattttctctctgcgaacctatgaacacacaatcattcttccttctgtacctgggagttat

SEQ ID NO: 777 - DNA, 744 bp, Homo sapiens
attctaggtgctgtggtctgtgaggcctatgctggcaagtgtgctggacaccacaaacttcctttcagtgtctgttgtggtgacacaaacataacccgtattcgctacctggcttagctgttcccatgaagaatgagattgaggcagagcctccaccgtgtgctgagcaagggtgagcaccaacagctggaccgtgtgctgtgagcacctgatgcctgacattttcaaaggggctctgttataggttgaattgtgtctccccccaagtatgctgaagtcttaacctccagtccctgtggatgtgatcttatttggaaatacaatctttgcagacgcaatcaagttaaggtgaggtcatgaaagtaggccctaatccagtgtgactggtgtccttattaaaagggaaaactttggaaacagacatgcacagagagaacagcatatgaggacacagacccagagggaagatggccatatgaggacagagacagaaattggagttctgctgccacatgccaaggaaggcctgtggctccagaacctggaagatgcaatgaaggatccttccctacaggattcagagggagcgtggccctcccaaaaccttgattttggatttccagtctctagaatggaattccaaaaacttctgttgtattaagccgcccacttcgtgttacagacattcctcaaatatattgcaggttcagttccagaccaccacaataaaacacgttgcggcag

SEQ ID NO: 778 - DNA, 291 bp, Homo sapiens
ataaagtctttgggaaaaacaaaaattgtagaaccatctgttagtgccccgttgatgcctattgcctttacataatagaaaattgtttgcatgcctaattcttggtcatgggacaagaacttggacctcgctaaactaaggagtaaggagattgcaacaaaaccactattaggactttattgctggtggaaagtaaaaaggtaaaacattggcatgcttctacgtaacacttactaagtctctaaacagtgatggattggcaagaggtagaaataaaagaggatcggcagg

SEQ ID NO: 779 - DNA, 204 bp, Homo sapiens
tgaggccaacgaggccattttttttttttttttttgcagaaaaaatactttatttgaaagctttaccatatccattttaagtaagataacattttgaagtatgaaggtttttctgtcctgtacttctttgcccttcatcctcttcaagcagatagagagttcattgcctaatcatccaacactccactttgatcacatatctgt

SEQ ID NO: 780 - DNA, 451 bp, Homo sapiens
atatgtgatcaaagtggagtgttggatgattagctcaagttaaacctcagttacaatgaagcagagcaaaacttgaaattcaggttaacccactgttgctcttcattggatctcagcttgagagacagtcctaagccatctggccaggaggagtgaagaataaggcaatgaactctctatctgcttgaagaggatgaagggcaaagaagtacaggacagaaaaaccttcatacttcaaaatgttatcttacttaaaatggatatggtaaagctttcaaataaagtattttttctgcatgattttgactggtaaagtgcttttcagcactggtttggcatccaaatatggtttacccatgttttaattcctcaaaaatgtattttttattgtatttcatctaactattttgagtatctaataaatgtttgttgaattggaaaaaaaaaaaaa

SEQ ID NO: 781 - DNA, 520 bp, Homo sapiens
ccccttgaagattggatggtgcctgcctatacggagggcggatcttcccctcctcgtccactcagactcacatgcaagtctcctctagaaacacccttgcagacacaccccaaaatgacactcttagagtgtctttgaagaaggtaaatattgttcccattttgtggataagaaaaatgagaaccagagcgatcaagggcttgctcaaaagtactcaaccagttaatgtcagagctggcacctgaactcaggcctctacaactctaaatgttttcaatgatagcagaattgcctctaatggcaaaacattgtagaatcatattgatgtttcagattatattgccagtcgtacttcgttgagctatgcttggtaatgccactgccatcttggaaagaaaatagatgctgaagttccccatagatgctgaacactcagaaagtgccaatagttgcatcgatttgattgtatctgctacctcattccctctgaaacacctgcaaataaaggaagatcggccag

SEQ ID NO: 782 - DNA, 761 bp, Homo sapiens
cttcagtccttgtctttttgccgaagttccaacaaaaggcccgaagaggagtcccattggcctggcccaggtcatgtgcctatctctgaaccaatcatggagaccaggggaatgggaggttctgatcggcggcacctggatcatgtgactgccctgcggcaggaggagaggccagtccaaacggagacacgtgacctgaggatggaaactgaggtgcagagagtttgacccgcccagcgtcagccagccaacagtagtggattggggactgaagcccgggcagcctggctgcagactccttgagcagtgtgctgtgccacctgtctacgtcaatggcccatttccttgaaaaatatcttgggagagcagagacggtgcccttctatggtccatcagaggctgcagcagaaatcagcaaaaggcgtcacacctaacagcatccacaatcttggtgggagcccttgcacctgcctgcacgacctcctcgatgagggaagccactggcctctccaagagccataaaaaagaccagcccagtcctcaaatcccaaggagtcacgtggacaaaggctcttttcatggccagtttatttgaggtctacaaactcaatcttgttttatttattcatctttaatatagactctctgttttatgcaattaataagagatttccatttcaggttagttcattatacattatgaatttacaaatgtcaaggtgatgatcacaaatattatccctcagtaaacggatacgttc

SEQ ID NO: 783 - DNA, 925 bp, Homo sapiens
cttcagtctttgtctttttgccgaagttccaacaaaaggcccgaagaggagtcccattggcctggcccaggtcatgtgcctatctctgaaccaatcatggagaccaggggaatgggaggttctgatcggcggcacctggatcatgtgactgccctgcggcaggaggagaggccagtccaaacggagacacgtgacctgaggatggaaactgaggtgcagagagtttgacccacccagcgtcagccagccaacagtagtggattggggactgaagcccgggcagcctggctgcagactccttgagcagtgtgctgtgccacctgtctacgtcaatggcccatttccttgaaaaatatcttgggagagcagagacggtgcccttctatggtccatcagaggctgcagatgctccagtgcacacagaagcatccatcccacactgcagcccttgagggcatcgtcacgggcatcatgtcaagtgcctcagccacctaccttcccaaggcatgtgcttcagtcagcactttgtcagaatcaaccacaggtgatggtgtggctgattcgctgtgatggcactgcatgctatgggtcactggtgtcccatttcacatggtcaaaatcccagcatggcactcaactccaaaggcatgacgagtctccaactcccactcctggaggtctgtatgtatctagaaccactttcttaactagttctgtatcagccagggtccaatcaggagaccctgactgattctacattggtaatttgaactgggacagtccaatatatagaattattgctgggcatggtggctcacacatgtaatcccagcactttgggaggccaaggcgggaggatcacttgaagccaggagtttgagaccagcttgggtctctacaaaaaataaatccagtatgcgcccag

SEQ ID NO: 784 - DNA, 619 bp, Homo sapiens
gctggccgatcatctttattttgtttaattggcattggctgaacatttgaaaacagtggagatacaatgtcaattcaaaacatactgactttttcaaagattttcacagtgcaaccatccttgcgacttcttttccagacatttgtgattcctcaaccaagatgttgtcatcaaaaatgtaaaagcctatgaaaaattaaaatgactttggtttggctaaggccttcagctggaaaaatatcatcacatgtcttcacttctcttgcatgtacggaattgtatattttggagatctttcttttcttatttttgactaaaactatgtcaatttcaaaggctccagctgcctttcttctgaaggaagtactcctgatttttgtgtgtcattgttctcttctgttataatgtggctccttctctaaaccagaggcattcctcatcttttcttccattccatgaaacacaaactaaacttctagcggccattgcctgccatccagaaagtgatctggggacacacctcatggagaaacggcaagggtacaaaggttcctcaaaggcagtaaacaaagatttcaggagttcattgctggttgcttctgatccatgtgaagaatca

SEQ ID NO: 785 - DNA, 221 bp, Homo sapiens
aatgtgctaaattggttcatgtctttattaaaacttcctgcctaagaagatgttatcatcatcttacggacccctgaacgtagaagtttgcattgaagagttcatatgcatctccaatttatcaactttaacttcatcttaattaaatcgagatttctttattttccccctgctgttttaatgagaatatgttctgctttctgaaatacaataaagcgaga

SEQ ID NO: 786 - DNA, 914 bp, Homo sapiens
cacacctcttgacatggaccttccatcaaggacaccaaagtgctttagaattttccagtcttatttccggggctggcggtggtatttgctcagttagtgagctagaagctgtgaggcctcacccacattcccttttctgggccagcactccaaccccagccgccagcgatcaaggctgcctcttctctgggatgtcatccttggctggcaggagccagtttgctccaggtttttgctgtcctgcccctgcccccatgactgatgcagaggcacagaaggggcccctgtatctccggaggggtgaatctgccagggacacctgctgcgtgggacaggctgagaccagacttccggaaatcctccccggtcagctgcatctccttccaagctttgcttccctactttgccttgcaggtccttccagaagagcactccccatcaacccgcgggcagctgaattccacctcagactctgctccaagggcgccgtgtctacggaggcgacgctgaggatggcttatcaggttgggtcactcaccccaccacgaggacctgaccttaaattctcggtgcatcccaagtgtgacccagacaccggctgcgtcagaagcacctagaatgctgtggaagcaccttcgatgcggatttcttgggcccaaccctggttccactgaatcggggttagctggtgggcccaggaattggcattttcaacagcttccaattgtacaccagaaaactcaagcttgtgactcccctgctcactgtttttttcatcctttttcacttcctggtgaggacaaatggattttactacttttaaagaaacttttccaataaaggcggttttgaaagtgaaaaaaaaaaaaaaaaaaaaaaaaaaaaaaaaaaaaaaagaaaaaaaaaaaaaaaaa

SEQ ID NO: 787 - DNA, 607 bp, Homo sapiens
cttgccgatcggcttttatttgatgaccatagaattgagaagtgggagtgtggctcacaaatcaaccattcaacttgtaagagcttggaagccacagatatagggcatatttaagaaaagaattgggcattgagagcaaggggaggaatattcatatcttttcttggaatgaatggagaacttctcagaactggtgtgtcaccttcctttttgtccctttatggtttcttccaatcattgtcatggtgattgttaactgtcatggcactgctgagagtgtcatttaacatggaaattagattataattaattttgaagttcttcaaaggtcaaatgagctgccatcttggattcccccatgagcttcagctggtttaattatgaggggtatcttctgatggcaggcctcctgtttctcagttggtaatgcagaaatcacccatcttctgtgtcgctcatgctgggagctgtagactggagctgttcctatttagccatcttggctccacccgagattttctcctggttgacacctgttttcccagcataattgtcgcatcttctttcactcttaattgctcccgtttgccaataatttatgttggtg

SEQ ID NO: 788 - DNA, 545 bp, Homo sapiens
cacacctcttgacatggaccttccatcaaggacaccaaagtgctttgggacgttggagtttggatcttgctcatggctggcgaagtgtttagatccttttggatgtccttccagaagagcactccccatcaacccgcgggcagctgaattcccacctcagactctgctccaagggcgccgtgtctacggaggcgacgctgaggatggcttatcaggttgggtcactcaccccaccacgaggacctgaccttaaattctcggtgcatcctaagtgtgacccagagaccgcctgcgtcagaagcacctagaatgctgtggaagcaccttcaatgcagattcctgggcccaaccctggttccactgaatcggggtcagctggtgggcccaggaattggcattttcaacagcttccaattgtacaccagaatactcaagcttgtgactcccctgctcactgttttcttcatcctttctcacttcctgctgagtacatatgtattttactacttttagagatacttttacgataaaggcagtcttgaaaa

SEQ ID NO: 789 - DNA, 574 bp, Homo sapiens
tgttatgaggctaaagtgagatatttgtatgtgaaagtgcttgggatccacacattgccataaaaagataagatcgccacatggtccctggtgctaacttttgataaagagcatgtgcttaaggaacatgccaacgtgatgaaggcacctgggcttgcagcctaattacctggaataaaagcagaaaattctatgactctatcatgttgactacccatcatgaatcacaggcattgattgtggaaccgaggttttgatgaccagcattttaatccagatcatcatgatcaagtctgcacagacaatgggcagaacacagtgttttaggcagataaaatttatggtggcagttttcaatcttctcagagcaggtgtcagcaactatagcccctgggccaaagccagcccgcccctctgtttttatatattttgctagctaagaattgcttttacatttttatatagttgaaaaaaaatcagaaggatattttatggcatgtaaaaatgaaatggaattcaaatgccagtgtgtatgtaattctcaataaaatcaataaattgagtatccgacaag

SEQ ID NO: 790 - DNA, 968 bp, Homo sapiens
cttggcgcatacatctttatttctttatttatttagagattaagtctccttctgtcacccaggctggaatacagtagtgccatctcagctcactgcaacctccacctcctgggctcaacaattctcctgcctcagcctcctgagtagctgggattacaggcgcccgccaccatgcccagataatttttgtatttttagtagagacagggtttcaccatgttggccaggctggtctcgaacttctgacctcaaatgatccacccacctcgtcatcccaaagtgctgggattacagatgtgagccaccatgcctggcaacacctttattttgttttagccacacaactgttttgaaggcagggctaaaactattaatcccattctacagaactgaaaaatgaagcccagagaggtaaagcaacttgctccatgtcacacagggaggaagtgactgaatcatgattcaagattagtctcttgacaccttgttcctggtgcctcttctaatcagtcccattcattctttcattcttttatttattctaaccatcattatcattgggtgtcactcattcaagcaggagcttattaaagcccattctgggccacctggtgctgggaacctggagatgaagccgcccttctccctggcttcgaggagtttctagggaagagagcccatgagtagctcctgattagctcaggacagtggcctgggctaggtgatggagatgccaactgttctcttgggtggggtccaagccagcatccctgagaaggtgaggcagggctgggccacctgaggaggtgcaggagtctggagtcatgtggccagttccaaccaataggatgtgagcagaaagtgactgcatctcttctggactggagcagttaggagccaaggtcctctttctgtctctctcctctcctgccgcggtgatcttagaggaatatccactccagaaaaca

SEQ ID NO: 791 - DNA, 655 bp, Homo sapiens
ctggagtgcagtggcgcgatctcagctccatgggagagagtttgaaaggatgaagagtttacatcctctggaaagaagcaaatagaaggcattccaggcaaaaggaactgcatcgagtaaaagcatggaggcaagaaagggcttggtgtgtttgagaaacagtgagtagggcatggtggtggcagaagcttaaagtgtatggcccgtggacagtgacagccggacaagaagctgaagtgacagaacaagttgaaccaaaggaattccagacctgggaaagtggagaaagaattttggggtcagagccgtttaagactttgcctagggcctgggtcttctttctcctaaaggcctcaacccacagcacgccacacaaatatgtcacataacacacaaacaaacatcatatttcacagtaagtagaattctttatcacactatattcaggtgcagtattctagttgacaacgtatttgtgcacggtcaatattaactttagctaggtgcagtagaacctacctgtagccccagcttcttgggaggctgagggggagggtcatctgagctcaagagtttgaatccagcctgggcaacataatgagatccccatctctaacaaaatgaaataaaataataaaaggtgtatgcgtcaagc

SEQ ID NO: 792 - DNA, 770 bp, Homo sapiens
tttttttttttttagctggagtcttgctctgtcacccaggctggagtgcaatggcacaatcttagctcactgcaacctccacctcccggttcaagcgattcttctgcctcagcctcctgagtagctgggattacaggtgcctgccaccacgcccagataatttttgtatttttagtagagacggggtttcactatgttggtcaggctggtctcaaactcctgacctcaggtgatccaccttcctcggcctcccaaattgctgggattacaggcgtgaaccaccatcaggaagaatttctgattcgacttggtctctgtgacacctgaggctcactcctaggcaccttgcatttgttagtggggtttcggtgctggttcactaggaagcacatagtggctccctggatctcctaatccagctgcaacaaatcagtaactgctcccttcttgccatcttctttcttctttccacctttcttcatgctctgtcactggccatgaccagctcatccaggtgacactcaggctgctcctgtctttttcagctcccaactctacctcttgccccactgaggaaagctggtggtcggggctggtgatcatcattgccgtatgctgtgcctccctggtgtttctgactgtacttgtcatcatttgctcagccgggcactgggttctcctcaccaacgttctcttagttcatctccacctacattttcccagtcagctccattttgcagaggaggttgaggttctaaggagttggagag

SEQ ID NO: 793 - DNA, 455 bp, Homo sapiens
caggccaaagccccctccccagagcagacccctagcactccacagcaggatcacaagctggtctctggtcccagaccctgcggatccttgtcgacgcttccagtctcgatcacttcccgatggtttgaatgtgaagtcaacaatccacggaacaatttgcacttactgtttctagggcttttgcagttaaaagtgtcttcagtttccccgatcttcctgcagatgcccctgcagtcagaagctgagtctgtcccttctcccagcagcagctgggtacaggatctaacatcagtctctgcctgctgggcagaagccacagctgcaacgtgctttcagaaaaatgggccaggccaaaggagctccccgtcagtgcttttcagtgttcccagcacaaagataaaattacacttccataggagtacacaaactaaaaataaaatttaaagaaagcgaaa

SEQ ID NO: 794 - DNA, 965 bp, Homo sapiens
tctagacaatgtgaaaatactttcacttcaaccccatgaagatacatagaagaaaatgccagatgaagttccttattgtttctcattcacagaatttatttccactaagttattaaaaaaatgggcaaaagaaagtggaacttcaactgttccttaggacaatacggacttgtgtttttgaagaagcaaagtggaaatgattaggcagcagggactctttgcagaaaaacgtaaggagcaaagaaaaatttctcagaaaaggagatttgaagcacaattgtcatcagttcacagaagaattttgaagttctgtttccagaggcctctctctgcctgcccagagactgtacatcttcagagatgagcaaaactctgcactctgcaaaatcagcaccctctgtctaatcaaaagttaacttggcccaggttttagtttctctgtaagttttgttggaaagtaatataataaatcttattacaagatacagctgattatgtatacattatgtctttggagaaatttgcattttaagaggaaggtcaaggatgccttaattacaaacattgcatttttggttatttaaatagtatctgggaaaacggtgaagatatataggaagttaagaaagatacctgtatctaccacgtgtgaaagattatctcagtaaatagaattggctacatattcatctattataataataccaaaaaagaagatatatatcttcaaagcgtcacaatttttgtagtcagcaaaatgaatggcaaagataatgagagaataaagatacaaaaatgagtatttaaaaatagaattccaatgggaaaactgttaattttaaaaattatatgtaaagatgaggttgctgttaagcattttacaccaatagagatatcaattggaatattttatgtgaagaaaagaaataatgacttaactttgtcaataaagaaagatcggccag

SEQ ID NO: 795 - DNA, 748 bp, Homo sapiens
ctggccgcatctggctttatttttttgttttttgaactttggtgacattgctttttaatcctcattcagacaatgcaatccacataaagcattagagagaatccttttgtatagtgtattttgcttaggtactgagtcaactgtgtatcatcaactctgttgatttaccctaagatagctcttctccattccttttccatgcatatacttttctttgacctgtctaaagaagcctttgttagaacttctctatgtaaggggtgtctttccttgacagctttatgattcacctttatttgactgttccagctttgtatttggccttctgtccttaaattagaggcatatttcactctttttttgagaaaaagaaaattttatagacttttttttgtttatggttcacagatcttgaaactcctgattaaaactttcccctccatttctttggattattacttcatccagtctcattctcttcgtaatttcccgtgaccggactcatactaatggaatgattgtattcctcatcctctcattcatcccccaagaagctgtatcctgcgccaacaccgtacctggtttctggtgtgcctccctactatgtaaactctttcatagccattcaacgacaagaaaagtctcacactaaacccttcggttgacacagacactatataaacgatgtcgtccccccggtcacaagtactcacgcattgggactgggcgtccaaagaacgtctagcgg

SEQ ID NO: 796 - DNA, 151 bp, Homo sapiens
ccggacgcattctgtatttatttatgtgcaggcccatttttggttctttgtttccattgtttccaaagttgtctccgttgatgtatttgtttctccctgagagtctcctgactttgctccttagggcttgtcctggagtttgcaatcatgt

SEQ ID NO: 797 - DNA, 1483 bp, Homo sapiens
  misc_feature (1)...(1483): n = A,T,C or G
ctgccgataccggtttatttttatttctgaggaaaaccttctgttattctatttttttggatttttactttatgattattttcttcattgttacttgttttttgcttattaaaataagcatgctcttggcataaaacttagaagtatagagatgcttatgtggactccgcattgtacaccctactctgggaaggtcacttttgagtgagggtggacttggattgggagacttaataaaaaaggattattggaagtaggaaatgcatgaaaggtagtgaataaaaataaaaataattagcttgatatattcaagagaaactctaagggtttccagacttagtaaagagagagagagagagagagagaaagaaagaaagaaagaaagaaagaaagaaagaaagaaagaaagaagatagatatgagagagacagagagagagagagagagagaacaaggaggagaaaaggcagaattattcaatggcattttcggccctaaagaataattgttaattaatagctannaactgggaatgcccnactcccatttccctgcaatggatgtatccctaggcccatnacatatgcactaatttttacaaaatacaagcagtaatgaacggtggagctgcaatagtctaattagctccaccatgaaggaatgtttaggggaagaatttgggagaagtttgtgatacaaaccaggaactagctcattagcattatctgaaaactgtgaaggagcttctggatactagtaatatatttgcttctcttcttgtttctacaattaaagattatcttcgcttcagtagcattatgtagaagaatcatggacaagaaaaatgcagatgttcattctcctggtgcctttcatggttgatctggatgctgagcaatcctggcaactatatatgaaccatgcttctctgtctttctcatcncccaggaggattgtatctctatgccacttctcctcaaccncaggcagcacatgaaggagagacgtaccatagttcagcaaggatggagaggccccaggggaaacaaacatgtccttcttcacatggtggcttttttcctctcttctctctttgtaaatggataatcgtgtccccacaccataggatatgcccctcagaagcatccctcaaaactgggaaaagtttgattccctcaaacagaggcatctctgaggtaattccagattcatcttggctcccaaaacatctttgaataatctatacaacttcttttgccattcagcagggcatatcagaccaaggcagagggcagcctttgatcagtccttaggccaattgccataagtgtgggtgctggctaggagagtttgacttggaattcactcatcccaaggggctgctctgacatctctgcttcctgtctccagtctcagagttcacacactgtgattgtgtcagcacacaggaggcagatcaggctctagaaggtgtttcaatcag

SEQ ID NO: 798 - DNA, 710 bp, Homo sapiens
ttttttttttttttttatagttttacagccatttatttgacaatggaagaggaatttatgggaccaagcacatgtcaattactgaaaaaaaaattcaaatatgtaagttacatctttcattcaaaatgcaaacactccaacttcatatcatttctaatgctgcactattctaagtgataaccaatgttcaaaatgatcattagaaagtattcctgatatgctgaatcactaagaaaatacacttagtctttctaattacaattgtccttaggcagaaatctagaattgtactttattttcagctacaaggtttggtacaaaataaatgttgttttcccacatttatcttgacaatgaggagtattagcactctgctttgccctgtggcttgatcgttccaggtaatagaagctgtatggaatttccattgtttcaaatggaagcagaggcatcattagactcaaaacattgcagtgtctttttgagcaagttattatccttagtcattacgtccttgtccatctcctttcatggttgggtggctctccttcaagcagtgacttaaaggcttagttttgtttcacccattggctctgccattctcctttatcttgtagtcctccggggaatcttctgtgtatggccggtataccaccttagctataaggtggtcacataattgtattacttacaaggggggttgaaaagta

SEQ ID NO: 799 - DNA, 331 bp, Homo sapiens
ctttgaaagctgtatttgatgagaaaaacctgtttcccaaggaaattctgcatcatgaacgaaaagccaagcaattatgccaagaaaaaagttgtgaagtgaagaaaaataagaagtaattacaacagaaaaaccttcactgttacataaggtacagatataaaatgcagaaaaagcatcaagaattctgccttttattttattttatatttaaacttcaggaagttttctcttcatgggataatttagtactgcttttatctatcatctgtcaatttctctgtattcttaataaaataaatattgaactaaagtgggaaaaaaaaaaaaa

SEQ ID NO: 800 - DNA, 1126 bp, Homo sapiens
acggagatttgctcttgttgcccaggctggaacgcaatggagtcatctcagctcactgcaacctccacctcccaggttcaagcaattctcctgtctcagcctcccaagtagctgggattacaggtgcatgccaccatgagcaggtgaaaaaaccgaaacccagtgaggaaatgtaacttgctggtcaaggtcaatgactaaatcagtcacagagccagtagaaaaagctaagagaccaacaatgaggagctggggaaatggaatcaagcttatctagaagggtctcactctatcacccagattggagtgcagtggtgcaatcacagctcccttcagcctccaactcctggactcaagcgatcctaccacctcagcctcctgagtatttggggctacaggcatgattcactgtgcctggctctcaaccaaaagttcaagattattaagcattgttttacaaggtttgaaatatcctactcttttgaggcattatagttctatgttgctgttattaatagcaattaacataaacaaatatatgaataactatgaatatcttaaaaatgtttattacacaatgtcactaacctcagagatgcaaaaaataatttaataaattatgctttttggaggaattttccatatactttatctccatttagaaaaaatatgtttttaatttgcaatgcaaaacatagctttgattggactgtaccttattttcaacattttcattacactctttgatgctaatccatggcagtttctaagggatttgaaagatggtgaaataggtttaataaataaaagattaagaaagcacttttctgtatcattgttgttttaaaacctgaaactaaagggtgaggtaaaacctggaactgaaggctgaggtataatcagctaaaggctgattatagtcttcaaatatactgaagaacagtttccacaccgaagtgtacagcttcatttcctagcaaaagcagactatcaaaacccagtgaatctggataacagaaggatgaattcaagtatccatttttttaagttgtggaatatttgagtctgttgtgtgctcaaccttgaaaattttttaagaaggagaaaataaaccctgatcggccag

SEQ ID NO: 801 - DNA, 375 bp, Homo sapiens
ctcaggaaacaagctcagggcttccactgattctacattatgaactcgtgtgacttcgacaaccagaaagagctgatggagcccgggattcagaagaagtggactctagtttgggccctgataccagtcagctctaggatcctgggaagtcactgaactttgaacttcagtacctaatatgaaagatggcgttacaacacctgcttgttctagttgcagagcccttgtggggctcaaaggagatgactgatctgaaaagcactttggaatgtgtaatacacatattgaagttgaaaagaggcccagaacacttggtgagaggccaagaataaaaaaatgttaggaaactgtttgcacagtagaaaaaaaaaaaaa

SEQ ID NO: 802 - DNA, 807 bp, Homo sapiens
cagtacatgttgctgatttctcctgatgtgtgaaaattttcacagctgtatgcaagagacattcatggaactgaagagccttttgtccctgacgactaaagtcagaataaggaattcaataaagaataaagaaacccagtttttcctgctctgtgagaacaagactgtgaactttgtagtcttactggctgtaggtcgaaagacaggtaatttagatgtctgtgagcccctgccaaagacaaaacttaaagatggaaaaaaattagtagtgcaacactcacacttataattccgattttttaaagtagtgccgctttataacctgctgatttttttttttttttttttgagacagagtcttgctctgtcaccctgcctggagtgcagtggcgtgatcttggctcactgcaacctccatctaccagattcaagtgattctcctgcctcagcctccagagtagctagaactacaggcacacaccaccacacccagctaatttttgtaattttagtagatacagggtttcactatgttggccaggctggtcttcaactcctgaccctcaagtgacctgcctgcctcaacctcccaaagtgctgggattacaggcatgagccaccatgcctggccttctgagctttttaatattaaataattaagtggctcatatttctcataaattattatttaaaccttccagaaatgtagtcactctcacatttgtgccataaatcaaggatcaataagagctaataatgatttctgtgtccaaacaaaagtacaaacaaataaaactcgatctgcca

SEQ ID NO: 803 - DNA, 324 bp, Homo sapiens
ctccctgtgagcagcctggccatggcttccagctcaggtctggccacacccgaaggctcttcctgaagctcctgtctttaccttggccatgtggaccacatcctgatttgctattttgtgatcctgagtctctttcatggtccgctcaactcctctgctcagattcattaccgggtgataatgaacagtccctccctcagggagttgctctgaagattgcacgtcacagcgcatgtgaggtgcctaacaacattcctggcacatggaaaatgctcaatccaggaatagctaataattatgatgaaaaaataaaataaaaatgga

SEQ ID NO: 804 - DNA, 824 bp, Homo sapiens
  misc_feature (1)...(824): n = A,T,C or G
acttgaaaaccatctctgaaatgtcaccatcaagatgatagtgcccctatctcccagttcctgtgacaggcaggggcctaagttctgcaggcactctcctcaagttgcaacacttctcctgtcataaatatatgagaaatttatttttcctgtgcgtaaatccagttagcaagtgcagatggcctcctgaatgaccaggtgcatctaagacaaactatatgtgacaaatggtgctgtcaagtactgttaacttaagcactagttaagtttatgctgagaacatgtatgtaacgggctgtatctgcctgcctgtataaaagggagagatgtatttctatcttggcaatctcttagcttcacattctggtttactgtttattcaataataaaactatttcctttctttttttaaaaaccnnnnnnaaannnnaannnaannnnnnnnannngnnnnnngnnnnnnnnnnnnnnnncntnnnnnnnnnnnnnnnnnnccccagcccccccccttccctttgggggggggtatttaggaccccccgccaataaaccggtggcacagggggttcgggggggggaaaccgtttaactctacctacaaggggggaactcgggttttcccacgagtgtgggggtacaccccgaaaaaaaatgtgggacaaaagggcccttaagggcccaaaccccgaaaagggccggttgtttgtggttttatataagggcccccccccctggagaaaaaaaaaaattataacccttatgtagggggggggaacccccgctgtanttaangnccnnnngtncccccnnnancccccngnccc

SEQ ID NO: 805 - DNA, 251 bp, Homo sapiens
aagaaggaaaaggaggaggagggagaaaagaaggacaaggaagataagaggatcaagaggatgaagaggagagataaagagaaggagagagagagtgaagagacaaaatctgtggaataggagaaaatatttacaaactattcatctaagggaccaatattccaaagagacaaggaactcaaataactcagcagcaagaaaaccccaataatccgatcaaaaagtggacaaattatctgaataaacctcga

SEQ ID NO: 806 - DNA, 802 bp, Homo sapiens
  misc_feature (1)...(802): n = A,T,C or G
aggctgttgtcatgagaaactccatcgctaatgactataactgtgcttgtgcaactatgacaaagaacttcccccacaatgctgtggctggaatgatgctagtgaaattcaggtggcagttgaagacaagaagatggaaggagaacggcctgagatgtgacaaatacttgcattcaccacatatgaaatttgggatcggtcttggcataggatggcacatgaggacttcggtgttctcccctcctcctgcaggattccagcgagattggaatgatcatgacagctgacacatccagctgagactgctggcattgctcactggcctaacatgaaaacgtttcttttgcctcctactggcatggaggctgtggaacaaacaccactgtgatcacttagggtgctccagggaaggtgccctagatgatggcatggggtctgtcatctctctccctgctgtcccaacaagcacagaggaaggaaccagcaggtgaggggaatccagcctcttagggatgtcaccaagggcctcctagctctttccatgcttccattccaccatccccagcacattgactttcatcctcagcnttcagcctctcaaatccacaaaacgtcgttttttcataaaattgtgcccaaataccaagaagaaaaacaataactttaaataacccgcttattagttgccgngggagaaggcgatgccgcctctttccctttgaggggggttaagtaatgaccttccttattgactcctttcgctgggtgatcgggtggggaaaggggttaacctactcaaggg

SEQ ID NO: 807 - DNA, 812 bp, Homo sapiens
  misc_feature (1)...(812): n = A,T,C or G
cacctcaaaatgtccccaagccatcgctggaactacccgagtgggtcggtcttccttacaaagtaaattccgttgctagggctgccataaccaaatgccgcagcctgggtggcttcaacagaatttcatttccccacagtcctgggagctggaagcccaaggtccaggcgctatcttccaattcagccattcggaggtcttgggggttgaaacttcaagacaggaatttggagtgaggacacagttcattccatacacaaaggcaggatcggcttcatccagaacccggaaggtctgtccctctacagaaacccagatctaatcgtgtcgcatcccacaccaggaatttccgaactttgatgccattacagtctgagagagcatgactgacgcaagtgagccgggagcacaggcaggagcacagagcccagctgcctcccgcaccccctccacccaccccatctacagctcattgcattagcagccgcctctcgcccctctacccacgccatctagagcccactgcgtcagcccagaggatatgtcatttggcagcanagcctcatcacagatagaaccagctcctcaggcaccctcattcctggagaggcacttgacgggcagagcctgaagcagagtttccaggaagacangaaggcccacttccctaggaactggagatggaggtcccgctcatgtgtttctgcgaattaagatgggatctcactatgttgccaggctagagtgcattggctattcacagacgatcatgatgcattctagggcccacatcctcaaactcctgaactcag

SEQ ID NO: 808 - DNA, 836 bp, Homo sapiens
  misc_feature (1)...(836): n = A,T,C or G
cgctatcttccaattcagccattcggaggtcttggcggttgaaacttcaagacaggaatttggagtgaggacacagttcattccatacacaaagacaggatcggcttcatccagaacccggaaggtctgtccctctacagaaacccagatctaatcgtgtcgcatcccacaccagatgggatctcactatgttgcccaggctagagtgcattggctattcacagacgatcatgatgcaatcatagtgcaccacatcctcaaactcctggactcaagtgatcctccctccacagcctcccaagtagctgagactgcaggcacacgccactgcacccagccctggactattaacttttatattttttatatccatagagtcaggcagcttctgatgcatagtaaccatgcaataaatgttgaatgaataaatgtgaatgaccattcccataagaaaaaaagatagaatagacagggtccttcctctcagcatcaangaggtggaanngtcgtcggtgtcccccccgctgtccttaaggggggggaaaatatgtgagcttggcttctggctgcgggggcctcgtccgttgggggggcggggacgggtgtcatcctctcttagaggccgggtgttcgggtgccccccagcctcagtggggagacggcaagaaaaaacctgtgagagcacggcccgccatgccgccggaaccggcaaaacggccggtgtgttgtttttttccacccacgccccccccgctttagaaactacaagaaagggactcgcgtggtaactggcggaaaccccgcagcactatgaaggctcacagccgcccccttcg

SEQ ID NO: 809 - DNA, 1175 bp, Homo sapiens
cacctcaaaatgtccccaagccatcgctggaactacccgatgaagtcattcttccttacaaagtagattccgttgctagggctgccataaccaaatgccgcagcctgggtggcttcaacagaatttcatttccccacagtcctgggagctggaagcccaaggtccaggtgtgagcagggctggtttcccctgaggcctgtctccttcgcctgcaggtggcttcttctccctgtgtcttcacagggctatccctttgtgtctgtgtcctcacctgttcctctaataaagacaccagtcatactgggttagggcccaccctaatgacctcatctaaccttatttattacctctttaaaggcgctatcttccaattcagccattcggaggtcttggcggttgaaacttcaagacaggaatttggagtgaggacacagttcattccatacacaaagacaggatcggcttcatccagaacccggaaggtctgtccctctacagaaacccagatctaatcgtgtcgcatcccacaccaggaatttccgaactttgatgccattacagtctgagagagcatgactgacgcaagtgagccgggagcacaggcaggagcacagagcccagctgcctcccgcaccccctccacccaccccatctacagctcattgcattagcagccgcctctcgcccctctacccacgccatctagagcccactgcgtcagcccagaggatatgtcatttggcagcaaagcctcatcacagatagaaccagctcctcaggcaccctcattcctggagaggcacttgacggggcagagcctgaagcagagtttccaggaagacaagaaggccaacttccctaggaactgcagatggaggtcccgctcatgtgtttctgcgaattaagatgggatctcactatgttgcccaggctagagtgcattggctattcacagacgatcatgatgcaatcatagtgcaccacatcctcaaactcctggactcaagtgatcctccctccacagcctcccaagtagctgagactgcaggcacacgccactgcacccagccctggactattaacttttatattttttatatccatagagtcaggcagcttctgatgcatagtaaccatgcaataaatgtagaatgaataaaatgtgatgcggccag

SEQ ID NO: 810 - DNA, 831 bp, Homo sapiens
ctttgcgatactcatttattttctgagtgtttacctccatgggtaagctaaaaagataaccaagaaattgtgtgttctcccttttgggagaagaaaaacagtaatgatagctattattatgaagcattattgtgtatgtcagcaatgagatgatattcagtacagtaatgtgtataaatcactatattaggtgctttgcaaacattctctcaattctcccagccacctaattgggtgcagggggtattgttatcctcagttcacagttgtggaaattgaggctcagagatattaatgcaagtcacccgggattatgcttccagtgaacttcaaggcctggctgtgtcccgttggtcgtctatgttgcctttccccatgtggcatattcctttttctgttccagtgtcctccccaacccaagtgcctcagatgatcctaactagttatgcagtaacctgtggtggtcccatttcttgtgctcatgattggtttaaggatcgggatgtgaccagtattggacaatgagagatgagaggaagtcggctggaaggcttctagaaaaagcattcctcactatcaaaaagagatgcgcaaagcggcagcttctcttctgctgctggatgttaccgaatctgcatatgatagtaggatgacggcagccaccttgtagcaaagagcagagtttcctccaagagaacattatggctgctggaaggatgccactgctcctcactggcctgaccagaaggcttcagctctttgccacatgagcccctccacaggtttgcctgaatatcctcacagcatggcagctggcttccccctgagaat

SEQ ID NO: 811 - DNA, 816 bp, Homo sapiens
actggagtgcagtggcatgaactcggctcactgcaacctccgtctcctgggttcaagcgattctcctgcctcagcctcccgagtagctgggactacacgcgtgcaccaccacgtctggctgatttttgaatttttagtagagacggggtttcaacatgttggccaggatggtctcgctctcatgacctcgtgatctgcccacctcagcctcccaaagtgctgggcttacaggcgtgagccaccatgcctggctgactttatcctattttaagaagtgcatgctactgcatctctcaaaaatgacttgtgtaactgagctgctgatgaaagcaatggtggccttctataatggttgtcattgattgagcttctacaatggactagtctctggatttagtgcttcatgtaacttatatctaatcttcaaaactctttaaggcttttctccattgcagtgtctcaagaaattcttcacaagctttaaaaagacagaaaaatattggtcgacattatctgactctacggattgtactcaatggaatatccctctacagaggttactaaaagtgaacttattacacatattccaaacttgtgtgggggatgggtggatatctgggtgcatataattggacctatggatatggttgcggatacacacatgcacaagtgaacatgtttggatacctctccctacctggaaatatttcccgggggttttaaaagctggctttaatccctcttaaagaaaagaaagaaaccctttggccgatttatttcaagagaggttaattccaatccacctttacgagggtg

SEQ ID NO: 812 - DNA, 588 bp, Homo sapiens
  misc_feature (1)...(588): n = A,T,C or G
agccagaaactgctctgcaaatggagggtgaagaagcagaaaatgaaagaagataccaagtgtgcccaatctgcaggtgtcaacatctatctaaaatcatctccaattaaaagattcgaaaagatttaattctcagtcaacttangaactcggtgttctaatgccaaactgaggctgttttgtgagttaaaggaagcatagagcttatcattgactataaaaattatgaagtccccaaaattttcttccagtagaagaacaaatatatgtcccatactttgaaaggtgaggaaaacaaaatgattttgattacatttccccagttgggccagctcaacacacaagtcacactacttaatttngctagctctcagctttcttatggataaaagaagtgtgggagaactggtttaagaattaaatatttttttccccgaaaaaagnngaaaaaaatgaaaaaggcaacaagggagaggaatgggtgtgggggacgtttgtttcagggggtttggtgtactnnaataaattcttcccccggccgccccttcccgtaggggggaaaataaatccctcctccgttgggcgggg

SEQ ID NO: 813 - DNA, 753 bp, Homo sapiens
  misc_feature (1)...(753): n = A,T,C or G
acctgtggcacctctacctcccctcttagtgctcaccaagtctctgcagtagtgagcgtgtcctcatctcctgtcttctccctcagctactttgtctgcaactgctcctgttgtgtttgtccagcagtcatcatcagaggacacacatcccaaatgtccttcagtcactttattattaaactgccagctctttccttgccagggactaaaccaggagataagatgatatttatatgctgnaaacacaccctacatatttaaaaatcttcatatttacaaattaaactgagaggagaatgaaaaaagccntggtgaaagactgctgaagttgataaaatggtcaaatggtttttcaactagagatagggaaatagcttacagtaccaaaacctttactttggtctaagggcccttttgttcattggtacaaactggggtaagtcacaggaagccaaaccttgattccagaaagtcccaaacttttggtctaaaatttaactagatattaaaagacctatcccaaattgaaaaacatggaaaaaggaaacagggccctttgttcccaatgggcgcccacatttatttattcttcaatcatccgcgaacccaaaaattttagaggcccccgtgtcccaacccctgccggagtggaagccaaaatccccaatattgttaagagggtcccgcgcctattctagaaagaaaggtagggaaaaacccgagcccccctcctttagagggggataacaaccc

SEQ ID NO: 814 - DNA, 175 bp, Homo sapiens
  misc_feature (1)...(175): n = A,T,C or G
gatctagatttattgaggtgtaattgacatctatatgtgtacataatatatataataagtgatacatattaaaacggggcgggggggggagttttaatacctangaacccatcagcacaagcaaggtggagaacgtatctgttatccccaaatgtttccttgtgctaagcagtgc

SEQ ID NO: 815 - DNA, 797 bp, Homo sapiens
agagaccttttcttccccctgagatattgtggtatttattacccccatggccacagccacagccttggtctggacctggacttgggcctgggctctgggacattccacagcctgggaaatgcactggttcatggaggagaacttgaaatgggacatggaggaacacacggctttggatatggagtgggccatggactgagccacatccatggagatggctacggagtgaatcatggcgggcattatggacatggaggaggccactgaggacaccatggagtggatcacagagggagccaccaaggaggccacggcaggacaagatggctgtggccatagattgggtatcaaaacatattatgggtgggagggggtcatggaagaaaaaaaaataatgatcatgaaataattaaaatggagcataggaagcttcccaggatgtgatccatggagatgggcctggactaggtcaaaaaagaaccaccaaaggccctcaaaaactttactgggttgggaggggcttcaagtcaaagcttctggagtttttccctggtttaagccgtgtggggggaatcaccacacccccctcaggccttttttcttccatttcccggacctaaagggcaacggtttcatcccttgggtcctctgggggtttaatataccccaaactggttaaaaacaaacccctataaatggggcccccccttccctttaggggggtaattattaatcttcttcattacccttgccccggggttgggtggggaagggttatcttctcaagggggaatcgg

SEQ ID NO: 816 - DNA, 712 bp, Homo sapiens
ttccgggttgaaggtggccagagcctctccaacagctcagggctcaggttggaaacagccctgaaaggacaccatcccatctcagggtgggtgcatacccacaaccacatctacactcactcagactgggaccatgtagacagcccaatgaacctaacgtacccatatttgggatgtgagaggaaactggagtaccaaagcaaacccatacagactacggagagaaggtgccaaccccacacaggaagtgccaaccccacagaggaagtaccaaccccatacaggaagtggcccaggccaggaatccatttgttttctcatcaaagttagagccaaaggacaaaagaaggtggacggaaaggatgtgttatttgagggcttgatgtatgttctttcagtttgtggcttgggttttaattttcttcacagcgtcctttgaagagacaaagttaaattttaatgaagttcagtttttcaagactttctttttttttttttttttgagacagagtctcatcccatcacccacactgaagtgcagtagtgggacggcacattgcaacctccacctcctgagttcaagcaattctcctgcctcagcctcctgagtagctgggattataatattggtatatagaaataccctcatattctgcaacctttttgtgaatttcttaggattgtaatcataaccaatcaatatcatattcaa

SEQ ID NO: 817 - DNA, 811 bp, Homo sapiens
  misc_feature (1)...(811): n = A,T,C or G
ggcaattgctggcaccttactttgtccatttggtgatgtcatgcttcccagattgctcttgatccttatggttataagttgatgtctgcccattgaaaaggtaaactgagagtgaggattcttaacactgctttgagcagggattgcaaagcagtcaagcctctgcacactgtgtggtcatgaattacgaagataatttaccaagacagctgcttggacatggcgaaaacagtttcctattttatgattattgtgtcatgctctctcaaacatacaagatgggattgttggtacaatttggaggggcaagtggcattggaagcctggtagccttaaagaatgtgagcactggagtggtattatagacacatatctttaatggctgtccctaaggtgtttcagaagggatgcttgtggagagcctcgtggtgcaccacatacggaaatggatatacataggctatgttcaactaaaggtcttatggggcacccaatagtttggagttcctacatgataaccctcacataagcaagagaacttctcaagaaaataaactagtgacaaaaataaaaagagggaaagaggaggactcaaattccatggataccttaatgccccaaggtaaataaggtgtgcaataacggtcagcctattattcagagggcagcaggggaagcagcaagcttggggaaataataataatgataaatcattcaatgtgtatataatttaatgtgtatatacttactgtacaaaaacttttattaatgtttctctttgaaaanncnatnaatcaagtaccagaaccaa

SEQ ID NO: 818 - DNA, 679 bp, Homo sapiens
attgtctcacaatttctgtgaatcagaactcctggctgggtcaggttgtcataagtgcaggaatctcatgagatatcagccgggcagtgatactttctcaacctcagggtcatcttcgcagaattcagtttcttgcagcttcagagctttgatgttggctatcagccagggcccactgtcaggtcctgggggaccccaaggttccttgttccttggccctttcacagatccctctcacaatacggcagctgacagccaagaggagaatccctcccatctaagacagaggcttacgtgatgtaatgtaatctttggagtggctattccattgtattcacagttcctgcctccttccaaagggagaggattatacaaggtgcgggattgagacaccatcagcaactaggaatattgaaaaccatcttagggctatgcttaccacaaagactccagctataatttctttcagctgctgtgacaagatgcaatcggaacacttcctttatgctttcatgctgagactttaatatacctctttcagaatctcacatacccttgctgtttagccagagaaaatacaatcttagttttaaagacttctttaagcatcgcaacaattttgctgttcttggaagaactttatcaatatttcacatgatatcttctctgcaggagaacg

SEQ ID NO: 819 - DNA, 562 bp, Homo sapiens
ttaatatgtcgctatttacccgtatttagggcgggggttttagctgcagtgactctcttattatccccgctcagtggttggtttaggagcatgcatatcgcagttctggacaatgagatatgagaggagatttgctggagggagagattctgagaaggctttccgagccttaagaagaggtagaagaaagggtgttattatgtgaggatgggatggatacctgtggccaccttgaagaccagacagaataaactggggaaagaaccaacacactgaggatcacagagaataaagatggaaagcttctgggatcttgatgctatccctgacccactcactttgcccactctggaagtacctgaatgtttcctgttactttgagacaaaaattccattttttaaggatatttctgtcagtttcagctgaaagcgtcctaagctacagattcagtagaaaaggagggaaattttcttgtttcaaatgaaattttataattgatttaaataaagcccgatgcgtcaaaaaattttctaacaaataataaatgcggctgattattca

SEQ ID NO: 820 - DNA, 730 bp, Homo sapiens
ctgccgatctgggtttattggctataagaagtcacacaagctcatctgagccgacaggttggaggcaatcttcctgtggggaggggtacctgtgaacggtagtgcagtctgccacagtcatcatgacatagctatgaggtagatacaatgactcccattttgcagacaatgaaatgaagtctcagagactttaagacgttcaccaacattcaggcaggtggtaaggagcaatgagaaacactgtgaaagtgaagcccatgtgtagacagattgtcatgatgggtctcgaggctctgtctaccattttgttccccaacagggaactgaagacacatttgatcattttgaacatctggtttaaaggcatacaatgctttggtgttaatcttttggcagggaggcttcacacagattaagtgcaacacagacattttggtgtggcggagtccccaagtatgatgatgtgaagaagaactcgggtgtcctgaagcctttcagcgggagcatccagaaggtacaggcatctcttcctcatgtttactgggccacccagaagagatttagctgaagagtggctcattcattcagaaaattgggtttggatttcacacatcaatgtttgaatttactaagtctccaattttaccacaggagcatccaatttgtgcttgccgtatatctaacattaatggtcaatatgtaaatcccggacttagatgaacatttagca

SEQ ID NO: 821 - DNA, 1049 bp, Homo sapiens
  misc_feature (1)...(1049): n = A,T,C or G
cttgagacttcggtttcgcatacataaagaagatggtaccgtaaaatatgatcaccacagtcaggaaatcaaaagaagatctaacatgaaatgtatttactgccaagaaacaaacagtacaaattaactgaacaatcattcttttgacacatattagaaggagtgcttgcttgaagttctgacatccagttatcttcagtaatgtgtgtgactagaatacaatgaaattaggaatgatggaagcacctataccgcatcgccaatatgtgaagatctacccacgatcagacacacatgcagacggaacctttcctgctgttgaggacatgttcctgagttgaggacactctcccgagctgaggtttctaaaacccctggccaatcaacaactctaagcttaacatcttcatttcatcaaccccagcaaacaagcagtaaagggggcaaaagactactcaacaaagactggaattttaattcagcaatttataaagtgtttgaaatttcacagcaactttgacatttttgtggtgttaatatttttttctgggcctgatactaataccctattgttaggttaattggggattttacagacacttaataataatacattgaatcacatcccctgaaatttgacaattgtttaaaagcatagttagttgttgatctcatagtatcttggtatgactggtcctatgacaggacctttgcccagaacagctccgcatgaatgtgatagtctttggagaatattatatagtgtctttacatattttactctgtagcttaagagtctgtcttgataatttactcatttaaatcaaccaataaaacagtaataatgtttaaatatttcatataaatatgtatacatgtgtatgtataccactttaccatttacaaattataatattctttatattaaccccatttttcaactataaaatatggaacttggccaagattaactaggtagtaaataataaactaagatgcggccagcctctcnnctcgtaaaccccctctatcgtttaccttaacctaac

SEQ ID NO: 822 - DNA, 763 bp, Homo sapiens
ccaatttgtaaggaagaagaatccattgaggactatgcaaaccatccataatctgaagagggtagagtgagatacctgctgtgcctgcactgaaacagctgtttcaagaaccttaagcatctggggaagtcatccagagaaaggccatccactgtgcttttgatctctccacttcaggcactgaagcactgcctgcccatatgcttggagttcttccaatagaaggaagctgtctgaggaaaaaggacatgctacatctatctgattcctattcctgtcacaatcaccacaacaccacttgaccctggaagcagtagagctgattggaggagcagcaggtgattccagattgcagactttgcacatacatggaagggatatcctggtatgtggcaggtgcgactagaatgcatagttgcttagagagttgagtttcacactcataggatccctcccctacacctgcgagtcacatcaatacctccctgacctttccaatcctacataatcacatgagtccccctccccccttctcccctccccttccgccacctcattacccttctaccttatcaccagctccccccatactatactccgctctcgtcccccctccgcggtcgaagcacctaagtctccctacaccacctactggacggctctattaccgctgcacaatccacacaagaacatactactaatggccctctcgccctcccaccgcatcttcacactccaccaccatcccctacacatcatccgc

SEQ ID NO: 823 - DNA, 295 bp, Homo sapiens
tctttgtttatttatttcctgattttaggcaaatagggagagggcagacagcttttcttgtttgtgcttcttctcaattcccttcagctcaagataatccttatgccaaagtcgaattctgggggtagcatattctcctgcccttcaccaccaaggttttcacaaggaaaatctctgtagtcccagctacttgggaggctgaggcaggagaatcactggaacctgggaggcggaggttgcagtgagccgagattgcgccgctgcactccagcctggtgacagagtgagactccgt

SEQ ID NO: 824 - DNA, 874 bp, Homo sapiens
tgtttgacttttgcgatgatcagtttcacatatccacttggccagtcgctggtacccggttattccatcaaacactaaatcagattatcctgggtgagactgattcaatcagctgaaagacctcaggagcggaactgaggcttccctgagaaaacataaattctgcctatggacagcaatttcagttcacccctaaaatcccaccctcctctttctgatggcctgtgctgtggacttccgatgtgccttgccagcgcccacaatcatgtgcagcaagttgcctttttaaaatgtgcactttggccgggtgtggcaactcactcttgtaatcctagcacttcgggaggccgaagtgggagaactgcttgaggccaggagttcgagaccagcctgggcaacatcgtgagaccacatctgtacaacaaataaaatttaaaaaaatattagccaggcatggtggtgcatgcctatagtcccagctacttgggaggctgaggcgggaggatcacttgagttcaggaggttgaagcatcagtgagctgtgatcatgccaatgcattccagcctgggcaacatacaagatcctgtctcagaaaaacaagtacaacatacaccttctcctctgttgtctctgtcataggaactaaccgtgctgtactctgtgctggttatgggtctcactctttatttcctttccctccagccatgcaaagccttttgcgctattctgtccaagttgcagtcagcaactttagtgcacaggtgataaaattacatcatatttcaggtaaaacaatcgcatgattttcttgagttccttaaaccatattttggaagaaatatgaagtctaataataaacccagtatgcggcca

SEQ ID NO: 825 - DNA, 598 bp, Homo sapiens
attttcattgaggtacctgataaagtcatcacaaaagtgatgaaatcactggctgagttttagcgtcagtatttacacaggatgctgtaagcaattagagagcactggcacctgcgtgggacatgcagtcttgcttccaatcagttggaacctcatctcataagatttcagaggctgccctgttctcagtttttattgctttgtggaaaggattgctgatctgcttttgctttggatatctaataaaataccaactgtgacattaagagctcgaaccacaaagatggatgagacgtgaaaacttcttcaaggagttgagtaagggaagcaacatggaaaatgacatgatggattgtatcacctactctcctctggatgccacttacatagacatatgctgtccaggacagtggctacatatggctatagatgcttgaaaatgtggctcatttgaattgagatgttctggaagcaagtacaaaatacacaccagaccttgaagacttaataggaaaaaaagtctgtaaaatatctcattaatgttttcaatagtgattacatatcaaaatgataatattacagatgtattggtataaat

SEQ ID NO: 826 - DNA, 707 bp, Homo sapiens
ttttatctctgaatgaaggcatcttcttgtttattaacagccacaggtgttctgagtccatgtcttccaggccagtgaccctgattgtaaaggtcactttacatactgtcatttcatgacttctggctttctcatgatggattaaaacaacaaaggaatcagaaagaaaaaaagggagggggagctgatgggaggcaaactcaatgagacattgcattgctttttctgtagtctctggttcctggtgagaggtgagagcagcatcctggtggcctcctgtagagatgggggctgtttggccgaatccctctctctgcttgatcagctcacaaagagcttgtgtgcgctatgctggtaatccagctcatctgtttcatctgcctccttctgacctctgagcaagctcttcccgctttatattctgtttgccagagttttgtgtggtgagggagttctctttgctttccagttttgccctctgctttctgtgccttgggtgatccttttcatccctgctgtaccactcttggcctctggagaggggatgcagcccgtagatgctaggatcccccccctgcgctgtacaataggctgtctgcaagctgaggagaaaggagcaatgaagccagtccaatcagtcccaaagcgcaaaaaatgtattcatgtcagtggccgccatcagaccgggaaccaatataaaatcttgg

SEQ ID NO: 827 - DNA, 861 bp, Homo sapiens
  misc_feature (1)...(861): n = A,T,C or G
ctgggctggtcttgaactcctgggctcaaacgatcctgctgccatggtctccaaaagtgctaggattacagatggagtcttactctntcggctcactgcaacctccacctccggagttaaattgattctcctgcctcagcctcccgagtagttgggattacaggtgactgacaccatgcctggctaatctttgtatttttagtagagacagagtttcgccatattggccaggctggtcttgaattgctgaccttgggatctccccgcctnggnctnccaaagtgccaggattacaggcctgagccactgcacccagccaatattgtattntttcttgctatggagnctaactctatcacccaggtgggagngcagtggngtgatctnggntcactgnaacctttgactactgggctaaaatgatcctatatnctnanactactgagnnnnnctgggactacaggcgnntgccnanatgttttgtttancnggntaactcttttttntatntggttccttgancattttttannanntntaantggananntttatgncatgnnnaatncnnngnananccattnnnccntcncttntcncncangnacnnncntnttttttncattnttntncacaaanangnngactntntttggnatnctntagcngacccttgncacntnantannnattgagnnntnttatnttattntcttntnncttnttnagatntctnnnngtcnnacncnttgnatnttttnnnaatccctgntaanatttattcnnntnatttantanagataanacctntntatatttgntananatnnnntantatncnnagtcnatanancnngagaa

SEQ ID NO: 828 - DNA, 679 bp, Homo sapiens
tttattggctgataaagtgattcttagtgggatggggaaaggggaagaaggtgatctttccttgaagccacactgtctgaagttagctgcatctatccatagtctccaatgctcagttgttacttctttgttcgctactcagccgcgtatatgcccaacactcagcagcttgtatccctgatgctcagccatttgtgttgctctgccagctgaagtccttttatgggcacaggataaggggtggcaggccaaaaaggcaacatttgggcaggagaaacagggccagctgttttcacttaaggttgtggttccaggcctaagagtggggtttattctggctgttctgtatcatttccccctctgaagaggcacatctaactgccgttagaatatagatgatgactggtcttagctacttcctgctaaaaggggacgttgtttggggaaaatcgcagtcggattcctctaagaggtctgcccaagggtccccggcaaaaggcagccatcatccgaggctccggctgcctgcacatttgaagtctcgatggcctcgtgaatttgcaagtggagggaaactggcttctaacacagtgatggagggaggtcagttgaaactttaccagcaaaaatcattttcacatctgtagcggtggatgttaagagagtcgttgcagctatc

SEQ ID NO: 829 - DNA, 890 bp, Homo sapiens
cggccgcatctccatttatttacatttaaaagaatgagaaacaatccagaggcttcctttacatttcaaagggttgtaacaatttagggaccgtctcctcccttcccagagagaattccttcacattagacagtgatgacttctcttcccctctctagagggaggagggttggcggggctgctgagaggcacttcatataaactcccagttacacaatttcaggattcgtcttatgcagcgacccctttgcatgtgcaggctgacatctaccttcacagcacggcttcaaaggggaaatagggagtggggagccagtgctgttattgctgtacataaaacaatcagtctgttctctgaccccgaaatcttgtatgttctcccaggataaaataaataaacacagataataaatatttatcaaggaaacaggcgcagtggtgttagacagaaatcttattattgaacagcacagtggcgtgtgcctatagtcccaccgatttgggaagctttgcttgagcccaggagttgaggctgtagtgtactataatcacatccgtgaatagctgccacactccaacctgagcaacatatagaggtcctgtcccttttactggacaaggtagagttacggctactggaggtgacttagatatacttcctgattttacaatctcttttgtgaacctgtgttcttttttcagtagttaattgcgggaggtgcagagcagaggcacaagttgctgaagaaggatgtatggatctcactttcatctgacccttcgagcagtatcatgacagagaaatagattttaggcttttctctcttgcttagaacatatgaacctgtaatccaatacagcagtcttctccaagtttttatcatcaattt

SEQ ID NO: 830 - DNA, 870 bp, Homo sapiens
ctccttctaccaccggacgagattacactcccattccatctggccgcatcggtgtttatttaaataaattcagatagaattagtatgactgtttcagggcatgttctagaaagggcatctggagaaagacagatgttctctctttctctcatcaagtgagagagaaagacttagtaacatttgcaaagacaatttgtgtaggaggcatgtgtatcttgaaggaaatattactttcaaaaatgacaggagtgaatagacaatatcatttttgtgattctggaagtttttacaggaggaatcctctctgaagaacaaacatttactttattttatattgggttgataaggacaatcaatgatttcaatcgagaaaagttttatgtgctaaaaattatggaaagaacttcatgggatactcagttgattaaaaaatgcatacatctgccttgaggatgaataaactttattttcctggaacaacattatctaggggacacacatattgtcttgagcttcctctttttgctttgtcaagtgcgttccttggcacttgacaaataaatgaaaataactataataataaccttgactctacacagtccattttatcaagaagctgtatgagcataaagcatacattctccccgttcattctgccagtcaggcagtgaggctggcctttaaataagactctggtgcatttcaatttgcaggcaagcattacttggtgttgggaatgctctccaaaattaagactgcaggtcctgtgctttttctcagcagccaactggacagggaccactttcatcctttcctgctaaggtttgggtccctgaacattgtttgcaactgaggattctgatcgctcag

SEQ ID NO: 831 - DNA, 553 bp, Homo sapiens
cccccagcgcacagtgaggattatgttggatcctgaggatggagtatgagacaaaaatggcacaagagcaccattgcccgttgagtttggtatatctggacgcatcatttttttggtctggcccaaagaacctccaaatcaacatcctcttgttccacctgccagccagaattacagatgccagtggagaaggtggtggagccaaaagaagatcggagcctggatccctgagtcactgcatggaaggcagctgctcaacaaccatgtgagctggaaaacaacttctattatgttagccatggagacttagcagcgtacctgtcagttccagtttgcctgtaattgtcctggttttagcactgaaagtcctgcttcctggggaacccctcagtcttaggcaaacctaaatctaatcaccctagatttggaggtcatttggtatagcaattgagctgccctgactggtgtgtgacttataagatcacacaccaatcttataagatgggtattactattatcctcattgtgtagataataaaccaggatcggccag

SEQ ID NO: 832 - DNA, 883 bp, Homo sapiens
cggccgatctgtgtttatttgttcatttacttattcaaaggcattcaacaaatatttattgagcaccaattatatgccaggtcctctgtttgacattggagatgctctgtctactgacaactacatattaataaaaagagtttaataattatttaaacaatttagaaactattttccttcgtttgactattaggtttaaaaaaattttcttggccgggcatggtggctcatgcctgtaatcccagcactttgggaggccgaggcgggcagatcacctgaggtcaggagtttgagactagcttgaccaacatactgaaaccccgtctctactaaaaatacaaaaattagctgggcatgatgacacatgcctgtagtcccactacttgggaggctgaggcaggacaattgcttgaacctgggaggcagaggttgcagtaagccaagatcgtgccactttactccagcctggatgacagagcgagactccatctctttgaaatggaatggatcctgcttatgtccagctttgatgaacagtctcaacatttcacaagtgactttcgtcatccgataggttcagtctaatatgttgtgcaatgcgcctgtttttttttactgatgtttgaaacttttctttactctgggagggatgtgctgccgtggtgaatagtgggtcaagtctggaaggattctgaagaatgtgttagaaaaaggctaattttccttggaggtctggaacggatttcatctgcatctccctataatccgggctggttctttttggctggcctttcttctttctaaggttctcttttggcctctttccaccttttctttttcttttagattccttttttcttttctttcggatccttctggaccc

SEQ ID NO: 833 - DNA, 637 bp, Homo sapiens
ctggccgatctgggtttattttcaggaataatgtggggaagttacatatcttataacctccggaataatggctggccttcatttatgtctgtgccttagcaggactcaggcccctctcctcccccaagtatggaggcctcccattagctttacaaaagcagttgagttttgggcaaggcctattatcatttacactgtcgcctaaatgtcttccaaagttagcccagcagcccataaataattaagggaaaggcaaggggtggggagagttggcttagcttactgttataatttgtctcactgatataatttttgcaaagacagtttcagagccagttctcaaacccaggtctgtctgattcaagctgtgttctaaacaccaatgttctaaccattttatttctttctgagcctcaatttctttactgtaaaatgaggcagtgcaacagatcataggacttcacaagtctttttcagctctggaagaatatgaatccaacagtgcagattggagtttaggatggagcttgtcttccttgccttctgctctttctgattctctctggagagaaaggagctctgtcttcaagttggaaggattgtcttatgaaggagtgagctggatcagtctctgagc

SEQ ID NO: 834 - DNA, 406 bp, Homo sapiens
aaactacaagacagtaccacacatagaggcaatctccaaaactgaactaataacactcatctgaaaggctgatgatcgtcactacaatctgacagctactggaaagaaagtatttcttggattttgaaatttaacatgaagctaaatcgtctcttcaggtataaatcatttaatttgccaaaagaagtccccaagggtaaggataaagacttgactctctccatacaattatataattattttccagagactagtttgaaattgcaaataccaacaggaactatttaagaatatgagtcattgtctccttttcctaagatttcctaaaatgtttccttctccaactcagatttctaaactttcaaaataataattttttgaaaactgtataattaataaaacaaga

SEQ ID NO: 835 - DNA, 624 bp, Homo sapiens
ttacagctcttgaaggacctttttgaatacagtatctgcagcttgagacttctgttctgacaaaatccaaaagtaaccaagacaaaggtaagaaggggttaaatcaactgtaagccagactttatctcacagaacccacaaaaataagtacaaatacttcaatcttctttcaggaaactacaagacagtaccacacatagaggcaatctccaaaactgaactaataacactcatctgaaaggctgatgatcgtcactacaatctgacagctactggaaagaaagtatttcttggattttgaaatttaacatgaagctaaattgtctcttcaggtataaatcatttaatttgccaaaagaagtccccaagggtaaagataaagacttgactctctccatacaattatataattattttccagagactagtttgaaattgcaaataccaacaggaactatttaagaatatgagtcattgtctccttttcctaagatttcctaaaatgtttctttctccaactcagatttctaaactttcaaaataataattttttgaaaactgtataattataaaacaagaattcatatcgtatggccaataaaaaagaaaaaaaataaaaaacga

SEQ ID NO: 836 - DNA, 582 bp, Homo sapiens
atggttttccttggcatctgattgggtcctttctgggctcatcactattgagaaaggaagactgttaatagaaaagatggttgtagtcgtggaaactatagttaatagcaatatattgtgtacttcaaaattgctaacaaagtaaataagtgttctcaccacaaacaaggaaaggtcacccaggcctctcagaaagtatcaaagaactgaaactcaccagatcactgcaccaaggcaatgagatgcaaaatccttcattcatcatgattgcttcctggccccaccatagttcctgttttcttacacattgttacatttcttctctgtcatgtaaacccctagttttagttggccagggagatggagttgagactgatctcccatctccttgagtgcagcacaggattaaaggcttccttggcacttccttagcattacttttcatctcagtcgttggctttctgtgtggcaagcagtagaacctagagcaaactcctggtgttttggtaaaaaatgtggtaaattaaatgattttgactcttacaatattaaaataaacttcatttgatcacggtgaaaaat

SEQ ID NO: 837 - DNA, 838 bp, Homo sapiens
ttcggccgctcgcgtttatttaattattcttgggtctcataatactattctcaccagaagccgaagcagtcagaactgagtttgatttaaaacaaagtttcaaaacaagagtagctccaaagataacattctggaaagaactactttcctagagaacaaaggcgagatcatctaataaattactgtcattattacttatatctgtgctccctccacatcttcaagatatgggagaattccagaagagtgcctgagggaaggctgcaagccatgagagttctcagtactggttgtcagcaatgtttcaactgcggctggcataaactcagatccaatgtcaaaagctagtagatcggcccatactttaagatgcttctaagcctccaaagccattactttcttttttcttacttacagcaagtaagatttctttcccacaaaacagattgtagaaccaggagggtcagagcccatgtcagacggtccctcagtaagtcactgtttccccgcgagggttggtggaagaagtgctgaagagaacagtgttgttgttgttgtgaaaatcactcctgaggaggataatgtggggaatcccatctcctccatgccctgcatggtcctgcaggttgcactttgattttgtcctgtgtcattattggtcacttccctgggaagcagatctgttcgaagggaagccaccacatcccagatcctcacctcgtgcatggccaaggtttgttcccctccagtggaggctgaagggtttttccagcctggtccgcctgttcctggctggtacagatggaggacccagaggctacaattaatttgtaagttt

SEQ ID NO: 838 - DNA, 256 bp, Homo sapiens
  misc_feature (1)...(256): n = A,T,C or G
catgccccctcttacccttctcaacctcactccgcacgcccaacacgcgcgcgacgcgatcttcggtttgtgctaaatccaccaactatcaggcgccggcccgctttcttttttttcgcgcgcgctagcgcacacgccccgggcacacaccccgtgttcgttattggccactaacacccccccctcatggggaaaccccaaggttcgggtttaggggcangggcccacccccaaaaacaggggaaaccgccagtgt

SEQ ID NO: 839 - DNA, 1224 bp, Homo sapiens
ctgccgcatccggtgtttatttgatgttttcttatatttgaccattgatcatttcatgtttcagttcactattttgacttgctcttcatgagtaaagagtgaagtgttaaatggtgttactcaaggattatcacttagatttaatcgaccttgctaaacatcacaccataaatcagaggatctttcatttctccattctaccaaaaaaaatgtgtcagagataatctctgatttttactaaggcagtttaatttaaaatcacaagaagatatagaggttcttatgaaaatgttttataaaagcttattttaaaatggttcattttctataaaaatgtttatagatctttaacagatagtctctagggaaacaaattttttcttgagtctattactttttatactttcaggtaatttggtgtcattttcattcaatgtaaatttttgagggaggagtaatcatagctgaagtctctgaaaaaccatccagttgttaaaaaccatccagttgttaaaatccagttgttcatataagaagactaaaatttgccactttgtgagtaacgcaatgatgaatggacattcaagttagcataccgtaggtataatggtcaacataaggattttctttctcatggccaagcctttattttgcctattattagagaataacaaagtcgaacggggcccagccctaacaaagacagaggacatgggtttgtggcaggaaaaaataaagcaaaagcaataaattttgtccaatccaatttttcttgtgttcatattcatgtcatgcaaataatgaggccagagttcttactttctgaatgcaatattaaattggattgcatatatcttaaaattaagtccagcttaaacaaaaataataagtaattggaacaataaaaaagtcatcttataaaaacatatgaagtagaaatttacaaactaagatcccatacacatataaagaatggacagatgtctgcaagagagtttttttctgaagggtctttatagtcttgatgatactcagaagagttttcttcatctactccacagtattccatcgagttcagaatattttttgactattttctttttatatggcttggcagttgatgctgattcctgactgggagctgctctgggggtgttcatggaagtgcttcattttctttcacatttcttttgtatgtggcttggacttcttacagcatggggg

SEQ ID NO: 840 - DNA, 1157 bp, Homo sapiens
  misc_feature (1)...(1157): n = A,T,C or G
ctgaatagagtccctctgaagtttatgtccacctggaagctcagaatgtgaacttatttggaaaaagaatctttgtagatgcaaacaagttaagatgaggtcatactaaattctggtggagcctaatccaaaaaccggtgtccttataatttaagaagacggaaatcttgacacagcaacacataaagaagaagaccaagaccgtatgaaaatggaggcagagattggtataatgtacctacaagccaaagaataccaacaattgccagcaaccaccagaagctaggagaaaagcacgagatagagtctatcttataacctgcagtattaaccacgccttctgacaccttcgttttggacttctagactccagaactccaagataatacatttctgttgtcttaagccagtctgttcgtgggaaattatgacaactctaggaaactaatgcgaactttggtatcagtttcttattgtatcattcccataggtacatcttcctgtgaggcagattctaaggtagatatttatatgcgggatttaaaaaaaaaatcaacattgtaggagactaaagaaaacaggagtggccagagagacaccctggacattgggctttggtacnggtcacaacaaaggagtcatttaatcccacaagcagctntggagtaggatgacatttanaattttctcacattaaggaagagtccaggctacatcaactacttaatcctagaagcttgagcaaatgccgttcttcagtccttaaagaattagggaatctgagcagcagcaatgcatctagtgaagtccacactatgcactactttgattcatttttttatattatttctgggagcaattccttcaagattctggtggtactcttttcctgagataaatttgtaagaggactgctagtgggatacattacatcttctgcagctgcagctgatattgagactacaattgatactcatgatttattatttatttattctgttatccactcatggttagttcctctgaaatcaaacaattcagaccataatctgtgagagactttagcccctagtcgccatgttcttcttgggttgtggctattgcacttgttcttatatcatttaaatgagagcaaaggaataaaaaaggatcggcag

SEQ ID NO: 841 - DNA, 380 bp, Homo sapiens
cggccgcatctttatttatttatttatttttgacggttttataatctttattaatgttttttgtatgttcgttcatttgtttgttgttgttgtttgtttgtttgtttgtttttgaggcaaggtctcactctgtcatccaggttggagtgcggtggcacaatcatggctccttgcagcctcaaccatcatgggctgaattgattcccccacctctgcctcctgagtagctgggactacaggtgcacaccaccatgcctggctaatttttgtagagatggggtttttgccatgttgtccaggctggtatcaaattcctaggctgaagtgatccgcctgtctcagcctcctgaagtgctggattatgcacatgagtcaccgtg

SEQ ID NO: 842 - DNA, 579 bp, Homo sapiens
  misc_feature (1)...(579): n = A,T,C or G
ctaagcgtgacgtgactctcttctaaccgncgcaacagaaatgtcagttttggagtatgaaaacggacgctattaggctggtcagaaaaagtgaagcgtactggcaggaagaagactagaggctactgagtttctagaagtgctgtcagctcacaccttatatacgggcacttattggttcatgcagaaagcaacaactactgagttgaacatggtcaacatgctgttcttcttcagagacagacaattcttaggatgataaaatgttagacctggatgggagcctgacagtcacctaattgaacaccttcttttgggggaagaaaattgaagctcaagatgttatgttcccttaatagccaaactggttttcctggaagaagaagaaaaagaaagcggngcaagaaatgttctttgatgtcatcttcctccttgctccagagtgtatgatgcctgcctgctgcccanagcattacacacagattctctaagcattgccatagctaccccattctgcttgggataatgatgtaaaacaaataaaacataagttaaattcgaatttgaaataaaacgtga

SEQ ID NO: 843 - DNA, 655 bp, Homo sapiens
aaatgtcagttttggagtatgaaaacggacgctattaggctggtcagaaaaagtgaagtgtactggcaggaagaagactagaggctactgagtttctagaagtgctgtcagctcacaccttatatacgggcacttattggttcatgcagaaagcaacaactactgagttgaacatggtcaacatgtggaatcttcttcagagacagacaattcttaggatgataaaatgttagacctggatgggagcctgacagtcacctaattgaacaccttcttttgggggaagaaaattgaagctcaagatgttatgtaacagagctaagtctgaattcaagtctcacgagatgcatctaattggtccaacctaattcacacccagaactccagctgcaagggttcccttaatagccaaactggttttcctggaagaagaagaaaaagaaagcagtgcaagaaatgttctttgatgtcatcttcctccttgccccagagtgtatgatgcctgcctgctgcccagagcattacacacagattctctaagcattgccatagctacaccattctgcttgggataatgatgtaaaacaaataaaacataggtaaaatcgaatttggaataaaacaataggccctaaaaaacataaaaaaaaaaaaa

SEQ ID NO: 844 - DNA, 724 bp, Homo sapiens
aaatgtcagttttggagtatgaaaacggacgctattaggctggtcagaaaaagtgaagtgtactggcaggaagaagactagaggctactgagtttctagaagtgctgtcagctcacaccttatatacgggcacttattggttcatgcagaaagcaacaactactgagttgaacatggtcaacatgtggaatcttcttcagagacagacaattcttaggatgataaaatgttagacctggatgggagcctgacagtcacctaattgaacaccttcttttgggggaagaaaattgaagctcaagatgttatgtaacagagctaagtaataacatatatataaattgatcagttagaaaaattacatgatcatatcaataaatgttgaaagtaattttatgaaacccatactaatttgaaagaaaagaggctgggcatggtggctcactcctgtaatcccagcactttggtagatccgccaaggcaggtggatcacctgagatcaggagttcaagaccagcctgaccaacatggtgaaatgccatctctactaaaattgcaaaactagctgagcatggtggtgggcacctgtaatccccgctactcaggaggctgaggctgaagaatcgcttgaacccaggaggcagaggttgcagtgagcagagattgtgccactgcactccagcctggacaacaaagcaagaaaaataaaaaaagatgcggcatg

SEQ ID NO: 845 - DNA, 310 bp, Homo sapiens
cggccgcatcgatttttatttctaagtactatttaaagtaggtctctacctggcattttgtcttgctccttcacatcactgtgtctgctgagattcctggcaggcagggaactcctctggacacactggcatgtcgctgcccaaccagggatccttctgccagcaccctctttttccatctcttgtgtattcggcttctcaagcggcaagtggctgaacttgctttccactgcaatttcaaggcatgagaggtttatcagtatctctgacccaagtcgatccggtgagttaggcatttcattcctgaaag

SEQ ID NO: 846 - DNA, 886 bp, Homo sapiens
  misc_feature (1)...(886): n = A,T,C or G
ctgtcgatcctcttttattgaaaatagacaatgtatctatttcatatgtacaatttgacatgtatacacatatcttgaaaggggataagaaggagcatactagaaaactttaattttctactttaaaattttgtttttaaaaatattggggcagaatagatgtatttttattttaaaaaaagaaatttctatattttaaagaaatgaaaaacttcatggagacagcatacccacaaagaacaggcacatgcagtactaacttgttttcttcttggacacacacttgatttgatagagaaatggcatacatggtgaatttaggtttctgcaagtcatttgacagtttttcctgatattttcaggagtcctagttgctgacttattgccatcatgtcttcatgtcagtctagaggaaagcctctagtcattgcaagaacactcattgaacaatgttcaacattttattagacatttganaatggaataaattccactttgggtaaatttgtgaagaaaacctagtaaaggtaggttagtagtagcactatcttacacttagaaagtttttaccatgcctttatgtaggcctgggatggacctatcctaaaattaatgataaaaatgtaccatgcctttcttaatttagaactaccaccagaataacaaggtgccaggcttcagaaggaatttttggttctcagtattagagggaggaacctattagacttacccggttcccaggttaaaatttgacctcttcccagaaatttagaaccccagctgttaagaagaccttgggaggccgccaaaaagcaacaaggactgggagggggccctttgaaccctttccaggagagggagcttgcacccaccagaacctgatggc

SEQ ID NO: 847 - DNA, 742 bp, Homo sapiens
ttttgttttaggctgcaaagtttaacatccttgaaatatcaactcaaactcttggatcaactgaagtaaagttttcagagccaactaactttataagaataaggacagtcttacaaaagaagctatccagatgcctcattggtgactgcttgaatgaatatttgagtacatgaaaatgtgaagctgttatggacatctatactcagatcaccacaaccactctgaatctaatcagaaatggatatgtttgtctaaatggattgaagccacagcatttccaaattccaaatggcaacccaccctgaaggggcaagagtgtcagcaaatcaaaggctgctgcggcatggaaaggaaaaatgccacccttattatgtagtcttggaaaaagaatcacatgccaatggaatgaaaatgtctgcctgaaattaagaatgcaaaactgaacatagtccagagtttggcatttcttttaagatttgagaaacatgctgataattttaatcctactggaaatgacttaccgtatgacttgggtttctgctaaatatagattactgcagcctggcaaattttaaaataatcaaccaattaagttgcctgaataaaacagttgaaacaaaatgcagctgagaaggagccatttgtcctcagtgacagaccaaatcatgtaatttaaattttaatgatgtatgaataaatccttgcgtgctgacaaggttttaagaagtcaaaaaaaaaaaaa

SEQ ID NO: 848 - DNA, 452 bp, Homo sapiens
ctgcccgcatctcggtttattaatttattaatgttcaattagagaatgttgaaagagctatgctgactcttagaactcacatagaatattaagtaggatacagggataccttcaagtcttttgacaaatatcctgcttcatttctctgaagatgaacttagattacaacatttcttgtctgttattgtagtgctgtcaccattttcattaattggactcagatgaagatttcttatggatgctggatattagaccttcgtcagatgcatagtttgcaagtattttctcccattctgtaggttttctgttcactctgttgatagtttcttttgctgtgtagaagctccccaactcatgaggccagcatctgcccgataccaaaaccaggtcgcggatttgagtaggaagagggcatctgagggggagcgtatatataaagattaaagcaattt

SEQ ID NO: 849 - DNA, 891 bp, Homo sapiens
cggccgcatctagatttatttaacacaggataggaaagtatgttgatttcagtactccctagctatgtgaattttgacaatttttcccccaacttgctttaatttggagtttatagaattaatgaagctaatagatagttgaatgagataaaatgtattagcacacagaacttgatgtataggaagtattcaatataggattgtggagctgtcaccatcagcatcatcagcatcatcttcacatcttcatcttcctcatgactctaatgatgatgatgatatcgtaattgttgtggaactgagcctaggtttgcccacccagctcagcaaagccaaacactgacaccgaggtttacaatgagagaaaggaaggcatttattgcagggcaccaagcacaagagaatgggcagctcctgtttaagatctggactccccaggggcttgcgaagcaaggggtttttaaagacaaggggtacttttaagaaaaagcggaagttacaggccaaatcatgaatttctttcatggaggttacagatggggttggccccaaaagggggggattttttgaagaaaaggcttccggtgtttagggaattcaaaaatttttaatttgcaagggtgaagggaggaaggtttgttaaaaacatgggggcaccaaaaaaaaatgcagggtgtgctttacctacattggttaaaaagggaaccttttacaatcttgggggggctagcgagatgcaggccaagccttttgtttggggcaaagggggacggtttcaaaagtgatggctgagggattagtgggtttccaggtcccaggaagaaattcgaacaaagaccgggttctgttcggggtgtgtgcttttgtttgagggtttggacatcatccact

SEQ ID NO: 850 - DNA, 571 bp, Homo sapiens
ctcgggccactcatgatttattttggcagtgttttgtagtcatttttgtaaacatcttttgcctccttgattagatgtattcctaggtattttgtgtgtgtgtgtgtgtgtgtgtgtgtgtgtggctactggaaatgcctattgcattcctgatttggctttcatcttgatcgttattcatggatagattttggtatgttgtgtctctattttcatttatttctaagaatttttgatttctgccttaatttcattgtatacccaaaagtcattcaggagcaagttgttttatttcaatgcaactttgtggttttgagaggtcttcttgatattggtttatagttttattcccctatggtccaataataggtatggctggcatgattttcattttttaaatatttattgagacttgctttatggctgggcatgtggttgattgtagagtttgttctgtatgcagatgagaataatgtattttttgtggctgttggatggagtactcttcgtctctttttttaagtatgaaatttggtttgcacatatgcaaaaataaaaatttataaaatat

SEQ ID NO: 851 - DNA, 433 bp, Homo sapiens
cggccgcatctgactttattctcatttttctttttttccttcagctttcccattgagatagatcattacacaaagatcttcaatcacccagctttgggctgaatcaggagggaaaggtataaccactgaagcacttgaggtagaagcaaagagcaggagaaggcatgtgccttgattccagtttgtttttctgctgccgtcagttggctgcatagagcagatgtggtgctgtgatatgttttggcaaaggcagggacggagaaagtgattgtcattctccctcagctcgcaggcaatagagaatggatattactgtggagcaactttacccctgagattaccactgtgagggaaaatcgccttgtaatgagcattggatggaaaactggtagtcaaatggaagttgcagccaagcctgagagagtctgaaaca

SEQ ID NO: 852 - DNA, 793 bp, Homo sapiens
cctggctgcaatcagtaatgtttaattgtaattgcatactttttagtatacacattttaaagggtatccatcataaatttttatgttgttcatgagaaaagtggggaaaattccaaataggggataacctttacaaattgtatggaaatgaatggcacaaatgcgtcggccctgcttcattctagaaacacacagcagtaaaattcattatcttacgaagattttcatttaaatgcctatgtgctcagaattattactttttcaaggccttttttcctgtttcttttgttgttgattttgtatcaacatagaaaagaagtgaataactgatccatcaatccaaatatattagtgtctttgagtatattcttggaagttcagggataatgccttgaggcacctgggggtgtttcggctctttgagctttggatggccgccctttctgcgttttccctaccttactccccgactgcttctctccccgggcccccccctctccttagtgacggcgctgcgacgcacccactcgattactagtgttttcaagtcattatctcaagatgtaatatcatcagatacggcatatactctgtggccggccgctggagtatgctgccgccaggctttatttcccaaagcataggtagaatatgcgctgcaccttcgtagactcctcgtggctcccactcgcccgcgctacaggcgccacactatcatgcactgacctgccaatctccattcatccccccccgcctgccaagatcccttgcccagcgcatactcatcttacat

SEQ ID NO: 853 - DNA, 585 bp, Homo sapiens
ggatttaccaggaatggagcttggaaggctggaagttgctctggatgagacagtgagtgagtgtcttctgcacatatggagcaaaagatacacaaattggaaaataaaggtggctgaatattgtgcaaaggagagataccgtctgggagcagcattatttcactctcaaacgttctacttgtaatttaaatggtgctgtctatatgagtcaagttacaggtcagaaaaattaacctcctataaaacaacaacatttattttctaacaaacttgctttcatttccagctatgtcactatatttatgttaaaaaaaaggaaaatatttttctgaactagtgttaatctgtggaattacaaaagataaactacaatagctggcaatagatgttaaaataatgtataatttcactgctaaaatatcaatgtgcatatttggaagtgtttttcttaaaaacaattttagatatttggaaggctctatagcttaaggaatatttattataaaattttatgtcataaaatcattcattttcataaaattcccacataaataaatacttgaataattaacaaaaaaaaaaaaa

SEQ ID NO: 854 - DNA, 281 bp, Homo sapiens
ggagttgattcctggtttggcctggttatcaaagggcacccagacaccaagacaaaggggtgaggaccaagaatgagaacaaaatgagaacacttggcagaggagggcatggaggagttggaggagtggaagccaaggaaagtgatggaaattgaagagcatagcaatgtcatatgggattcctgattcttattttaaaatgtaatcaagacataggcatgataaaacagtattttgtaggttccagcagagagaaagtaaaataaatggagatgcggccg

SEQ ID NO: 855 - DNA, 850 bp, Homo sapiens
gcctgccaagcattgcatctagagtgctttatggatgggacctgaaagaatcaagtgactctttcccctgctggatggacctgggccagcaggtgacagagcaagagtcccactgaactctaaaccatgactttcacctgagcatgttgggttcttcatgtcaagtgaccaacagacaagaagaatcaccatctggaatgggttcttctatggcctgaggaagtcatggtgaccagaggctcagagcactcagaggttagagtctgggtcacaccaccagaagagaaacctaccaggatcatagaggaacagctctcagaaacagtatgaagaagtggatcctagaggtacaaggggtgcaccgtggtggatcctgtgatgagccatcgggtctccattcaggaaagatggactcgtcctcctaggattgcttctggcagacagtcctcagctgccagtctcctttgaggattacctcagctaaagagggtcttctcatccaaggtcatgctccaaaactgatcaacatggaggcataaaggatcataatggaactcataatggaactcagaacatcctgggaaggtcatcccagcttcagaactctccgaagtgttgactgtggtctctgttgaaattgcgtcacagctcaacttgtctatttctgcttccaacttttctcctccgtgggtactgatcccaaccgaatccctaataagcttcctacaaacttatctccttctcagagtctgcttctcagaagacctaactttgaacaactaacaaatgtgcattaccctcactaatgcagttgaatgaatgaatttgtcaaataaaccgggatcggccg

SEQ ID NO: 856 - DNA, 218 bp, Homo sapiens
tgcttgctggaagggacgtgttcactggacaaattaaaaatcacaaggcatggcagcggaaaagaaaacaacttgaggatggagcttactgattagctctgaaattttaatacatgatctccctccttcatactggtgttcacgtttgttactagaaagaaagaaaataacagaaaaagaaaggaaaggaaggaagaaagaaaagaaataaagagaga

SEQ ID NO: 857 - DNA, 373 bp, Homo sapiens
atgccaaaaaagggagtttcaaccagacaagagtttatgagagtgggttgggggaaagaagatagcaaccataggactcggttgtagacatccagaagatggtgcaaaacagtagctgcatttcagcagaagcccaatggatgtggacaacaatggcttaacagagataaatggcttcgtgtcaaacacattgtttcaactttcaggggtgtaaagggcaagtggcttgaaatatatggggctaagacacgtatttttgcccttaagtttaaattcaaatatgtttataattatgaaaataatttgattgccaaattagactcagttcagagattttgccccttattttaatgattcaataaataaacgcaga

SEQ ID NO: 858 - DNA, 505 bp, Homo sapiens
ccttgcggcatactgtgtttatttatctaatcattaaaataaggggcaaaatctctgaactgagtctaatttggcattcaaattattttcataattataaacatatttgaatttaaacttaaggacaaaaatacgtgtcttagccccatatatttcaagccacttgccctttaaatttttgaaagttgaaacaatgtgtttgacacgaagccatttattgtgtgtcaggaaattgcttagtgctgggtctatagatactataaaatatattttcttctcacagaaaacacatcgataatttactgaaaatgatacacttacatggaattggaaggcaatctctgttaagccattgttgtccacatccattgggcttctgctgaaatgcagctactgttttgcaccatcttctggatgtctacaaccgagtcctatggttgctatcttctttccatcaaaatactctcctaaactcttgtctggttgaaactcccttttttggcat

SEQ ID NO: 859 - DNA, 323 bp, Homo sapiens
tcttggtttatttattgaatcattaaaataaggggcaaaatctctgaactgagtctaatttggcaatcaaattattttcataattataaacatatttgaatttaaacttaaggacaaaaatacgtgtcttagccccatatatttcaagccacttgccctctgttaagccattgttgtccacatccattgggcttctgctgaaatgcagctactgttttgcaccatcttctggatgtctacaaccgagtcctatggttgctatcttctttccatcaaaatactctcctaaactcttgtctggttgaaactcccttttttggcat

SEQ ID NO: 860 - DNA, 592 bp, Homo sapiens
cggctcgatcactttttattttacttttttattcacattactataccatctaggccatttagtagagtgttaaacaaatgtagtaataataaacatctttacctattttatattaaacttaaaatttttcaccattaagtataatattgctgtaaagttttttgataatatttacacgtttaagaaatttttcttccattattagtttgcttaagattttctaaaccataaacggatattaaattttatctaatacaatgtgtctacttagctcattatatagctttcattctttaatatgttaatggtgcagcggggtgcggtggctcacgcctgtaaccccagcactttgggaggctgaggtgagtggatcacaaggtcaggaattcaagaccagcctggccaacatggtgaaactcaatctctactaaaaatacaaaaattagctgggcgcagtggcaggtgcctgtaatcccagctacttgggaggctgagacaggcgaatcacttgaacccaggaggcagagtttgccgtgagcccagatcgtgccactgcactctagtctgggagacagagtgggactccatcagg

SEQ ID NO: 861 - DNA, 174 bp, Homo sapiens
cgggtcgccagcggctcctgctgaaagacgggaaggatacgactgaaagcccgaggccaattcccagcatctggaaagaagcgctccggggttgatttacatgcataggagtgccatgtattttctgtacatataatttacttactactcaatcaacattggaataaaaaaaga

SEQ ID NO: 862 - DNA, 956 bp, Homo sapiens
tttaattcactgagcctgaaattgccgagaattatagagaaaaggttcctccctgacagtttggcaaggaatatggaatggttaaggactccccacccttccactccaaccccacttccaaagcctgagatttcaggacctctgacccagcagctccaggtgtctacggagcatctaaatctggatatcccatgggaacttcaaactcaaaatatccaagagagatccattaatattcccttgcgctgacctgtaacaccgaatcacatgcagtagtatttagttgattctactgctaaaatgtcaaaaaaatttgcccagttttatccaaccctcctattattggccttcattatctttcaccaagaccaggcaaattacctaatttctcttggccagcttctcttgctccaaccaaagcaaaactcaaattgtttaactgccttgattctataccttgcatttccaaatcaaagtatctttgtattagacatcagtttccttatttgtaaggtgggacaataatatttcatgagattgtaaaaagttcttatcataagaaacgccaacagtaatataatatagcaattaataaaagcccgcttacttcttctcaccattatctcactggggaatattataaaaactatcatatatggtgctaagggttatatgttgattaaatcatttaatcttcacaacagctttatgaagtaagtatcaatgttacaattccaactttagagatggggcaaagagaagctgactatcttgtctaagatcacacatcaagacaaaggcaacactgaatctcagattaggtatgcctgagtccagatggtgataaccaacagaatataccaactctgaaacatattaaattctcattacaatggaattaacttcattaccttcaaactgttgaaccaagattttaaataaaaaaggatcggccg

SEQ ID NO: 863 - DNA, 801 bp, Homo sapiens
agatctaaaaaactacaataacttatcagaaaaataagatgtacttttattcaatattcatcagtagacttctcatggaatttaaatttctgaaccaagagattaacctttatggaattgaagaagactgagtaatttgcataataatggatttcccagagctcctgactcacaatgctcatttgaaactttcttcttttttcctggaactatttctttatgagtggacactgaaccatttgagccgatctatgtcaaattattggccttcgtccctcattcatttctcagcattcatttctcagttgtgcagagggctggtgtttcaactctatgagtggattaattgactgaatcattactgaaaacctttagcgtctatttgctatggtatacataatgcattctgaaagtatattttgaatttactcatatttttgaaatgattctgatcaatactgaatgataaaattgaatatggaactctatgattataataggctaacatttgtctttcatgtaaataactggtggcacatttctttaacacaccccaacagagtactgtctcagctgaactcccgtgtgacttactatctataatgtatgtacaccctttagtgctttgctctgtagctataggtgtgtgcatctcatcagtcttttaagattataagcctatggagtgccagactgagattatatacatcttcacattttttaatatttctaaataacccacactgtatcttgaacaatataggagcttaaaaaacattcccaataaagcacgatcggccg

SEQ ID NO: 864 - DNA, 455 bp, Homo sapiens
actaatgtagacactccccagaaactttgtatatcaattcagctattaatggaagttgacatgccatcattcagaacacatgctgtagagaagcccgtctccataaaacagtcttgactactctgagattttcatgctgtgcagaagactaagccgactgtatgacgaagaaatgttaagaaaaagagctgatcaaccaatttggaatcaccgccgccttcccagctgaggtcccagacacttgaactggtccagttcatccaaatttctgactattctagacccaattgacatttgataacaactacatgtgatatttggagcaagaacttctgtctgagaccaatatactcaaagatccatgagagacaataatatagtgatgttttaaaatatccaggcatggaatttcttgttaatgtaatattaaataacaaaaggaatgaattacaaaa

SEQ ID NO: 865 - DNA, 463 bp, Homo sapiens
ttagtaacagcccaaaattggaaacaactcaaatgctcatcaactgatggatggataaacaacatgagatatattgctacaagggactattattcagcgataaaaaggagtgaagtactgatatatcttagaacatgatgaactttgaaaacattatgctaagtgaaagaagccagtcacaaaaaaatcacatatgattctatttatgtgaaatgtaatagaccaatttgaagacagaaaatagattaatggttgcctagggttgagtgggggactgggggaatttgggagtgatggttacagggtatggggttccttttagaggtgatgaaaattttctaaagcaaatgtggtaatgcttgcacaactctatgtacgtaataaaaaccattgaattttgggctttaaatgagtgacttttatggcacgtgaattatatttcaataaagcaagatgcaggccg

SEQ ID NO: 866 - DNA, 690 bp, Homo sapiens
tcaagccttgtgctttgttgctttgctgcactggactgattaggtgatgagaatggatgggactaagacggctcaacaattaccttatggaaatctaaagacagcaaaccatgaaccagacacacagaaagacaaaaacgtttccaagacacaccaggagggtaacttcaaaaatattagtactaatcaatggcatgtgacaaagaatttgaattttcagtggagactgtgaggtttaagactgtaaaggacacatgaaccaccgctgaaccacagatctcaaagcccctgctttaggactacggtttcaagagatcacattctatgcaaagagtgcaagtagctgggtgcattgttacatcatcacatgatcacttgcacacctgccagctcttctgtacagacaagtggttacttcttcactcaggaagaattgccagaccatggtttcttctgccagttcaattcctataattttagtcgtgatagtcttccaggaatgcttttctccttaatttctgatacctacataaatgagaatttgaattccttatcaccatcctgatttcagacctgaaattttaaatatgagatatttaactatgtttactatttcctggtaacactttatagcaggaaaaatatcccttctgtttttaaggtgaataaaataaagaacgatgctggcag

SEQ ID NO: 867 - DNA, 447 bp, Homo sapiens
aggcaggatctctctatgttgccagagctagccttgaactcctgggctcaagcaatcatccacctcttcctcccaaagttctgaaattacaggatgaagaacgaggtcacatcctttgcaggaatatggatggagctggaggccattatccattgcaaactaatgcagaaacagaacacttaagaccgaatgtcctcacttgtaagtggaagctaaatgagaacacatggatgacagaatggaacaacacacactagggccagtctgagggtggaaggtgggaggaggaaaaggattaggaaaaataactaatgggtactaggctcaataactgggtgatacaataatctgtaccacaaatttccatgagacaagtttacctatgtaacaaacctgcacatacaccctggaacttaaagttaaaataataaaaatagatgcggccag

SEQ ID NO: 868 - DNA, 384 bp, Homo sapiens
tctggtttgatttgttttgtttgcattttcatttcatgtcttgttcctgttacagggagagaagggccacattttttgtttttattgtttaatgcatgctattttaagatttctcaagaagacagcagtccctgtccaaaactgtgtctgtgttctgtggttaattctattctccacattctacatggaattcctgattcaggattcccttatgtgattccatgaccagagaggctcaggaggaaatgaatcccttattgaagtcaagggagaactggattcatcttggggagattttttccttcatctgcttcgtggggtgatcgtcccaatggccatcactccctcaccactggagtgttacctcacagatggaggacctag

SEQ ID NO: 869 - DNA, 641 bp, Homo sapiens
tttgggttctattgctcagcttccatctccagaaacatccccagtcaacaatgacccatgtcagagcaaccttatccacctgtaaatgctgcagccagcccagaagaatgccagttacttcttttctgccatattgacgtcagttttttagagattcagcggacctggagcgtggccttcatgcaggatgaggagactccatgtgcatggttgcagcaggcattcttgggagctcatgagctgaatttcaggaaaagcccaagaagattccacatttccctcaggatatcctcaggaaaatgtctgcaggcctggaaacacttagccatcacttgtttatttgagagaaatcaaaaaggattatggaaacagattggaatgttgaaccacatttataaatgttcctaagctgtttccactaaccaaaaatgatgctgaataaacagaaaacaaacaaaaaggtcaggctgagaaagatcactaggactggcccccacaaaaggggaaaagtactgtgaatatttagtggaagagaaaatggtagacattgacaaccaagggagtgaagaagatagcttgtcaaagggaagtgttagaaaattaactctcttagaaggatgaaataaatacggatcggccag

SEQ ID NO: 870 - DNA, 226 bp, Homo sapiens
tctcgttttatttatatccaaaaatgcagttcaagttcacacggtgactggataaggatctaagagatcaagtagtcactgcagacctcttgaggcccaggctcagaacatgcttccagcacattctgttggtcaaagcaaatcccaggccagtccagatttggcagatgtgaagatagactccatctcttgatgattgaagctgcagaggcacctcgcaaaggag

SEQ ID NO: 871 - DNA, 681 bp, Homo sapiens
acacgtgtgagcttcgggaggctgggtctcccaccagccctggagtgctaggtgcaagatcccttctctccctcacctcctcaaggctgctctgccgtctgggaagaagggccagcttcaaaccttgtcaagctctgacaagggaagatgaagcctagttccagctaggggtgacctgtctatctgcattttttgagctgcagagtgatgggagtcatattcgctgcctgtgcagcaccacaggcctgatgaaaatgaaatggcaacaccgtgcagatggcaaagcgtaggcctcacaaacatcctggccgtgaaggacagaaggatacacaggcaacataagaatataagactgtgttgagggcaacagcagggcaaaggggaaaagtgctggtcacaaccctagatggtgactgaagagaggacaacagccagcggtccatacgctgagacggatgggagaagagacacacagggacgaggaagccagcctgggtactaagtatcccctggattagctgcaagtgcgcttctcctcacccgcggacctcagctcttcccttcatgatatcagcagtgatctggagctggaggagtccccagggggaagggagtgcagctgtcgctcattccacccttcctggcatttcaagttggaataataaatccagaatgcgcccg

SEQ ID NO: 872 - DNA, 378 bp, Homo sapiens
agcaatctcccatctttaacagatgaagcttaacacaagagcagcacaaaaaccgtgaaaaagaagggaggaacaagggaggtcagagcaatgccacgtgagaagggcttcacatgccgcactgctttgaagatggagggaaaaaaggacaccagtcgaggaatggaggcagactccagaagccggaaagggcaaggaaacagctcccaccccgggcctatggaaaggacacaaccctgcctacaccttgattttagtccagtgagaccaatcatggctttctgacctacagaactgtaagataatacacttttgttgcttaaatcactactaaagcaacaagatgtggtaatttgttatgtcagcaataaaaaacga

SEQ ID NO: 873 - DNA, 420 bp, Homo sapiens
cttgtaccataaccaatacccctgcttggcaactctaatgagcaaactgccgcaaaattgagagagaacacacctttttgatgagaaaaagcgggtaatttggtcagaacacatgatcggttaatgtgtagagacaaaattagcgctgaaacctgcctgcattcttcatttcttttctatcacttcaagctgcatttccaatgaactccaaagaaaaggtcatctggaaaattgggcgtcttcaataaatggattaaggtggtggttgacaaacctttgaagaactgcatggaaaaagatgcaaagaaagacatgctgtgttgtttttttcccccacagactgacctctttggagttacaataaagccaagcttttttcttccttgtttaccaggttctatgagagagaataaacaaaga

SEQ ID NO: 874 - DNA, 781 bp, Homo sapiens
atttgaaaaaaaaacagtatttatgaaaaggtagcaaccagtcataaaatatggtgcttctagaatgacctagagagaaaacatcacagcttgctggtgaaaaccacacaggccctgggaggcctgagaatatctacatgtcagaacatgtgaagatagtaaggatttttctctctgacattcctgaccttactgtggaatcccagcccacaaggttggtcaaaaaaaaataacttaatgcagatgttttgaagacaatatttacgactggttgattgacttcttttacatgcaaacactctcatgcacttttgactcctaatagacctttccttttgttaaccaaactgctgttcccagttaatagctgcttattggctatatttgcctataaatgcttgtttgtcctttctagaaaataagatcatctttcaaatgataacagtaacataagtgaacataatgcagtccctcctaagaaaataagctaaaacaatcccatagattatccacaaattgaatgagggaagtgatttgcttgaattagcgtattgccttttaagatgagcacccgaggatgtaagggatttaaatttattaaaagttatggtatgtatgttaaaccaatatggtcttagtgatttatagctacaacttataaccattgtataggaggagattctgataaacaaactctcttgtgatattcaacatactattttttcctcactaaaattaataaagattttatttcacatagaataaataatgatgcggccag

SEQ ID NO: 875 - DNA, 679 bp, Homo sapiens
agccctgacacatgccgacgttggcagatagaaagcatcgggagtgtcagtttcaggacgagctgtattaaccccacccaccacttgaaaaattattttgatattacgaagagcaagccgttttcactggtgaacacagtcatcactgcaatagctaaacatacatggaacacatcagagtggaaaaataaacatcgatttccttgctaaagtcatgcccaggaagagttatgaaaactggagaatggaagataagatggtcacctcacgtgaagatgaatggcttcttggaggcagagagaagatggtttctctttggtttcatttgtcatgcctatcacactgttcccttggatagaacaaagaagaccatcctagaccattgggcttttgaggaactcaatgtgcagtatgtttgccaataaatgatttatcataatatatatatgaataataataaaagggtttgacgtacacatttaataccagaaaaattagcacagcaaatcaagagggaaatgaaaatacaaattaatcctaaagcatgtactagcttggagatttttgaaggccaaaaaaatttttattttgaattccccagtgcaactggagtatgtttggtgggtattcaactgatgcttgttgaattaattcaacacaataaaaaacgatcggccag

SEQ ID NO: 876 - DNA, 316 bp, Homo sapiens
gcagaatgctgagtggagaagggggaatagtggctgtgttcggcgaaacagaagacatattacacaaatgccccctccctgattctcaacatccacctttcaccaatgaagaggtggtttcgttccttcatccaagcagtggaacccttccttcacgaaggatggtgtgtgaaagatcaacatctggttgggtgtggtggctcatgcctgtaatccagcactttggaaggtcaaggcaggaggatcaattgaacccaggagtttgaaaccagcctgggcaacatagcaattgtcttcaaataaaaagaaaataaat

SEQ ID NO: 877 - DNA, 171 bp, Homo sapiens
  misc_feature (1)...(171): n = A,T,C or G
actgcttagcacaaggaaacatttggggataacagatacgttctctaccttgcttgtgctgatgggttcctaggtatcaaaactcatccaactgtaaagttttaatatgtataacttattatatatattatgtatacatatatatgtcaattatacctnaataaatctaga

SEQ ID NO: 878 - DNA, 848 bp, Homo sapiens
tttggctcatcagtggaagggacttgccttgtctcagaagaaactgcactttcgagtgatgccgaaacaggttgagacttttgggggactattgagaagggatgattgtattttgcaatgtgagaagaacatgagatttgaagggccagggatggaatgaagtagtctggatgttgtaccctttaagtctcatgtcgaattgtaatttccagtgttggagtcggggtctggtgggaggtgatgcggtcatgaaggctgatttctcatgtttaacaccatcctcttggcactgtccttgcaagagtgagtgagttctcattacatctggctgttaaaagtgtgtggcacctctccctgcttgctgctgctctggccatgtgacataccttcttttgcttcaccttctgccatgtgtaaaagctccctgaggacgcttcttgaagccaagcaactgccaatgcaaagcttcctgtacagcctgcagaactgtgagccaagtcaacctttcttttctgtataaattacgtagtgcttaggtattcctttatagtaatgcaagaatgccataatacgaggcataatggtttgcattttaaaaacgaaaattagatttatgtaatttatcatgaaaagatgaaatgagttaataatgagcaatatctacatgttgtcttagaggtgctgatgatctgtcaaggaattacatgcattgatcaagcagtttaccttcaagttgaataacaagatattcctatctaacataacaaaattttgacattatttgggggactggaaataatgctaaataatatcagattgtcaaagtcaaataaacatagatcggccag

SEQ ID NO: 879 - DNA, 317 bp, Homo sapiens
caggagtatcccagaaagaagaagaaagaaggaagctggactgcaggaattggggaagtaggcatgactcttgttccttgccgagttctcactcccactgttgagctacctgtgtcatcccaatcttgtcataaaacaagggagtttctgcagaacaaatcgaaatggaaaggagatgccaagcactcaggagggatctctgtcaggtcacttaatatccggaacgaaagcacaggagtgccggatcgaagagttaatgaaggtggctttcattgccacaataatctttatcacctcctcccttcaataaagactga

SEQ ID NO: 880 - DNA, 642 bp, Homo sapiens
agaaaggaattctgtcgttataatgactcctctgaaacgacggcttattgcatctccactgaccagtacaagagaagaggaaaagctctatgtgtctgacagtaaacattaagtggggatttagcttgctcatttccacgacatccacagttaggttaattcagtctccaaagaaaaatgattttacttgaaatgtctggtcgtatacatggatcaaaataattaagacgtttatgaagctctgcaattttctggaggggacctgcatgactgttttccagaaagttatcagatcttgctttcctgattagcagcagttagcggggtggataaaagcaccccttcagagcaatctcatttccatttctttcaggccacttattttttccaactttttttccgtatcttcataaatgtttcactcttctttgttagtatttcttagtctcttgagtcaagaaatatttactgagtatgattgcatgcataagtagtgtgcgttagagatacgatacctgtaagacaccacagtgctgggtagatccgggtgccattgtctgttgccagggccgaagttggcattttgtaagtgttcgaataagcaccatgccgtgggataagaaataaaagtggatgcgcccg

SEQ ID NO: 881 - DNA, 868 bp, Homo sapiens
cgtgccgatcagtatttatttagacccattattattaaagtattatacaaatattacaatgtaaatattaacaattgcagactccctggctctaaagattctaatgggatccaatgggaaaactgccttagctggggagaaggggattttttttcccccttagtgaaagaaaactcgtattatgcagataatataccaaatgtaggtaatcaatcactccattgaaaaataaagttctttttcaaaatgtattaacattttcaagaaaaactttttaaggaaatatttcgaactttgggaggggaataatggctttatttttttctaaaaaggaggaaggcacattatgaacattttcatttgtacaaagagaagttcaaataaaagccactaattacccaaaatcctaccacccagagttaatcgttgttaagatttgctgaatattatctagatattgcataaaaatgaaactaaagggctaggtatgcaacaaaaacagtgttgataaaataagattgaatatgttacaaaaagtatttaaaataatttaactgaagaagtggacttgaaactgaaagaattgtggaacgtaagatccatgtttctttcctatatgacctttttttttcacacgtcaggaacctttgtccagggactttgtgaacaagttttgagacataatcccaaacgggcttttaattgctttaataaagtaaattgtgattcttataaggatgcatgccatttacttaaagccttgggagataaacaagtgctccaaatgggactggttaaaagtcgcaataacccctaaagaaaaagacacccgactctgtacgggggtttactacaagatcctgccgct

SEQ ID NO: 882 - DNA, 252 bp, Homo sapiens
  misc_feature (1)...(252): n = A,T,C or G
ggatgcattcanagctgccagtggccctgggtcccgtccacacgaagaagctggaaagaatgaggccatgccaaaacagaggctgagatgagaggcgaaggcagaaatctgcccccattcctgggaaaacttcctttctacgttttgttttcatgggccaatacatcccttttccttgtttaatctaacttgatttggaattctgcatttgtaataaaaaagtctctaataataaaaagcgaatgcagcccg

SEQ ID NO: 883 - DNA, 834 bp, Homo sapiens
  misc_feature (1)...(834): n = A,T,C or G
ctgtcgcatcaggggtttattttattgctttcttggaaatacaattaattaaaaagacaatttaagataatttatgcaaatgaaatattgattgaagaaataattacagttggtgggaaaattgccatgttgacattagatattcatatatcattataattttaaaaattattatttttcagtgatagaaactgaacttaaactaagattggaaaaacacaataaagctaggcaaaattttaagtcatcaaataaatgagtaattgaatgaattagttaataaaatcaaatatattctcctggaaggcttataagacatttatttattcatttatcagatgaggacctaatttattactgaggacctaatctacgggaggtgcaaagaagaatgaaatattgtgtctgcctgtgatgcacattgcttaatatgaatactaagaaaaatagtcatctgtttctgttcctgtccccctcactgcaaggtgatttctttggggttctagtactgttttacacatatcacttcctagagtcagtatggtcaataaatacattcaatcgtaacagcaggccagaaatacatctggaggaaaaagtacatgtgtcatatgacaactacaaataaaattcaatgattattcacaggataaagaatgatttaggggaaagtagggagaaaaaagtgcttggctaaagattacaaggttttaaaagttaacacaaaatttagggtacgtaaagagcgttatgggatgggnggtgcagggagaagcctaaacccttgcagtgcagcaaatggcatacgtcttttttttaagacaatttatgtgc

SEQ ID NO: 884 - DNA, 178 bp, Homo sapiens
ctttatttacagcacggagctgttgccgccgatgacgtatgactgcaatacattactcaagtgaggagttcccctgatccgtgtttcaaaagagatgagaaacgcttcagtaccaggttgcattaattaagcaggaaaggctaaagaagagtgacagagacttcaaaataaagattga

SEQ ID NO: 885 - DNA, 1031 bp, Homo sapiens
gccttgctgcaacgactctcttaatcctccaccgctacacgctcataagtggaaaggacttgccttagtgccaatatgagactgtggactcagtaactttcgggttactgctgtaatcactcaagactctggcgggactgtcgcaataacatgattgcattccaaactgtacaggacatgcacattcgccaaggtgcaccagcttgcactctcttgcctttctgccttgcacatgggaggacacagctagaggctctcaccggatgctagaccctcaaccttggacttctcagcctccagaaccacgagaaataaatttctgtttattgtaaattgcccagtctcaaatattatgtgacagctgcactaaacagactaagatgctcccttaacataaaccacagggttcctatggaaaacaggcaacatggaatgtttcaggcattgtaatcattgaaggaaaggagaaacaaaaggagagattgtgctgaagtgaacagagcacagactgtgacgggaatctcacaatcttaccaactttgagatcaggtaagcgtcttgtctggagatcagataagggtcttgagatcaggagagggtcttgtaaagagcttctctatggtatatttcaaatctgaaattttggattcaggtgaaatagttaaagatctgagttctaatccactgtgtcactttgattatgtagtgtacaatgccttaaatgcatattttcttacttagtgtaacagaaacaccataagagagatgtctttgataatctccagtatggaggcacataattgaaagttccaaaaggttgaataacttatgaatagtgaacagcaagttagagtttgaatgcatttctttggaattcagagcctgtgtttttatactgtcacactacctcttatatatgcttattcactgaatgtaagttgtattattttccccactgatatctattcaggcttgcataaaaagtttctcttttataattagggaagctaaataaactctgatcggccagc

SEQ ID NO: 886 - DNA, 1037 bp, Homo sapiens
ctttgacaagaagatggatcctccagctacagagtacatgtcattgttcatgaagcacttgcccaacaggaacttaaatattaattgtgaaaaaacagcatggggtaagaatctttgatgaactaaaattactgttgtgccatgatgtgaagggcctttaattttgccatctgggtcgaattgacaagaatgactaagaattgtagcttggagaattggtgaactttgcatatggacaattaactaaaaaagaacaagccagtttggaaaattgtgggtatctctgaaaatgaagtgtctgcctaccttcatattatgcagtcatttttccatcagagacacatttcttgcagcgaatggtagtttgggctgtaatcaagattagtgttgatgcatttggacctaagtaaagattgcaacatcctctaggagcccgggccctgatcacaggatctctcggattttccaaacactcttcctttccctacacttcctattacaacaaggagagcattttgttatatctctgacaggaaatgtaaatctctcatccatgttatttaatagctcttcatctccattagaaaataaagataataaatcagaagtatttatattgttaagttaaaaaaaagaattgattctggttcattcacgaatcggtttttattttcacaaaagcatgaaaaaaatgtattgagttaaaccactagctgttttgaaaataatccatttactagaatagctagtcagagttattaactctgttattttcaaataccaatttttcaattttaatcttttaactaatcttggcttttttcttttaaattgtttgaacagcctaagtttcctgcatgtggtgttaagttttatggttatcatggaaaaattattttaatgtagatgtgttcctttgcaaagccaataaaacacctgttttccttataaacataatctacataaaagtgaattttttaaaaaataaatttttgaggtttttgaccattagtgataataaagagcggtcgcccaaa

SEQ ID NO: 887 - DNA, 283 bp, Homo sapiens
accgcatcaaaatatatgaagaccatggacattcttacgttggaagcattgaagtgaaaagaaaaaagcaagaaatacctctgactaaaagcaaagacgtagatgaaaaacacacacataagtgatgcctcagtttgcataccctctcatcaactgataagccatgatgaacctgagaaaactgttgcaactatggaaatgcagatgaagattattcttctctctcattgcagtcttgagacttgtggttgagaaaataagtaaataagcaaataaagaacga

SEQ ID NO: 888 - DNA, 604 bp, Homo sapiens
tgatctttgcagaaattcagcatttttgcaacagaaatctgaagactaccttgttcaactactttattttacatatgatggaaacttagaggtccagacaaaagtgtcttgcataaagccttacaaataaattgctgttatttattttaaaaagtaaaccgtttattgaaaaattatatacattcagaaaagcacaaaaaactttccaaagtgactagatcagcgcaactagcttctggaccaagccatggaacattaccaagcaccccagaaatctccctcatggccacctctgtcaccaccaagctctccaatcccaaagatttgtaggaaacggtgacagaaatttccagaaatgcttgtggccatgataacagcccagacaataacaatttaaggtctgcctgggtcactggaataactgtgaatttgagtcaaggacctgagtaaggaggggaaggctcatttatcatcagagaagggcaagacaactgtcatcactccatttgactccagctgtgaagtgaacagcttattttgttttgatgatgatttgagagactcatcaataaaatcaccaatactcttttcaaaaaaaaaaaaa

SEQ ID NO: 889 - DNA, 332 bp, Homo sapiens
ctcaggtttccttctgtcacccattgctggagtatactggcgtgatctcggcttactgcagcttcaatctcctgggctcaagagatcctcccacctccacatcctgagtagctggaattacagatacatactgaagcagttgcagatggaatgatagatgtctagacttgccttacaacaatgcagcaggagcgggtgatgtgaaacaagactggcaaaataaaaactacagaagctggaggagtgggaggtgcaattcagagttctccaatgcttcatatataaatttcaaattttccataataaaaagtcaaaagacctaaataacaaaa

SEQ ID NO: 890 - DNA, 754 bp, Homo sapiens
ctgccgatcaccgggcgctactgatgaccgccagtagccaacggggtggaaacgttgttgtgatcattatgttgataggccggagcttatgcaacccggcgcctttcaaagtcggtcgactcagactaattgactgcgacgaccgcaccttcgggaacaggggacggaattgctataccggtcaccccagttatctgtgaaatcagcattcctgaacgctttaaaccaacggtagttgtctttgtcaggtctaccagcacagaaggcaagcctgacggtgcaaccccatcaaaataagtataggccgttcctgatgagatgtaagaacctacgcccacaggtttcacaaaccacccaggtaggttgagcgcagaatcgctcggtactccgctgaagcccgggttggcctgggcatattcggtagcggcagatcggtacaccagaaagccgcgacccagtgagtcgagggtagcgtagtcggatgtacgttggtcctgatgttggttctccatgaaaatgctggaggcaatgagcacaatcatcaaaacgagccattgcattgtcatgatatgagctccatccacaaaatggtgggttgttaccacctacgccgtaataaacaaaactatttcggggaggataatcaatgtgtaagccaattcctactagggcaagcgcaatgacagtccaactttgcggctcgcttgatgctcattggtttgcgttggggattgattaattccatagggcgaac

SEQ ID NO: 891 - DNA, 299 bp, Homo sapiens
aaaacagcctgcactgttattcagcaagagatttaataagagaaactggaaaaatgaacataagagcttctctaatcctgaaaaaacaacttcccagatgtcattctccaaatgccaacagcccgacacatactgaagatgcttatggtagaaacaaacagcaattaatcatcatattgattcaatcattattcacatctttcaagagaatcacataatatgttctgctttatccatatttacttgacctgtgcaggataataaataaagtcatttttaaagggtcaaaaaaaaaaaaa

SEQ ID NO: 892 - DNA, 568 bp, Homo sapiens
ctggccgcatcggagtttattaagggagaattgactcacatgatcacaagataaagtcccatgataggccgtccgcaaattgaggagcaaggaagccagtgatggatcagtctgagtcccaaaacctcacaagttaggaagctgacagtgcagcctccagtctgtggccaaaggcccaagagcctctggcaaaccactggtataagtccaagagtccaaaagctgaagaacttggaagttgatgtttgaaggcaggaagcatccagtgccggagaaagatgaaggctggaagactcagcaagtcaagtccttccaacttctgcctgcttttattctagccactctggaagctgattagatggtgcccactcagactgagggtgggtctgcctctcccagtccaccgacttgaatgttaatctcctttggcaataccttcttcttcatggtggctcacagcaaaaaccttcttcttcgtggagtctacagcagaagacctttttcttcatggtggctaccttgaaaatgacccaggcaaggagtggttagggccttgggttcatggcat

SEQ ID NO: 893 - DNA, 407 bp, Homo sapiens
tattcctctgtggctatttattttcacgaagtagttctcagtgtattgtcatgaaagaattctttgagacttgcaaagttaaaacagtatgtggaaattcttttttcttctaaaatagccacatctgcttcttcaagttgtcttccctgtgttgatgtctcataaggatgtcaagttgtaatctctaggagttgggttcagtgggaataaaagagatttattcttaagggactatagaataaatattatggtaagtcacaacctagcagaaggaaaaggatctatttcttttgacagcaaaataatccaaagtatataggtaacatggagatcttaactgttagaaaattaaaagttatttcctggttgtaaaattgcacactatatgaataaacgaagatcggcag

SEQ ID NO: 894 - DNA, 569 bp, Homo sapiens
tccgggcgcactcggagtttattaaggagaattgactcacatgatcacaagataaagtcccatgataggccgtccgcaaattgaggagcaaggaagccagtgatggatcagtctgagtcccaaaacctcacaagttaggaagctgacagtgcagcctccagtctgtggccaaaggcccaagagcctctggcaaaccactggtataagtccaagagtccaaaagctgaagaacttggaagttgatgtttgaaggcaggaagcatccagtgccggagaaagatgaaggctggaagactcagcaagtcaagtccttccaacttctgcctgcttttattctagccactctggaagctgattagatggtgcccactcagactgagggtgggtctgcctctcccagtccaccgacttgaatgttaatctcctttggcaataccttcttcttcatggtggctcacagcaaaaaccttcttcttcgtggagtctacagcagaagacctttttcttcatggtggctaccttgaaaatgacccaagcaaggggtggttagggccttgggttcatggcat

SEQ ID NO: 895 - DNA, 424 bp, Homo sapiens
tcttgctttatttttattcgtattaatttcttatttattattttatttaagaaattacattttcatctccaaaacagaagatcattgatccatcttttctgttagtttgtatatagaagctttcactctgagtggggaacagtagttgggctgaagaaaaatcttggagcaaacagcagaatggtgtaccataaatagcatatttgcctcttgttcctttcctgcaggcttttcttctttcattatgagaagcataatttttctatagtctgttccacttcatttccctcccagagactattttatgcgctcaggaataaaagaagatgctggagagggtgtccatggttttacactttccagtggcaaataccaccacttcctcagctctgtccctccagtccagggactggcaatttttttt

SEQ ID NO: 896 - DNA, 741 bp, Homo sapiens
cctgccgatcctgttttatttctctgtgtctggaaaacctggaaggcaacatggtcctttgaaaatgggcttgccagggtgatggcttgccctggatgtggaccggtgcacccctgaacttgcttatgcatgaaacagggattccaatgacaaggtgggagggtgagaaagcccatggattttaaggtttgggttggacagcctcccaccctcctcttctgatcctggtgtcctctgaggtcacacaaggtcctgcttcccaagcccgaccagtctctttttctggaaggagcagttccccaggcctgggctcaggcatctgtgtgactgacaagctgtgaggtgactccaaggcccatctgggatggggaggggcagttccagtctagcctccttgctgcacagatgaggacacggaggcgaagccacagtgtgagttctcaaatccagctcccctgcttccaagtgctggaccttgtttccgcccgcattcatcctacagcagggcaagccacagagagaggtgctgtgcagaacagggcatgagagggcctggttacttcaatggggcttcttcatgccctcctgggtcctctgctggcttaggtacaggcactgagactttacttccattgggagggcactgcccttgagctagactttagattcaaatccctgctccatgaagcattaactgtagagccttgggtaagttgcttaaatgcctcatttttccatctg

SEQ ID NO: 897 - DNA, 335 bp, Homo sapiens
tcggccgcatggccctttattaaaattaatattggaaatttagaaaagtatagagagaaatctgtgaaagaaaataaaatatctagaaccaactgggtacttttctcatactccttgagagaaaattatctattatttttaaacatttttgtcatttatgactgcaaaaagaaaacttatgatttttttctttcagtaatctcatgtttagtacatgtctatttctttatgagctcaggacccattctgtattgtttggccgtagcatttcaatcttcatttgcaaaccatacggccttcattccatttggatgtggctggtcctgtaaacttgg

SEQ ID NO: 898 - DNA, 618 bp, Homo sapiens
  misc_feature (1)...(618): n = A,T,C or G
acacctattgatgcggctaccaagcaacagaacaacaacagcaacaacaaaaagtgatgaaacccaacttaagctatgataaacttctgtgttctagggcagtactttcagaatcacggacagcggcaaactcctgtggaggcagatctctttgatttcagtatgggccttgcagctatctccctcttgccactgtgcagaggacaaccatttttgacctgctgtcccagggataagggtatggacatacttgaggaaccattattctgcctaccatcagccgtgtcttcactgaaggacaaaaagcatttatctatgctgaacatgatcaaagctgcagagagcatcataaaaactaaacttctaggtaaagacagaaagaaaagaaggcaagattcctgtggctctcttggaaactcatgctgagaaaatcatcaccattttatccataggatgttggggtcttgagtcatcagaagactttggtacctgctacctgatcttggggctttagtgaagccacaagaaacttgaagggacttgccatgaaaaatgtatgggttttgcgaaaaaacagagaangaaaatgtgtatctcacttcaagctcacctaaggtt

SEQ ID NO: 899 - DNA, 666 bp, Homo sapiens
  misc_feature (1)...(666): n = A,T,C or G
tattctgttatagcagcagaaaatggactatgacaaagggctctggagagaaggccctgtaccttggcaaaagtggaccctttcccctcagactggatggtgatggtgtgcgttcgcctctgcagaatctggtctatgtcttcttcacagaacttggagccttcatcttcttcatccattaaggctccataagcacctttccggagtaggtcctccacctccatttttgagagctgctgtacctggacaggtcaccaaaggctactcacaaagtggaaaatgtataggagaaaaacagcctcaaatctggtttttgtgattcagtgcatagttcctccatgaactacatgttagaacaaaggacgtgggcaacaaacttcagctagtgaaatcccagatgcgatactctggggagggcagccccccagtcctctataggcagctctgaaataaagctcagcacatgatccaaggtccctaacattcttcaggatgttggttattatcagatgtcacaagccactataactatgcaacattgaagatggtacttttgacatctttatattttagttacagctcgtatctttaaaaacctccagatgtaccaaacaagcagaagaacaatgatttattcaatattaaataaagagtgtatgcgnccag

SEQ ID NO: 900 - DNA, 1044 bp, Homo sapiens
  misc_feature (1)...(1044): n = A,T,C or G
aatgctgcagtctgctgtcttcaagaccactcaccaattagctctgtttccctgctctttttaaacctgcttgccaccgttaatgttcctgcggtgacatgaagaggtaggcttggtgtcctggtggatttccctaagatcaactccatagaatgtataaaaatataattgcttcaaacagactctcagacacacaacaacggatttatttttaaattcccttgacaatatgcagggcagaaaccatcttttcaagaaacccaaaatattccattcccattaggttttaaaataacttgtaagctcgatttctttccagaactatgggtctgtggatcttcttatagaaacccattaccatgtggctgtttaacaaatccgtgcctgcttaaaattatgaatgacagcccatttcataaagagaaaagtcctccttgacaggaaaacaatctcagttggttctccttggataacaaatggacttgcgtcagggcccggccccatagctctttctaaaatagngggggcgaaggactgccattcctatttcagggggcctaattaaggagcttgcagaaattagtgaccacctgcaaatctgaattatcaccaccaggagaaaattatcatgatttgctacagatctgcattcataactttaaaaactgtccatcttccttattttttgctctatggatttcttgtcagaggcaatgtcagaggtcactgccagagtgtccctttggtacccattaactataaccagcaaacttgttcactattgatccattatgtctaagcatctattatggtggatataaaaggtggcttcacatctttctaaacagataattcataaaggccaaggggtcatggcttgtgatatattattctttcactgtatttgtgactgaatggacaaagagagagaagatgcaaaaggggtgccaagggtcacgagtgttagactagagaggcagaaagccgtgtgtcaactggacacattaacatccatataaataataaaaggcgtatgcgnccagg

SEQ ID NO: 901 - DNA, 1127 bp, Homo sapiens
actctcttgctgttgcctaggctggagggcagtggtgtgatcacggctcactgcatcctcaacctcccaggctcaagcgatcctcccacctcagcctcccaaagtgctgggacaacaggcctgagccactgcgcccagccatatctacattataactgcatgtgaatctacaatgcaagatctgtctcccacaccaggctgggtgcctactaagacagggactgcaatcgcgtttctctgtctcatcttgtatgatgcctgactcagcagatgatagaagtcgaaggtgctaacgatgggcacacatcacaaactcattgcgaggcacaactcggctcagcgtgaccctctcactgcatccctggaagctaccatggggctggcaagggacagtgtctgccccaaggccgccttggaccgagcacctgttccctttcccgctgtgcctctcggcatccacagaggggctcgggacacaagcttgaatgaatcgaagaacccaaacaccccaaggtgtggtcgggcaggtatcttcgtttccctggctggtgacaccccctgccttgggacaggcaatgtgcagaaattgcattttcttcttgtaaggggagggactgaggtggaggaaatcccttgggtgctggctgggccaggttatctgtttcagggtaaacgggcagcagttggtgtataaatggtgcggatggagcctaaggtgggcccgtaaccgcttcttccatgcaaatatgcatttttaggcgtttttccccattaaagtatggacaggggtgtctgtttaacctaacccataaaatacagcaaagttatcgggctgtcactcttgggactataacacatcacccgatggtctaaattttactaacccgctaggtaaagacctcccttgttagcatggcctcagtatccacatcaaaaaagcccatggggcaaggaactgcaggtgggcccttggatatgcaggaggcctccaaaaaacaaattaataaataaaaatgaagcccccatccttcaaccgcaaagttgtggattatatcagccaccacaagagcttggaaggggttgtatgagtctgttctcatgatgctaataaagacagatgcggccag

SEQ ID NO: 902 - DNA, 1498 bp, Homo sapiens
  misc_feature (1)...(1498): n = A,T,C or G
aaacccagatttcttgaagaaaagactgattccaggtctgggacagggaaagcacaagaaatcatggattatcttgtcataacagacagaaagacagctatgaaagactccacaggtcatgttaaaggacacagatgccaacttgaaaaggcttccattagccaaaggttcagcaaaatttattgaagccatgcaggcggtcagacaaccacactagatgttgggaaaccatctatgaacaaagcggagtatctcatctcaggaagaccagtgtgtgacatcaccaagagactgggaaactgcagcagactgtggtatctgagggtcatataatgcttagaaaaagggatattgggaattggcctcatgaagagcagaagaacagctttgagatgctgatctgtgcccctatgaacctaactgaagcttttttatgacaaaagacatattgaaaatgaaacagtttagaggaggggtgtccaatattttggctttcctgggccacactggaagaagaataattgtcttgggccacacataaaatacacgaacattaacaatagctgatgagctaaaaaaatacattgcaaagaaaatctcatgttttaagaaagttaaagaatttgtgttgtgctgcattcaaagctgtcctaaccacatgtggccggcaggctgtgggttggacaagctttgtttagagccgtgaggatcctgagttcaaattagacacgaagagcagagggcaaagatactggaaatcaaatgtcttctctcgagattcacgttgatccctgggtgacagagcaagactctggtctcaaaataaaataaaataaaaaaagattcacanttgatgtgttaatactgaaaatggcacctgagtaaaagnaggcatttttcttctgaaatcanaatagacattcntaagctgtgtgatacttgacaagcagcttcttccctgagctgacctgggtcctaagggtattgaaaggaaatggtgcttggtggatgcaagtgcctaatactttgtcaccacaggtccactttctcatttccccttcatacagttagtacttacaggattgtactggccttgtctgctgtacacacatatttgctaaattgtctctcaatgaattggtcattcagcaatttttctttctggagaattggctctcagtgacttggcttgcttcaggggtaaaggtgttggaggagctggttgcagaaacagatatgatggaggtaaaggaagtcaagcttcttctagaaggaaaaacctagtcacaatagcaaatccagagcaagaagccttaactaagtcagcatagccttcatgtatgctttccagggagccaaccatgcaaagagcattgggttactatcagggagggagactgaagtataacaatatctggcaagtaacgcaaaagaacttagacacttagacatctgtaacctatacatgagtgttgcaaaaataaaaaccgatcggcag

SEQ ID NO: 903 - DNA, 564 bp, Homo sapiens
cttaactgaggaatccattgtgtgctgaaaacaatgcaaatctctgaagataaaaaaaagagagagagaatgacacagcttctgtactcaatgagagaaaggattacaaggtgtgatgagagttcctgactaactcaactagagaagaaaggaggctggggaggccacctcagcggcaatgataattgccctgagtttctaaagcagagttattatgagggggagaatggtgatatgattaaagacaagagtcctatcctgagaagttcatagctaaaaataaagagggtgccaggtgtgaattcagaagtttggacctattggtaacatgacttgtagatacgcttgctataaaggcacacagaataagatcagaagaatgatgtgtagagatggttgtggaagacagaagcagaaggtcaacaggcgattggcaagacaccagaaagaaatctaaaaggcatacacttagttcagaattatagcacatctgggaataaaaaaaagaaaacatggtgatgtctcaaaactgatatacaaaataaatcccgtatgccggccagg

SEQ ID NO: 904 - DNA, 766 bp, Homo sapiens
catagattctaaaaaaacatgtttgctgggccaaaagtgtaaagaactgtgaaaattcagattttcttccttcctgcaagctaacaaggtaccctgcgacaatttcatgaatgttggcagatgacatgcgatccaaggagatggggtcttgctatgtcgcccaggctggtccggaactcctgaactcaagggatcctcctgcctcaacctcccaaagtggtagaattacaagtgtgaaccactgcccctggcctttattttttaattataaatttctaggaaaaatttatgctagggaaaataaatgtttgttacaagtactttttctactttttttaagttttcttagctgactttcgccgtatacattctaaaattggggattggaaaaaatttttcttccataatttctttactctttcaaccaaatcacctacaagtaccatacaaattttcttttaaaatttttatcatttcattttgtatcagtgattagtctaactaggacttattttctgtgtaatgtaagctgagagtgtatctctgattttgttgaagaattgctggttacattaacatcatatacttaataagccattcttttgcaactgaattgcaataccaaccttgtcatattttaatttctcacatatatttatatctactgttggtccctatattctgttccatttatatacttgttcttttctgtgtgaatatcatatattcattagaatataatacaaaataaactaagatcggccag

SEQ ID NO: 905 - DNA, 1067 bp, Homo sapiens
actctacccaacaacagcagaatacacattttcttcaggttgaccaagagcattaaccaagagtaatcaaaaagaggagccgactagacacagccaggaagagcttctcccaccggaagaccagaccagcaagaaagttggcaccctccaagcaggttgttgaaaggaaggccttgaatgtggacagaggacgatgcagatggtaagctgaagggtgaagaagctgggaaacctgcattgggttactgagcactagatctcgtttctgatcccgagtagctcctggggaaaatgtgagttaaataggtatggagtggccccttctcaccaaagacctctagaatcctagctgcaggagactttatagccccatgaacatttgagctggaagggagagctgcttggagagttggcgggaacaggaatccagcctgcatggagctcatagtttggctcaggaatagctgcagtagaacatggacagggacacccattccccaaggcttcccttgctccttcaggtagctttggcctttgttgactgttggacctggacagaacaggtctatcttgccacatgggacagggccaggctgatttgagtgtctcttgtctgctagcctctcccagggttcatgtgtggctgcacccacttgcaacacagcctcagatacctaactggggtgcttctcagtggccaccaccatagctcttttgctggtagacactgcctaaccatcagagagcttttgcagatggactccagccagtgtgcatctgcttgcagccttcccccagcactttgctggtgtatgcacatgcgtgtgtgaactgcactgctgctgtcctaccactagcgcatgcatgtgcacagtccaccaccccgctgctgccatgctgttgtctgcatgtgctttaacacactattgccaccccctcaatgaagtgcttttgcaggcatccctgtctggagataggtgcattgagcaggggcatttcaatgccccttagatgtatctaggtgattgccattgaggatgtactacagcggtggtatggcgagctgt

SEQ ID NO: 906 - DNA, 410 bp, Homo sapiens
acaccgagttaaagaaggaagaggtttatcggccggtagcatcggcaggactcctgtctcaagagccgagctccccagttgcaagggatcttcatgagtgcgacacaaaagagagtgggagaaaagcatgaactacagcccagaacagaatgactaattcctggaggacgaatttgcattcagcttgaaggccaagaggttagcatttccaacacaaaacaatttcgagtgggctcattgctcccagtcttgtcttatcctggaaccgtctctgaattcccctctttccttgttgctgtgcctacgtcctgctccagagagagctgatggtgagatggaacacaagatttcagaattacatttagtttgtaaggagctctgctgtatttgtatttgagaataaaaagcga

SEQ ID NO: 907 - DNA, 671 bp, Homo sapiens
acagaaactctactctcgcccaggctggagtgcagcggcatgatcttggctcactgcaaccctccatctcccagtttcaagcgattctcctgctgtagcaggacaagccgcagacaaaactcctcagacactgagttaaagaaggaagaggtttattcggccgggagcaccggcaggactcctgtctcaaaagccgagctccccgaacaccgagttaaagaaggaagaggtttatcggccggtagcatcggcaggactcctgtctcaagagccgagctccccagcacaattttcactcctcttttcaactaaaaaccgtctcctggcttcagttgcaagggatcttcatgagtgcgacacaaaagagagtgggagaaaagcatgaactacagcccagaacaggatgactagttcctggaggacgaatttgcattcagcttgaaggccaagaggttagcatttccaacacaaaacaatttcgagtgggctcattgctcccagtcttgtcttatcctggaaccgtctctgaattcccctctttccttgttgctgtgcctatgtcctgctccagagagagctgatggtgagatggaacacaagatttcagaattacatttagtttgtaaggagctctgctgtatttgtatttgagaataaagcacgatcggcag

SEQ ID NO: 908 - DNA, 220 bp, Homo sapiens
ttgatatgcccatgtcttagttgatgtctgcctgccacaactagcctgcacatcccgttgaggctggaaggcagacctggagataagctctcttgaagtatatggacaaagacttcgtaccctagtgatggcagagcctgaatccccagtaccatggagctgccatacagatcctggcaattaaacctggcctgcagcaagaaagaaaaataaaccaaga

SEQ ID NO: 909 - DNA, 364 bp, Homo sapiens
cggccgatccctttttatttatttttgtgtgtgtgctggagtttttaaaagcaaagccaagacgtcacatgaattttcctgtaaatattccagtgagcatgtaaactgataagggattttgaaaacatacatctaccctgctattacgccctcaacaaaactaacaaaaattcctcagtatcatccaacaaccagtccatatcttcatttcccaatagggtcaaattatcttttcacagctggttttgaaacaggataataacaccaggcacagcggctcatgccagaggatcgttgagcccaggagctcaaggctgctgggaaccacactcacaacactccagcttgggggacggtgccagac

SEQ ID NO: 910 - DNA, 240 bp, Homo sapiens
tttgtttgtttgtttttgcccttttgtcttgaacctgttccttccagagggaccgaaatgcagatatgaaggttggcactccagttgccatcttggaccacaagtgacactggggatggaagctgcatgctgagcatggtggagcagggagacaggagggtcccggaaagcatcatgggctgccatgctagtcctggattatctatctccagtttcctttacccaagaaataaatgccga

SEQ ID NO: 911 - DNA, 411 bp, Homo sapiens
  misc_feature (1)...(411): n = A,T,C or G
gtattctggaaacactctcttaatcctccaccgctacanatggagtttcattcttgttgcccaggccggaggttgcagtgagccgagattgcgccgttgcactccagcttgggtgacaaagcaagactccatctcaaaaaaaagacaagaaaaaagaaagatgcctgtttctgccaaagacacctacaacatccaaaggacctttattcataacagctcgaaactaggaaacagcccaaatgtccatcaacagggaaaagaataaatgaacgtggtatattctaaccagacacagcattatctgtgcattttatctccatacacagcaataaatgagaattcttggtaaaatccaacaacctaacttcatttccaaactttatgttgaacaaaataaaccaggatcggccg

SEQ ID NO: 912 - DNA, 635 bp, Homo sapiens
agaactcctgaagttacactccacaatgatcctctgtgagccataaacaagtagcttgtatgactctcacagtgtcaccctccgagaatatgaggaaaccaagatgcttcaattcttgtggcctgtaagattcaaaggggtcatatgcaactgttgctggacaaatttcagagtgaagacattttaacagatatgtagcaaggtttcccagtcagccgcttattgtgaaaagctgttctgatgtttgcagccctctcacactcaagaatgacaacaatcaggcttttggattttggatgacaagatacagcacaacaatggaatggcctcctttactgtgaaaagctggtgacagatcagtagaagttagtgaactcagtagaagttaggaagacacaagatatttgatagttgctagcttgtctttttttttttaacgttttcttaagctgcaggcaaagttttattttaatttctggatgttttttgaaaagttaaataaatatggaagtgctaacaaatatctgtgtttccaatatccacaattaattaatgttaatattttggcatcattgcttcagatatactttatatatgaaagaaataaaatattacttagtttaaaaaaaaaaaaa

SEQ ID NO: 913 - DNA, 400 bp, Homo sapiens
ctgcaggttgattgatggcatcacatcgaagaacactctggggggagctgtttatccccatcttccatctggagctgctgggatagagttcactgtgatgatggctactgaatgagctgcactggcaggacctctgtgacaaggaaggattgcggctagggagccaggcccgaatcaaaggatgtcaaggaaatgaatggagctaagcaggaaacagccaactcttctcaaacatgatggggcagcaattcaaaaagaaagatggtgcacagcttttaaaactacaaaatgggagaatattatgttcctttgttctttcacttacagaggttactttatagatatgtgtttcagatcaaataaacatgctgctaacaactgaaatagaaaaaaaaaaaaa

SEQ ID NO: 914 - DNA, 449 bp, Homo sapiens
tagctcttccctttcttcctgccccagccactcaagcaggtgcttgggttctatgctgatgaccttgttggagagatgtgattggtcagaaaagcagcacctgggctgggcacggtggctcacacctgtaatcccagcactttgggaggccaaggtggacagatcatttgagcccaggagttcaagaccagcttgggcaacatgtcaaaacccccgtctctacaaaaaaaacacaaaaactagccaggcattgtggtatgcccctgaagtcccagctacttagcaggctgaggcaggaggacggcttaagcccagaggtggagattgcagtggactgagatcacgacactgtactccagcctgggtgacagagcgagaccccttctcaaaaaataaataaataaaagtaattaaaaaaaagaaggaaagaaaaaagaaaaaaaaaaaaa

SEQ ID NO: 915 - DNA, 429 bp, Homo sapiens
ctcttccctttcttcctgccccagccactcaagcaggtgcttgggttctatgctgatgaccttgttggagagatgtgattggtcagaaaagcagcaactgggctgggcacggtggctcacacctgtaatcccagcactttgggaggccaaggtggacagatcatttgagcccaggagttcaaggccagcttgggcaacatggcaaaacccccgtctctacaaaaaaaaacacaaaaactagccaggcattgtggtatgcccctgaagtcccagctacttggcaggctgaggcaggaggacggcttaagcccagaggtggagattgcagtgaactgagatcacgacactgtactccagcctgggtgacagagcgagaccccatctcaaaaaataaataaataaaagtaattaaaaaaaagaaggaaagaa

SEQ ID NO: 916 - DNA, 866 bp, Homo sapiens
ctggccgatcgacttttatttctcattccttctatttccatttctttgacaacttttcttaagaggatcacgatgtggtgaggaaatagaatttaaagaggggaaatgtaatccagtgaaatgggcataaaactaagaattctgccttctttgagaggtttaatctgctgggttacaaagagtaatttcttggaataactcagtttctagtctcagattgtaattactccttcagttagaagccttcttccattcattgcctgctaaattaagtcaacattctttacttagctttcaaggtatatttgtatatgaatttacaaattcataatatgttatttagtttgtacttcatttatcaaagctaatagtatctttactttaaaaaaattttactctgatctactttttagaaattgaaaagatattgaaaactttaaaagtacatttgaataccaaagtcatatgtttcacattaaaaatcatgctcagcacttaatctgcttataattttgaacaagtggaagaccctgattaaataattagcttttgaacagaaacaataattgataggttgaattctatcttttagcactggtggtagccctaacttgggtgttaggatcgagacacgggacaggtacattatacatggggggggggcgacatacgcctgtaaggggctttgtatcaaaggaggaacaggtacccgagtatttcgcttgcggagaaaactaggcacgttggcggaatgttttgcctgcaccctgtagttaatgtgagattttggccaggagttggaacgcgatctggcgtgaccctctgataaaacctcggttgttcatatttcacggtgagggagcgcg

SEQ ID NO: 917 - DNA, 600 bp, Homo sapiens
caacccagacatacatccatggcagggccagacgaactcaagtggcacttgccacactgaactcagaatcactacatgaagcttatcgtgcctggctccttttttgacaaagttaagctctcccaggaggctccccaggtttttgcaagaaggcttgggtttatttgctccatcaggttggcaaaaatgtttggatcacacttccactcaagcaacatgtctggattctcagagtctcctgatgcaaacaggtaggtatatccagatgtacgagatgagacttatggaggctcacttgcccagagtttctcagctggtcacttgctcagcagaagttgaattcttgatccaggtctctgaagcatgtgcgagctaaagtttgagttatgaattcaaatgttgtcagggctcaggtgaggaaaagagtaaaactggctaggtggagactgaagatttggaagcaatttttggcatggaagaacttgagaccagcattaccagatcttcccatttttcaagagaaactgaaaatatcttctctttaatgtgaaatctctgtatttaaaatgctatatattaatttttttaaataaacatgga

SEQ ID NO: 918 - DNA, 601 bp, Homo sapiens
attccacaagaagagagttcaagtggaaagagaaaagtcatgttacataagattgtctctaatcagtcaaccactggagtcagataaaaatagaagatgaaaatctgtcagatgaaatttcactttggaaatattgtttgtgttcttcaaatgtataaggtttgtgtttctatccacaaattgtgtatacagcagcacattaaaagaggttgaaagtgcccaatgaattaagtaataaaagtggtatttaaagtgaacttcagtggaaatgaacctgcatatgattgaagaaaggcaagtgaatgaagtgatgaaaaatagatgacttcgtttgaaatgattatcattaaaggtctaaaagcagttctagaacaaaaagaatggcatgttaagattattgtgtaggcgataatcatgaataatatgctagtatggtaacactatccaggctcacattccaaagtttaatgttaacatggcagaaataaccctatgctaaaaacacaaaagtgaagatatagtggaatattcataatgctgcctattatttggaaggccttggaaacttgaaaaaacaaataaataaatatagatcggccag

SEQ ID NO: 919 - DNA, 824 bp, Homo sapiens
ctgccgatctgtttttattaaattatttctacatggtatcctagtaacctaaaatagttaagtgacaatgttttatgcaacagttcaaaagtcagactaagataaagacttcatagtgtggtttctaaatcttcctgctctctgctcccaaactggagcggtgatgatttacgtgtatctgggaaccgttttcctcagcaccctgctcctgccagacctggttcttgccactcatatgagtcaggctcatgttttggcttccacatggaccctcccttctccccaacacagttcccagaatacagacttctccccaggtctaagggttttcacaacaacattctgagatgtgattaaggcaatcctgaagagatggggaaaggacagtggatggacagcaagaagttgacttctaggccaggcgtggtggctcacgctgtaatcccagctacttgggaggctgagacaggagactcgcttgaacctgggaggcagaggttgcagtgagccgaaattgcaccactgcactccagcctggatgacagaatgagactctgtcgcctttctagtgggcgcccgtcacttgagatgcttcaagggatgttggcggctctttctggaggaggcatttttccatctccttttccagcattcagccgcgaggtcttgggactctgcacctgggacgggaccttgagggaatgaggccccttgctgccgttcctctgccacttggttttatattcggagggaaacctgaattcgtatagaccccttcatgcattttgcactccattatggccggcgggaggttaaaacaacct

SEQ ID NO: 920 - DNA, 438 bp, Homo sapiens
gtgatgttagcagctgcttagaaactttctcccccagtgaggaagaagaacaactgtgtccaagactttcagtagtatattgaataaaagtggcgagaacggaagatcaccaaataggaacagctccagtctatagctccaagcaagattaacacaggagatgatgaaaatgatcctcagaggagcattgttaataatcaaattaccaaagaatgatgcctactctgaatccagatgtctgacttcacaggacaaaaccactgcatttactgttctcaaatgatttattttaagaatttacgcttctaaatttaatccctgagggtaatgggttatgtcttaaaatatgtaatggaacattaaaaaaatgaattctttcttgcttggtttcggccaaaatgtaaataaactgaatatcaaataccaaaaaaaaaaaaa

SEQ ID NO: 921 - DNA, 273 bp, Homo sapiens
cggccgcatcggtatttattgactaataaaaaattttttaatgtttaagttttttgtggtcattttttatcactcataaaggtggtccctaggcaaccatgattaaggcttgcacttgattaaacattgtggtcacttgatccaagctgagccaatcaggttcctcttcctggtgagctggaatcacaattaaaattctattcaagtgcaggcttctctcttgacctcaggagttgtgaggaggctgtctgctgacatagtgagaaatccagt

SEQ ID NO: 922 - DNA, 894 bp, Homo sapiens
acccattgtgactacacagagcccgctggaataatccaggataatgtcctcatcccaagatccttcatgattctgcagagtcccttttgccataaaagtgacatttgcaggttctgggaattacgacaaggacattttgtgggggagcatattcagcctaccacagcaagtgccatctattgagaagaaaccatataccagccccggtgtgaagtactcctacccacaccaactccttgcatttctcctaaataaccctataaagaaggtcatattctttcctccaatttacacagagaggttaggtaactaatggaaggaagtggtgaagctgggatttgaacccaactggctcttggtgataccaaaactgtgctcttaaaactaaatgaatctacccctccttagtgctcctctccttccaagctgcagacttgcagatttgggcatttcaagttgtctcccaactaccctgcttcctttccagagtggcagggtatggagctacccttccacccaccaggaaagaagtcaccaaaggagactcggcaattttctcacccaaatcctgctgcccctgaggagcccacctggctctccaagccgtgcctctgctcccaggtcagccttctctcatgtggagacaaggcagaccctgggggaggtttctcaaaggggtaggtgggagaggaaatgtcaggagaggagaccagagctctagagcacccagccacctgcagccagggtggagagactgacctcgattgagtctgtcttatctcgggctgtgctaacctcactctcccttgcatcctgggctcacgagctatttccgtctctggatcagatacgagaccatgatttattgattgtaataaactgtgaatgcgcccg

SEQ ID NO: 923 - DNA, 809 bp, Homo sapiens
actctcttaatttttcacgcgctacactttatgaacagaaatcctcccaacacacccgagctgaaagatatgcaattgtcttgaaaatggagtatcagttctttcttgctacagcagccaactcctggggaaatatactacagatgcaagttcctaaaacttaagtttttcatctcaagggaaatacatatctacctctataaatttcaaggttggagcacttactcagaagctctggcgtataggaagctcccagcacagggaactttagaaaactcataaatgcaggtctccagatgccagaagattaaacaaatgccagcttcacaaggccatgcttttccagcagaagagagatgcaatgtaaacaaaaaacttgtaggtaaaaataaaattttggaacagaaagaggacacaaaataaggatttaaggctgacagaatgggaggagaaaaaaacaagaattcaatataccaaccaagcaaaaaggctgcagagaaagaaggaattcttcctcaattgtttgttgaagttaactattgcatgaagaggcccatgtagcaaagaaccacgaacaacctcctgtcggcagccaatgaggaacctagaccccccaatgtaacagcacgcaaggaatggaattctgccaatacctaaataagtttagaaagcaaatccttccctggttgagccttctgatgagacaccagtcctagcttacacgttgattacatcctgtggtggtcaatggcgtgtcaacctgctagactgggggtctcagtggattggcataaataagtccaaaagtt

SEQ ID NO: 924 - DNA, 808 bp, Homo sapiens
  misc_feature (1)...(808): n = A,T,C or G
cattcatcttggaggataagcagcagcaagagcctatggaggcagggaagaagcctctatcaagtggtggtgtttgcttttgcagttttctaataaaaatgaagttttccatctctaacaaaataccaatgacattctttgcagaaatagaaaaaacaattctaaaatttatatggaaccccaaaagacccagaatctctaaagctatcctaagcaaaaggaacaaaactggaggaatgacattacctgacttcaaattatactacagagctatagtaaccaaaacagcatggtactggcntaaaaactgacacatngaccaatgnaacagaatatacaacccataatcaaatccacacatctacaataaactcattttcaacaaaagttccaagaacatacactagggaacaaacatgcttcaatgaatgatgccgggaaaacttcatatccctttgcagaaaattgaaactggacttttatgtcttatcacatataatattataagaatggtttaaaaaccttaaatacgaaacctcaactttaaaactaatttaaatattcttgcgaggatattttcaacgtatacaattatatagcattttattcaatctctcccccattcccatacatctaaaatcttaaattgtctatagtgtccnccgtatgttctgaattcttttactagtcataagtaacatatgataacatattgaagatactgacttttgggttcaatctagtcaacatggtcctacttcgtgtgtactactatttttgtatcatcaatgttcaaccacctcatatc

SEQ ID NO: 925 - DNA, 1030 bp, Homo sapiens
gtatgctgcaacgactctcttaattttttcaccgctacacaggatcatgtagtccttctgtgaagacctagactcacaggggtcagagtgcaaagccagagaagactctcccaaagatggatccatgaggaagggccctgctggtataggaagtgctctggttcttccgcaagaatgagctatctctgcacccacagcctgaggggtgactgctgcctgctgagcattcggattatttaatagagaatcagggaggaagaatggagagtagaaacactcactgatcattatttaagctgacaatgtggctgacttctactaaatgttgaataagaattgcgagcctcagagagaagagaaaatgagggctacttcacacagtggacaacaaccagtctttactcagcaagcatcaacactgccagtctctgtgactcagcgatggaagagttcctgcttctctgagagctcctagtccaatagtaggaatgggcatattaatacattattatagcaagtataaatacctttatacttcatctaggaaggtgagcaagacaccaaggaaccaaaaaggaaagtgttgtaacccatggaaaaactgaagaaggctttttagaagaggaagcacttctttcacttgatttttacataacaaatagtgcagttaacccagtgggggagaatgcaaaagaagctatttggcgggggcatgatgagtttaaattggttgtaggctgtacaggccttgtgttcaggatctataataggctatatagaaatagatttgagcacctatgatatatagtagttagggccatggaagtaagtttttccaggaggagtatacacaaagctaaagaatgaggcagatgaatggtgggagaaatctggcatataggatgtccccagtaaacatttgttgcataagtgaatgaatgaatgaacaaacctgggaagtgtgttgaaaaggagtaacccaaagatagccagaaaagcagcagagaataaaataaagccagatcagccg

SEQ ID NO: 926 - DNA, 852 bp, Homo sapiens
ctttggtatcaggatgatgctggcctcataaaatgagttcgggaggagtccctcttcttctattgattggaatagtttcagaagaaatggtaccagctcatctttgtacctctggtagaattcggctgtgaatccatctggtcctggacttttttgatatctcctggcatctcaggagcagcatcagtattccaggaaactcagcagattgcccatggtctctggttctagcagcaatagcagcaccagataactacaatgcaaattctggctactgtaacaacagtgcagttctggcaggggtagcaatgggtgactgcaggctccagcatcctctgagccctaggagcagtagtgtcttcctgcagttactgatcttttgatgaattcactgtccattttctgcttctccagccctaccaggacttttggcaattgattcccggactgaggagagaataaagagttggaaaccatcagatacccataggaagaagtcatttgctcatcttctaaccctcaagacttcatgtaaccaaatgaatctaacttcagatggggatgtagagcacaagcatggcagcagaaaaaagtcttgccctgttgcccaggctgaagtgcagtggcgccatctcagctcactgcaacctccacctcccgggttcaagcaattatcctgcctcagccttccaagtagctgggattacaggcacatgccagaaaatgaagttcttctctgcaattttctaccaactactttaagagtttctcgtcaatggtgaccaacaggaatttgaaaagataatcattaaacaaccttggaataatgtgtttctgtccaaagataaataa

SEQ ID NO: 927 - DNA, 705 bp, Homo sapiens
aagaaacatatagaatgacagagacaaagttatttgtcaagagcattttaacatttgatgaccatactgcccaagcaatctacagatttaatgcaattcttataaaaaatatcaatgtcatttttcacagggttaaaaaaatactataatttatacggaatcaaagacagactgaagagccaaagcaatcctaatcaaaaagaacaaacttagaggcatcacattacccaacttcatattataatacaaggcgtatagtaatcaaaacaggatggtactggaataaaagtagacacatagatcaaaggaacaaaacagagaacccagaaataaagccaaatacttacaaccaactgatcttcgacaaatcagacaaaaacatacactggggaaatacactctattcaaaaatggtgctgggaaaattggatagccacatcatatagaagaatgaaactggattcttatctcttactgtgtgcaaaaatgatctcaagatggattaaagacttaaatgtaagacctgaaaccataagaattctagaaaaaaacctaagaaaaactcttctggacattggcctaggcaaagaatttatgattaagacaccaaaggcaaatgcaacaaaaactgaaataaataaatggaacctaattaaactaagaagcttgtgcacagcaaaagaaataataaacagagatcgcacg

SEQ ID NO: 928 - DNA, 615 bp, Homo sapiens
ctccagctttcagttgtaagatactacatcgaaaaagggtgtaaattggtaaagagagtacagagccctgtgcccagtgctttgcttgcctgaggagggatgagctccccgtcgtgtgcaagtagaggagcctactcctgcctttgtctgatgctgatcaccacgacaaccaccacgacccaggaaagctcactggttcttaactggaataatgaggggctggaataaaaggcgaggtatccatccctaagctgaatttgaaggttggcttgaaggagtcagaatgagtaagagaaggcaaccttcagcctggggacagacttgaagacagcgcaagcatgaggactgccttctgtgggcagtgaaattgcctggctgtaggggcctaagggcaaaggaggttacaaaagtgatcttgaaaggcattcgctgacctgtggagggagctacccctccttaaagcctgaagaaaaagtttattttctgctccttctctgttgctcccacactatttctctgagctggaggtgccaaatagacttctgtgtcatgatcacactactagttaagaaaacattttccaccaaaataaaaaaataaatacagatgagaaag

SEQ ID NO: 929 - DNA, 827 bp, Homo sapiens
gcatagctgcagcgactctcttaacttgtaatagtaagtacacagaaaaaaacacagaatattacaaactgtaactgtggtgtataaactacttttgtccttagcagaaagactaaacaatgaaccaatcaaaagcagtaacttcaacaacttgtgaagacataaatagtacattaagatataagaatgatggtgtggatgtggtgaaaagggaatggaaactggtgcaaccactaggaaaatactgtggagattccttaaataacaagaaataggtctaccatttgatccagtaatcccactactaggtatctacctagaggaaaataactcattatacaaaaaagatacttgcacatgtatatttatagcagcacaattggcaattgcaaaaatattgaatcagcccaaatgcccatcaatcagtgagtggataaagaaaatgtggtatatatataccatggagtactactcagccacaaaaaggaatggaataatggcatttgcagcaaccttgcatggaattggaggctatttattctaaagtgaagtaactcaaaaatggaaaactaaatattgtatgttttcactcgtatgtagaagctaagctatgaggatgcaaagtcttaagaatgatatattggactttggggaatcacgagaatcgttgggaatggagaggataaaatccacatactggatacatggtcactggtcaggtgaaggatgaccaatactcggaatccacattaagacttatttctggaatccaacccaacttctttcaaaaaccgtgtggaatcgaaaattaaacttttaattaaaaa

SEQ ID NO: 930 - DNA, 799 bp, Homo sapiens
  misc_feature (1)...(799): n = A,T,C or G
aatctacccaagagaaatgaaaacatatgtccatctgaagatttatgtgaatgttcatagaagccttgctcatcacagccccaaactgcaaacaacccacatgtccatcaactggtgaatagataaacgcacattcttgatgtgtgaaacaaaactagggctcacagagaaaccaactagaaaatatgcacagaatgaccaaaacttctttcaacacgcttcttggactctttcaacactatggattatctcaaaccagaggaatgtctgctatggtatctggaccaatgccagcccttgttataaagtgaagaacactttaagagaagatcttgaatccctgtgctttgcaatctgacangcagaggtattcttaaaacagaagaaatatgccataagagacaacctaatagcggcctagaatttttcaaaaaagaaaaaatatgatgaagccgaccaagaaggacactgactgatccctaatcccagagctccagttgccttttacaggggcttttttctgctggggttccctgccagataatcttgtgcttggctgtatactttccaaacacagtagctttaaccttgaaaggcaaaccaaaacattattccccctgcccaaataaggatcccttaaacactttaattgactggtatttgataaactggcctattccaattttcccaatggtatggtcctacccctgcatttggtcagaaaagcgaggaaaaatgcctttgaccaaccgcaatgttttgatttcattgcctgccacattcccatagagaagggatg

SEQ ID NO: 931 - DNA, 884 bp, Homo sapiens
cggtcgcattcgggttttattttgcaaattacagataaatcatacattgggttgcgaaaatggcaggctttctacatttgcctaccatgatgaagtgattagccgtcacattcagaatacatattggaaaatggcgtggtatgaaggttgttggcagatccaaaagttttaacttgtctggtcaaaacaaggaaatctacagagatgacaggaagaaaatatgatggtggcttcaagtaaaggcgttgatttcctctacatgctcttcaatatcagaaagatcatacagtccttctcctccagacacttacaggctccaatgagcacccattaggttggtgcctccaccgtggtctgaagtcacaaggaagccatagccacctgctgcgctgagaacgatggcagtatcatcccatgatctgacgtaaacattctctcaactcctgagagattcagctctactttgaaaatgttttttcatatatcctcaacttcttccaggtttaaggtcaaatgttattttgatcaaaagggctttcctgggctgcccctgttaagggaaatcgtcctcttctcttaaaaagtggctggtctcttacctggggcaatttttttccttgggtttctacactaactcgggggggggtggggggggtcccttcctttgggatcttctttgggaaactttaaacaaaactggaccattatctgcggagggggggttaatcattgggataaaggcaaagtggattcttttaaaaaagcccagcgacaacccttttattttttgtatatgaaggactttttttaactcccccattttttaacgattgcaaaatttatttgaaaacgccgaagagttttgccctaccgggggaaaatat

SEQ ID NO: 932 - DNA, 874 bp, Homo sapiens
cggtctgcatcgggatttatttgataagttttattgcttttaaataatcatttagtcatcgtggactaatctaaaagatatttgcaagtatgattggaagttttggggatattctgcacttgtgagaagtcaagaaatcctaaatagtctgtcagccctagagattttggcctgttgcagtaaaactatggcatgtggtgtttcaattgcttcccatttggagatggcgttttattgcttaaatagatcacactctttagggcttgtcctctgcttacctctacatgccaacaaagttggctgtagtcaaatgaaatggaagtcaaactagtccattttactcgggctaccatattaattcttcgagtgtgacttagacatatctgttcagacacaagtgctaatgagcatacgtataatcttattgatcatatccctatctcatgtcaccaatggaaaaagatgactctcagggcttgtccaacgcttattaggtacataggcctgcctttttctttgtgatttctatctttggatgcgaggggttttatcatgcttacctccggcggcaatggtcggcggcttgtttatcctcactgcgttgggtgtgccgtattggtaccgtccgaccgagatacggggacaccctgtttcattatttgggttttctctttttgaaagctcggacagggtccttcctaacaatagtctttctcgcattttggaattttatagcccccttcggtccctgccctgtgtctttctttttcggagttaatattatcggtgcacttgtgcgtctggactgtgttgtggaggctacatacgccggatatcgatctccgcgctttgcctccgccttcttattcatgtt

SEQ ID NO: 933 - DNA, 1156 bp, Homo sapiens
  misc_feature (1)...(1156): n = A,T,C or G
cgtcactttaaacatttcattccatcatcgtgttcctggtttttatgagaactccactgtcattcttattcttgttcctctaaatgtgaggtatttttttctccttgggcttctttcaaaatttttctcattgactctggttcgcttatgacatgcctaggtgtagtccattttgagtattatgtaatgagacaccattccctcnttcaaccttctgttntggctggatttcctctgaaactgctctggcagcaaaggaggaagggttactcccagctagggttataattccaggtccctcacctggccgctggggaagaggctccacattactgcgtgacagagatgcaagttctgaatcacctctaggcctccactgagacgctccatctgggatgactggaattttggtttcttctcaccacctccactgagacgctccatctgggatgactggaattttggtttcttctcaccacctccactgagacgctgcatctgggatgactaggaattttggtttctgctcaccacctccactgagacgctccatctgggatgactaggaattttggtttctgctcaccacctccactgagacgctgcatctgggatgactaggaattttggtttctgctcaccacctccactgagacgctccatctgggatgactaggaattttggnttctgctcaccacctacactgagacgctccatctgggatgactaggaattnaggntnctgctccccacctntactganatgctgcatctaggatgactaggaatnaatggaaaactgctaaccacctnacnntgaggcgctccatctgggatgactnggaatnntggtnnntgctnncccccaccnctggaaacnntgtctnngggttgacttnngtatngnattnttcttgcctccncntctntccttgtgngcnctngcntnnntnnttccccnnnagngtntnacatatnntntcnnnacnattnctattngcngcnntgtnntcncttntntgnngnnnttngntnnnantgtntcaactcnntctntatnnatntcnntnntnannnnntntttttnnnnnnngncntngngcctgatcnttcngtnnnnntgtntgtnanatntctannttganntanncnatt

SEQ ID NO: 934 - DNA, 150 bp, Homo sapiens
tcctgcttcggccatgtgaggcggctgctcccctttcgccttccgccatgattggaagtttcctgaggcctctccagaagcagatgctgctatgtttcctgaacagctccagaaatgtgagccaataaaacctctgttctttatcaataa

SEQ ID NO: 935 - DNA, 472 bp, Homo sapiens
cggtcttgtagagctccaccgctgaggtcaacgaggccaggtttttattatttgcaaaaaatccctctgattgccatggcgaatggatgggagaagcagaaagacagtaggtcgggggctgtcgtggtcatcctggtgagagactgagccgggcagtgggtgggagccagtgaggacagacagccgtcgatggagcaagaagacacttgtgtgctggtctggctgtaaatgttaccagttgtctccagatggcttttctttttttttttccttttttttgagatggagtctctgtcaccgaggctggagcaccaggacggagtctctgtcacccaggctggagtgcagtggcgtgatctcagctcactacaacctccgccttccaggttcaagccattctcctgcctccagttcttgagtagttgggattacaggcgtgcacgcacaccaccatgcctggctaatttttgga

SEQ ID NO: 936 - DNA, 432 bp, Homo sapiens
caggcattggactggtgtgcagtgcacgccctgtaatcccaactactcaagaactggaggcaggagaatggcttgaacctggaaggcggaggttgtagtgagctgagatcacgccactgcactccagcctgggtgacagagactccgtcctggtgctccagcctcggtgacagagactccatctcaaaaaaaaggaaaaaaaagaaaagccatctggggacaactggtaacatttacagaccagcacacaagtgtctttttgctccatcgacggctgtctgtcctcactggctcccacccactgcccggctcagtctctcaccaggatgaccacgacagcccccgacctactgtctttctgcttctcccatccattcgccatggcaatcagagggattttttgcaaataaacacctggcctcgttggcctca

SEQ ID NO: 937 - DNA, 654 bp, Homo sapiens
cttggcatggacggtgtgcgtgcactcctgtaatcccaactactcaagaactggaggcaggagaatggtttgaacctggaaggcggaggttgtagtgagctgagatcacgccactgcactccagcctgggtgacagagactccgtcctggtgctccagcctcggtgacagagactccatctcaaaaaaaaggaaaaaaaaaagaaaagccatctggggacaactggtaacatttacagaccaggtggcctgatgtttgcactgatgacaacccagtctccttcagcctggcctgccctctgcactccggatctaagtgtctgggcctgctggacaaccctacttggctgtaacacagactcctcccgttggtccacagacaaaactcagcctgcttgcttctcctggttctcttttgctattttaagtctcccttgactcctcactcccttttgcagccagaccagcacacaagtgtctttttgctccatcgacggctgtctgtcctcactggctcccacccactgcccggctcagtctctcaccaggatgaccacgacagcccccgacctactgtctttctgcttctcccatccattcgccatggcaatcagagggattttttgcaaataaaaacctggcctcgttggcctca

SEQ ID NO: 938 - DNA, 439 bp, Homo sapiens
ggccaggcatggtggtgtgcgtgcacgcctgtaatcccaactactcaagaactggaggcaggagaatggcttgaacctggaaggcggaggttgtagtgagctgagatcacgccactgcactccagcctgggtgacagagactccgtcctggtgctccagcctcggtgacagagactccatctcaaaaaaaaggaaaaaaaaaagaaaagccatctggggacaactggtaacatttacagccagaccagcacacaagtgtctttttgctccatcgacggctgtctgtcctcactggctcccacccactgcccggctcagtctctcaccaggatgaccacgacagcccccgacctactgtctttctgcttctcccatccattcgccatggcaatcagagggattttttgcaaataataaaaacctggcctcgttggcctca

SEQ ID NO: 939 - DNA, 809 bp, Homo sapiens
  misc_feature (1)...(809): n = A,T,C or G
tcaggagaaaatttccaccaccgaacaccctgctgttacaaattccctccgaccacgtccccgggacgctcctggatgccccttcctgcccctgaagggagagattgtggccttatcagatgcaaggcagaggatgaagattttgtaaattttactgttacataaaaatgagcattatccctttcttaaagtgctcctacaatgggaacactcgtaaataaaagtttataaaataagacatatttttattaatgtttccacatcatcatgttctgtgattccatctgactcacctcttttagaatccactcagttaacatttatagagctctcctcaaacctaaggccagcaagacaactggactgggggctgccgtgtctccccagcacacgcatggcagcttgtgttgacatcggcaaatcacaaggcattgaaacgaagctcatcttagaaaaccaaggccacacgtggcacttgtggagagtgggttttccacacttcccacggccacagaacatcgttctgagcctcacatgggtgtcacaggcctccctgngacctgctggacctcccagggagtggcctcttcagatctaccgtccctgcagacatgagagccagccccgttccaagactgagagagtcatggtgctttcaccagatgtcctgggactgggtgtaacccataaccttgccatctgcacgggctgctaggaaggcgcccacctccctccaaaaacaagctgtctttatgccttgcagccttgcaaggacctggagcaggccacccccaaggcttcagaggacc

SEQ ID NO: 940 - DNA, 271 bp, Homo sapiens
atagatgataccaaagcggccaacgagtttaaaactctttttgcgcagtaggaatgactccatgaagatttctcatcatggagcccagactagatggacccaaatctccagactcccagctcttctgtaaaccccatcctgattctctgagtctctgaatcttttatcctcattttcttcccaactgtccataatgtagaatttaaataaaagattaaatgtaatctttataacattattatattattgaaaagtttcaaaaaaaaaaaaa

SEQ ID NO: 941 - DNA, 376 bp, Homo sapiens
atgaagaaactgaagtccagagagctcagagtcacaaagctagcaagtgaaaagaccacggctggaacccaggagagcctcacttttcaccaaagtctatgagaaaaagtggaggagaggcatatcatcgaactcatttccctggtgccttagaaaaatgtattaggttacttcttaccaccccatatttcaattattcctccccttacaaagggtgctagttcatagtcttgtcctcctattgcggctacctggagaaagaagatatggcttactgattcattcaatgaatttttgtagtacttaccatatgcctggaaatgtgttgagtactgcagatatgtcagtgaataaaaccttggcctcgttggcctca

SEQ ID NO: 942 - DNA, 283 bp, Homo sapiens
  misc_feature (1)...(283): n = A,T,C or G
agaagaaactgaagtccagagagctcagagtcacaaagctagcaagtgaaaagaccacggctggaacccaggagagcctcacttttcaccaaagtctatgagaaaaagtggaggagaggcatatcatcgaactcatttccctggtgccttanaaaaatgtattaggttacttcttaccaccccatatttcaattattcctccccttacaaagggtgctagttcatagtcttgtcctcctattgcggctacctggagaataaagacatggcctcgttggcctca

SEQ ID NO: 943 - DNA, 937 bp, Homo sapiens
  misc_feature (1)...(937): n = A,T,C or G
agctagcggactacgcacacaaggagtagtgatgagcgccatcgtacggctgtctgtcctcactggctcccacccactgnccggntcagtagtcatcaccaggatgaccncnanagncanccgacctactgtctttctgcttatcccatccattcgccatagggaatnagagggattgtaaagcatataatannnacctngcctcttttggcnntcancggngnagctctannnggcgcttnccttttntgagggnnaannnantatccnnngctcantgacttngtganccnnggntnttnggctgcggnagagcnggtatnantcnctctccntggtgttctttcggntaatccnngggatttnggggnnaancgcnggntnttctcctctntnttnncntnctcccctttttttcccatngtcnngtccanntgttttcttncnnncctnncggnnttatttaacttnntcganatttnttgannagtgccanantntttntntnntctttcnttnnttangttntanttannantnttngtttnnatngtcctntnatncnanncganggncccatgcnnatcnngcnttccgtgttcnntgttnccactcnatttnaggtncnattnggntnanggngttnntnntagnnnttgngntcnanttntncnggtggaatcngntacncagtacngtttagagagncncnggncnnattttnacnngncgngaagagtatanntcntgnnatatgatgngaggnggngangntgnannngngnggantttngnagngnnatgtanagantngggnnngcacnaagagnagncgggggangaaggantantgggagtgngaantnntaangnnntanngnnanagngaatcnaacnaagnnnganagngtagggagaagnngtngnncagtgagag

SEQ ID NO: 944 - DNA, 403 bp, Homo sapiens
tgatgctggcctcatgaaatgagttagggaggattccctctctttctattgactggaatagtttcagaaagaatggtaccagttcctccttgtacctctggtagaattcggctgtgaatccatctggtcctggacattttttggttggtttcatcccaaggtcgtgctcttctcaaggtggcatcaatcgatggctgagcaagaatgtagtaaaaggacccagccacttactactcaacatgagacacctctgaaacaagcaattttcacttcagattcttcagtgtgttaggagactgtcagatctacattgcaatcctatttccctactgtcaatattatttcttcccttttcctgtcttaggtgttaatctccaataaatcactggcctcgttggcctca

SEQ ID NO: 945 - DNA, 665 bp, Homo sapiens
ttaagagttcattccaataagtgctcttttaattttggggtgggaacactgattaattatatgaagctatttctccattccttcaaaatatacaaagtatttgtattttatcttcatgtttttggcggagaataaagggtgcacaatgaactttcatttgcagaaagcatgcagaatttgatttgaggtgaaaatagagaacagaagaaaacagaaagtaagagaatacatctgactactgagatcaagtgggaagctgcgcttacatttgaaaggctgctttacagacttctgctcctggaccccacccaaccaattcctacacaatcatcagtgtgtcaagcactgtctactctcatcaatgcaagttcagagaaagtgattctgggtgctaaattagctacttaatcatttattatttcaacagcacaagttatgctgcctagttgcaacctttatctctattaaatggaagtcattcatttatttgaaaactattctaattatctgttagaagtcattaccctcaaaacaggtggttacattctgtaattacgatttctttaaggctatatggacatttaaaaaataaaactatctgctaaagactgagtttcataataaaatacatgtttttttaaaaattaaaaaaaaaaaaaaaaaaa

SEQ ID NO: 946 - DNA, 705 bp, Homo sapiens
cctggtacttcttgggggtgacttcccaaatcaactatttgtcctgacatcattgtctctgactctacttctgatgaactcagaccaagaaacctgggttgattggttctccttactgtctccagagagaagatctgacaaccaaggcagaggactccaaactgggaaagagcaggaagctgcgtcttattgtcactgtagttccagcacctgacatagtaccacacacgggacaggtggatacgtgcccagaaagtattccattagattgagttaattaattagagtgtattctctcatcaacttgctgtgtgattttgggcaagtcactttacctctctgagccacattttcaccatctccaaatacatcacctacttagaagatgaaatgagataacagctgtgaatgagctttgtgattctaacaccttctgaatcttaaggggtgaatgattagaaagctgcctcttattcttgttgctgcttttcgaaatgcccaaatgggaacattttaatggctaaaaggcagcaccaattttctcattgaaattcttttattcgacaaagtggataatcttagtggaaggaatatacattatattttctgtaagatgcattaaagttgttttcattttgaattaaacatgctgtttctgaatatttgttctgaattggtcttgtgccaaaaaaaataaataaataa

SEQ ID NO: 947 - DNA, 194 bp, Homo sapiens
caggtgtctcagctgcacgttgcaacttggagtagaccactgagccgtcctcctaaatattatgacatggagaaaatcacgtcgtactttaacctatcaacaaaggggcaaagcaattacagagctaaacagagtccaggaagacccaataaagaaatggcctcgttggactcagcggtggagcgttcggccag

SEQ ID NO: 948 - DNA, 670 bp, Homo sapiens
ctgaatatgaaggagtcccactctgtactatgatagcaacagaagcagatcttagcccttcaactgatgattctccccttcgacaaaatgccgaccccttacagcatctgcagagaatggggccataagtcctgcattagacatagatgtcagctccttgcggagctggttctggggcaccggcttggatgagcttgccagttgttactcacccaagacatttctccaaccatcattttcagcttataaactaatggtgtgtgagatgcctcagcttcacagaaccagaggaaaccaactggagtggttcgtgctcatctgcctctcacttgtcagccccagaggtcttcacagacatccagctgctgatctgctggacactgaattcttaatctctgcaaaagaaataattatcaggatctgctgatgggagcttttgttaagaagaacaacaactactagctgacaagtgtaaatgagttgcccaggagccttctgcacagagataggtttttagattaggcctcttaaaaatcagctctccacagagcagagtgtctaataacccgactgtccatactctggtattatctgtgtggactaagatggaaacaagcccaggagctctcacaggaaatcctgaaggggaaaaaattatcattaaataaat

SEQ ID NO: 949 - DNA, 900 bp, Homo sapiens
  misc_feature (1)...(900): n = A,T,C or G
agcctttttagctggatattcttgccttttcattcttccaaatgaattttataatcaacttttcaagatacatttaatacaaaaaaatctgactgtatgtgcattaagactgctttacatataaaaaataacttagaaataaatgatgttttatgatgtttgagtcttcctaaaaaaaaaaaaaaaaaaaaaaaaaantctttccgggcccccttgccccccagggggggacctttgcggggggtcccttttgggggggggaaattaaaaaccccccccaaaaaacccccggccccggggttttcgggggggggagccggtttcccccccccaaaggggggaaatccggtttccccaaaaatggggggaaccccccnnncccccgcntaatttaaggcggcccggccggcggcgagaagggtgagaggaaagggcgccgcccgcggcggggggaggccggcgcggggggcgtgaacccgcgcgtgcggggccgcgccgcagagacgagagaccggccgcgggcgggggcggtagacgggcggccagtgggggcaagagggtgtcccgcggctctcgatggcgagagttgtgaagaggaagatcacgcggggatgtgggtgaggggccgcgcctcgtgcggggggcgcggggggggtggtgccgcggcgtagaggggggagagtgcgggcgcgggcgagacgggcgcgcagaagggggaggggcggcggccagcgcgggcggaggaggaggacgcggcgggaggaggggacgagtcgagcagggacaggggcggaggcggcggcggggcgtcggtnctgggccggacgacgcgagatcaggggtggaggcagcaggaggggtgaggcggggcgatagaagagaggtgggtggaaggcagag

SEQ ID NO: 950 - DNA, 596 bp, Homo sapiens
  misc_feature (1)...(596): n = A,T,C or G
ctagatgctacttctctggccctttactactagtcaccattggtctaccagttgaatgtaaagggtaaaagattcaaagcacacgaacagtctttggctcagccccagcggctagcctcataagattatcttgacctgttgattttcacttaaggaccagatgaagaaaagtaaatctaataattgtgtttcattgtatgatcacgttaaaatgagatcactggatagtcctaatccaatatggctggtatacttacataaaggataaatttggacatacagagagattgatgcagagggaagaaagtgtgagagcacagggagaacgccatctacaagccaaggaaaacctgagactaccagaaattagaagagatccatggaacagattcttcctcagagcttgcacgaagaaccaaagatgccaacaccttgacctcagactttcatcctccagaaccgcaagacaatcaatttctgttgttgaagccactcantttgngggactttgtatggcagctcaanaaactaatatagccattgaaattgaagggnagaaatntattataacaaattctaagataaaaaaaaaaaaa

SEQ ID NO: 951 - DNA, 885 bp, Homo sapiens
cggtctgcatcctgttttattatcaatacataaattccttcagataaaatgtgtctctatttcttttctctctctttatcagtatatctcctttccattccttccactgccaacctctccctttctcacaccttcacataaccacacatgcatggacacaggcacagaaacatgtcacaacttcaagggaaaggaagccatcctgtgagcattgcaatcaacattttccatctttgttttctttgaatgcatttttccagagcaaaagactcacagaaataaaggacaataggttccaaatctgcttccagctctacagttcccaattctaaaaatgtccatcaaagcacataaatgggacaaatctgcatacttattagaaatcaagaataggttccttttcatgttggaaaacagagggtttccagacctgtgcaggactcagtctcccggttgtagcacatgttcatttccgacagctgccataactaagcaccacaaactggactgctgaaaacatccaaaatgtatcctttcacagtctggaggctccaagggagaattcattctgtgcttctctcctggcctctggtgttgccggcagtccttgctgctccttggctggtagatgcataactcaaatttctgccttcatcgtcacatggcattctctctgtgtgtctgtctccaatttcctccttcttgtaaggacaccagtcatttggtttagggcccgtcttaatccattataacctaatttaaacttgattattgtccaaagaccctatttccaaattagatcatatttatgacatgtgatttttgggggatgcttactatgtattcccaaacatggattagaattgaaagtaatcctatgttgcc

SEQ ID NO: 952 - DNA, 248 bp, Homo sapiens
tatagagctctcttcaggctacagcagggagtggaaaccttcctcactttacacccagagaaaatcaggctacaaaccaggcggaccatgaagatagcctggttctgactacatacctgaaaaatgttattaaaaagcattctattattaagacatcattaaaagttcaaactgagcaatattcaatctaacaaaatttaagcatgaatttggatggttgtgcaaagtaataaaccagtatcgcaaag

SEQ ID NO: 953 - DNA, 876 bp, Homo sapiens
  misc_feature (1)...(876): n = A,T,C or G
ctggccgatctgtatttattatggtcctcccctgagttggcccctgatcacaagcttctccacagcaaagatatctgacgaaggccttgctgaaccccaaaccaggcgatgcagacagtgtcatggaatttgcaaaatccccagacaaaattagtgtatgtgccagaaagcatttttccttggggaggagcatggttaaatttggattcccccaaaggcagaccctgtgaccaagatctgagtgcatacagtgtatgtaaaaggggaccacaggcagcacccatggagcagtagagaagtgaggcaggaaaggaaggcaaacaattcaggatgcgttaataagcagctgactgccatgagcaactggggctaagtcccactgggagttaacctcaggtttctccctactgagggagagaaaacagcggcatctgtcttccagttacattgcatcatcagttgagggctgctcctggtgacatatgctccagagcctcttggttgtcctgtgcctgggctaagcatgcttccagggccagtactgaagacttggaggagagagctgcaggggttcgaagtgagcacacagataggtggaggtgagtacccaggaggtaggggtcagccaagatagctttcactatagaggatatcagtcgaagagcgagctgctgcaggcacccaaagaccaaagccaccagtgtgcaggtgcaagccctgttgttctctttctcactcttgaaatccnactgacttctgtggattggcaacaggctggaatttccaaaggctgaagtcccttcaaagagtatttaatactgggaacctggacataactttgagtcttagaataatgctgtggggagggaatcttgc

SEQ ID NO: 954 - DNA, 787 bp, Homo sapiens
  misc_feature (1)...(787): n = A,T,C or G
agaacagacactgagacaagtcagttttttcggagatggtggcaggaagcagaagtgaaggagcaagaaaagtgaaacagggaaaggaggaaagccacacattggaagtcaatgtcaaggagcagatcatcacaggaagcaagtgtggctcagtcctgctgggatcccctgagtaatcaaatagaacattgttcagaacagtcccagttgggtgtttatccatcaacccacatccttccttaattgaagattacccttggttgcagagataaacaagagaaccctcaaaattgaagcaaacagacctcagtgtgaaagcaactggcttgaatgggaactgtcagttgtagatgcagatagactcaaaggtaggccagagtgatatgtaacatggtattcaacatcatctgctttactttccttgaaaaaaaaaataaagaaatccataaatgaagccacttatacaaatacatcgaagcaaaaatgagtttcaacagaaaaaattatatttttatggttacaaaaataagctttcctctgtaagaaaataattttagttataaaaatgagaaaacagtttattagcaaataaacattgtgccantnnnaaagagagggagagggganattgaggtaatagggaaagtggagtgtttgatagtggtaatgagttgattggaaggaagtaaaaaaggggtnttccggcccttttgggccccaagggggggggtccttgggcgccctctcctcttttgggggggagaatacacaaacgccccccacacag

SEQ ID NO: 955 - DNA, 390 bp, Homo sapiens
tcactgtttatttatatgcgtagttttgcactggttggaggtgatggaatggggaaggttttacagaaggaggaaagtggaatggtgagaacaaccacatgcctatgatatgtctggcatgacccagagactgaggttataggtaattacacagggtctctgtgaggcacagaagtacaaagatggcatctttggtattcaggaagagaaatatggcactgaatggatgcaaataaacttctgctcactgttggggagcacgcagtcaaactttggcattttgagggtgcctggaaatgcagaacatctagaaataccagttctgggagcatcctgacaagttcgtgtccttggaagtcctgaggcttcctctccaaatggattcatcat

SEQ ID NO: 956 - DNA, 442 bp, Homo sapiens
actatttgaccgcaatgtgcttagggatctcaggatcagaagccagaccagccagaatcctcagtactcaagagctttaagaccttatgccagagcccaatgttactccaaaaccttggcaagaaaggtgcactgagatttcaaactccggaatctatctctaccctttgtctgattgggaagtgctttgagactgcaagcctaggttctttgcctgcttctttccaggacctcacatgtcccaatttgcctgggatagtgtcaatttaaaccatttgtcttggtgtttaaatgttatgatagtctgtttctctcaaatttggataaaaaactatgtagtcaccttactgatgaacaaagtgctgtgcagacttaacccaggattctatttacccacaattgctaagtaataaattattctaaaatcttaaaaaaaaaaaaa

SEQ ID NO: 957 - DNA, 718 bp, Homo sapiens
atctctgtaccaggttggtgttgaagccgatcctatacctttgcacaggagtcagcaagggcttggcgagaaagaccacgctgccaaaacaaaacatctgaaagaggctaaccttgactatattttaatttagcaaacactactcgtttatattcgcaggtctattatggagcctaacatcgtcacgacattatccagtgtcttcaagaataaaattacattatacatagacttttgaagctggacacatctcggggagaagaagacgatttgatacattcagcgaactattagtgagcctctgtttgatgcccacaatcatcatatgaactcgcctcatttctcatcataagacgccggcgcgccatccgtccggggtgaagccccagcaatcccgtatccctcttagaagaggcgaaaagtttcgaagcttgcccgggtaatcatcgcaccagtagcctgtttcccatcacaatctcacacaagtacaaagcggaaacataaagtggaggaccctgaggagccttattacgagaacctatcttcactttatttgcataacagctcactggcccgcggccagaaggcatactagctaagagggcgcgatccgagcccctattcaaagagttgcccatgctggatgccgatagggacggcccctgtatcggtctcttatcgcgggggaggcggctcggtggggcctaaaccccatctg

SEQ ID NO: 958 - DNA, 403 bp, Homo sapiens
atttctgcaccagtttggtttgaagccgatcctagacctttgcacaggaatcccattgtctcataaggagttaaagtcttggagagaaagaccaccctgtcaaaacaaaacaactgaaagaggctcagcatgactatattttaatttagcatgcaaataatttgaggaagattacctttatttgtaggttatatgaattaaatttcagaattatcatgtttcaaaataaaattcagtattataattttgaactgatatgcctctacaagttgtaaatctgtggaaagaaatgattgtaaattcgtcaatattgtgtgcttgtttgtgccccatcatcattgtctccctctttctcatcatcacaataataataaaacattttaataatgtaaaaaaaaaaaaa

SEQ ID NO: 959 - DNA, 488 bp, Homo sapiens
ttctaatttccaccgctacagcagctcctgcctggatctgccctgtttgttgtgatgttgaatcgggtcaccacccaaatgacagctggctttggtttaacctgtgtttttccagagaagcctttggcgtggaatgggcattcctggagccactggaattgtgtggtggcaggagcccggaagctgccagttgtcccatggtcaactctgagggctcctgagatggaccatgctatgaaattggagctgtcaaggaggaatcaggctcattacagagatccctgctcaccagtgcttctgccacaacaataagtcatgccatcaattttcaaagtgctgatgcaaatgcccatggatcatgttcaagattttatgaaacttaattaaacaagattgttcacctgtattatgtaactgtacatgcatatttgcacttaacagtatttctaattcaatgtcaacatcacaataaacacatgatcggaaag

SEQ ID NO: 960 - DNA, 725 bp, Homo sapiens
ctgccgatcgttgtttatttgcttaatgatctgtcagttgctattgacctgtgcttataatcttaagaacaaatgtatataaagcaacttacaatgtagcagatttgttctaaaagttttacatatattaatttaacagtttattagctgaaaatacaatgatgaatcagtagattagatcttttttcctttatggaaaggaagtatttaaaatctagtttaagtctgcctgaatggtagagtccagaattcagatccaggccctcattctctgaggcttcgttgttggatgactataatttctcttgtggctcatttgattattaatacttttcttctcttctgtattaagatgcttcacttccaccactattacattggagctctccttctggttccttctttgacttctgtctgacatccacatctccaaatcccatttcttcagttactttttccaaagatctttgaaacacagccatcagtgggagtgtcattgtttgctttgatatagatacagaaggtaatggacaagatttcaagtgtctcctgcagttactgaggtcagtagaggaggaaatatgtaaatttatgcttcttataaggatgtgaagaatttaaaacttcattccctggcttgcagatctggccatactcactgcatccagacacagtaccatattttcttccatctctttgttttcttaggttgaaaatgaaaacag

SEQ ID NO: 961 - DNA, 688 bp, Homo sapiens
agtattcagatcacatgtataagatgccagaaaagattttaccaaaaatccttggctgtgaggacctaacaaataataactcttcagctcagaatttcagaatgcagggtccggctttaatgattgatggtaaagagaagaatatgcattcagcaaggttcaagaatggaaaacagatcaggaaaaatgaacaattttcaggaaaaaaagaaaaaatgaaggtgaacaaaatatctcttcatagcattaaccggagaaacatttttggagagaacttagtatataaggctgctctacacgatgatgctgatcttgttcatcattgtataaaaaaaggaggaaatgttaatcagccaagttatgctggttggacagcacttcatgaagctagtgtaggaggattttatcggacagcaagtgaactattaaaaggtggagcagatgtaaatatcaaaggattataccagattactcccctacatgatgcagtgatgaatggacattataagctcaaaggagtagcattgacccactagacatagaggatgtgtaccaacacaagaaaccaaagttcagttctaaaagtcacatttggcatgtttataatgaaaattccaacagacagaagctggaacatgtaaaagtcaataaaggaagcaaagcgagtttatttataaataaagaaaga

SEQ ID NO: 962 - DNA, 467 bp, Homo sapiens
tcttgctttattgatttcatttaaaagatgttggttgggcacttctaaatttcagtgacctgcttccagtgagctgcagtctagtttgaaaaacaaatgctaaaggaaaaattatacaagtaatcctttagttacatttgggaagagtgtcatggaagaaatatagagtgaactgtgagagtctgcctcatgcagactgttaaagaaggtgtactgggacttgcagaatgagtcggagttcactaggccaagtggagctgaaaaggaatggagggagaccactcaggagagattcagatgcctgggttagggtcttgaggcagaatggcacttgctcctcctgtagtcccagctactccagaggctgaggcaggagactcgcttgaacccaggacaggaggtggaggttgcagtgagctgtgatcgtgccactgcactgcagcctgggtgacagagagacactccat

SEQ ID NO: 963 - DNA, 486 bp, Homo sapiens
tttttttttttttacacacacttttttattttcttaaacattttgagatcctttggtaaaaagtacattgctacattaatgatgaaaatgatgctattttacatattcctttttcaaagtattattttatattatctcatttatcttatttattttacctatataaggcaaataccattagaaaaatgtacttagataaaactactaccgagtgccagggtgacttatgaattccttcacaggtggacattcctcctacacaaactcttatcttctgaaaaagaatccatactcattttgtctccagacacctccaatgatctgagtctctgttcttatataaaaatccaaagcggccagacgcggtggctcgtgcctgtaatcccagcactttgggaggctgaggcgggcagatcatgaggtaggcggatcacgagttcaggagatccagaccatcttggccagcatggtgaaaccccatctttg

SEQ ID NO: 964 - DNA, 328 bp, Homo sapiens
accaggaagcctgggacttggtgggaacctgacaaatcggaacctgacgaccggaactccaccaccggaactccaccacgggaactctttcagaagcgaggggtccattggttaaaaagatccaggactaacatccacctcagcataccttaccataaatggtcagcttcgaagccctccaatcagactctgacaagccaacattcctaaatcctttcccttgccctctgatccctaaaacttgctgcagaccccaaactggggagacagtttgggaccctgttctccttgctgtctggctttgcaacaaagccttttttttctcaaa

SEQ ID NO: 965 - DNA, 389 bp, Homo sapiens
aatgtgaagttgatggctggagtcggagcagccatattggatggtgagttgaatttagcaacagaggctacacctcacagtgcaataagatggaaagagcacgtgtccttgaagactgtactggatagaggtgccatattaacctcggactgccaactttcagattttacatgaaggagaaatatctgtcttccttaggccacttctattttaaatctctctatttactgctgaataaaatctcaactaacgcaaacaccaataacaaaaaattcctattcactcatgatataggattataccttagtcttttttgtgtcatatatctgttcattcaccattttttgctttgatgttcaataaacatctcaaatttaaaaaaaaaaaaa

SEQ ID NO: 966 - DNA, 1264 bp, Homo sapiens
  misc_feature (1)...(1264): n = A,T,C or G
cggccgatcttagtttatttctttagtgactggctggattactttagtttagtaaaatctaggggggagcagtttagggtatgccatggccacactgggacttataaggctctcttcccatgttccctacacacacacagttattaaactccattaacaatctgggattgctctattattatcaacaacgtcctggacataaattcctctacaaaccaatccaatcaaattgtggcttcttcatgtagtttctatgttcaatgttttttatttttgttttctgttgccaggagggtttctccaagctgtcttcttctgcagttctctcctgcaaactagctggtctacggtgttgtctgtacattaattatatccacatatgtcttcttacttgcctattaccctaactctactattcctgagagtgtccctacttttaaacttttccacaatctgtttcaaacaaagtcagttcctctgggaagagattgggaactaccctattttaaggcttgtttctcattcctggcaaaaatgtctgagtcagggctctggagatgagagtggggacaatgacaagtttctttctgagtgacacttccacttaggagctgagtaatgtgaatgatggcagtaagaaagggatgccgggggggcgtgcaaaagcctaagtaaggtcttctcagcttgcctctcctaatatggaaccactgcctcaggagccagggaaacggctagcagggcttccatattctcaatgctggtgtgtccaagatagagcctccattccattagtggagatagggtagaaaaaggcattcccttattggtcaaatcatctgggacttagcctcaacagaaggcacctgaaggtatgatgagaaaggctgagtcttgctcctttcagnaaganaaccctntggatgaagnctgtgaagaaagggagccctatatttttggttgcagcagtcaagagtgaagtttccatctctctgaatagagggggtagaaaggtggagggaggaagtagtcttggttcagataccacagattcatacttttcttattgaattttcttattgaattttcatagattttgcttgaacagatanttcttcatttgctgtttttctttagaactagtcccaaaggcttcgactggtgttttgttcttgttgttgttccataattttcaccagtttctctgaagacacaggtagaaggaaatcctcacgctgctatgccagagtggaactcttacttg

SEQ ID NO: 967 - DNA, 577 bp, Homo sapiens
tattttatttatttatttatttatttatttatttatttatttttgagacagagtttcgctctgtcacccaggctggagtgcagtgtcgtgatctcagctcactgcaacctccatctccccgtttcaagcgatcctcctgcctcagcctcccgagtagctgggattacaggcatagccaccacacccagctaatttttgtatttttagtagatacagggtttcatcatgttggccaggctgttctcgaacccctgacctcaagtgatccgcccgcctcagcctcccaaagtgctgggattacaggcatgagccatcgtacccagcctggtatgcaggttttcttgaagcccctttggtagtactacacttcagtgttttaaagcaccatcagtcctggctggatcctgacaaaccagagaggtattcaggtttctggggacacattcatttcagcctcttttaggccagcctgggaaatagtcaagaggagaggagaactgggttcacatcctggctcagccatttcccagttgtgtggccctggtcaggcaacttcatccctctgagactcatcttt

SEQ ID NO: 968 - DNA, 1097 bp, Homo sapiens
attatcaactccctgcatacaacgacattgtttaattcacgtctgtatttttggtacttaataataagccacacataattgatgtccaaggaaactcgttgaagatgaaactgaaagaagaaaaacatgtttttctactgaaaggtgctgtgtaacttaagaagaaaaaactcaactgattattaaaaggaagtactggattttaagacaggaggaaaaacctttttttctgtgatgtcctaagtaaagagacatttccttatactatatttggtaacacactaaagagagaatgctgtgcagacccattctgtctgtttatatatttagtgtaatgtttagtataattgttggatttcagttttcataggatgaagaaaggcatgaaacatttttgctacaagtttagaaacaagataaaattaacaaaacacaaaattatttttataaattattggttaaaagtgctaaacataacaacactttggagaactgaattccaaaaaagaaatatttcataagtggggagacaggtttggaaggtctcatgcccagggcaagccccctgatcctggatgtaagtagagaaagagcacagttagaaatagatggagattacttcccacgtatgagaaaccaatccaatgagtcttagaggaacgtgtgagctttctatattggataggatctttaaagcaccagacatactaaaaatattttcagctggacacttttatctcatgcctgctgtgatggttaatactgagtgtcaacttgatcggattgaaggatacaaggtattgttcctggatgtgtctgtgagtgtgttgccaaaggagattaacatttcagttggtggactgggagaggcagacccaccctcaatctgggtgggcaccacataatcagctgccagtgcaactaggataaaagcgggcagaggggctggcgcggtggctcacacctgtaatcctagcactttgagaagccaaggcaggtggatcacttgagcgtcagaagttaaagagcagcctggtcaacatggtgaaaccccatctctactaaaaataaaaaaaaataaaccaagatacagaccg

SEQ ID NO: 969 - DNA, 816 bp, Homo sapiens
cttgcctattagttctttattgtgtggttttattcaatatgcaggtattgttttccatgctggaaacatgttctccatgctggagataacagcagtcaaaaaaaatagaggacatttctcctgatgtgggccttttattgttgtgtgtgtgatgatagagaaacagagaaaggaagagattgataaaatgaattaaagaaacagatgaataatatatacatattaaagctattagaagaaaaagaaagtaggcaataattgtgggcaggtaggcagctactgtatttatgtaggtcaatcaaggagggctgtctgaaaagtgggttctgcagaggcctgaatggagtatgggagtgggctgtgaggttaactgatgggaaagtgtctcagacagaggaggctataaataaaaagctcctgaagcaggaacatgctggagtgtttgaggaacatcaagagtctgtgtggagctaaggaaggaagtgggagaaacagacaagcggcagtcatagaagaaaccagaagcaatgtctggtgtagctttgtgggcttcagattgttccttactttgagtgttctgcttgaaaatagattatggtgttgatgcaaagcactggggggtctcgttaaaatgcatattctgattcggtaggttgcaggtgggacttgagattctctatttccaagctcccaggtgacgtggttgttgctggtctgtagaccacacttccagagcgctggtctagaagcaataatgaggacatccactctgctccagaccctgagcgggtaaattaagagagtcgtcgcagcatg

SEQ ID NO: 970 - DNA, 587 bp, Homo sapiens
  misc_feature (1)...(587): n = A,T,C or G
attgacgacactggcacatttcaagtaatagtggttccctccggggccgactacataccagcattagagagactccagcggtgcactttctgctatgatgtgtgcaagccagatgcttcttgtgaccaagccagaccaccccctgtgcagtcttacatggatgctgctttccttctggatgcctcccggaacatgggaagtgctgaatttgaagacataagagccttccttggagcactattagatcactttgaaatcaccccagagcccggagacttctgtcactggagacccgggtggccctatttgagcccatgctccccccgactttcctaccaacactcagaaggagtccagttagagctggagttcaatcttaccacctacagaagtaagctccttatggaagaggcatgtgcacgagtcagtttaaacaacttaaatgggagatgcttttattggacatgccttacaggggactctggacaatgtattntttaaggacacgccatttggagaaaaacataggtctatatgtgacttctgctggggaaacccagccacttagatggggaaatcttacagag

SEQ ID NO: 971 - DNA, 550 bp, Homo sapiens
aatggaagatccgtgaggtcaagaactgtgttttgtgcactgctgcatccccgcttcttagaggaacatgtgccatatctatgtttaatgaataaacaaaggaatgcaatacaagatgacataacatgggcctaatgaacccatccaaactgcgggagaagatgcagggacacatcttacatggctctgaaaagaaaagagagtctccaccaagtaactccatgggattaaaagcaactacaagcaatagtttcctttgaagctcagctctgaagagaacccattcatttcataatcaaattagatcagagggtgagaaggcagcccagcagaaggtcctcatgagatctcccagcccttggatctgaggaataactgaggaagagttggtcttaagagaagagatattagccgggtggggtagctcacgcctgcaatcccagcactttgggaagctgaggcaggtggatcacctgaggtcaggaattccagactagcctggctaacattgtgaaaccccatctctataaaaataatccggatcggcaag

SEQ ID NO: 972 - DNA, 204 bp, Homo sapiens
ctgccgatccccgtttatttattttgtattcataagtactcaaacctgttagtatctctgtaattttccattgaaattcttgcttggcttgttacttgccagttgaagctggaaaacgacttcttaactaaccagctgataccatgatacatcttcaggtagtcatctcaagctacatacggctcttgacagatgctgtagctt

SEQ ID NO: 973 - DNA, 807 bp, Homo sapiens
acttggttcctcgcaaaccacgttacttttgtcttctacagctcgagaagaggagtttccagatgccagatcacatcgtcgcgcaaaaggatacgaatgtgcttcacctgtcgacagaacttgatatgcccgaccacaatgcgttctcgtctacgcggtcgggagaaagcccgaaatccggccggacgggcggaatgcggtcattacgcaactgtgacaggcagcaaaggtccatgcctgcccttggactaaccacggcggaatcgcagtagtcctaggccagaaggcgacgtgcagagcgtttagtgccgccatctaatatctcaccatagagtggcgatttttatgtatacagttcatacatacgttcggggacaacacaagcccatggcttaggttatggtctctatataggtccgcagctaacacttttgctggtcgtggtggcttacctagtggtgtgatccagaccctcatctctgaggaatctgaagtcctgatgaccatgcccttctcaggtattttggatttcttgcttccagaaatgaggattaaaagggtaagctttcctgatgaggggaaatcgactccgataatcaggagaaggtgggctgctgtcccacagtgcagacaagttagaagagcatgctctaacttgtgcttgttctacaatgggatacgtggaggaaagcccaacctgaactgcagataagcccccagctgaatccaatcaagttcaaccaagctcagaaaaacttcagctgacctacagatattttcacaaggaataaaaatggttatggcaaa

SEQ ID NO: 974 - DNA, 783 bp, Homo sapiens
ttgggggagcgctgatgaaagtcaggggtggggttcaaaatgcaataggattatgccttctttcatgctctatttttaatagataagtgacattttctgaaaatatattgataaaccaatgtggcttactaaaattgacttttgcctatgttgcctaagatccggcattccctctcctacgtttaaatgctagaaaaattattgctggtctgtaacccggaaggggcaaatgaacgttcataatttgtacacgcgcccgaggaacaccaggaataatctgcaagtgcattagcattagaatggataaatgaattatggtatattgatcccatggcagactattcatcagtgacacaatacaaacagttacacgctgtacatggatgagtcttaaaggaatagcagagaataaaaacaggaaatctggctcacgcctgtaatcccagcactttgggaggccgaggcgggcggatcacgaggtcaggagttcgagaccatcctggctaacacggtgaaactccgtctctactaaaaatacaaaaaattagccaggcgtgatggcgggcgcctgtagtcccagctactcaggaggctgaggcaggagaatggcgtgaacccgggagtcggagcttgcagtgagtgagccgagatcgcaaccatgcactccagctactcaggaggctgaggcaggagaatggcgtgaacccgggagtcggagcttgcagtgagtgagccgagatcgcaaccctgcactccagcctgggcgacagagcaagacgccgt

SEQ ID NO: 975 - DNA, 776 bp, Homo sapiens
atgtgtcagcagtacctgtgaaacctgctgtgagtagacagtaccgcttgtagaaggcacgcacagatgtcggcttgtggatggacatcatgttagtgaatggacattgtttgaaaaggcctccaaatggactcacaaaggaaagatcatgaggtgagaagctgctagaaacttggaaacgtggaagaagtggaatactgaagaagtccaatgttctggatttgcatctgggctctgctgctgacactgtgttcccttgggaggacctggcacactttactctgctggtgctcacgctggtgggacaccgagcaccacgtgatgctggcccatgtgacgctggcccacgtgatgtctgatgtcttgcgtgtgtgagcacgagcaggacagagtgattccaagatttctgcaatatccaacttctccttctatgacacttggagagctctgtcctccacttccctcccagagtggggaaactcgagccaaaagatagcaatgaaagaaaaacccacatgggggtcccacgtctggtgaagccctatcccctccactcaacaaggattaccttgaaagacctcctatgagcccggcactgagaggttacaagagcctgtatggtcacagcctttagaaaaggagcccttatttttgggaacaatataaaggctcaaaacaaccctctgaacctgtctaggcctgagtttgctggtctggaatagccaacatctcgagggtattttctttctgacaccacccgaaatatgcagtccttg

SEQ ID NO: 976 - DNA, 301 bp, Homo sapiens
agacgcccacccatccacaaccctgctgttcttcacagagcttccaggaatgtcgtaatgcttcactgtcaacaacaatggagagccaaggacgatcagctgtttaaccaaaaagaaagagagcagagaaacaaatgaattcagttgaaacaatgaaaaatttgggaacagaagaaaatctttaaagctcaaagctataataatatataggcctaccttggagagattgagagttcaattccaaactgcctcaatacagcaaatatcacaataaaacaagtcacgtacaaaaaaaaaaaaa

SEQ ID NO: 977 - DNA, 914 bp, Homo sapiens
gtggcaacgagggcagcaaaaaatgctcttggtgaagagagaggttgtgccattaagtggtttatcatcagcaattttaggatctttgaaaatgtaatacatgttttgaaatgagtgccctgtccagataaccacttcttcctcttggttcttttaactgctgctagaatctgaaaggttcatgctcctttcatacagagatgtgtgactttcttctgtgaattatcacatgagagcatgcacagaaaatatgtccggggatagggacagtgtgggaatgcggctgaggttggttggacaatgggactgagagatcgtcatgagctgtgagatactaatttttaaaagaacatacagaaattatgcccctaagggagtaatgtctcagtaatatcaaatctttatcctttggagataaatttgatttttggaaaaatccaaaagtcatctggaatgtagtattattataaagttggtttaagggaaccaatttttcttatgtggttcaccaactcattctaagaagcgcatcttccaaatcatgtattttagtataattttaatacaatggtggcttcatgagattaagcgagtcatcgttctagacagaatcatctgttggaagtatgaggttggtggtacatgtgctttgaagtcaggtggatcaggcctttagatttggcttcatgtatttccacgatgtatgagtggggttgctgacccaggtgaagcctcagttcatttcctaacctgtaagatgaagataattctagtatctatcttgtggcattgtgaagattaaaaaatgatagtgtatgtaaagtgctctgcccagtgcctagcatatagtaaatgctcaataaaccgtcagcggccggcgtgacccgtgggcattattcaatcgagatatttaa

SEQ ID NO: 978 - DNA, 326 bp, Homo sapiens
cgtgagccactgcaaccagccggcaatttcttaaaataagaaaacaatgcgtgtaatcccagcactttaggaggccaaggcaggctgatcacctgaggttgggagttcgagactagcctggccaacatggcaaaaccctgtctctactaaaaatacaagaattagccagcgtggtggtgggtgcctgtaatcccagctactcgagaggctgaggcaagaggggaatcacttgagcctgggaggtggaggttgcagtgagccaagattgtaccactgcactccaacctggatgacaaagtgagactctatctcaaaaaaaaaaaaaa

SEQ ID NO: 979 - DNA, 316 bp, Homo sapiens
agacaggttgtaaagaatggttctcagtgctgctttcatcatgaaagactgaagaatcactattggctcattttataggaaagaaatactttcacagaagagcatgcctatagtaactttggaaatattccacatcttggaagagctggcttaggatataaagaaacttgaaaataaaaaaaaatggcctaatcagaaaatatttagtttttgccataaactatatcaaacatgtagacatagtacacatggacttgcttcttttggttttcagtgcctgtaacttattaataaaagtctggcctcgttggcctca

SEQ ID NO: 980 - DNA, 796 bp, Homo sapiens
accagcaatattcctggctgctcaatcagcccaggtcctggagtgatgaggacttggcacagagtctccagccaacccaagatagacatgaatagtgagagaccctgtggctttcaaccaccgagactttgaagtaatctgttctgtttgtttctgcaacattaccaattccatcctgatggatcaagcttggcacaacaaagcatcttcagaaggtgaagtaaagaacacaatgaaacaaatatttagaatattttgcgaatatggtgtcctgagaaaatacaattaagctagatcagcagttagcacagcctgaatggcaaatcaaatcaaatgaggatgtgactttgcagaaagttgagcttatatatatatatttcaggaaaatgtataatttattatttaaaaaaggactcacaatatggattataaatcaaagtctaaccttatgtcatctggggataaaatattaaattctccataattcaatttccttggatgaaaataaaaatgtaaccaatattttctcctttctaatttcttataatggctgggaggggtcaaaaatataagaagtggaattctggggaaaataattaatatatgatgaaagggacatactaccttttactggtactagagctatatagcagagtaaaatattctttcttattatggttctggggtggggaatggaaaaatttatttctgtaaaaccttagaaaaaaattatggggataatttgaaattgggggcctttttattccagtcatttccagttaataaaactcgtaac

SEQ ID NO: 981 - DNA, 476 bp, Homo sapiens
cctgctggaacactctcttaatctcaccgctacaccaattccgaattccaagaacctggacaacttgccgtctagactttccatcaggtcttaaaaataaatatgaatttagattccatacatcgattaattgaggaaacacagatcttccagatgcaacaatcatcaattaagtcacgcggcgacatggtggcccctgcctcaccccccagggatacctgtaatacctgtcttctacttcatgggctacaatctcatgctgctcacaatttctgtgctcactcatataacaccaacaaatgggatatttgtgaagaacttcgcctgcgggagcttgaagaagtcaaggccagagctgctcagatggaaaagaccatgcggtggtggtcggactgcactgccaactggagagaaaaatggagtaaagttcgagctgaaaggaacagtgccagggaggaaggaagacaactcagaat

SEQ ID NO: 982 - DNA, 626 bp, Homo sapiens
ctatttagattctctagtggtcaataaattatatacgaaccgcgcgcatctgtttttattaacctgctgggctgctccactgtaaacagaggaggcagccccgcttacaggctgctgtggggttttatagggcaaggggttaggttggggtggcggaaactgagtagtgttgcaggtattgcaactgtttcgtggaaatgtttttgcctgctcggctaggcaaggtggacagatgtcttaaccgcatcctggaactatttaccagttctactgaaagtcttgcacaagcagctgtagaaaagggttgggggtgcttgtaggtggtcacaaaggactgtattgagaaggccatggaggaggaggaggggtagcttggatctctaacaagagcttcttcatctaatgtttactataccattttcttatttgtaaaaggaagatttggaggatcatttgaatacccatccaacagagatccatgattcatgtatttctcaagacagccatacacttacaagattagatcatcattaacagtcaggtagtgagagatctagtcccaaatccacatttttccagctgcatccttgaatcactcctgacaccaggtatgttaagttggctat

SEQ ID NO: 983 - DNA, 778 bp, Homo sapiens
attccatttggatgctcccatccggactgtgtgcccctgtactggaactcaagtgaacacttggctcaacatccattgctgttctcatgaattccaggccaattgtcttggttaaagacaagacggtgtttccctcttgttgcccaggctggagtgcaatggcatgatctcggatcactgcaacctccacctccctggttcaagcgattctcctgcctcagcctcccgagcagctgggattacaggcatgcatcaccacgcccggctaattctttgtatttttagtagagatgggatttctccatgttggtcaggctgatcttgaactcccaaccttaggtgatccacccacctcggcctcccaaagtgctgggattacaggcatgagccattgtgcccggcccatttcatttatttttatgtgtgctgctgaagcaagcacttatgtgtaggaattgttcttcctgtgagcatatgttggccagcctggaccacataccaagatcccatctctttaaaaacacagattacgtggcacctggcacctggtcccagagacttcatttgggttggtcatttgaaacactagcctcccatcaatttagtgtaatcaatccaaatcatgtgtccctcattaagagactaagaacgcctccacgtctatccagtctattttgtaatcacccaactggttgtctaatattaataaaactgggtatgcggcaaggtcctttcctcatgattatatcatcgccacagaacaaggaataatcgtgtt

SEQ ID NO: 984 - DNA, 656 bp, Homo sapiens
atcacctgtagacccaaaacaacttcaaatagccatttccttcactgctgtgagcagatgtagacagtccagaggcctcaacactcctgagcccttagaattgaaggtgaagaaatgaacaacttttgaggatgactaaggggaaatttttaattgtgataagggaggaactatatcaaactactttaaaactattcacttagctagataaggaaatgaaggcacaaagaagtcaagtgcttttccaatgccagagaagtaagaggctctcaacgaattagaggatatctacccagaatggggaaatcagaggactcaggcagttcatggaggcagcaggaatgttgttatttcaaggatttgatgtactattttacttttctgtccagaagtgctttagcaaacaccaaggaatcatatcaaaatatttgaagattatgggaaaagagaagaaataaagaaaaataaaacaacattcaagaagactccgggtttgaactttgcggaaaaaaagtgagctttgaagaagaatatggtttacatgtctttgttttccaaactagaaatgttaaccctaatacagtacatagactacaatctaacccataaaactatgaaagaaaaacaagtgtaaattcaataacaataaatccaga

SEQ ID NO: 985 - DNA, 882 bp, Homo sapiens
  misc_feature (1)...(882): n = A,T,C or G
attgtgaagaaacaagctgctctaagtctcaagattttgtgaagtcagtggaactcttgtagataatgtggactccaacaaagacaaagcaaaaaataaatagacttgaaacatcgaatcaataaatcaagatgtatttctgaaatatcccagggaaggaaaatacatgactaattctattttttctctttgtagtataattctaataccattactaatactgccagtattactagctagcatgtgtggagcttgtagtatgcaatggactgtctatatagaaacacaatttatatattatttaatgtctttctcataaaaattctattctgatatgaaatagagaaagagcaagaatcttgctgaaaatcaatgacctgngaagtggtgagctgggattttcatccataagtgaataatatttaaagttctatagagcagttttctgaggtttgacagagatagatagggtcaggaaaggagcatgcatggggcttcaaggattgtgttttactttggagtgtggctggtgggtaagtgagctctcatatttttagtcttcacattctaggcatacactaccaaatagttctgtataatttggagatactctgtatttcagttggaataagactatcaaaaaaggaaaaataatattcctctaaccacaaaaatgctctacttggcgtttaatggactcatggaatttataagaaacatagggggctctttatgatgggtgcgtacccaatttagctacacacagaacattgaaaattaaccgggttttactgcatattacagtggaggcctaaatctttttgtaaaccaattctaaccaattcccccccgcccggaaatatttttttaaggcggggaaat

SEQ ID NO: 986 - DNA, 675 bp, Homo sapiens
ggccatcccgcttattttttttttgtattcttcagagaatctcactcatttatttttagttttgttctactttgtgatgcatatgcatttttgtcagctaccttaaattcactttagaacaaggtgggatataaatatgaaaaacaagtgaaacaaaaattacatatcaagggaagacaaagacatgtattgtagttttcttaaaggaatttagagtcaagctggatagaaaaattgtagtcattaaaagttagctagctgcaggaggtggagaacatttgtttcttaaagagttgtgtagacaagaagtgttataattgtttgcaggaagcagtgaacccgttaggcttcaagaataaactggatttgagattttttccttaattttaaaagatagataggatttgggccagctgagataattgggaaggattcaaaaagggaagtggtttattaaaaggttgatatgttagaaaagcccaaggcatattttgggccctggcagaagtgcagcttggctggagagtctgtccagtggaactcttgagcagtggacttcttttcttgcctaagtattcattcactcatgatctgggaactggacctgagtttccttttgagcaaccatcctcccactactcaagctctgaagtgaagcatagtctgaggcctggg

SEQ ID NO: 987 - DNA, 1198 bp, Homo sapiens
aaatgtagcctggcaaaaaacgtggggtggcctcagcagaggaaatgctgccagctgaaaacaccggatgtaatcgagaccacaagagacacagacttagttataaatgtcgaaataaaaagaggtattggaaagaaacaaagtctaactttttattggctggattaattattgtagtgaaatcttgctatttcatagtttagtcccaaacaaaacggcatatcggggaattatttttataatcctaggttccactttctagagctttaaaagaagaagaagaagaaaaaaaaaccctatggattcttaccatccctggccattttcctactactgtgggtaggggaacagaggttttgggtgtcaacctacgagacagtacaggataggttggatcggcttccacaaatagctgggaaaagagcatttttaaagaatgtcttttagcatcacagaaatgtccttttactatataaagaaccagaataaatctgtctatagatggacccgtaacagactaagttaattagtattattaattctctttggcaatggggtggggataagaaaacttaattttaccaagtctgtaatagctgtttttctattcccgccctttggcaatgtggcttctttttgtatagcgtaatgggggataacccatgttccttccctattgggctatgaaaatccaaatttgaattcaggacaagcataacactgtgggatccctatgagcctcctaggttggctattagtgctttccaagttgcacttttcaacagttatctattgctttctatgtaaagattgtttcaattaaatacatttgtctgttcaaaaaataattcttcaggcaaaaatttaaaatttaatttactttttagccagggaaaatgatattttaattgtcaaaatataatagtttttatttaagaccctgactaaagggagcagttagcagtttttgcactttaaagttaacaggaggtctcctttcttccttttttttcgtgtaatatgatcaatgtttcttggaaaggttaacatttctcataagagattaaaggacccaccataactcacacaggagaaagtgggcatcttctgatggtaagaacaggtcatttttgaaactatgttgttatacatgtcagccatcttattaagtaagctcttggaaaaaaaaaaaaaaaaa

SEQ ID NO: 988 - DNA, 231 bp, Homo sapiens
gtagcgatgcggtttcaccatgttatccaggatggtcttgatctcctgacctcatgatctgcctgcctcggcctcccaaagtgctggattacaggcggggagccaccgcgcccggccaacactgcctcactcttatgagcagcccaccctgaattctctctctcccgaggtgtactgtctactctgcacttaactttcaaaatattcggggggctttgcaataaaccctga

SEQ ID NO: 989 - DNA, 852 bp, Homo sapiens
cggccgatccgtttttattaatgtttcaggtataaaatgggtttcaaccaaagaaatggaacaaaaatatttacaattgcccttaaatctctgtggcctaaaagagatcttttgcttggtaaattttcatctttctttgtcgtgaaactacagctggcggaggagaaagtggtagatggtcagcagcttcagttcactcagaacatgtcatgattttatgtctgttgcttagtattgcacatgtggcctgaaatgcagaaggaacagtttttctgagataaaagagcagtctctgaaatatttccatctgtcctcgagatgtcagttgacaagagaaaccaacagcatacccagtggacctttagcctgtaatccccattactttgggaggtccaggtgggaggatcacttgatgccaggagttcgagaccagccttggcaaaaaagagagacccgatcactacaaaaaaacttctactgtgagagttacttgaagctcggcgtccatgatggtctagggggcttctgaggcgatcaggcagcattagtcttcagccgctaagccaagaagatctgggaaggagtcagtcagagagccttgggccagagttccagaggctctgggagtggctggcaggtgagttgaagagtccgatttcagtggggtctggattaaaattggtagatgttccttgggctggggggtctgaggacccgaaatcgtagggggtagggggtccttttccagagcaaaaacagacggggattgtctctaagggagcccctgatcaagtacggcccaattgatgccttccgtgaaagaccccaacgggttttgtgacataatgtgtt

SEQ ID NO: 990 - DNA, 246 bp, Homo sapiens
aataagaatacacataggcaaacaaggtcactgcagcccgtgccaagttctaggagaacgtagagggatatgatcatgagaacaagggactggatagtggcacagcactggaagaaggcctgtctgagtcactgagatttatactgaatcctaaagaatgtggaaagaggaagcctttctgactgtaagggaaaatatcattgtgagcggagcagagaagaatgctcaaagaccctacggcagtca

SEQ ID NO: 991 - DNA, 701 bp, Homo sapiens
cggccgatccgtgtttgtttactccagaaagaggggctggcatgcacaaataccctagagcaagaaggctcctaacatgttcaaggaactgaaatcaaatatgattgcagctgagtatgagaagaacatcctagaagctgaggcaggagaggtgggcaggggacagatcataggagccttgtaggtcgttcaaaatattcttatttctttccctatacagctatggaaaactaagaaaagattttgaaaagatgccttctagcccatgtttaaatctagttcacatggcagaaccagcagccaggacttctaagaaaaacatgccactgtgtctcgtgttgcccaggtacccctgctttgctgcagacagtatcagccgtttgaaccaccctgtgtcatttgcaagccacatgctcatgaatgatccagtggagcctccacgcataggtgaatggaaagaaatgaggccagagcctgatggcaggtaccagatgtaatgcaatactgcatgtgtgttcttcaaatacatgcaaaaaagttcttcagtgaggaccaggtagagtcctgggatttctttttcttcttcctcttccttctcttccttcttctcttctgcctcctcttccccgccattttgttttgttttgttttttggtctgtggttttcaatattgatttgcttcttttggattatcggccat

SEQ ID NO: 992 - DNA, 671 bp, Homo sapiens
  misc_feature (1)...(671): n = A,T,C or G
gctatctgagacgactctcttaacctccaccgctacaacaggcctgcattattgttgtcgagttcaaaatcatctttcaaaatcaagaattgacatcagttcattacccacggacatgagacatcaatcaatatatgtaagaagtacattggttcggtctggaaaggcgggagatctcgaaggaaaagcaggaagactggaagctggaagcagggagggggcctcctggtcacatanaggtgtggtaccaggaataatgtgggaggctggattgaagtctgggccaggaacaacggtaattgtgggagactcaacaaagaaagacttgaggagaaaaggagagatgttggaatgaacaagcagtccatggagcagttacacacactcatcaattaagtttgctgtctcatatgagggaaattcatggtaccccaaaacaattaccatagtaacattaaatatcactgatcagagaccaccataatgatataataatgatgaaagagtttgaaatacttcaagaattaccaatatgtggcacaaagacccaaaagaagcacatgctgttgaaaaaatgacaatagacttgctcgatgcagggttgcaacaaaccttcaatttgtaaaaaatgcattatctatgaagcacaataaggtgaagtaaaattaaaa

SEQ ID NO: 993 - DNA, 653 bp, Homo sapiens
  misc_feature (1)...(653): n = A,T,C or G
ttttctcctgctacatattcgatcaactaatatctctcatctgtacagtcttcaagggattggttccaggatccaggcataaataaccaaaatctaatcatacccaagtctcgcagttagccttgcggagcccagggatacaaaaagtcggccctgtgcatagtcggattttacatcctgcaagtactgattttcaatctgngtngagctcgaaaaaattcacataaaagcagacctgggcaattcaattccttgtagttcatgggtcaactgtattcttgcaagagcttctaaacaaactgtcctatcaactttgttctaatactggatgatgccatcactcattcaatcaaactttgtttattgagaatgccccacattcaaacatgatgccgagccctgaagggaacaacactaaataagctttcagtgaagagcttaagcaccaactccaccatttagcttctcaaactctaagaactttatcacagaacaacttgaaaactcttgacagatcatgaaggtgattttaagtaagataggaggaattacttcaagaacataatttaattactttgtatgaagcagaaaaccaataaaaagagacgcgtccgtccttctcttcacttaacaataatttatcgtgctactcc

SEQ ID NO: 994 - DNA, 899 bp, Homo sapiens
acacagcaagaaggcagccatctgcaaggcaggaaaagagcactgatcagaaactgaccatgttggcaccctgacctcagatttccagccttcagatctgtgagaaaataaatttctgcctatgaaatacccagtctatggtattttgtatggcagcctgggatgatgacagagggggaaatggcagccacgtatgagtcacacagaagccacaggtctggagtgttggaatacagccagcaaagttctcatccttccccagtcaagattgctttttcttgtgtcagtcagcatgagaaacattatgctacagtgacaaccccaaaatctcagtggctgacaaagtcactctgtcccagggtgccagaggctccatctcaacatgtgcttttatgatcggaaagacagccaggcacggtggctcatgcctgtaatcccagcactttgggaggccaaggtgggaagatcacttgagcccaggagttcaagaccagcctgggcaacatagtgagaccccatctcagaaaggaaaaaaaaggtagaaagaggattcaaggcaggaaaatggcaggaggaaaggattggagagtgaatttgggggcatgttcaaaaggcaaaaaggagacaagccaaactgaatcagaagtttctttgtaggaataacagaatttgaattctgctttataatctttgaaggtcatgtcctgtgtctttgtttaagtaggcagtggtgtgcagatgtttgcatttcagaataatttttctggtgtaaagcatgtaggcaaagatgaaataaaccagaaaaaagaagtcaatttattactatacaatagcctatgtgatgagcacctggaaatgagtgttcattataggaactaaaaataaagcatgatcggccg

SEQ ID NO: 995 - DNA, 285 bp, Homo sapiens
caatcctcagccccttgggtgtctgaaagaagtacagagaaactccagctccagttcccaagactgaatggacatgttcagcctcccaactaaccctatctgcttggcactatttggagaagacctcagagcatttcacacatcaccacctgattccttgtccctttcacctctgccttggaaggattgtaatgcactgtggtaatcacctgaaattttccaacagctgcaattatctagctgttctcctttccttatttttgagggggaggcaataaagaagga

SEQ ID NO: 996 - DNA, 368 bp, Homo sapiens
aacagggagaaggtgacaatcaaaatgaactgcttttgtgagacacagggccagaaattaaaaccactcaatccctctaggtccagggactatcatgaaagaggatgcaagttctcctgaagacctggagatcccatgaggctgaagaccacctgtaaccacaaggggtcagccttttttgaggtgctgctgacctcccactcatctgtcaagttagccagtgttaagctgtggattcaccatactcatctaaaaccagtacctctgggatccctccaggggagattgtcgtggtcttttgaatcctcagatggccttaagttaatattcaaagccctcgttcaaaactctacataagataatataaa

SEQ ID NO: 997 - DNA, 115 bp, Homo sapiens
aaaatggctagaaaaagggaatctaagatagtggagccatgtattgagaggagccagatacctgtgtcaacacttggagacaagctactgaggaatgcatacgaataaacaacga

SEQ ID NO: 998 - DNA, 803 bp, Homo sapiens
ggagatgatccgttaaagatgatatcgagagatctgattggtggggatcacccaaagaaattgtgactgcacacaaactgttaaactggaaatcaagaaaaatctagatactttatgtcaaacaacgaacagggactcaacctgcttgttattggaagactagatgaaaccaaaaatcatgatttccaccagaaagtccggcttctaggaatcacctctgctgtcttgcaaacaaagtctcctgctagcagatacagatttttgtcttcagagtaccgggtggcaggacttttcttttctcttctgcagggtatcttcaattgtaattctttcacttatacttgtttagccaactgctgtccttagggaatgaggcaagaaacttccttccacataggtgtttaatattttaatattaaagacttttcatctcaaggctttgttctatgcattttcattaaatattgtgtttttggaatcagaaccgaaatttataaataaaatacatatggtaatcatctttctggaagtaaaaaataactcagatgaattcaccacaaaatatatttccagtaaagcaaagaaacaaaagccaatttcaaattttttttcatttcatagtgtattaatgtgttaattttgtgatgaatcctagaatcacttgttataaaaacaggtggacactttggatacaacaaaatgttttgtttgatatatttcaaaagtattgctactattgtgacccgcagatgacaggcaatggtcaataaagaatacagtgttcataaaaaaaaaaaaaaaaa

SEQ ID NO: 999 - DNA, 283 bp, Homo sapiens
aaagaacccggagctgctgatgtctgagggagtcgtttcaacagagactagaatatcgagagagaaaattgatccagctctcttgtctggtgcttataaaacatgaaagtatcaccctcgccatggcagaccacagggaatgatcagtgtgaattgttaagtcctcttctcagtgatgcttgcaagcaatttccctggggaagcaacaagttcctgaccacagtgttgtacacaaataaataaacaaaatgctattactttttgttcttcaaaaaaaaaaaaa

SEQ ID NO: 1000 - DNA, 893 bp, Homo sapiens
ctgccgatcggggtttattatggtttctctttctcatcttctcagagagggagagatgtcagaaaaatgatagaattgtcaaaagcttgtgcaatcagctaaataaaaaaacaggtaataattccactttttccgttacagaatacaagcaaaaagaaacctaccgctacattcaagtattttagggtaggtatgaatatgcaagtgatggggcatccagggcagtgggaggcgtggcactttctggaagggtgaggagaaagaggagcagctgtccaggcactgccctgggtttcctcctactctgttgaagctgctcttgttatgcttgcctgtgtgccttgcatctccacatccactgcacactttgctgtcttcttactccacctctcagccacgttgaacacagatggcaacctcctctttcttcaagcatgctgctcttgtgacgcttgtgatgccatagactactgcttctcagcgttcttgtgttttcctcccgttctatttctttttaaaatgttgaccattgataagtagaatttaatttttgtgtagtgtgtaaatttttaatcctttagcgtattgtatacatctttaattaagaaattcttccttgggccgagcaaggtggcttacacctgtaatcccagcacttcaggagtctaaagacagcagatcacttgaggtcaggagttcaagaccagcctgcccaacatggcgaaaccccatctctactaaaaatacaaaaattagccgggtgtagtggctcacacctgcagtcccagctactcaggaggctgaggcaggagaattgcttgaacccaggaggtggaggttgaagtgaaccaagatcgtgccactgcattcagccagggccacagagtgagact

SEQ ID NO: 1001 - DNA, 320 bp, Homo sapiens
tttttttttttttacatgaattctcatttaattctctcaacaaccctataaagtagaaactattatttcccctcactttacagatgaggaaactgaggcacagagagactaagtatcttgctaagggtcccaaagatagtatgtaatagaaccaagattaaaatccatacgctttacttagttcctccttcatttcgtaattgcagtccagaaagacaaggtcttcctatcagaaatctaggcagccatatctctacaatgtccagtgataacaaagtgtattgtcataaaattttagtgccaaattgcaaagcatcaag

SEQ ID NO: 1002 - DNA, 412 bp, Homo sapiens
cacaggatgaagttattccctaaagttctcttatctgcctaaagtcggaacacaccaaaagagaaagcaattacctctggtcgcttccttcagttttcaggaactgaaatatcacaggaagaaagactgaagtctgtcaacaacacctggatggacttttgtcacaagctattgtcttctctgcaggcccagtcgactttgtcccaggccattgcatacaatgttctttaagcccattgaattcccctaaaaatcacttactactcccctaatatcatccacacttccttatctcccctttccctataaagaagggtgtataaccatctgtatcccactgcgtggttgattttccctctgggattctctcctgtacacattaataaatttctatgacttttctcttgttaaa

SEQ ID NO: 1003 - DNA, 855 bp, Homo sapiens
cggccgatcattgtttatttttatccattagaacattaaaaggaatcaagtgttgacttcatttaagaaacagcactaaaataaattaacttacaatatcgacccttcagtacacatcttttaaacattccttgtgatagctgggaaatatgcatacttagcttctggaagtcaaagtatgatgattattttaaggaacagcacttgtgtgatacagttgtgagttgattttgttactttttcatggaaaataattttcaattgaaaaaatagctaacaagaaatcttaggttattcagacatgggtatttagtagacattttcttaaacagaataaactgatcctgtcacttcaaggaaaacaacagatactatttgttgccaataaatttgagctttcaagtgacagaattttggaaaacatggaaccactattgtgatcttgaagcttcctagtagctacatatttctcttatgatatcagtggtgatggtgtaagtgtgaatttttgatacgatatatttaaatatgtcaaatttggaggaatcgaaaaactaaaaaaatctagtaatttccaagtgacatcatgcatgatgttatgacatcatgcatgatgttatgacatcatacataggtaaaagatccattgaaggtgggacataaactcatggatattaatgtaccagggtacagaacattcactgataagttttcagattctacattacaattttcacattgatgcttttaagaaattaccgctgttcaaattttggtatggtatcacgtgaggataaccacagttatctgaaaaggctattataatacccttcttttcacatacatttctgtgtg

SEQ ID NO: 1004 - DNA, 862 bp, Homo sapiens
atttatttttctaattatttttgagaaacagggtctcgctatgttgcccaggctgactttgaactcctgggctcaagcaatcttcttgtctcagcctctcgaccagctggtactacaggtacatgccaccacatccagctaataattttgtgtagagatgaaagtcttgctatgttgtccaggctagcctcaaactcttgggctcaggcaatcctcctgcctcagcctcctgagtagctgggactccaggcatgaattaccacgttcagctttcttcctctttatttttgcaattttgtggaatgctcctactaagtgctaaattagaatttgccataatattcatttaggtgccgctttggtgcacagtacttgctgttacacaggatgagcttccttttgtgggaattaagactttaatagtgtcttctttggagctttcaccaggtttaatgccagagcccaagcgtaattatagtgcaggctgttaatggattaggtggtggcttttgccgccttactgtgtgcctgttttcttccatttggctttgtgctggctcccatcatctcctaattatctgttcccctccttgcttgactgccttagaagttataagggtattatctgaatccaaattaaatttcttttttctttaaggaaatgaaaaagagaggtttgttttttggtttggttttgctttgtgttaggagtagcacactctatccagagtaatcgaacagaaaagacatataaaagcatctatggtgttcaagctttatgaagccaagtaagatcaagtcagctccagccttgctttggatgcagtgggcatattcagtctcttctccacctcagggtatc

SEQ ID NO: 1005 - DNA, 1337 bp, Homo sapiens
tagttgttacctatacagaatcacgtctagagtcaaaatgaatcttaaggaagattgagtcaactctttgtctcagcaactcagcgacagaggcgagattagaaaccttatttgttgaaattccaatttattgaaccttttattataacctaacacagaaaataataaccctgcacatagagtaatacatagtttataattaattcaactccttgagataacatcaatgggaaacaaacatttgtttcctgtttgcgttaaacttattagctagtttttcaaatgggattcagtcttcctcagaaataaatttatttagagcagaaaccaatgtgaagaatctcttgccccctctttggagacaaattcatttgtgttggcatatagggcactgctttgtgcactgggacattatcttcacatatggtgcacaaatttcttgaaggaataaaatcagtataaaaaaggaataatttttacataatggtcagtataagatcaacaattttctatcattaggtgttaagggttttaaggacaatcattatcaaatgagcagttgtttaacagtgtgttaccaaacatcataaaacaggatttggcttttgttgaatctgtagtcgggtagccttaatttgatatgtgactcagaattaaaacaaaacaaaaactatttttgtctttctcattcaaattaataatttttgagaaacaggatgccctttgctttaactagataacatttaaaacaaaatattttggtaacaatttagccaacttacatttgttgttgtcaagtcggtgcatcagcaaggaggcaactccaagaagggaggggggctgatggtatttgctagtgagagggtcctgatcaattgagtgctattagcaagggcattgttcctgccagcagaacattaaaaaccctggtcaaataataccttctcttgaattcatcagagatctgaagtcacagggacaaacagaaccccaaaatttgctcaactggaacagatgtcagtgaaataagttggtcagaagatgcagacagaagctctcaatgagttgctaaagctgagtgtggattatcctgagatgatgaaaatcctgtaggtcacggatgtgggggaggggatttacactttcacaggcgcactttgcacactttccttttcacaaagcatttctcagaagcctctccaaatactcaaggggaacatcaaggagaatccctggaaagcttcctcctggtgcagtttgcggaaagggaatgttcaccaccacagaaattctgcccagagccatctctgtcttctctcctaagaaacattttcaat

SEQ ID NO: 1006 - DNA, 171 bp, Homo sapiens
ttgatgaaaatgtgctgaaattggaatcctcaaacattgctggtgaaaatgcaaaatacagctgctatggaaagtagtttgttggtgtctcaaaaagctgaacataaaattattatatgagccagtgatttcactcttaggtatattctcaaaagaattaataaacgacga

SEQ ID NO: 1007 - DNA, 549 bp, Homo sapiens
cggccgatcaggttttatttttattttatttattttttgagacggagtttcgctcttgttgcccaggctggagtgtaatggcacaatctcggctcactgcaacctctgcctcccgggttcaagcgattctcctgcctcagcctcccgagtagctgggattacaggcacgtgccatcatgcccagctaagttttgtatttttagtagagacagggtttctccatgttggtcaggttggtcttgaactcccgacttcaggtcatctgcccgccttggcctcccaaagtgctgtgattacagacgtgggccaccgcgcctggctgtgatgttttttttttaacttgttttccctgtcctgtcctgttcttcaggtatggcttctcccacttccattcgcgaatcactgcctggaccactttctcatctcccttgagcaggtccagcagctttagttccagtgccttagtctccttgcggagctgactgatggtctcctggttcttcttgatgttccactgagagctctcaaaaaaagccttccggtcaccct

SEQ ID NO: 1008 - DNA, 577 bp, Homo sapiens
cttcgttaaatgcctctctagaaataggcggaggtcgaactctccatgggtggtttgcatggatgcagcagaggtgactcacgtttgccgatcttaagagctgtacagatggctgggagcggccgattaaaacctccttgacaactcctcggagactgaagaccacccacctccatcttcactgggagcaaatggactgtagagtgagcaacatggtttctgacctgatcctcaggccagggggtaaacaaaggcagcttgaccttttgctaaacagagtgtccgggaaaataatcctcagcttgttttgaatgcacgctggacagagaattactgggtaattttgtgaacccggtaggtctctgcactgcaataagaagccaccgtaactggggtcctcgtggtgtgacttgattcattttcagtctacccagacttgtcctgggtttaaaatgggaaaatcctacaacctggggaatccccttaagttactgcaaaccaacatttggtcatttttgcttccccttacaaagaagtaagatgcaagggcccaatttggcttgaatgatgttccagg

SEQ ID NO: 1009 - DNA, 464 bp, Homo sapiens
tctgctcagccgattaactatggctatcaaccgctgtttgaagatcgtcgaccacgcaatattggcgatacgctgaccatcgtgttgcaggagaacgtcagcgccagcaaaagctcctctgcgaatgccagccgtgacggctctggagctctacaatcagcatgaggcaaagccagataagcctgcgacctgctcttcagggtggtgagatcctccagactccagcacccagagatgctctcctgaggcccagaccaccactgccagccatggaggaggagtggcgttggcgattcaggactgctttttctgtctcttcagtgcctctctcagcaacatgaaggtgtaaaaccaagctgtagcccaaccacctggggaacatgttttcaagacctcctgctgttgtatcataagtcatgctcctcaaatttggctcagaataaatctcttcaaataaatgccga

SEQ ID NO: 1010 - DNA, 788 bp, Homo sapiens
cccgaatttataggagatgcagatgaaatccgttccagacctccaaggaaaattagcctttctctgacacactcctcaaaatccttccagacttgacccactattcaccacggcagcacatcacctccagagtgaagaaaagtttcaaacatcaggaaaaaaaaacagcgcattgcaaaacatattagactgaacctatcgatgacaaaatacaactgtgaaatgttgagactgtccatcaaagctggacataagcaggatccattccattttcaaagagatggagtctcgctctgtcatccaggctggagtaaagtggcacgatcttggcttactgcaacctctgcctcccaggttcaagcaattgtcctgcctcagcctcccaagtagtgggactacaggcatgtgtcatcatgcccagctaatttttgtatttttagtagagacggggtttcagtatgttggtcaagctagtctcaaactcctgacctcaggtgatctgcccgcctcggcctcccaaagtgctgggattacaggcatgagccaccatgcccaggcaagaaaatttttttaaacctaatagtcaaacgaaggaaaatagtttctaaattggttaaataattattaaactctttttattaatatgtagttggcagtagacagagcattctccatggcacacagagtacctggcatataattggtgctcaataaatttttggtgaatgcctttgattaagtaaaggagcacatgaacacagatgcgggcgcttactttagtgagggtt

SEQ ID NO: 1011 - DNA, 782 bp, Homo sapiens
  misc_feature (1)...(782): n = A,T,C or G
cccgaatttataggagatgcagttgaaatccgttccagacctccaaggaaaattagcctttctctgacacactcctcaaaatccttccagacttgacccactattcaccacggcagcacatcacctccagagtgaagaaaagtttcaaacatcaggaaaaaaaaacagcgcaatgcaaaacatattagactgaacctatcgatgacaaaatacaactgtgaaatgttgagactgttcatcaaagctggacataagcaggatccattccattttcaaagaggtagagtgactgtctgaaaaaacaaaagtaactagaaaattgataaaactgaccgagtcatctatgcagaaagttgcttatatagacccataatataatacatttgtgatcataaagcacaattttgattttggaattgcaatcatagttcaaggcgagtaacaattttaacctctgtaattattttaaaagccaatgcacatcctttaacaattcagtttgctgaaatggtcacttatgcttttgtatttatacacctaaacatcatctaagtgcaatagattttacaatcccaggtgatttacctagactgcaacattgttatcaaatgacaaccttctaagtttcttgaattcatggggncatattcctttgtttgagctgcataaaacctatatcactgaacaatcacttaatatctctgatgataaagggtgttaatgagttctagaatactnttctgaggtatttcgtctgtccaataatgcctattgaatgctct

SEQ ID NO: 1012 - DNA, 968 bp, Homo sapiens
  misc_feature (1)...(968): n = A,T,C or G
aagaaaacagcaaacttgcagtggtttggaacctaaccaaggacacacagcgtagcaagtggcataaacaaaatatactgaccctaacacgactgagctaggtagaacacctacgacgatagtcttactcgcacgatagaaagagacaatgtcttacgaattatctattcccgaaagcatagcgcatctcagcaatagggcgacactctntattgtcactatcaatncctttaggccactcaccacccttgccgatttcactaccttcgcgattagcatccttgccctatttacagccgttttttctgctatcttctcggacttcaccgtagaaatcgaccacgctctcactattacgcaaacgcgcggcggtatgtcctacacccgtgcactcttcaacacgctttatttcacccactgcccccccgcaatccacctcagtacgacaatttcctgccctcgtcattacctaccgctcctataaccagcccgcgcatatatcatatctcgcgccctcctacctccgctcccccctttcctcatttccttatcccccccccttatcgcaccatcactccttcgtctctaccgtgcccaactaccacccccccccgtccgccccaacatacgtatgatccactcccactttgtcctcacgccgcagcgtctatcgtccccgattatgccaccactcatccctatccctacagaagccatgcacgcccgccttacgttcccctattcttagattatcccccatcctactccacacccgccatcctctccccccctcttccccgcgatcgtctattaccttccttcgcgcgccccaccccgccccattccaaccataatacttccccacttagcgcgccatccccgctattccccctaccacctagattcaccccgtctcttacatatacctacatatatattccccccacccccccatttctctcttaccg

SEQ ID NO: 1013 - DNA, 786 bp, Homo sapiens
  misc_feature (1)...(786): n = A,T,C or G
ttttggaggcttggagaaaatgccagcaacaaggacttggaaggaaataaatctttagattccctgaaaacacagagagttattgtggaagacatatggaggaccccatactgcgttaagaaagaaaatttataaatgtcagcttcatagcagcaatgtcgaagggatttcagcaatccacacttaactacaataagaaaaacaggctgcaggtacacatttgccacgaagaactaattatgcttaacccgtgctctttctgggaggagcaaatgaggagagaaggagctgggcctgcttactcggggctggtggaccattttcttaaataaggcatggcgctggtctgacattagtttaacaagatcttcagaatgataattagtgtcatcattgtcaagttcaagttctcctgacttgttgagaagccaaaaatacatattgtgacagggaagttcccatcaaagagtagtaaggagaataccaattgggaaaggacaacttcataaaaataaaccaagtattggcataatggtttgtgaagctgattcttctggaatgaataataaaagccaaattcattgaaggcccccagttcttgtagctcctaaattcaaatactccaatatgattaccttggttaaacaattaattaaacataccctgatggggtaattttgtccnaatacaccacccataccgaccgaacgaaaaatcgaaccatatgaaatctcccgtagtccgtgccttcttatttgggcgccaccacacatattatctttctcg

SEQ ID NO: 1014 - DNA, 581 bp, Homo sapiens
  misc_feature (1)...(581): n = A,T,C or G
caaataaaccaccaccaagaaaagaaacaagaaaaaaaggacaacaaaatgacctatcagaagctgcctcggacttatgtggacttggcacaggatgccctcctgtcccacatctggaagactcctcagtcttcatatcnaatgtggaccatttcatcaatcttagtcctgcatttaaaactcattaataagcctgatgccattcccttcacagattaatgacacaattccaccctaatagcttttgacaatgtaaatgctccccattttagccttcaatttcaagggcactgcaattacattgctttatggctaacctagaaactcgtttgcagagattagcccttcaaactaaccatgaaccccgaaaaaaaagacaaacaaaaaattacactaaaataattaccacataagacccccgacttaacgccttgccntttccgatggataagtcgggccccgccccatccaacataatataccccagtaacaggctatcgagggtagggcttagctacagattaagcgccgtctccctgatcccaacgaaacggcaccgcccccacaataaatcgttttct

SEQ ID NO: 1015 - DNA, 798 bp, Homo sapiens
ctctgtgatcctcaacatctgcttgcaggtacacttttagagccgccactgaggcaggagaatagcttgaacctgggagatggagtttgcagtgggccgagatcacgccattgcactccagcctgggcaacaagagtgaaactccgtctcaaaaaaaaaaaaaaaaaaaaaaaaaaaagttggcggggggaagttgaaagatatggtctgttgttgagggagaaaagacatttattacttacaaggtaaccataaagtttataaaatagtaatataactgtattaaagagggagaatggtaggggagaacagcaagaagtcaacaggaaatgcctaaagatggagaactcaggtagaatatttgaaaaaataaaaattgatagagtacctggggtatttgaatatagactaaagagctttcattttccaaagagcatggggataaattagtgatctgcaaatttttcttttgttaagaaaaccaaactgaggaaattatgaaccccaggaaaaatacaaatttaaaaaactacactgtataatctaaactgtgaacaatactagccctatgaagttaagccataattatggaaataacccgatattggattttataagaaaaaactccctataacattgcggaaggatgtgaaaaaaatacagattgccgaaaggcgcaacaaacaaaaacaagcccggatacaaaaacagcccagaaaaaagcgatacacacatgtcttctccaaacataaagaaagatatacataacgacaccccccacacaaaaatagcaatgcg

SEQ ID NO: 1016 - DNA, 573 bp, Homo sapiens
tggccgatcgttatttattagttgcagaaagtaagactctagtgagcagagggagtcaggatcattaaaaatgctgccatggacccacagaaacatcagaacaatcccagagtcctgcagagaggggtagagacagcagtcgctggctagtctaggcagagaaggcaaagcccaccctgttgttggccatgtcatagacagagcaatatttcttgaggaagacatcccccagaatccagaggggctgcccactgcgggagggcaggcaggtggcctcagttccaagcctgcagtagccattgttgtcaccattctgagcctgctgggctcctgttgcctgcaggaaggaggcatgtactgctgaggaactgccagcaggaaggtctcggtatccacagtggcctggcaaccctcagagcacaagccagtggcctggttaccgatggcaaattcctcgatggcaatctgccagtacagttacgggctgacaggggtccagatgatctgaccagaataaagttggggtccacacctccaaggatgagctctccacaatactggcgggttggctgg

SEQ ID NO: 1017 - DNA, 655 bp, Homo sapiens
ccagccagcccgccagtattgtggagagctcatccttggaggtgtggaccccaactttattctggtcagatcatctggacccctgtcagcccgtaactgtactggcagattgccatcgaggaatttgccatcggtaaccaggccactggcttgtgctctgagggttgccaggccactgtggataccgagaccttcctgctggcagttcctcagcagtacatgcctccttcctgcaggcaacaggagcccagcaggctcagaatggtgacgtgagtaccagaagccaagaggttttctgcacacccaggcagactcaccacagaacaatggctactgcaggcttggaactgaggccacctgcctgccctcccgcagtgggcagcccctctggattctgggggatgtcttcctcaaggaatattgctctgtctatgacatggccaacaacagggtgggctttgccttctctgcctagactagccagcgactgctgtctctacccctctctgcaggactctgggattgttctgatgtttctgtgggtccatggcagcatttttaatgatcctgactccctctgctcactagagtcttactttctgcaactaataaattggaaaactccaaacacctttaatgttcaaaaaaaaaaaaa

SEQ ID NO: 1018 - DNA, 585 bp, Homo sapiens
  misc_feature (1)...(585): n = A,T,C or G
tttacctgtgatgtgtggcatttcctacatgttgctgtcaatcatgaaatccacctcaaaaaccccaaatccttcattcttactggaggaatatgacctctctacaaaggaaactattctcaatgttgtggctctgacatatatgaaattcagttactgcagtgtatttatataacaccacttccctaataacaaggttgaaatgaaatttacttgggtatatcaactgtgagtaattgcataaacgttgctgctagctctttattccagacatcactgcaaagatatcagatgtgtctcaatgatcagtgatgaaatcaccccacttttctcaaagactgtcagggattggtcacttggcatctgtgattcagttcacataccaacaagaaaatacgtattgggggtacgaaccttggctcccaagggttaagcccaagtgacatttttacaaaaatggaccactcgaaagaggtgatatggtcattaaaaacagatgcggcccgctccccttagtgaggggtaatttatgatccttngttactgacttagtgagctcgcgccgtccgctagggaaaccgtata

SEQ ID NO: 1019 - DNA, 774 bp, Homo sapiens
ttgctttggctatcctgaatcctttgcatttccatatgagttttggtatcatcttggcaatttctgcaaaaacgaagaagctggaattttgtacaaggcagcaagaaagccctgaccagatgcagctcctaaatcttggacttcctggcctctagaactcttactggaatgaaaagtaaaaccagcataaagccagagataaaagggagctgccttgaactccattcagtcctgtatcccgatctcctgcaatactctgtccttcctctacccatggaaagaagatgtgtagaagataaaagagatgtgtagagtttatacacatctagttttgcctctattctgtgagccttagcatcaaattttaatttgctcaatactgatctacatgcccctcactgaagctgcatccatgttttcttgcccttatgggaataggcccagaggccggcaggtggctcatgaaaggttgcagatgtgctccagcattttttaaacatgtgctctattcactgactgatttctttcttgattatgaagcatctgtaatttttactctcgacgccaagatttcgctttacatgttatctcggtatagcagagcgatggtccgccaccctactatcggacaaatagggagtgagtaagcactatcgagtctctaaccataaatgccatatccctgatcacccgtccatccaatactaatacaatatatcttggccccattcaaatctctatcctacacccggccacacacccatattcgataca

SEQ ID NO: 1020 - DNA, 271 bp, Homo sapiens
aaaaagaaaaacgacatccaaagagggtatgcgactgtgtcgagttcaacagaagaatgaggactgcacaattccatctagttcctgtttgaaagctctcttgtccacatgaccatttcccttatggactctccttctacttttgtgggattgtttttctaattagaaaattcattttagcagtattcttatcattccaaaagttaattacccgtgcactgtggcatgagcttcatatctgttgaatttcttcacctttaataaagatcga

SEQ ID NO: 1021 - DNA, 768 bp, Homo sapiens
acataatgccatgagtaacccatatacagaaaattcacagcctgaactggcttcggggaagaccaaggcgcatttggaggagaaggccagccctaaaggctggaagtgacattcctgttgataaagggcagagcacgagcaaactgagagaggagatgcaaagacaaaaatttcatgcaaaggatgggtgtgttcagaggctgatgagctgcaggttgcagagaggccctatcatggccctctgttatttgtgctgtctgctcccttctctggtggtagcacacctgccactcctcatcatcctggaatacatgcaccacctgctcgccctggagcatcgcgctgaggagcagttcctggagcactggctgaaccctcactgcaaaccccactgtgacaggaacaggattcatcctgtgtaaggggatcaggaccagcctcgcaagcattttaatagacaacaagctggataatgtcgaagcaagacaaggctgcttctttcacttgtttttaaattgcagaaatggatgtcttcaaacctcgtgaactgtgggcatatcaaagattgcccttggaaatggcaaatatatatactgcttattttactaacctgcatagatcactaaaaccaatagcttaaagcatagacacctcccaaaggtcttcccttcactttgcaagagtgggaacaaccagaatcttacctggggttaatggagcttggaacttccagaccaagagttgggcaggctgcctgccctaaagaat

SEQ ID NO: 1022 - DNA, 768 bp, Homo sapiens
tcctcaatagacggattgttctgaaagtaactagtcatttctaccaaagaccaataaagtgaaactacacagaagttgcagacaaatctggactgcaaatagaattcaggatgaataaaaaatatatttcacaaaacctaaaaaaaaaaaaaaaaaaaaaaaaaaaaaaaaaaaaaaaaaaaaaaaaaaaaaaaaaaaaaaaaaaaaaaaaaaaaaaaaaaaaaaaattgggttggggggggcccttttcttttaagggggggaaaaaaaaaaacccggcaaaaaaacccctggcccctgggcctacgggtggggaaaagggattaaactcattaaaaggggggaaatcggttttccaaaaaatgggggaaaaacccaaaaaaaaaaatttggaaaaaaggcccaaaaaaggccaaaaaccttaaaaaggcccccgtggggagggtttttcaaaaaggccccgccccttggaaaacataaaaaaaattgcgttctagatcaaaggggggaaaaccccccgggctcttaaaaaaccccgcgcgttccccgccgaaaggtccctcggaggttattttgttcaacatctgccgttaaaaaaaaccagggacgttttttccatttggaaaagggggcgtttttataaaagacacaccgtgagcatttcaaactcgaagacacgccgtcgtcccaaagtgggttggggtaaaaaaccccactgaaacccaaacctggggcttaacgagacacccgccaaaaaaacccataaca

SEQ ID NO: 1023 - DNA, 424 bp, Homo sapiens
  misc_feature (1)...(424): n = A,T,C or G
tttctgagacactctcttaattttcaccgctacagtctgggcgccgtggctcatgcctgtaatcccagcactttgggaggccaaggcgggtggatggcctgaggtcaggagttcgagaccagcctgaccaacatggtgaaaacccattggtggcgtggtggccgggcacctatattcccagctactcgggaggctgaggcaggagaatcgcttgaatccgggaggcagaggttgcagtgagccaagatcacaccattgcactccagcctgggcgacagcgcaagactccatctcaaanaaaaaaaaaaaaaaaaaaggaatccttttttacatgctcttggaaacaattctcctatctttatgctgattccctcattgtgcataaaacctgttaataaaacagaagctaataaataaaaagtga

SEQ ID NO: 1024 - DNA, 216 bp, Homo sapiens
cattcaagcagttatatttcccagtccccttgcagctttcttggtggagtcttgccgtggaatggaaaagcctactttctatcacttcctggaggtttgtccggaaccacagctggctttgagggagtgagaaataaatgtgtaaagccaaaaaaaaaaaaaaaaaaaaaaaaaaaaaaaaaaaaaaaaaaaaaaaaaaaaaaaaaaaaccattga

SEQ ID NO: 1025 - DNA, 538 bp, Homo sapiens
aaaaaatcaagtgctctatgacattactgagtatatacccaaaggaatataaatcattctgttataaagagacatgcatgcgtatattcattgtggcactattcacaatagtaaagacatggaatcaacccaaatgcccatcaatgatagactggacaaagaaaatgtggtacatatacaccatggaatactatacagacataaaaaggaatgagatcatgtcctttgcagggacgtggaaggagctggaagccattatcctcagcaaaccaacgcaggaacagaaaaccaaataccacatgttcttacttagatctgcagagaaaggagcaagagttccttgcattctaacccaagccaccccttcacacttccagctttagttcacttctccaccttccatgcatggttgccatctgacctggctactgagaagatcagacctcccagtaggagatccaccacataagctaaaaataagagctgctacttctctgcagataccattaacccaattagataaataaaaaaaaaaaaa

SEQ ID NO: 1026 - DNA, 814 bp, Homo sapiens
  misc_feature (1)...(814): n = A,T,C or G
ctctcttaataatcaccgctacaggtcaagtgctgctggatagtttcctgtaaccataatacaaagggactgaagaagtgagatggattctacaaaaacaggcggaatgtctccaccgatttggaaatggaatttccagttcagttggagcccccagaacccggaggcagctctgcaactggcagtgcacacatccccctgggtgccagctccagggccagctcacggggacgtgtggatccagcttccttccactaagagccagtcgggctcatccatccagggctgttccgaggttggggtgtgtaggacaaacttgccagcagatccaattnaaggagcaatgctagatnccctgatgcacacacaggggacatgaaaccatgcactcggcnctgtgtgtgctgaccttgaaaaccgacctgatgtgatcaggcgttgcttacttgaanaattacccacagcgccacatggcatgaaaatgagacaaacgctttttacaaaacctctcctgggggacaagaatggattgcgaatcgcaatgaacaactcccgatgccaaagtggccggacttctcaagcgcccttggggccttaatctcgctcccactttagtcctacaaggacttcacccacctccaaaccaggcccttacgggcacgttttttatccggcagatttatttattttgcctttgcgggacaaattctcttctatccccacttcgaggcgtgggggaagtgtggtcatactgaaccctcccctttccgtggtgtcaattttcgtccccccgcctcaccaattgtcctattcg

SEQ ID NO: 1027 - DNA, 212 bp, Homo sapiens
acgtgatgtaagaaggaaggtacattataaattaaagctagtcctgaggatggcaaagcagaaagatagaaagagcttggacctgttatgatgctgttgagctgtgactctaccaaccctgagatcccacctacttctagacttttaatgcagaagttttcaactatagcttcacactggaatttcctgaactgttaaaaaataaaaaccga

SEQ ID NO: 1028 - DNA, 436 bp, Homo sapiens
aaataaatgtgtggatacagaaccagtgaacaacttatgtgtttctgaataaagctgctgtggcttcccagaagaaggaaggagatttctgagttgtgagaggccatctatgaaggcggaagcccaggggctctacagttcctttacttcttccctttccactggtatagaaactactcatgacgatcttagagccagggccattattggttaagattgataaatgtacttttagactgccatcctgggatggtaagcatgccttaggagaggcattagtaatcaggtagatggtatttccaggatgaggcctcatttcttaaagagatacttctcaggcaattattacagctttctcttcatagaaaaatactgattaaatacagatgcggccagccttttccttctccctccttctcgtcgctcgtcgcccccc

SEQ ID NO: 1029 - DNA, 738 bp, Homo sapiens
  misc_feature (1)...(738): n = A,T,C or G
cttggtgtactccaccttttatatcccaatctttaggtcaacagcacacaaactgggtcccgtaaatcaaataaggaaatggtgcaagtaaagattttcaatataaggcagagtgacccttttttcaaacaatattaggaaagaaaatcacttaactacattaatcagagctaaaaccacgtaagaatagctaaatctgttatcaaagaaacgaccattttcatggtgatgactttgcattattcatttcttttaaaaagtattaataactccttacctatcacctgtggtcaccaaacactcctggcgtgtgtatggtcaagggagccctctcntgccctgctcacgcccaancagccacttcctgtaactataggaggcaagctgctccaagggctgaaggaggaaggcaggagccagacaggctgaggttcccaagctggggaccctcccgttctcttacccagtgtctaagctgcagccactctcatctagaagacgaaattcaaatacagtgtttctaactgaagactcacttcctaatgcctgatctcattagcagtcgggtttaaaagatccagctcaacatagccttgttaatattcttactcacctactttggttttaataacatgtgttcttgtaactttctcatgtaatgtttattttttattgcatgtttaaatgatattttgattttatttagttagaataaaaatggcagatactaggtcaaaa

SEQ ID NO: 1030 - DNA, 353 bp, Homo sapiens
tttcgagaatctagattgtatttgtctttggaaacagtcacagccacttccagaggtcatttcccatagaccccaaacttctcttctcccagccttggaggtgctgggttctagaaggaggaggcagtgagtccagaagcccagccatatcaggatgacatctaccatgcatcagtcctcgtgtgtcttcagcgcctctttcacatgtctgtgtccttagagcttgctggaaccatctttgcttgtctctgtgtattctgagtctgtgactatttggctctaggagtcttctcaacaaagtacaatttctgttgtctttttccaaaaaactttatgaataaaataaaaattga

SEQ ID NO: 1031 - DNA, 519 bp, Homo sapiens
ttcaactatctgcattggaagatacctcccattcaaaccatgtaagagaagagtgtggctacattgcaaagcaatcccatatgagatggattgcccaagctgatcttgaattttagcctccagtgatcctcccatctcagcctcccaaagcactggaattagaggcataagctaacacacctggtctcaacctgtaaatcattaaggtgacaatagaaaattgatatttttgttgttatttcatttcattgtgcttcactttactgtgcatcatgaatattgcgtattttgcaaattgaatgtttgtggcacccctgcaaccagcaaatccatcggtgccatttttctagtaatgtgtgcttacttcatgtcgctatgtcagattgtggtaattctcacaatatttcaaactttttaattattgttatatctgttatggtgatccatgatttgtgatttctgatgttattcttgtaattgtttttgggatgcaacaaaccacacccataataacagaga

SEQ ID NO: 1032 - DNA, 878 bp, Homo sapiens
  misc_feature (1)...(878): n = A,T,C or G
atttaaagtttattgaattttttattttttaaacttttttgtttttgtttttgtcaaaaactagggggcaggggggcgagattancacattantctangcctacacagagttagataatcaacatcactctcttccacctccacatcttgtcccactgggatggtcttttggagcaataacaggcttagagctgtcatcacctgtgataacaatnnccttctgaaggggggggggtgaangtcctncttacntaaaaggaatgtacccctaaaacgatgacttaaaataagacacatccatcttctcccagtttctggtgggtctggaatccaggtgtggttcaggctggcactctggttttaaagtctctcacaaagctaccagttggggtgttggctcggggtcttactccattaacgtggtggggccgggggtaataaaaaagggactggagttaaattgggaagttggggtggaaaacccttggctggggagcgatttaggtgggggggcctcaatgggggagaaaggggggggggtcccggggtagatatttcccaggggggggggggggaatgggggaggctttggggggcatggggggagccacacaaaggggggaggggggggggggaggggagaaaagagagggggaagaaagagagaagagtgggagcggctgagggggtgaagaagagtagagggggaagtacggggggactaaaaaaggggggtcaggagtgaagggggcaaggagcgagaaaggggggacaatggggagagaggcgggggcgggaacacacacaggggggggagaacaggtggggtgagtggggggcagaaaaaacgggaggggggaaaaagggggaagaaaaaa

SEQ ID NO: 1033 - DNA, 763 bp, Homo sapiens
gattttctctacccattttcaggagctaagtgtattttgtaagattaaggctttgcttgtcatttgtattgctaatatatttttccaatatttatttatttatttgtgtatttatttagagatggagtctcaatctgttgcccaggttggagtgcacactccatgttttatttaaattctgctcatactgcttttcttcaaaattgagaaatttcactgcctgtaggggtgacattgcttccatattggagaagctatcctgttcttgtataatgttatattacatgatttaaaggagatctgtagcttacacagtacctcaaatcaaccgagaggccgccaatcacaaacctcgataacccctcacaccccctaacttcacggtgtatccgctcatgcatatccaaccaccaccccccacaacaaacaacatacctcaccacagcccttcctcctaccctctctcacctctctgctccccccccactgattatcctcattaacctcatcttacgctttgttcttcgtattcctactctccctttctctcattcctcccattcccttagctctaggttcccactccttcacgcatgataagctcagatcttcctacgtctggcgtatgctcatgtttccttggcgtcatgtccgaatcatccactttatcttctcatatgccgttcaattcacttaccctcctgaccttctctatctcatacacgacctgatactcatttacacctattctcttgcctagcaa

SEQ ID NO: 1034 - DNA, 857 bp, Homo sapiens
  misc_feature (1)...(857): n = A,T,C or G
ctgccgcatctgtatttattttattcggggaaagcttaagacagtttattcacaatggtaaactacattcttggtggtactagaaagaaaaacaatccttttctgatggcatttgcaactggaaataacgaatcctttaagcttcagagactggtgtaagaggaaatgggttttatgccccgaggtccaaagcctgagttaatctaatgaccacacattccatttttatgtaaaatgtggggggggggtntatttttcttttttccatcttataaaatctctcattactcancacttcatcaaaagggtgagattggctccaagtgttttcctcaagggcttggagagcagccaaaaatacacagtctgagtgtggggagtgattgcaaatgtgattgggacaccatagaaattgttcagggagattccaagggtgctggcttgatcccagggatatgggctccacaaaactcactcgggcgtaaatgggtctacatatttaatgaaactggtaccaaaatttcgggtgggccttgtggcagaaattaggaacagctctttgcatcatgtgggaaggcgagaaacccagcacaggcaaagaaccctaagccctgggcaagatttaacggctgggacgtggatagctgtgttgttgggaggtgggtttcaaagggtacctggattgtcaggggagttctgtggaaaaatgaagaaaaagagtggggattgggcgcgggagttgtggtggttggaattttggggccggggggaagtaagagtggctggggctgagggggggatgggggcagaagcgggtgggggggaattgggtggggaggcgttgtgggaagaaatct

SEQ ID NO: 1035 - DNA, 790 bp, Homo sapiens
ctccgcatccgtatttattgctatctggggatccatcttcaaactcaacctggtacatgctgggcaatatcttgagccaaaatattttgctccatagagtttgccatcgggccacttgacttggacgacttctccctcagcaggtgggcccagcttcagacagtctcggctcacgatatcctcaggaaatgtgcctctgctaaaggagccatcatccaacatgacctcatccaaggcctgcgatgccacaaccattactctgtatctgataccccgggtgttcgcaggctcacacacgaccgcgggagcaccgccctcactcaatcgcccgccccgctcttcccccgtcccctcgaggctaagcatcatctggcccccccgaccccaaagatacgacccccgacacaccctcccccccccttcctttccccctcctctccctcacactcctacttccccacacatctccaggctcttaagaccacccacagttccgccagagtacgcctcctctccgccggctctctttttctccccctcagcgaatgcactgctcgcgatgcttgccttctacttacccctcgccctccccctcttctcttcttattaggtgcgacggctatcccccccctccccctcccccccccccaccccgcgatcgtgtcctccacccttgtccttccgctcaccatacgcctcatttgcccctcacgagccacctccatcccgtagctcaccgcgccgccccaccactgggaacaaagatggtgggggaagtcgcgtaccgcac

SEQ ID NO: 1036 - DNA, 881 bp, Homo sapiens
ctgccgcatcgtaatttattatattgtcttatgttccacaagaaaacaaatcgtaatgtctaaaataacaagagctgaaattagatccagtttatatattttcagtgcccagcaaaacaccttgcacatggaaggcactcatacatcttgttttaagggaatcaagcttctaaaccataaatacaaagtacaagggtaagatattctgttacaaaatgttcctttcttcttctattactcgggggggcttttttttttctgtaaaattcctacatcttggaaaggaaaaaatcaccttgtccacttaaatgcacccttctagggaattttttacaatcgcttacaatatttggcctttcaaattcaggcctgagggatgaaataacaaaccaaatttttgttttgttttctcctgcaaataaggtgttaaatatataatattccttcttagtatatacacctgattttcttttgtcccttcgtccttttttacctaaatggctgctgtttgtttttttggggaaatttagcgaccttttttttttgttggaacaaaaacaaaggggctcatttagacccttttgcgggggtcttcttttttttttatagcttaaaaaaactgggtttttttaatcttgtgactggaaacattgttccaccggtgagggcagacccgaaagtgaacctcggggcgcaaaattttttttgagcggggagggaaaaaaaaagccctccgcttaagggcgcaacgtggtgggaaaacagtactgtcgtgcaatatgatcgagaaggggcgcttttgacgaaaaaattggtgattacgccggtggatttgcccgggggcgaagaagaaatttgggggttctagcgcggtcggatgt

SEQ ID NO: 1037 - DNA, 153 bp, Homo sapiens
  misc_feature (1)...(153): n = A,T,C or G
tttattttgtcagtgcaggcgttctcttgtgtaaatcaaggtcatcaaaagttcagagtgatttttagggatntgcgctgtgtccccatgtaatcacaatatcctttcttctgacttctgactccctttttgtcaactcatcaaaatgtcttt

SEQ ID NO: 1038 - DNA, 706 bp, Homo sapiens
tcgtcttcattcattaccacgtccagacgccagtgcagcttattctccacgtgccagtggtttcggattgctgtggcgaacttttctgcggttaaatcagcagaactgatataatatctgaccgtcatttctggctctttcttttgttctgctattattgaccgaaaggagactgccacgcataatttcttcagtcctttccattcaaacgtgaaatcaataagttcatcagggacatcgcaaacaatatgaagacggatttcttctctgccgtgactcttttcactcattgcgtaactgtcatgctctggattatttaattctttcagcggaaatttttcctcaaaggctttattaagccgcccctggtttccttttacagcgaataaataatcacctccctgtttttgtatcttctctgcaatatctttctggcaacccatcgcatcagttgtgatgatttttcctttaatatccagcatgttaagaagttcagggatagctgtaatctcattgaatttcttatccgtcttgatctgcccgatgaccagactgtgcattgttgagaacgcactaatgacatgaatcgctcccctgcggcgactcttgtcataagagtgccggagcgtttttccatcaattgcaatgacgtctttatcatttaatgaatggcaatcacgcatccagttaataaagcactcgtaaa

SEQ ID NO: 1039 - DNA, 1012 bp, Homo sapiens
acactacctatcttcaacagccaagagagctgaggaggggccaccatcaagctttttgccagtgcactacctaggacagaatttttcaaactgcattccatggagaggctacaagaagcatctgagaagatgggagaagatacataagcattgaatgaatggggctctacatcccccaactccacttctgtcatggcagttccgctttatctgcttcacgttagattgcatttggagaattgttccatccttgaaagagagagagaaataaaccccttattttggaagatcctttggatcgccaaacttttgggccccttaatttcttgaatctctcagtttccaccattcctgcccaccaggagcagaggtaggaaagaccagcccagcagacactcccaactcctaacagcccactttctaggtcccagagccaaggagaattacagcaaaacagaactcatggatggagtaaggggctgtgggttgttgcttcccccacaagtcctacaggtctgaatcttacctgtccttgcatagagtagatttttaaatgaacatggtatgactggatggatgatccaatctctattactttagatcattctggggggagtggggggacgggactggccttagatctcagaatggccacaatattcattcttcaatatgcagagaggcaatttggcatagacattaagaatatgagatctagaatcagacccttgcttcaaatcctggctctgccacttcaaactatgtgaccttattcttgtaaatatgaatatgcttgcaatgattgtttctgtcatgaggattaaataagttaatacatgtaaaatacttggttacttggtgcctggcatgttagtgtcagtaaacattagcaaatgttagccctcattattgttgttatcctgttcaaacgccttcctctgactcttccgagcagtattcattattctcctctgcactttttagcagtagctcaataaaagcagatcggcag

SEQ ID NO: 1040 - DNA, 373 bp, Homo sapiens
tgatgcgggagagaatatttgatcttagatttgtccgcctgcatctttctcctgacgccaacctcagttcctcctctgactgcctctctccatctgtattgcaaaacaccaaactctctgccaaagaacacatccaggtgtggccatgtgactgagctctactcagtgagaactgttgtggcacgttctggacgatgcctcagtgaggcgatgcgcatcttttgcctttcctttgtctcctgggaagtgattttgaggatagaaggtatgcgctgaggatgatgggacagaatcatgaagcctccatccaagacttcgctccttcctatggatttcttttatgtgggagaataaataattgtgtggttgaaaa

SEQ ID NO: 1041 - DNA, 808 bp, Homo sapiens
actcaggctgaaggaacccctcccacggagggaacatcattctcttgacaaggggcagatgcaagagaactggtggcatctcaggattctttctgaaacttctgcctgaacacagcatacatcaggtcttttctccccatcccattgggcaggtttggtgagtaattgtggtgatgaattgtttttcattctatggcgaggatgaaaaggacactttctttgcttcttcacctctgccccacaatggagagcggcagcgcctctgaaggcaaggggagtggggtttccgaatccccaggagaaaacacaggtctctgctgcggcggtctggtccagagaacctacatccggaggctttcatttcctcatctgtaccatctcccaaacagacatttctgagagtgaaaagaggcaccattagaattagcctgggttagccagaaaggaggtggtcttgggcaaaactagatgtgatgcgatcccaggggactctagggtctctcccagctgagacatcctaaattatgaaaatgcaaggcccattctgtatcccacaagggcctgagtaagctccgtgagccatcataagctgccaacctttagctgcacaagagaaatgaactctgtaggggacatatccaatttcgatttaatgtaatctgtgtggccaatatttgtgtaataatggaggaaataaagtctatttcacaaagtcactctgtaatttagagcctttagacatttgaaatgcctgtgcattatgtggcgcctatcttagataatggacaatgaaagatgttgttgattt

SEQ ID NO: 1042 - DNA, 1113 bp, Homo sapiens
ctggccgatcatgatttatttcatacatttatcatatttcaggctttggaataagatgaagtcacccaaactccattgtgaaatctagtctccttgcaatctgtctgacctcagagaggcaaacagtgagtaattcaaaatatttttgaatgaaagtgtcagtttaagatcctcagcataaaacatacctacaaagcctatttgcaaagtaaatttactctggattcttgatacctatgaaagttttttctattatatttatttaaaattacaacagtttacattagaaacaagctcaaacaattaaggtaaaagataaataactgcatacagtttaattttacaaaatgcaaacatacatctttcattgttccattatctgagtattaagcgccacataattgcacaaggcattttcaaatgtcttaaaggctctaaaattacagagttgacttttgtgaaatagactttattttcctccattattacacaaataattgaccacacagattaaatttaaatcggaattggatatgtcccctacagagttcatttctcttgtgcagctaaaggttggcaacttatgatggctcacggagcttactcaggcccttgtgggatacagaatgggccttgcattttcataatttaggatgtctcagctgggagagaccctagagtcccctgggatcgcatcacatctagttttgcccaagaccacctcctttctggctaacccaggctaattctaatggtgcctcttttcactctcagaaatgtctgtttgggagatggtacagatgaggaaatgaagcctccggatgtaggttctctggaccagaccgccgcagcagagaccctgtgtttctcctggggattcagaaaccccactccccttgcctttagaaggggtacagcgtttccattgtggggcagaagtgaagaagcaaagaaagtgtccttttcatcctcgccataaatgaaaaacaattcatcacacaattacttaccaacaataaaaaggaaaaaagtgccaacttttatccacagccaaatgcatttattccaggatttcaagtgttggcttccatctaatggtccactttgttattg

SEQ ID NO: 1043 - DNA, 766 bp, Homo sapiens
ggtctattccaaccaagaaattatgacggttgaagaaacaatcatttttctttcctacacatttgaactcttatatcagaatctgcttcagagagaacccaaactgagacagctgccttcatttggggcttagccatttcgaactgaagagtcagggaagtgaagccacttggcctaagtggcacagccagtgagtggcagaactggaactccaaccttggtctgtttggctccaaagtctatgcgtctcccattccacctactaccactcagcacaaaaagactacctctgccacctcacttcacaaagcagccccaagagagaatcaggaaatagccaagagaggggttgcaccttaaaacatttttctcccctacccaccctccatgtgatctgcttttctgcagtatgtggccagggctatgtaaacccaaacaccataaatcaatgttgaatgagcattgttgctgcagagaggctataacagagtatcatatgagctttggccaggccctggaagaagtgacatctatttccatacttggcatttttcctcatgctgtcgtctcctctgcctttctgtctcctcttataccctcccacattggccccactactctcattctgctctctgtcatcatgcagtcatcccttcccccttttcatattttaaagctcacacagctggtccccagagtcactgccttctcaactgtcaaaattgtccaacatgaaaaattgaaacaataaataatgatgcggcca

SEQ ID NO: 1044 - DNA, 671 bp, Homo sapiens
aagagtgcaatgatttcaggatcaatgatttctgaaaatgaacatttttaataaagcagctctggactgtgattcctaactattggggcattggcattaaagaaaagagattggacattttgaaccttgtgtgtgtcaaaatgaaactttttgtccctggatatgttgagacgggaagaaggaaaatctgattctatggtttactacactccaggaattatcatccctctaacaccacacatgatggaaagagctcattgttcttgaaaaactatctgtggcagttctttgaggcctgggattaaagggtgtttctccaaggagaacttgttagtgatctgcctggtgcctataccaaattttggaggttccctggagtactcaacctgcaaatcatctcagagaaaacagaaatggaaataatatgaagattcctagagagaaaacaaagagatggcagagatagcatctcattcaggaagtttcaaactgaaagggtctgagtgaggacagctgctacagaattccatgacctctgcaagactctctgccctttgaaggagatgatggccagatatcagcttgaaaatcatggcaagctcagtttggctgaagaaggaagaaagaatgcccatggcaaaacaaacaaacaaataaaccacgatcggcag

SEQ ID NO: 1045 - DNA, 809 bp, Homo sapiens
aagagtgcaatgatttcaggatcaatgatttctgaaaatgaacatttttaataaagcagctctggactgtgattcctaactattggggcattggcattaaagaaaagagattggacattttgaaccttgtgtgtgtcaaaatgaaactttttgtccctggatatgttgagacgggaagaaggaaaatctgattctatggtttactacactccaggaattatcatccctctaacaccacacatgatggaaagagagaaaagaaagacaaagaatggcttaatcactgactgtcaaataaatgaaggcctatcaactggagagaaactgttagataaaagagagagagaactaaaacaaaagatctaccctagaaggaagcaccattttgattctaaagattgtgggagtctcttgggctcattgttcttgaaaaactatctgtggcagttctttcaggcctgggattaaaaggtgtttctccaaggagaacttgttagtgatctgcctggtgcctataccaaattttggaggttccctggagtactcaacctgcaaatcatctcagagaaaacagaaatggaaataatatgaagattcctagagagaaaacaaagagatggcagagatagcatctcattcaggaagtttcaaactgaaagggtctgagtgaggacagctgctacagaattccatgacctctgcaagactttctgccctttgaaggagatgatggccagatatcagcttgaaaatcatggcaagctcagtttggctgaagaaggaagaaagaatgcccatgcaaaacaaac

SEQ ID NO: 1046 - DNA, 264 bp, Homo sapiens
  misc_feature (1)...(264): n = A,T,C or G
ctttcatctttttgtgtgacctcccagacgaggcacaaaacgctccggggttcctattttttggggggcccccatacctaaagaaacccgcacaggtaggtcacttggtcttgtatgaaccccaaaatccaagggacaaacccccgaggcntanggagggggttgtgttgggcccttcatgccccccccaacccccggagaaacacaaagtggcttggttaaaggcccccnggccatcccnaaaancagggnnnancgcagagt

SEQ ID NO: 1047 - DNA, 1165 bp, Homo sapiens
  misc_feature (1)...(1165): n = A,T,C or G
caaattccctctctcctgccacctagagaagaaagacatgtttgcttcccttggcagcatgattgtaagtttcctgaggcctgcccagcccttgagaacttttcagaggctgggattccaagatcaagtttcgtccctgattggggccttcttgctgtgtcttcacatggaatacagtacatttcaagagaatgtgaatgatgtgttcccatatgaaggaagaatggaatagcaagctacccaagtgcagctgaactctctttcataaagctcttaataccattcacaaacgagtagtcctcacggcctaatcacctcttaaagacctcaaatcttaatactattacattagcaacacctaaaatttgaagggattcattcaaactatagaattccctttttggcttctcaaaatttatgcccttctcacttgcaaggatatactnatttcatcccaatagtcccagagtcttaactcattccagcatcaactcaaaagcctaaagtccaaggtcttatatagatatcaccttaattagatgtaggtgaggctcaaaggtatagttcatcttgaggcaaattgctctccagctgtgcatctgtgaaatcaaacaatttttgttcttccaaaatatantngtgtttcaggcataggatagatattaccattccaaaacagaacattagaaaattttttggctacaacattctcactgattacagaaactgcttgtgttttcaatgggagaaaacaacattctgaaggaaaatcactgatacacaggctgtgaaaggtttgactgctttcatcttaacacccaaagctaggtaatgggagcgagcactttaaagaaaagccctttccccaactaaatatgtaaatatgtatgtgttaaacagttgggattggtggggtagaaaaaaaagttagtcagcatcttcaaattgtggcagtgagacagattttaggcgttaaggaattcagcctttttttttttttttactgatgagaaagtaggatcccagaagatgagggaaatagtgcaaggccaaaatggataattagaagcaaactgggacttgatttagttatctgcctctgaatgtaattccattcctaaagtgtataatgataaagctaataaagacgtgtatgccgnccagg

SEQ ID NO: 1048 - DNA, 685 bp, Homo sapiens
gatagctgcaacgactctcttaatttccaccgctcagcactttgggaggccaaggagcagatcaccttgaggtcgggagttcgagaccagcttggccaagatgatgaaaccctatctccattaaaaaccctatctctatgtaaaaatacaaaaattagccgcatgtgctggtgggtgcctgtaatcccagatactcaggaggctgaggcaggagaattgcttgaacatgggaggcagaggttgcagtgagctgagatcacaccactgcactccagcctgggtgacagagcgagactccatgtcaaaaaaaaaaaagaatcctttttaattaaggaaggatagcctcctgtctggtatagatgttacaaatatttctccttagttgattatttgccttttggtttcagacaaatattttaaattgtaatatgattaaatttgtcagtattttcttttttaaataacatttgattttcataacttgcattataagctttctttactcaaaaaaattgtggttttattttgtgtattttttctctgtctttgggaaagaaataacagtcaaaaaagctttagaaggccaatttggcaatatctttcaacatttaaaatcaatattaattaaaatttgtgtaaaaatatttattgagcatgtgcgctgtgccaagtactttttaatgga

SEQ ID NO: 1049 - DNA, 497 bp, Homo sapiens
  misc_feature (1)...(497): n = A,T,C or G
cagcacctgagaccccaaaaagttaggccaagtnggtgcaanaacacaaagaaccatggactcgctaattttcaatagatgaccaactgccacctgaacttctgaatgggtttttctctgagcccacctgatatgctctacttcagtgggaggtgggcagngataanaagtcaagaagacttgantncctgccaactgagagacngctgaaggaaatgggaacatttatcttggagaaganaaatatggnggcctcaaggactggcatcagacagctgactcgctgctatgtgcaagaaggagtgggcttatcttaagttgtccagagtgcagtagaaaatggaaactctgggcaatcagatttcagctcaatgtaagtgatttctctctattgttgttttgtaaatttttgagaaaatggttttaagtgatagaaatagcaacatactctttgtaaaaaataaaatcaaacaataacaaaaaaaaaaaaaaaaaaa

SEQ ID NO: 1050 - DNA, 566 bp, Homo sapiens
  misc_feature (1)...(566): n = A,T,C or G
cggcccgatcaaggtttatttagaataagaaaagaaattatggcaatactaatattaaaaagctgacaatattaataaactgcaatatccagaaaaataaaataattttttaattaattaactacttgatatatctctacagtgatttttttctacgattttggctgtcacactctttgcttcttcctatgatgatggctttgtaatatttctctccttctgattctcattaatggcagggttgggggctgaggacgaggagggagctggaagaggcaggaggaagggcagcaaccacagtggttccagaccataggcgggtagagggggtgcggtacagcatagacccgaagctggctttcaaggggtcctttgcaaaaccccgcttttctgcctatagtggctggcacaaaacaggcagagtcattttcactgtagcgggggtaattaaanagcctgacttaagtcgaactgtggcagaagcctgctgggtacatttactggtagctttgcaattacatgctatcgtatctcgccgcncctgatntgagntagttgttgcgact

SEQ ID NO: 1051 - DNA, 185 bp, Homo sapiens
cactcaaagaaggagtttaccctgctttagaagactgccagaagaatgtattacccaccaactgattaagaactcctcatttaaacaaatctgctaaaaagagactaatgagccaagaatgaagcatttttttatgttgtgtgttttctaaaataaacctttcaatcatagtaaaaaaaaaaaaa

SEQ ID NO: 1052 - DNA, 908 bp, Homo sapiens
  misc_feature (1)...(908): n = A,T,C or G
cctccatgtaagacgtgccttgcttctacttcaccttctgccatgactgtaagtttcctgagacctccccagccatgtggaactggaagtccagagcttctgccttttcctgcctgaagaagttacttgggtaggattcacaaggattcctagttcatcaatttcacagaaaacagaggagagtgcgttttcaggggcctgtatttcaagaagtccaaggaaaactctacagaaaacatggagccaacattcccactcagatcagaactaaagctcagaatgaggctcttgcaagagaagaaagcaccggaaagtttagtgctaagaagccagttaccaatgccttactgtgtgttttaaaatggagtcataacacctcatgaaactgtatgggagagtctttgctgcaagaaatacttgcttaaagaaatactgatctattggctctaggtgatctcgtgggaattactcaaaggttctcaaaaactaagatgtgaattaacaaatgcaaaaaggccagatttgtagctgaatctgctagaagtcaaccttcatttggagagggcctgcaaaatcaaagcccagaatacntgaggttgctaaataacataaaatgcacattatcccttctattaaaggtccattagtacaagacccattacttcatttacaacttaggtaaacaaattttatttgncaaaataaatgatatttcaaaagctatgtgaagcaagaaagtggctataattgtttgtaatatatttattaaataaaactcattagtaataataataataaaggggaaaaagctcatttaccatcttggaggtgattattacacccacatggaataatttaattctttcaacaataatgtaaaaagaataagatgataataaaattgttaa

SEQ ID NO: 1053 - DNA, 352 bp, Homo sapiens
cagtgatttggggagacagttctaaggacttgtcagggatatgtgatgtgctcagtgtgctaacagcaggaaaacatcagcctacagagaagaacttgcttcatagacacattgctggtatatggtagaatgctattaaagacatggctggaatatacacaacaataatagctaacaccttcagcatactcagtatgtgacaatgtgttaaacagtttccgtgtgcatcttgtttaatcctcacaacagcttcgagggtggactattgttaccctcattttgacccaaagaaatagaaataaacaaagatgcgcccgctcttccccctctcctcccccctccccacaacacc

SEQ ID NO: 1054 - DNA, 511 bp, Homo sapiens
agaagccatgccagttcatccctccctcatcctactgctgcttgactgatggtataaaacctggagctctgtcatttaccgtgaagaaggaaataataagcaaggaaaacagagagaaaattatgaatggcacctggtctctggataagatcatccagattctcatggacatccctggattgtaaaagtagaatcacattcttcacataaagaggatgcttctctggtctgccggaacaatactggccattttatctaaaatctgtacatacccttagaaaggggaatgttatcacccatacctgacttagaattttaaatacaagaatatcctctattagaaaattcttactgtctatttgaactcccatagtatatctttatgaaagttgtgtaagtgtcttaaaaggttcagatcaaggttgagatcaggtgacttgaccccagactatgtatttctattaaaccaaatggaatagaaagccaaaatgcaataaatgccgatccgcca

SEQ ID NO: 1055 - DNA, 597 bp, Homo sapiens
catagctgagacgactctcttaatcttccaccgctacagccagaaggctataaacttcctctcgggacatctaatttaatgcaaagctggaatgctaattaactagatgaaggcagcaggatggagacatggtatgatacataacggttctgaagagcagaatgacatagcgttcgaggagaggataggaggagatgccccagtactttaatatgtaccaacaattggctatgttatggaatctgcaatgtggcctccgctgctgacctctgaaacacaattcccagtctgactacggaaactgttcagtttgatcctttcaacttatttgaatcctgacaaataagctcacagctgaaaggtcaacatagtcgtatttcatcctccagagctgttcttaagacatctgcacaacaaagcacttcttatagcacctgacatgggccctcaatggcactgtacctcattaaaaatgtcccctgcatgcgcacgcattccaaggcacatggtctggtgatggtttaccaaataagtgtttacagaagggttagtaaacaaggcagattgtcaacttttccaataaagcgggatcggcca

SEQ ID NO: 1056 - DNA, 928 bp, Homo sapiens
gcgacgtggggaaaaccttagagcaggctctgttatttccagtcactaaggacaaagctgggaaaaggagtggtcatgcgctggaggtccatcctgtgaggcaggcacggagaattagaagagaaggggatttgctaggataaagcagctacaatcagcaactccaaaggctgccgctgctgctgctgctgaagataaagaatatttattgagcaattgctgtctcctaggaaagccgactaaatctcatgcactggataagcttgactctggccacatgagatgtccccattcctggaacagctgattcacgagcaaatccggtccattctttgactgaactactgactcaagagaccatttttctcccactccatggccactgctctagcctgggccaccgttttgtcccctaggttggacaatgagctcctgggttctcctttcccccagtttgctcttcagttcactgctagaagattctttgtaaaagggattaggtcatgacagccctcctcttttaactcctgtaggtgtctttctgttgcacttgcaataaaatctcaacccttagcatggtgtacaagagcctgcaggatgtgccataggccaacctccctgcccctctctcatcacccacggccttctcttcatgcctaggaaacaataatctacttgcccctccttgaccccaaaacaatccttctcctgactgaggctttctgcctttgcagatttttctgaccgaaaagttctttgtctgcaccatcacatagcaggttccatcaagtctcagctccaatgggcccttctcagtgaggcctttgctgatgtctcccctgctctgtgtaactatccatcacatcaccctactgcctgaaatccctggagcgcttaccagactatgaaataaaccccgttcgccagg

SEQ ID NO: 1057 - DNA, 694 bp, Homo sapiens
ctgccgatcgttgtttatttgttttaatttagccagtatctaatccccatgcccagctccacagtagccttgaaaagagcagtcttacaacaatggtggctgtaaaaatgagattttcagcctacagagggcagagcatatttgaagcttcccaaaaagtcccacctccagaacactttcactattttacctctttttcagcttcctggaaaaaccccctttacagagtgctgtcattatttaatctgactcagaacttgttctatgagaaaagttctagcctcaaaaaatttcctaaaaaccattaggaatagttaataaacattgctgttccctgaggctgtgatacaagttaggacaaagaagggtctggcaaaaaattaaaaaaaaaatctgaagacaactatagtagggtttttaaaacctgaaaatttccaaggaatctaaaaggtaacttctgtgtagggctgtgtgcatggccaggaaccacatgcaaggggtcaactctttcattccgaacgaccttgaggacttttgcaggcaagatacaaaagccaccacagaattgtgaatagcataaatgtttaaggcatgctgaaatatacacatagagctccttatgtatttaagaaaatctttcacaaatcttcagctgaccaccaagctaaccaagcagtaacttcagcggctgcac

SEQ ID NO: 1058 - DNA, 244 bp, Homo sapiens
tccaggtgcgtccggaattgctgggttcctggtctcactgacttcaagaatgaagccgcggaccttcgtgcatgtcccagtaggaggctgttcctttagtcctggaatgagaagacaatgtggagccaagctgagcattgatgcacagtcaggtggagccaagcaggacgacagcaagtctgcagcctgagtcctacatgaatgagaaataaatctttgttgccataagctaaaaaaaaaaaaa

SEQ ID NO: 1059 - DNA, 1011 bp, Homo sapiens
  misc_feature (1)...(1011): n = A,T,C or G
gtgggtgtgctcgtgtggagggagggggaaggaggaggggggggctagtcggcgacgactctcctcattttccaggaattcctcgcaacagcacaggtagatgcttctaagttcctagattactctttaaaaccctttctagaacactaaactagagaactggcatatgtgaataactagacacctgagaagtccaggggatacaggagaaccccaaagaatgaacaagccccacaataaattctgcactggtgccagtctttcctagtgaagctatggagcacaattgaaggcctcaccacctaatgggccttcacattcaggcagcccttgactggacattcctatttgcccagggatcatgttcagacctccattgcattccattttttgcctttggcatgcgacataaatccctcttatgggtattgaaatgctgctcatttccaagcagttcggggagtcctaaaaggactgcccccaagacatttngatgtaacaaagttagagtgatatcagggttacatttagatgtaagcgtttgaacacagacttgtgtccaaatggacctgcgaaagtataacataatagttttcgattaccagatacagtctgcacagactttccagaacccagtgctgattatggtaaatttatacatttctgtagctgttttgttattaattttgctttgtaatttttttgttgttgttctttggggatttttttttgccccggttgttagtttctatattgctggtttttttctccaaatatgaaatccttagagaatcaagtcagtacaaagtctctgttgaatatgggctctagagtcagatgacttaaaattaaattctgactccatcacttactaattgcataaccctgaaaatttccatgtgcttcagttttctcaggtacaaaattgggggtgggggagttggagggtgaataatagctctaaaccctgatgcggcaggtgttttatccttccctaaaacacccaccacc

SEQ ID NO: 1060 - DNA, 822 bp, Homo sapiens
acattcagagagagatggctgattaaattaagattgaagtaatgaccaatcaccagattttttagtgaaaatgtaagtcctactaaacgaagcttttcacagtgtttcccatgacaagagggaacgttcgggggagatttgttgcagtcttctaaggattttcctccatcagctatcttcaaatgccattttaagagaagaggaacactttctcagtctatatttacctaaactgtgttctgtgtttggtttcccacatgagagaaatggagtccactcttaacagtgtattcaattgtgttgaaaactgtatcatattccatctacccagtcttggtttctgtctgaaatataagcagctgagacagtaataagaaaaagattcagagtgtctgaaaaaacattttattttcattactcatttcaagggtctgtttctagctattaaactgtgtaattctctgaacacattgaatatatattgctagaagcaaaaagaatgtaattacctagattgttacattgtattaatgagaatgctttcctgagattttattattctgaggattcctttacagacggtccgttcgcaagattgcttaattatacaaagatgccgcgccccttccctttaactgagaggttaatctcattgatcctccgctcactgaacccgcctgcgcttaggtctttctggttgcagagacgccggtttcatctcacttcaatgtcggttctcccggttttccacctatatcatgggtttcccccgattcgttcttgtatcgagggcctgtagcctagctcatgttcccgccgcgg

SEQ ID NO: 1061 - DNA, 896 bp, Homo sapiens
  misc_feature (1)...(896): n = A,T,C or G
gtttttgagacagaattttgctctgtcacccaggctggtgtgcagtggtgcgatcttgactcactgcaacctccactcccctggttcaagcgattctcctgcctgagcctcctgggttgctgggactacaggtgcccgccaccacactcagctaatttttttttttgtatttttcatagagatgggatttcaccatgttggccangatagtctcaatctcctgacttcatgatccacctgcctcagcctcccgaagngctggnnttncaggtgagcgccatcacncctggccctgatcttggtcttaatgnaaacttaaatgctacacatnaaacctcttatcactgtttttgctgcatctcacacattttgatatgctttgttttaattccaatttagttcaaaatattttctaatttcccttgggattttttttcttttcacccgtgggttatgtagaagcatgtagtttacattttcaagtattaaacaattgttctagctataatttcactattgatgttactataattctcttgtggtttaaaaatactctatataattttagtctttcaaaatgtattgaaacttattttatgactcagcatttgtcaatcttagtcaatgttacttgtacatttgaattaatatatatttgcagcaatttgttgtaatagtctataaatatcaattaggtcgaggggttgataaagttgctgaattcttctctatgttgctaacttttttggtttacttctgtgaatttttaatatatggctgtaaaaatttcccactatgattgtaaagttttctaattttccatttagctctgccaatttttgttactgtattttgaagttctactcctcaatgcaaataaatccaggatcggcaag

SEQ ID NO: 1062 - DNA, 787 bp, Homo sapiens
  misc_feature (1)...(787): n = A,T,C or G
caggaagccaggtgacatcattcctctgtgcacatcttgccatgactttattggcctgcaataaaagctgaaggactcacctgtccattgggatctggccctagtcatccttctaccaaatcacctgctaccccagcccttgctcccttcatcacaagaccaaactagcctttgttcctccctctttggggtctttgagtgcctgtgttcactgcgagctgtcgtaatctgcacatcctaagggccgattccctgcctncactgcgagccatcctaatccgcacatcctcagggctgaatccctgtcttcactgctagtcatcctcatgtgcacgtcctcaggcctaatccctgtcttcactgccagtcgggctaatcggcacatcctaaggccaaatgcctgtcttcactgccaaccgggctcattatgcccattcttagggcggaattactgtgcaactcgggctctatgcgcatgaggcctgctttaattggaggggactaggaacctgggccccctgtgtatggggtagctttaacataaaaatcgggcgctttagcgattcttaatgacgagggtggggtgtcgaacttttcctatatactcaccgtcgctgcataggttttagacacagtacgagtctgcggtgaattattaacgaatggttacctgtctgttggaaaatcgcggtatatagcggaaacttgaatacctgtagagactaattatttgttgtggacagggaaatcatgggtggtaacggacctactgctatgtctagaaggt

SEQ ID NO: 1063 - DNA, 853 bp, Homo sapiens
ctttgcggtaactttttattcatcattacaaatatagtaattcttattactttcacagaaaatatttcctctattttcttcacagttttactacctgcatatgatgtatttttcagggttctctagagacagaagcattgggaggtaaccacaaagatatagttatagatgtagatgtagacatggatatagatatacatgtagatgatacagataatgtagatatatacagattttgtagatatatatagatgatagctatagatacatatagatatacatacagatatagatgtagatatagatatctagataacatagacatagattaaagatgtagatggtaagacaggtgatatagatgatatggaagggaaatcactaacagaattggttcacatgattacggaggcgggaagttccatgacaggccgttttcaagctgtagacccagggagccaatggtgtaactctcagactgaggttgaaggttggagaacctggggtctgctgatgctcctcccagagtccaaagaccagagaacctggaatgctcatagacagttgtaatgtgtagcttccatcacattttattgtttttgattgaggcttatgtacataaactaaattttatccacgtaattatcatctttcatcatatacaaaattccttgtcttgtggtaggaacatggtaggtcatcaaacaggatttttcccaattattaatcaatatattaatttctagaacactttttgagtgctccccatgtgcaggcattgttctaggagcttggtaaacattcatgaagaaaacagacggagatctctctctctcttcatgacgctcttagt

SEQ ID NO: 1064 - DNA, 661 bp, Homo sapiens
aagacaggtgttggagctccaggcctcaaatcctcacaacacggctttttctacaagcagaaaagaacccaatcctcaaccgtgtttccttcaccagcgagaacacctttctgaggagctcccaggaaggaacaaagattgattctctggcacacaggaaggtgaattcgggaggaagcaaaccagaagtggggaccaactaaaagaaagaaaatgaaatggagaatgagtggattttattcagtttcagacaagcaactgttggattagagcatacagggacatatattgtcctactgccccctgtggttagtatgatttgtctgactagctagttattaatagttgtccccttctcctaccacttcaagcccacttcaaccagctccttccaaatgctcaagagaagacttcagaagaaattcaaagttttcaaaatgatgttggattgaaagttctgatgatgttctataaaccaagagtttgcaaactgtggccaaatcctgctcaccctctgattgtgtatagccccaagctaagaatggtttttacattttaaagtagctggaaaatatcaaaagaagagtaataatattttgtgacacatgaaaattcatgaaattcaaacttcagtgtccgtaaataaagcccgatgcgcgcg

SEQ ID NO: 1065 - DNA, 626 bp, Homo sapiens
gacaaagattgattctctggcacacaggggtgcagcaaatgccaaggccttgaacaggagctgagcagtgtgtgcctggaaactacagagctgatgtggtgtgaatgggagagaactaggagccagatcagagaggtagcaggggccagatcacgcaagactttgtagatcaacgtaaggacttcggtatctattccaagcaaggtttcagacaagcaactgttggattagagcatacagggacatatattgtcctactgccccctgtggttagtatgatttgtctgactagctagttattaatagttgtccccttctcctaccacttcaagcccacttcaaccagctccttccaaatgctcaagagaagacttcagaagaaattcaaagttttcaaaatgatgttggattgaaagttctgatgatgttctataaaccaagagtttgcaaactgtggccaaatcctgctcaccctctgattgtgtatagccccaagctaagaatggtttttacattttaaagtagctggaaaatatcaaaagaagagtaataatattttgtgacacatgaaaattcatgaaattcaaacttcagtgtccgtaaataaagcttactgaaacagaaaa

SEQ ID NO: 1066 - DNA, 861 bp, Homo sapiens
cttgcgcatccttatttattttaatgaatgatatttgtttaaaatgattaaacctgctgctttccagtcgtaaaggcaaagttcttggaccccaatgtctcccagaagccttcccaaagagtaactgttcattttggtaagcagttcagtaaacctgtgttaaattaaaatggaaactaaaagagtaatgtcatttggaagactcttggtctgctgtcagcatttctgaacacttcacttggtactgggaaatcctaaatggttcccaatctttgatggagatcatcaaggcactgctggtactgaagatgttctagcttctcacaagtgcacagacatggcttcaaccacacttctctgcaaatcacaacttgaaattcggtctcctcttatcttccaattggcactaagcattctttcaacagtctcataagccatttctatcaagaaggaattattgtctttaactattggaaacgtaagtgaggtgaattacataataataacagtagttgtgtctgggacaatgggacatgcctgtaatcccagcgttttgggagggccaaggcggccagatcacttggaggtcagtggttcgagatcagcctggccaacatagtgaaacactgtcttcacttaaaatacaaaaggtaggccggtacggtggcccatgccctgtatctaagctacttgggaaggcggagaaggaagaatggcttgaacccgggaggcagaggttgcagtgagccaaatacggcccttggacttcaacccggggtgcagaatgagattcattttgtttcccagctactggggaagctgaggaggaggtatttcttaactgtaagtttaaagcttcat

SEQ ID NO: 1067 - DNA, 1212 bp, Homo sapiens
cttgaactggacccctaccttttaccagaggaaaaaaagtcaatttgagatgaaacaaagactttaatataagacctaaaactataaaatgtcatataagaaaacctagagaatacccttcttgacgtcagctttggcaaataattcataactaagtcctcaaaagcaatttcaaccaaaagaaaaatggataagttggacctgattaaattaaagggtttctgcacaataaaagaaactatcaacagggtaaacagacagagagaaaatatttgcaaactatgcatccaacagagatctaatatccactatctctaagaaacttgaacaaatcaacaagcaaaagatgaacagccctgttaagaagtgggcaaaaaaacatgaacaggctcttctcagaagacatacatgtcgccaacaaacatatgaaaaactactcaaaatcacaagtcaggaaagaaatgcgaatgaaagccataatgaagtaccatcacacaccagtcagaatggctactattaaaaagtaaaaaaataacagatgttgacagggttgtggagaaaagggaatgcgtgttcattattggtgggaattgtaaactatttcaacgccctggggaaccaaaccttgaagatcctctctatcaacctacaattaaaacgacgattcgacccatagattccattacttggttttatatccaaaggaaaattaattatcctaccaaaaagacacatacattcatatgctgactcaaaacactattcatattaattgaggacatggaatcaatgtagatgtccatcagctatggactggataaagaaaatgtggtacaaacataacatggaatactatgcagccataaaatgaaagaaattatgtactttgcatcaatatggatccagctggagaccattatcttaagtgaattaatgtgggcacagaaagcccaatactgcatgctctcacttataagtgggaactaaacattggttatgcatggacataaagatgggcacaatagacactgggatctaccatgtgggggagggcaggatggagaaagggcctgaagaactgcctattggatattgtgttctctacattggtgttgggattatttgtaccccatacatgagtgtcacacaatatactcgtgcaacaaactcacacatgtaccctctggacctaaaataaaagtcgatcgcaaa

SEQ ID NO: 1068 - DNA, 863 bp, Homo sapiens
cggccgatccttttttatttctggttttctctgctgaggaaagcactaaattcatattcaaacttaattttctaatctaggatgacttccagtacaccaggtatgattctgactcttcctggtcatttttcaaattcgtcctatggtaataattgcaactgcctccagcttattcgcaggtggaaagtgcacctcctctgcaaaggtagactgcctttgggacctagaccatctttgtctagagttctctcacagcagtgctggcatagacactactcaggtttgcgtgtaagtctgctgattggaactgggaatgcatttggtactttgcatgatggtaaaccatagttagccttccgtgatccacagtattgctgaggaaattggtgagggttattaagactccaggtaccacgagtagcaaaggacatcccttggggagaaatactcaggggtctaacaactcagagtccgtgacactctttgtccttggatccccttcatctcatgccccatgatttgagacagatagatggtctagcagattctctccagatatggaaaaactgcagattactggaaattcctgctttggcaccttctctacaacatgagtcacttcctctgagaacttttcagaaccatttcagatgattttctctttcgctttcacacaccttgagcgggggtatataaaaaagccctgcacctttagttccagacctgtgggccaaagccctactgggtatacatttaactggagaaggcttatggccaaaaaatcctgagttcccccgggattttccaaggctgggaagaaatttggggttaacgcaggctagggctgtaccaacagtgggtac

SEQ ID NO: 1069 - DNA, 1532 bp, Homo sapiens
taatgattatccaatgttgacccaaaactatgagcaaagctccggggattttctgggcgttcagcacaaaattcccagttaatgggttccagtgtcttaaaaaggcaggactgaggcggtctctatggagttgttctgactgcagctgggccctgtccttccacacctgcccctgcaggaattctccggacgcctgtggagggaagaatgtgtgtgtctggggtccaagaccacatgcaccgcctggtggaactttctctgctcttgcatgtctggtgggagcttcccttaatgacacaggatctgccgagattcatccccaactccaggctggcaccagtgttcaagcccctgcctctgctgtctcccaggtcttcaaatttacaccactctgactctcagtttccctatctgcaaaatgaaggcaggaatgcccacctcatggggtgagccagtggacccaaatacgtggtgcagtaggtgccacggagtagtggcacgtgatttgtggctggtagtgtgagtattccttactttagagagcagaggaaaacacatcagcagattgtttaagccaaaaaatgtctgttggttgaagaatttcgttttggaaggcaagcccaagttttgggtcagaaccgtatttcctcaggcacggcacggttgaacgtcgaggcatattttacaggcttggtgaccgctcaagcctttgagccctccatgcgggtgctctgaggtcagacttttcgggaagccctcacacagctggtctgcttgtcgcgttggtagcaccgtttccacagagcaggctctgtttggctatgaatagatgtttttctcactcttttcttggatgcctgaatggcaggctcccctcctgcagtctcagaggccgacctgcatgtaaaactccaagcggacatcagagtgggttcgtctgttcctgcttggacttgaggctctcagcaaggctcaaagagctgggtcgatggccaccatgacccagggagcctcccgagagtctcccaggctatagtttctgaaggctactgagtgaactgaagaaatcagagttcatggaagaggcagcagatccgagcaacagccgagattgaggaggatggttcaggatctccaaacacaggcccgctggctccactgtgtccaagccgcagatgcaaagcctggcatgtgcccgacagttggggccggctggtgggaaggtgtgtgtcaggtgtcggagcctcggtgccaggttctcactcacgcgtcctccagggcctcagctgctgtatgccagtgtcagtcccagtggcgatgagctgcagatggggcacaggggtggtttgcccagggcagaagtggctcgttctgttgtccaaagctccccgtgacctggccccgccagaagcagcagccatgggtccttttcctgagcagcttcgtgctctttttagcatgtgggtagcagttccagggcctgctcctggggagttgtaccggtggaggattaagagagtgtcccatatgac

SEQ ID NO: 1070 - DNA, 299 bp, Homo sapiens
cggccgatccttgtttattttttatgatgtctcttgagtgatacaaaatcttcatggttggtttcttcccctcagtacacaaaagcaacacagctctttctgatacagaaggagttcaggtcacttaaggcatgtgggtgatggttgctgagcagatcatcccgtaggtatccatgacaaagcctgtaatcccagaactttgggaggccaaggcaggcagattgttcagcccaggaggttgaggctacagtgagccatgatctcgccattgtattccagcctgggtgacagagcaacac

SEQ ID NO: 1071 - DNA, 1036 bp, Homo sapiens
  misc_feature (1)...(1036): n = A,T,C or G
ggctggtcggaacgctccaccgctgctgccaacgaggacgattttttttttttcatattcaatctgttgtttattagctgtctgaataaaaacaaaggtagaggaaagatattttcaaattaaatgaaaatctaagtttgctaccaataaatacgcatttaaaatatgtctaaatatacgattcacaaataagaaaaatactttcaaataatttctgagatgtagtaaatattcaagaaaatgaaaattataggtgtgtctaagtaattattagatatataaaaatgatagtaaatatctaaataacagggttaatcaaaatagacttaaaaaaataaaataaaatagccttaaaatgctagataataatagtatacatttagtaaagtgctaactgtaaaataaaatatgcatcaaatttaggcttttaaatatatgcatattcaatttctggaggaatcattaaaagagtagaatgtaaaaactcaaaattatgaataaataaactagcaaagaatgaactttttgatccatctaaccgatggtaagaaagtaaaagtaataatgtcatgacagtttcatcaccaaaatttagctgataaatagtggagggaggttgctattgaaaacaactgattcactgggcaaaaaacactaagcttttaaagttacaggaacaaggattgcacttagccaagtactgagtcccaaaggaaataaaaacttgctgttagtggatctgcagttgtccttttcagttctcttttgtgctcagatagtattatgaggtcatacatcatcacacttaacaagtgactttataccatgttgatagtctttgaaattgtttatgttcacaagataacactctctcctctccattagggtaaggccaattctcagttaaaaagtcagatgctgtttgtttctttgcttgtttgtttgttttgtcccgnttatgttttcttgtttttttctttttacttacaatttaaactgagattagctcctattgaggcttgttatgggctctaag

SEQ ID NO: 1072 - DNA, 954 bp, Homo sapiens
  misc_feature (1)...(954): n = A,T,C or G
cggccgatctgtctttattatgttttagattacaatatacatagaggttctaacttttcccgtgctcccttgtggatattatatgccccgtaggacgcatatgtcttcttttggagacccctggctccatctcagtgcataggaagcccctgtgatttggctcctgtccacgtctgctgactcgccttgtaccatatactccagcagctgcaaactgcctgttcgttttctttttgtgctatgctctctccacttcctggaatgttcttccttcaatcctcttcctccccaactatgccttttatatgttaggtaggggtctgtacctttctttgacccccaccctgatcccaaattaggcatccctctgtgtgcttatggactattttgtgtatgtctctgatctgcattttatcactgatattttattatgtttatgtctctctctcctgcgtatcacaatttccttgaggacagagaccaggtcttgacatatatttctgatctctttttaatagaaaaatgtatagtttaatttttcttttatctttcaacctccaaaccattttctttctttcgggtttgcaggctttggatggatttttcttttgttgggagctgtggaagggagaattggtgtttgggtgagaaaatggtgaccagctacttagggtacaatcaggggggattaattaatacgaccggctacagcatactgcgcgggggggacatgcagaattgggagaatctcgtnccagggagaaacgcgtgctcggtaaaattaaatggggaggggcgatgggcaaaaatgatgggtggccccggggtttatccaggggtgggaaaaactttaaggcggccggcgtggtgatggctatagcaaacganggccgaggagggggggcgggggtgggcggggagggggggaacagggggggtggggagaggtgggga

SEQ ID NO: 1073 - DNA, 878 bp, Homo sapiens
tggccgatcgaattttatttaaaaagtatgtgggagtgttatgtatatattccaaatttaagtcaattgtctattatcttttgcacatatcttctttcgcgtctttcgaagtctcttgtcttcactttcttctaatactctgaggacctgaatatttcactttaatatagttaaattatctattactttaatggtgaatgctttttagtattttttaaagaagttttctctacttcaaaaatcacaaaatcattttgctatgttaatttctttaaatgagtagttttcccttaaacaattaggtctttaatacacctgggatttagggaaggagtagagtatgaggtagtggtggtctgatttcgtttttttaaacatgaattacaattgtctcctcaccttttgttgaaaaccctgcatttctccacttatctgttatgccatctctcccatatgtcaaacatccatttagacattattttttgaggggcgctatttttcctgcccattgttctatatttctcttactgaagcatggtgttttatttactaaaaaataataataatcttgatatctagtaagaaaagtccacccacctcaagtgtagggaaagttaaaatgccacaaaatgtactcttcttgcttcagtaagatttgttgtttttcttttcttcctaggaaagaaaaacaaactggcttggttttagactgtggggtaaaaacattgactggttaccaattaacttgtaaaagggctttatggcaaaaaaacactggatttaccaccgtgatttatccaatggcgctctaaagaaatttgagggtttaagcaggtgctaatgtgccttaaccaaccatgggatctcctggtgttagg

SEQ ID NO: 1074 - DNA, 775 bp, Homo sapiens
aagctgagaagtctgagatcaaggctccagcagatttgctgtttgatccagttgtgttttgtccatgctaaagatccagtggctatttttcctggttgtttgaaagctgctccgaggttattatttacagttcacagaaggacaacccaccatttgaagttattcacactagtttgtaaagaacttacgactcatgaagttcaattggaagcagattcttccttatctccttctattttctgagtagcctacaacctagagtccatggttttactattacttttgctccactgttatgaattaagtacacttttctcaagtaggggccaagcgtcctttggtcatgaagagagtgatgttttgtcctgtgttttgttctattagtctttgagagagtcttaataacacatggtgaaatttccctttgttggaagaaagaacaaggtttcacacaattgatttgatacaaaggtttgtcaggttgatgacgttcctctttctgaagagatctcacatgcttatgggcacaattctactaggttattttttattggacaaattctatgcctgaacaacttcccattctttatggaatgaaatttttttggaaattattggattattttaaaaaaaactgttgcaaaaattcccagaaatccactgaacctttggcaaaatcaatccccaccactggggcactattaaatatttccaggaaaaagttattaaccaaacaaagtctttagggcttgaattataaataactggctgcttt

SEQ ID NO: 1075 - DNA, 1027 bp, Homo sapiens
tttttttttcacaaattctagaagctgagaagtctgagatcaaggctccagcagatttgctgtttggctcataggcaaaagaaacttgccttgtctcagataaaattttagactgtcaatttttgagttaatgctgaaatgagttaagactttgaggaactgttgggaagacatgattggttttgaaatatccagttgtgttttgtccatgctaaagatccagtggctatttttcctggttgtttgaaagctgctccgaggttattatttacagttcacagaaggacaacccaccatttgaagttattcacactagtttgtaaagaacttacgactcatgaagttcaattggaagcagattcttccttatctccttctattttctgagtagcctacaacctagagtccatggttttactattacttttgctccactgttatgaattaagtacacttttctcaagtaggggccaagcgtcctttggtcatgaagagagtgatgttttgtcctgtgttttgttctattagtctttgagagagtcttaataacacatggtgaaatttccctttgttgtaagaaagaaaaggtttcacaccaattgatttgatacaaaggtttgtcaggttgatgacgttcctttttctgaagagatctcacatgcttatgtgcacaattctactagtttattttttattgtacaaattctattcctgaacaacttcccattctttatggaatgaaatttttttggaaattattgatttattttaagaagaactgttgacaaagattcaccagaaatacactgaacctttggcaaaatacagtccacacaactggagcactactaaaataattccaggacagaagtttattcaacagaacaaagtctcttaggtgctgtcattgataagtaaactgactgcttcttcctttcctaaatatgcagtggcataattaagagtattttatcacttctgttctttcctaattatataaaaaataaaataaaaactgatcggcaag

SEQ ID NO: 1076 - DNA, 1014 bp, Homo sapiens
  misc_feature (1)...(1014): n = A,T,C or G
cttcgttaaatgcctctctagaaataggcggaggtcgaactctccatgggtggtttgcatggatgcagcaaaggtgactcacgtttgccgatcttaagagctgtacagatggctgggagcggccgattaaaacctccttgacaactcctttgagactgaagaccacccacctccattttcactgncaagcaaatggactgtagagagagcaacatggattctgacctgatcctcaggccagggggtaaacaaaggcanctngacctttggctaaacagagagaccgggaaaataatcctcagctngaaantgaatgcacgcnggacagagaatgacngngganaaagggaaccggnnngcctcctncactgcnnnanctangccaccnnaaccngggnnncncnnggngagacnggtgncanngngcaatgnnancccananctgncncggncgcnnaaanntgnaatatacnccnacnnngnanngantgcannaacannnnacacnnnnnncanaccaacnngnnacaaagaggnggctntcgagnaaaatgganngannnatgaanaanngngagaganaannnaaattcnnnagntggangnaaanttnnnganancaaanannnancnanggancncnnggtggnnggacnnggaaaganangnnggnanatnnngnaaatanganganaangagancangangncngnaaatcnagnacngnagnnaggtgnnaagaagnngnnnganannaangcnnannctnngtcancnaaaacaaannagnnngaaagaagagcaagagangagnananaggnnnacncgnacnanaaaanngnaagtnaagnagccannaaganngnnnnnngaggaangggaagnatannagagnaananaananacnnnanaagaaaaaaaanngaagnantaggcagncnaaaaaaaanannacgganncnnacnangnncangnnaanangggaagananncgantgtcaangaanacg

SEQ ID NO: 1077 - DNA, 889 bp, Homo sapiens
tgggcgcatcagggttttattttagaccaggttgcagttgcgtattgtgtggcttcaggcaacatagacttcttatccataaaatgagctgtaattaaatccctgctttccaaacataggtccttggaccatgtataatcagagtcatctaaggtgcttataaaattgcagaatttgggaccctacctaagacatatggatggaatcagatttttgcaatagaacccagacatttacattttcaataagcagcccagggggttctgatacacactgaagtttgagaactactggatcaggtagttactaatatccctttcatcctgcacattttctcattcaatgatttttcaccaactgtggagaacctggaacatcattcaagccaaaatttggccttgcatcttactctttgtgaggagagcaaagatgaccaattgtttgttttgaagtgaactaaggggaatcccaggttggaggatttttccattttaaaacaaggacagtctgggtagacagaaaatgagtcattcacacccgataggaccagtttacggtggtttcttattgctgtttaaaaacttaccggctcacaaaattaccagaaattttctggccagggtgcctttaaaacaagctgagggttatctgcgccgggatctttgttatccagaagggcaatttgcctgttgttaccccttggccttaagatatgtgtgaatacctttttttcatttacaatacatttgtttcaaagaaataagagggggatggctctcatttccgcggaggtgttgaaggaggtttctaatggcgtatctctctatttatctttgtattatatgcgcgatattatctgtctttatgttatcgtgaacaccatctggct

SEQ ID NO: 1078 - DNA, 834 bp, Homo sapiens
atctttgatgctaaaagcagaatggactgagagatgccttggacataagtgatttcacatctgtaactatatcctgcaaacatttgtagacacatcttgggaaagaagcactcatgcttgcatctgtttccaacatctgtgcatttaagtcagcaacaaaagtcaccaggcatttgagctttccctgctataatgtttctgatttaccttgacagcacatgataatgtctaagttcttcttcaccttaagcggctggaagcccctgcatatcctgcccaagcctcaggaaagcatattgggaatgaatgtgagacggaggtagatgcgtgcccgtggcctggatggatgattggaattgaggaagaattgatcatctaaactcggcagggctgcgctctactcgggagcgtctcttggctgaataacagataaaaatttactggatttccatgtctgaacctttgcgatcgcactctgtacttcactttgatggatttaaagctggtcattatgatacatggcaagttgtagcaggaataaaagcgggtcctttcaaccagccattttaatcaggaaacagtgttactctggcatcattaaagcttgccatatgccatagaaaggggtgaaacatacacttgacttttagggcagattaaaaaaaagtttgattttacggggaggcagggaagaagcaacccaataatatatttaaaaatatttatctgtctcagtaagcagggcgaatttttaaaaagccccctttagaattgtgtctctcctttcccctaaaatgttgaagcgaattaaaaagaataaagctcgatctgccg

SEQ ID NO: 1079 - DNA, 247 bp, Homo sapiens
taatccaccgctcagattcattcaacaaatcaagctgaacatctgttactgcttgccactgctctgaatgctagcaatactgcagggaacaagccagatcagtcctgccctcttggaacttatgttgtggtgatgaagacacacaggacacagatacaagagtgtgtttcctctgccccaggactgaaagctccttgaagatagaaaccacgtcctgaaaaataaaaaaaaaagtaatagaaaaaga

SEQ ID NO: 1080 - DNA, 725 bp, Homo sapiens
acagagggctgagctttggagaagttgcctaacttgcccaggcccaccagcaaaggaagctccagttcctgttctcgccattccacagataaatacacagcaactatggatgagcagcatttagactctgaagtcatgtggtttttgtttctaatttagtgttatcttatgaatttgtatcaaagacaggaaagaaggccagcccaatttatgcttccaaatccaagcttccccaatatttatcaactgactcaagaagttctgagcattcactaggcttcctcactatactttaccttaacccttctttataagctttctttataattgcttgaaaatttactttaatgcttttcatccatttctcctatagaagtaagctggtcctgaatcatgtaatattgagagggacttgagtcaagcttgttctgctcagaaacagctgcttcttgagccttagaaccaaaaattctgaggaaaaataccatcctcatagaaacccattcttttatctattatcctaagacatatggtaacagatgaaaattgcttatgttgaaactttatgcattttctcataattgtaaatacaaaaataagatgataaatatttctcatgttgctggaaacagatgcaaatgtctgaacattgggactatatattaagcaagctaaatagagatgtttatcactaggaaaaaaacaaaataaaacacgatcggcag

SEQ ID NO: 1081 - DNA, 1146 bp, Homo sapiens
gctgccggaacaaattaccacaaacttggcggtttaggataacagagattcattctctcacagttctggaggccagaagtctgaaatcaagatattacttataaatggaatcctgtagtccaaaaatgaacagtaacaatttttgggaggatatggagcaactggaatccttatacactgctggtgactccactcgggtggctccatcctgacatgccatttgctatgatatatagcatatgtgacacctgactttcttcctaccatatcagggaagtttgttttccccttgaagtttgaagattgagtattctttattctgtctgatttctgagcctaatgaaacagtgagaaggaaggagagagctcatctaaggtgatatttggtcattcttagattactgggcatctgtttcttctttttagattttgtgaatatcccatactcagattcactacatctacttgcaggtatttacttttctgatgagaaggtagtccctattttcatttatcttactcaatttagaagacagtcctgaagattttgctaccattagagaaagttaacctcctccataacccccttcctttgctttgtttatacccccatcccggccccaagccattttttcttattacttaatcatatgagagaaaggataatgatacccagtaaacttgattttctctagatgtttggtattgaggaatccccaaactatgttactaatatgctttttggtgggtggggaaaaaagatttagaagcctagctatacctctccacatcactctgtgtctcctgtttctttccatacttaccagtgtttaaaacttgcatttgatagttttctttcccttgttttggtgttgtggtgaattttatttatttttcttttcttgtattcttgtttgctcaatctattacgtatttgtcaagaggaattctgtaattcagtttctgtcagtgatcttaacgcaaatatctgagtcacactttccataagtaagttgggataataattataatactgaactcatgaatttttttagaagtactaagttagataatatatgtaaattgctttgcaagctctcaaattttatatgaagaatatgttttcaataaatatagatgcggccg

SEQ ID NO: 1082 - DNA, 338 bp, Homo sapiens
  misc_feature (1)...(338): n = A,T,C or G
ctgtcctcccctctccagacacgcgggtcgcccctctcgcggtgccaatcgaaagcatgaccaacagacggagctcgagtacttctactggcgggcgtgttagtgcagactaattaggcagatggcaccgtcggattgagaaggcttcgacataggaacgaaccgagcgcgctagaacccgctctttagatggtgctcacgagccacgccacaacgcgggggtgaagaggtttcttttagttaagggcatgcaccactctccaccactcgggggaaccgcgggggggtgtggtatagggcacttggcgccgccccaaaaaacgcgcgaaaancccact

SEQ ID NO: 1083 - DNA, 715 bp, Homo sapiens
cggcccatcgtagtttatttcttaacttccagttattttctattttaaatatttatgtgtcagttggtttgttttgagggcatctagacctttaaaacagtgctacctgagctgaaatcccaactctgctacttgctaggtgtgttaggccatttgcgttgctataaaggaatacctgagattagctaaaagaaaaggtttaattggctcatgattctgcaggctgtataggaagcatgacaccagcatctgcttctggtgagggcctcaggaaacttccaatcatggtagaaggtgaaggcggagcaggcatgtcacatggtgagagcaggagcaagaggtagggggaggtgacacactcttttaagaccaaccaaatctcacatgaactaactgagcgagaaatcacttatcaccaagatgataacactaagccattaatgagagatccacggctatgatccaatacctcccactaagccccacctccaacattgggaatcacgtttcaacatcagatttggaggcaataagcatccaaaccatattattccactcctggccccccatatttcatgtccttctcacatttcaaaatacaatcgtgcctttgcaatagttccccaaagtcttaacttgttccaggcttaactcaaaagtctcaaactccaaagtctgaagtgtcatctggagatgagttccttccacctatgag

SEQ ID NO: 1084 - DNA, 238 bp, Homo sapiens
cggccagcatcggagtttattgcaaaggaaaaagaatattttgaaagttaagtgcagagtagacagtacacctcgggagagagagaattcagggtgggctgctcataagagtgaggcagtgttggccgggcgcggtggctcacgcctgtaatccagcactttgggaggccgaggcaggcagatcatgaggtcaggagatcaagaccatcctggataacatggtgaaaccgcatcgcta

SEQ ID NO: 1085 - DNA, 987 bp, Homo sapiens
ctttgtccacagaaacgcaaccccttcttccaccgcttcacacagtcatgcacatatatgtcttcagccatctgagaatgagctcccttcttcctgtgcagatatgatcagccctagctgactatggaaaacagggcagacatttggcaaggagctcaagccacagcaacaatgaccaagaataagttagaaaatgggccaagagagtccaggcacagaagcaagccagtgtcaagggactcgccattgccagaaggacatgaagacacagctgtgtgaatctgcacctgtctgtatcctggaggatcaacgtggatggttatcactgcggaatctggggcctcatgagccaccatagagaaagtcagctgagttcctagtgccagacaaaatgattgatttagaattgaaaaaaaactttttattttatagcaattacagattcataggaaaaatagtgcttacaggtcctgtgtagccttcacctatgttctgccagtggttgcatcttatataattgcgagataatatcaaaaaccagaacattgaccatgtcgtttaaagtgtgtgtatagttttgtgcccatggcatcacacatgaagatttgtgtaaccaccgccccaccagttcaagatacagaactattccatcaccacgaggatttctcctgtgctgacccgtttatagtcacgtccccttgcttccgtgactaccatctctaacccctggtaaccactaatctgtcctccacctgtataatcttgtcactttgacaatgttatataaatggaatcatacaatctgtgaccttttgagattggcttttttcattcagcattatgcccttgagatccatccaagttgttttgtgtatcaatagtttgttcctttttattgctgagtaatattccatggtatgaccgtaccataatttgtttaaacgttcacttattgaaggacatttgggttgtttccaagttgggggc

SEQ ID NO: 1086 - DNA, 836 bp, Homo sapiens
gtctccctctgacacccaggctgcaatgtagtggtgcaatctcaactcactgcagcctcgaccactggggctcaacgatcctgcaacctcagcctcctgggtagccgggactatagagctcagataatgaaaatgagaatgatgataactccaatgccagcatgacccagatatcataaaaaatgaacactaaatggaagaacgcatcactggcttagggagataaacaacaaaaacagaatatactgtacactgtacagaaaagaacctgggattggacatactggagaaggagatgtgaaagcatatacgaagatggaatctcataggccttcaactggtaagttgagaaggcagaagcttctacctcatgaatgttaagccaatacatagaggagagcaaacaaaacctagatacagaacaaaagttttggggtcctacgcaagaatttgctgaagttaaaagagaaatgagctactattacacacgacatggatgaatctcaaaatcatcatgttgaaagaagccagacacaaaagaggagaagactcgacatttgcattggcttctcaaaagggtttcaactacacaaaaagtgtttaaaaatccagttatatggagaaacaagatcaatttattgtcaaaagacagaattattcctcttttgcatcaaccaggcttgacataactgtaatctcatggaaatgtctgctactgtaatcaagaatttgcatgtagaaggaatgcatcacagaatatatgacatcttgctatgtctactgtactaaagaattaaagaggtttgaaaataaatactgaaacaaaaaaaaaaaaa

SEQ ID NO: 1087 - DNA, 355 bp, Homo sapiens
atccttgcccaagtttttggaacatggactttggatggagatctggatgcaaggactttagagtggaatgaaccaggggattccacctgaattcatgtgagagaagtgggactgggaagaaagagaaggtgaactgcaatgcaagttaaaaggaagcctcagaaatccatgggaagctctgaaactggagtgactgttcagagatagtttaagtggaagtacaaggcccacttatatttcagcatcaaccagccactctgtgaacacagatgtgagggtgggaatatacaatccaggaatgatcgcagatgtgagggtgggaatatacaatccaggaataaacacagatcggccg

SEQ ID NO: 1088 - DNA, 791 bp, Homo sapiens
gtcttgatgcaacactctctgaattcttcacgctacaacttactgtccagagtggcaagctacatatcactaaaaataaagatggtgtagtgtatcattttaccttccacattgagggttctgatgcatctcttttcaaacttggaacatggtgttatgcaggcacaagctccctctgttgcccaggctagaatgcctgggcaagatcttggatcactacaacctccgcctttttaaaggagggggggggtttatgcctcagccttcccaggtgggggaagtccgcgcccacaccacccaacccagttttttttttttcgttcgaaaccaaacactacggttttgcctttgctcccccggctagacataccccgcccggaccaaaaagaaattcctctccaccgaattttccaagattggctccgcagacctatttggaaatatataacaccccgaccccagtctcttttttatctcccccaaaatcccctcccctctattattatatctaaccctccccccattagtccctttccatccccctttataccatcgctcatatcgttcctccctgtcaaccacacacattcttgctcctttcatgccgtcgttcctgctgaggtatatgtgtccggccccccgctattgtcgcggataaaccccgttgtgttcgcgccgcacccctcaattcaattagcgcggtaatggatgattgacgcccagctctaggcgatgaatggagtcacacgataatacattatcgataacctctactatcgttcggtagtaat

SEQ ID NO: 1089 - DNA, 822 bp, Homo sapiens
ctggccgatctctgtttattagatttatttaagtggcatgacatttgtcaggatgcagctcagggaatttctcagtgtgtacagattgcaaacacttttttcagctctatgctaccgtgtttttttgtttgcagtagctctcagcaagaaccatgtcttcttcaagatgttagatgctcaatgaatgctggttgaataaaaaaagagagtgccctcacgactaacttcctgtaagctataaggatctcaatttgatggatttctttctccttctttttctgcttgtgcttctctccacctcctctcataccttttttcgcttcctctttgctcgtccgctggtccccgtcccctctcccccttcaccactgcctgctcccagcaatacctcccacccccccctccctccctccacctcctcccatccctccccttcaccccccaccacctctccccactgcccaccgccctaccctacctcccttctcactcctcccctctcgctgttccttccccaaccgactattcttttgtttatggttatatctccacattacatagcgtgtgtgtaatttatccgtctcccacccatctttggccttcggtcactcatattctaccttctccttattctatacaactcacctatacaatcttctccgatcgagtagcttcacataccgcacgcctccttcctccacccctctatacgtaccccacacagccacgccctcgctaccctgttgatcctcactactcgatacctactccactcgattccctcttactacctcaactctccttgacggcctgcccagcgtt

SEQ ID NO: 1090 - DNA, 299 bp, Homo sapiens
  misc_feature (1)...(299): n = A,T,C or G
ttctcccttcggcagcacctacagcatattcttgcttctgagctgagtatctgcgttcctgctaaaccagagatcacagttatcagatgcctcctctggacatttcatatgaatggataaatataatacgaagtctttcgtcactgctttctttcacttagaatggtggagcatgcgtcagcacttccttcctctttatgaggaagtnaggttccattggaggggaaggccccacttgggttatctactcattaggggatgtagctcgatcggcccccactttagcttttaagaaaaaa

SEQ ID NO: 1091 - DNA, 663 bp, Homo sapiens
tgttttacactctatttctcacacacaggtctggcatcagaggcatgtgacctgtagagttgcataaggtcctgcacttaaaagggccccacatttggattaatgccctgctgtcaccatcttgtaattcttaatagttgttgatcaaggggcccactttttcattttgcattttgcccaactaattatataaccggtcctgcttacatatactattttatttcatcctcataataatcttattttctttttacaagtgaagaaaccaaggcagagagaaaataatttatggaaagtgtaattggccaagctggaattttaagtcaggtttttttctgaccccagtccaagtcctgtgtcctaatctcactgtaaaattcaccacatgatctcaatgccctctctgtcaaatgatattaattaaacctgcctggactataactcagaattatagaactgccttatggagtgttcaagtgaactcacatgaatacttgcaattgctttgaaaagaaaaagctactgaacaaatggaaacttttattattaatgaaaacatacctctgtatcccttaatgtcacccaaagaactagtgtatttttaacctgattaaaataagttccatgtggaaatgaacatatataataaatgccgatcggcca

SEQ ID NO: 1092 - DNA, 159 bp, Homo sapiens
acattgagcctattcttgttttgctggctgaatgaggggaggagagtagtttgaagtcaggagaatctgaaccagctagaacatgatctgtctctgcatgaagatgttggacctctgaccttttctgtagctattccagacaagtataataaacaggga

SEQ ID NO: 1093 - DNA, 775 bp, Homo sapiens
acgtaagatcaaaatgcctttctcaagagggctggaagccatccgttcaaaatgcattcatcatcatgcatggatgccttgctctaagttgtaaacctgcctcctgtcatgaagatatggagagtttacttttcctttgggtaagtccaattagcaaacacaggcaatctatgattctcctcaccccggctcttaaaaactctccagccctttgttttggggaagttgggttcaatctctctcctctactgaaatagccttgaataaagtcttccttgcctgtttaactttttccagtgcaatttttctgcattattcacatcaaaaaaacagtcacatatttctgctatactgtattcccagtgacaggtctttgccttcattatacaatgtttcgcatgaatttaaaaatcacctatttagtgttccacagaagacccacctgaggtaagcatattgtggtgattaaatctttgcacagaagttgaaattgggatgatttaaaacttggaactcaaaattaacaagacttggggcacaattcctatcaagagattcaataatattattaaatccttcaacctctgatttcctgataagaaatcaaagatttacgtgatctcattaaaaagctggccatggttcattctcttattagtgaaaaaggcagctttgagatcttgcaaggagccacaaggagttgcagaaatagaacccagcagtgttggacttagagagcttcaatcttgattcaggtctaccgcggactaccttg

SEQ ID NO: 1094 - DNA, 406 bp, Homo sapiens
tcatgctttattcgatggccatggaattcagaagaagcatcaggctcataaatcaacttctcaggtcatgagagccaggagcccacaaataaatggcatcttcaatgaagggtctaggcattaacagcaaagggaggaatattcatttatgacttttctgggaacaggcagaggacttcttggaactggagtgctgcctttctttttgtccttttgtagtttcttccagtctttgtcactgtgattttcaactgttacggcaatagtggaagtgttgtttagcataaaaattagattataatgacgtcagaggttcttcatatgtcaaatgagctgccatcttggattccacgatttcagccaatttgatcacgaggaggaccatctgactacaagcattctgtta

SEQ ID NO: 1095 - DNA, 856 bp, Homo sapiens
ttgcagggccttgactcctgggtacacatgtcgcatctgaagaacgcactgactcctaccagaaactgacaccaaactcaagatgaccaaagcctcatctttagacctgggcaaaggtctttttcttgatccaggagataatttactaagagtccggcacctgaagtttgataagaaacatttacaaagtccaggtgaggtgggccacacctgtaatgccagcactttgggagtctaaggcagaggatcacttgaggtcaggagttggagaccagcctggccaacacagtgaaaccctgtctttactaaaaatacaaaaattggccgggtgtggtggtgcacgcctgtagttccagctacttgggaggctgagtagggtggatcgcttgaacctggggggcagaggttgcagtgggccaagattgtgccattggactccagcctgggcaacagagtgagactctgtctcaaacaacaacaacaacaaaaagaaacatctacaattcattctctttgaagcctgctacctggaggcctcatctgcacaaccccttatcttaacccagacacttccttctactgattccaagtctttaagtaaactttctaccaattgccaatcagaaaatctttgaatccacctatgactggaagctcctctcttggagttgtcccacctttctgggctgaaccaacgtacttctacatgtactgattgatgtcttccgtatccctaccatgtataaaaccaagcttagcccgactaccctgggcacatgttctcaggatctgcaggggctatgttacaacgccatggtcactcatctttggatcagaataaatctcgatgcggcca

SEQ ID NO: 1096 - DNA, 505 bp, Homo sapiens
aatttgagaccagcctggacaatgctgggaagtccaagatcaaggtgctgggaaattccatgtctggtgagggcctgcttcctgattcatagaagcctattctctgtatcctcacgtggtggaagaagcaagacagttctctgggacctcttttacaagggccctaatcccattcatgaagtctccatcctcatgatctaatcatctcctaataccatcaccttccaggtcctggcatcgctgtgaggctgaatggatacagatgctacagatggacgtgtcataatagttttagccaccagaaggagctctaaaacagactacagggaagtattagacgttctggcaaagaggaggaaaataatatattgtctacagatggagagtgtaaaccacattaaaacttaataaagaattacagagtggctgagggaattataacactaaaaattcttcagaagacaaggtacaagtgcccaaaggcattatgctaaaaaaaaaaaaa

SEQ ID NO: 1097 - DNA, 805 bp, Homo sapiens
  misc_feature (1)...(805): n = A,T,C or G
acttttacctctccctctccctctttggcccctctctccacctcattggcttaattggtggccctcctactcttcctcccttncataacatcgcatcatttctgattgncctgctttgtgatacagntcagggaggtttgacacagagaagaactgtcagtnctttaatcactnctttatnatcaagatagggagagaaatgccattatctttcacaacttcacttngtgggacagatgtatttttagtaggctccagagaactgaaacaattctatacattaacataacttcaaaatcaaccactttctcattgatacaatttggaaataaactgaagtgggtatagtttcttgctcttctgtccctcccaggggacaacaattagtgaaccaaccactcatatggaactctcaattggccacgtgaatagagtgagtggaaatcctttcttcgtgatgtgcaatggatgctatcatttcagtcaccatgatgtcgaagtgggaatcgatatttgaggggagggaaatatcccaaccctgaccatctactgaacaatgactcaccaatagctgcacaacagtcaggacagagcacatgtccggaaaatttcattttaatttgcctcagctgggactacagttactgtttgaaagaaagaacaatcaacaaagtacctaggaaagaagacatcttgcaacactcttcaatttcttcttaaatgcttgggggaaacgtgaaaaattttgataaataggaaaacaaaattgttggcaataaaattaataaacagcgatgcggaccgg

SEQ ID NO: 1098 - DNA, 840 bp, Homo sapiens
ctggccgaacaggatttatttatttggtagtaattcaggggctcgaagaagttatatcatacacacatatttgagcaccaaatttatcataaataactttgacttggcttataacctcagtagttagaggcacacaaaaatgtcttatctcatcttgacttaagaaatagtattgctcactgtctgcataaatattatccaaacacaccacatggaagaggttcaggactttgaaagggaaggctccttggcttgcctgtctccacagtgaacatctcattttgcttgctgtggcctgctagtgcgttcagcgttggctgtccgtttactcttctgcttaatcagaaattcagtttgactaataatcacatgagatgcattataaccaacaagaaatcagttcatcaaaaacctgccttttttactcctttctcaccacatagttttgcaaaaaaactcccaccctgatgcctgaagtgtacattgatttgctcactgaaccagggagaaaactgaactaattcaagctagatccacctcaaccatcctgggaggatatttttaaaaccagtttcaaagcaaactattattcaaagatgcccctgccctctacacccacaagagtagttccccgcctcacaaaatgtcaccagataattgcatttttctccgaatgggaggacctgccacctctggtgtctattttttgggagaggcattggttggcaagggggccgtttttaaaataagttgtggaggggtgaaataagctgtaatctcaaacctggcgcttttatagcaatctttgaagcttgggccgattcattggtgggcggagtc

SEQ ID NO: 1099 - DNA, 774 bp, Homo sapiens
cccctacctattatagattttggaaagataatcatctacactaataacctgaaaatcattcgaaccccaatggacaagagagattttgtgaggaaaattctccagaaggaagaggaggctgaggaagagtctctgatgaacaaagaagaaagctatggaggcagggaccagcacgatagacctttggtggaggcagaaagcacattcccccaaaaccggtatacacaggaaggggatattcccgaggacagctgttttcactgccgagggtcgggcagtgccacctgctctctgtgccacggcagcaagttctcgatgctggccaacagatttaaggagtcctatcgggccctgaggtgccctgcctgcaatgagaatggcctacagccttgccagatttgcgatcaatagcccgtggcttttgcatgtccactgttatcttaccctccctaaagttatttctaataaaccgcccccttctcctcctcctgcctctaccaacaagaaggccacagtggctgcaggcactcccactgctggaaaaagtcacttatctgatgacattttgtgaggccgagacatgtgtgggtgggagtaaatgacgagcgcattactgaattatagcctgctttgaaactgagactagcttatacttcgaggatggcgagaacgagtgtgacttgacttgagtgagagacatgcttggctacagggcgaagcgcatggagcccacgagggtgaatatgggcattgctcttagcaatccccagacgg

SEQ ID NO: 1100 - DNA, 738 bp, Homo sapiens
  misc_feature (1)...(738): n = A,T,C or G
gatgctgtgagggtaaaatgagacaatacatgtgacatactaagaacagtgtctggcacatgataaagaaacagcttcttgggggagctaagtaatctacttgagatcacacagctagtaatgggcagaacaagcactggaacttttggctgtcccccttaagagaatgacttctccactgctatcatttgaataagggaaacgtggaacaccttttggtaacaggtgtctgagggactggagcactgaaaggttttgtaaccaaaatttgaagtaaagaaaactgaagttttgctagcaaactctttaaaaataataagagactgttgggccgggcacggtggctcatgcctgtaatcccagcactttgggaggctgagtcgggcggatcgcctgaggtcgggagtttgagaccaacctgaccaacatggagaaaccccgtctctactaaaaataaaaaatcagctggacctggtggcgcatgcctgtaattccagctactcaggaggctgcggcaggagaatcgcttgaacccaagagcaggaggttgcagtgagccgagatcacaccattgcacttcagcctgggaaacaagagcaaaactccatctcccaaaaatagaaaaaaaaagatactgttttgaattcacaaataaattattatcaagagcagaaaaataaaaaagttgcgcccagctnntttntttcttttctttcttgtcggttcggacggctggcc

SEQ ID NO: 1101 - DNA, 241 bp, Homo sapiens
gaatgtgccttccaatgtgccttcacaatggggaagaacttggggtgatgaggaagatctactcatcaaagccggccaagcctgatattaaacagcccacgctctggttgtacgctgttcacaactggcttcatcattcatggacagagcgacctttggcttaatacctctgtgtgccagttgccccacctgtaatacatagatgataaacagtacatgtcaaccattgctaataaagagc

SEQ ID NO: 1102 - DNA, 905 bp, Homo sapiens
ctcttgtgcatgtgaatttccatgagattctattcaactggagtgactaagaagaaagaacaatgtccctctatacaagttgaaagacacctgtatgggatagaaagcaccaccctcacggacatgtcagaagcttttggactgcctgtactcagcatctctctgcggatgaggacccttggatcaaagcccattgggcaactgggcattcagaccttcaggctctcttggcctgaagttttctcctacaaactcaggttattttgaaaaacctacaaaaaaaatttacatacatggggttattttttttcaacacctgaaagaaattttcagggattataggggagttcctcgaatgtaaatcaccttattggacctttgattttgtcttatccttacactggcatcctttcacttaatcttatcaatcactattcctatttccttttaaaaaatgtctgcagtttttaatccatgctatcttactttattgtacttccttgcagtaagcaaggaacaagaaagtataaacagagggcccaatcttccaggcagctgtatgcttgctgtgtgcttacagataggtcactgaaagtccatgcaaattagggcactttgctgagccacagaatttcatctggagtagcaggtgtgttgtagaactataaatgacttagtttgaatgatggctgttgatgcttctctgtgctttattcttgctgttcaccgaatgggtcatgttattgacatctgaactgtacaaaaatggtcgtggaaacctcccatgtctaatgttccactagaagcggcattgatcttaggacagaagatcaccaactgttctgtttccagtactctcaaaataaagatttgcacattttattaataaaaccagaatgcgcccg

SEQ ID NO: 1103 - DNA, 454 bp, Homo sapiens
atggaaagatacatctggttctccacgattgtttaaagcctcttcagcagatcatgaaaagagacagtctgcagatgaatgagaacaggtgtgttgggggtgaaacggcaaagtactggatgaaagcctggattagacagaccccagatgcaccactggccttccctgccccccggtaacctgacctggcatctaaatccaatcccattccctgctgttgcatttatattggaagagaattgggagatatttggtaaataaagttatctttattgctaaaagactgtggaggggctcagtggccaccaggagctttggaggtcctcctgcatagtagatgctcttcaagtatttgttggtttttttcattgtggctcccagtggctaaagattcatgtggctaaagggtctaatgtccagaaaatggaaaaataataaaccacgaatgcggcca

SEQ ID NO: 1104 - DNA, 600 bp, Homo sapiens
tagaaatttcccagggctacaaagccttccctgtatgagctgcaaatcaagccaaaacgttaccagagatgaagagatggggacagccatcaggcctggggatggacctccctggagctgggcattcaagaggatgagtgcagcagaagacgtatccagggagcctttcagtgactgtttgggcaaatcctcccttgtggtagaagatgcctcacttctggggagaggaggctcctcatcttgcagacaagaagcagcacccactggttcctgctccaaaagccattaacattataaactggccaggtgcggtggctcaaacctgtaaccccagcaccatttgggaggttgaggcagaaggattgcttgagcccaggagtttgagaacagcctgggcaacaaagtgagacccaatctctacaaaaactagagaaaaaatagctgggtgtggtggcactcacctgtactaaggaggctgggctgggaggatctcttgagcctaggtggttgaggctgcagtgagccaagatcacacctctgcacttgagcttgggtgacagagtaagaccctatctcaaaaaataaagactgatcggccag

SEQ ID NO: 1105 - DNA, 609 bp, Homo sapiens
cctttctgcatctaattttattgagtaacagaacagctctcaacaaagagaggatgcagaggtagtccccacccccacagttgggtggtttctctctcagtggctgagtccagggcttttatgagctcagataggggaatacatgctaattggtttgtgagaaaggctaaagcaaaggtgccactcaaaggtgagcatagcaatgtagaaaatcaattaggaaacagtagttatgtgtagggtggggagacatcagaggaaagtgtgtcacaaaggaagacagattctcaatctggtctgtgtatttgactcgttgcttggctttcaggctttgtcttcagcttgaaggtggggtttcactggagaactgcccctatttgcctaggcatttgtctgcctcctgctaatatcaaattccccctctgaagaggtacatctaattgccattaggataaggacagtgacagatcttaactgcttcctgctgacaggggtcaccattttgggaagatgggaagtaatttctcctcagaggcctatctaacggtccccagtaaaagggagccatcgtccaaggctccagttgcatgactgtttggagttcgatgg

SEQ ID NO: 1106 - DNA, 224 bp, Homo sapiens
actaacctgttcatgtgagctgtctgcaaacaggatcaccacctttactagaagacatagcatgtcaccctactgaagatgcaagtgaagcatttatgtcaaaacacatcctacggtggaggcaccagctgcagtggttttgtactgcatttgtttgttcggacaatggaacttatggaatcaaaatatttagcaggagtacacaataaaacctgatcggccag

SEQ ID NO: 1107 - DNA, 513 bp, Homo sapiens
cccccggtcccagctcattctgatacagcctcatcaaaactgctctgtgaagttcttctcagtcaaaatgattgtatgaaaatgaaattttaaagtgacttcatcaaagtgtcctgcttccctcactatagagccatcacttgtcaacaaaaacaagtaggcacagccataaaaaagaatgaaatcatggcctctgcagcaacacagatgtagctggagtcccttattctaggcaaattaacgcaggaacaaaacaccaaatactgcatgttctcacttatcagtggggagctaaacactggttactaatggacataaagatggcaacaataggcactggagacaactagaggtaggagggagagaagggagaaagggttgaaaaacttactattgggtactatgctcactacctgggtgacagaatcagttgtaccccaaacctcagcatcacgcgatatgcccatgtaacaaacctgcacttgtaccctctgaatctaaaataaaagtaga

SEQ ID NO: 1108 - DNA, 883 bp, Homo sapiens
aaactccaagaacaccggaacttcctgggaatttcaggcattactgagaacttcgtagcacaaataggaggacttcctagcacaaatagtgagacacaggcttggttgtgtgtgccttaaaaggctccttgtggcggggcttggtggctcatgcctgtaatcctagcacttgggaggtagatgtgggaggattgctagagccctggagttcgagaccagcctgaacaacatagtgagaccccgtctctacaaaatgtagaaaaattagctgggtgtgagggcacatgcctgtagttccaggtactcgggaggctgaggtgggaggatcatctgagcctggggaggttgaggctgcagtgagcagagatcgcgccaaagtactccaggttgggtgacagtgtgacatcctgcctaaaaaagaaataaaggcaccttgctgcactccaaaagccgatactgaaagacttgatgcaaataaatgctttctctcaagaatccaggatggaggggattatagcaggcagaactcacagtccaactacccagcaggattcccaggggcccttgcggacagttttaccaagtaccaagtgaagcctgaagctggtgatgcctttactttagtttcctacagtactttcaaaatggggacacaacaggcaagaggcgaccaagcctccctagcctgaggtaagtgagaagacaccaccagctctacacaagcggaatcattggtgcccttgcttctccagtgctctccttactcagagtggtgtaatttgctgggaaggagatcttgggctcttgagctctgtgtaatattcaaattctcattatatagacgtggttgaagatgtcaagggaataaaaactgatcggccag

SEQ ID NO: 1109 - DNA, 772 bp, Homo sapiens
agtttcagagttacctgcttctcccagagagacgaggacagattgcctccagcaggggcacagcggacaaaaggcacagactgacctgggcagcccttgctaggcaaccaagctatgaaatcacagctcactggcaccagcccaagcctctctcttcccctgggctcatgaccagaggttggtttccagtgggcaactgattacctgctgtgccaattctctttgcattgtgatctgaagatgggcctggggtctactatgatatgaaaatgtcctacagtacctggcattggaggtgtatgggtagtgggagaaaaacaaggtttgaaatctacagagtctgaaagtaggtcatggggcattcctcccatcattagagggtgtacatttgttggtgaaggattgattcatcttccatcaacaccttgtcagcctgaagttcctttgtcagaaatatacttgataatgcgggtccaaattgtatatgtgtcatatcctataaagcatggatccatcccatcctctattgggggcacaaatgcccttccacagtaacctgcagccgacctactactgacaaatcccagcaaatggtgtgggagtcacttcttttcctcgggtctgcagggactcagggtgcagcactgttctcaaatttcgagctgtacctaagatgactggaagggtgctcctgctacccctgggagcctccatgggctccatagggtatgggaccagcagtgccaaagcgaattttgggcgcttggaaggg

SEQ ID NO: 1110 - DNA, 619 bp, Homo sapiens
tttttttttttttttttttggagacaaagtctcactctgttgcccaggctggagtgcagtggtgtgatcttggcccactgcaacctccgcctcccgggttcaagtgattcttctgcctcagcctcctgagtagctgggactacaggtttgcaccaccacgcctggttaatttttgtatttttagtagagacggagtttcactgtgttggtcaggctgatctcgaactcctgacctcgggatccccccgcctcggcctcccaaagtgctgggattacaggggtgagccaccgcgcccggccagcctaatgattcttataggatactaaagctatttggacatgagtctgtctctagaacacgcttgatggctttgttctaaagtgataaagtatagtctagctctatactagacaccatttgtccttatgctgtattcttctaggtaggtgaggctccttctattcctgcctgaatgaaaagcatttagctgacttcccgagcatgctgcatcttgtccttcagtttttctttgtttttcattattctttgctgaagctcagcatgtcttccagttgtggttctacacaaggcaggagccatagaagttctgcacgaccg

SEQ ID NO: 1111 - DNA, 798 bp, Homo sapiens
  misc_feature (1)...(798): n = A,T,C or G
atattcagaccaatgcgtctcatatgagatgaagaaatgtccagaagaaactatactgaactgacagaatttgttctcttgggtctaacaagccgtccagagctgcgagttgctttcttggcactgttcctttttgtctacatagccactgtggtaggaaacttggggatgattattttaatcaaagttgattctcgacttcacgctcccatgtaattttttctctccagtttgtccattctagatctgtgtttctccacaaatttcactcccaaaatgctagaaaatttcttatcagagaagaagaccatttcctatgcaggttgtttgatgcagtgctatgtagtcattgctgtggtccttgccaaacaactgcatgttggcagtcatggcatatgaccgctatatggccatctgtaatccattgctctacagtagcgacatgtcccatggtgttcgttgccccctggtcattgtcccttatgtctatggatttcctcctcaggggatggaaaccttaaggacctacaccctctccttctgtggaacatatgaattcacccttttctacggtgcctaatcctctcttatcaaacgggaatgctctaacactgacagtcatgacctggtcattgacaatacagtcggtttcagacacgcccatctatttagatattctcccccccacaggaaatccttccgcaaactcaaaggcattgtnagaggaagtaaataatctttatccattgggtccaaccgcctcttatacatttatatgnacctttgtgatagcttaag

SEQ ID NO: 1112 - DNA, 504 bp, Homo sapiens
tgtttaaagcagggtgtcttgaagtcaaaatggaaattggtacttgccgcccccgctttgtgggggccatggatggaggggctgcagcagctcatgggatgctctctctgtcatcaggcagcctcccgatgggctgccttccaggctctgtgcttctgaattcctctgcagcggttggcaggcagccagtgtgccatgaaggattagattctgtctctcttccttttatacacaccccaagaggatttccttcttcaacttttaaaagactggctccaaccagcaaatccaacaagtgggcccatttgtgaattgagtatcttgggaattatgctatacaaataggtcacagttgaatacccagtatgtgcaaattgatttttctctttgggtggaggaaaaaccctcctagttctctttagggagaattggatcaccatataccaactgtcacaagggcccaaaaattctttttttgggttgaggggagtaaaaaaaaaaaaa

SEQ ID NO: 1113 - DNA, 775 bp, Homo sapiens
agactgggtttcgccatgtcaccctggccggtctcaaaatcctggactcaagtgatcaacctgtctcagccacccaaagtgctaggattagaggcgtgagccagcgcgcctgtccagaaggctttactgttaaaaatataatttaaatctctttcaatacctcaaaacttcagtataaaattgaataggaagattgttcatattacagtaatttaaaaattagaaaccagttagataaacaaaagtgaaagaaattattcaatataaactgtttttcaaattgaattcagaataggccagccaatgaaataacagaggctatttaaaataagaaaactacaaggtaagggcaataatgacaatgaaaaatcaggcaatctagatgagcttctgaaacagagaaaggagtaggctctccaaaagaaaccctaattgtggcccacatggcactaaagccacatagctacggtttaaggcaagcctatttactgtattttcttatatccttttcttcccaaataatcgtatttccccctctttgtaattaaaatggagaaaaactaccctggaaattgattacctatgatttcatttcttaaaattggcaatttaaaaaaattcttctgtgataatattaagtagtaaaatttagaatttctcctctataaaaccagtaaccacttggtatatgcttttttaatctttatgtggctttaacgaagttatgttagttttctggctcccaatcgcccatcaataaatcgagatcggccag

SEQ ID NO: 1114 - DNA, 1107 bp, Homo sapiens
ccttcagtacatctttattaatctgactgcctggttgcagttacatttgagaataagactgagatcaaattccacgtttagagtgagaaatgactgcagttgaagacttggttgcaagagtctaagaagacacctcagggagagagacaggatccaaaacaagattgctggctgaggagtgggacaagtcaccagctcagaagtctcaggaccagcgacatcaagagcaggaagtggccagtgcctcaacttcactcccctctccctcctggaacaggccctccatcaccgtagataattcatgtcactgaatggaacattggaaaattattaaaaatgttttcccagcaaatcaacacaatttaatagtaaatagcaatattagcagcattccatctagtgcaaaataggtctttcaagcacagtggccaatgaccgtggagaagtctcccaggaaggttctggaacaggttcttacaggaagggcagccgagaacatcaatgattaaaagggggctgagaagaggaaactgatggacaaagaggtgagaagtgggagaaagaacgaaaatctggaggttggaggataaacaaaccccacatccttgtgggatgaagaaggataccaaaaactcattttcctggaaggagcaatttttgaaatcagctacactgaggctgcagattgagtgaaggtcttttccatgtgaatttgtcctgcatctgggataaaggtataatgattacctaaagcatgttctgttcatggaagatcactggaacacaaaagaccaagctcacagcatattcaagacatctgctcgtattccactggccaaagaaagtgatgtggcccagcctaaagtcagtgaatggatgaggaaaggaaggcatggaaagtggactggcatggctatgagttagaagcagtcagagttcagttcagaaacctctgaattcaaggccaaggctctggggacgaggttttcccccaacatcagtaagctttggaaactttttcaaaactggaagaaaaagtgatacctaatacagtgctgtccacatgatatgcaaccaatacaattcaataaatgaagatgcgccaag

SEQ ID NO: 1115 - DNA, 899 bp, Homo sapiens
aacacagcgaactgcacggccatgtctaaaacagaaaaaaagcaaatcgtcccaaggtctttagactggccacaaatggaagaatgcagatctaactaccaagtgccccctgataggagagatctggaatcaagatgggaagcctgagacggatgaggttatggacccaacatcccacggagagtgaagagaaaagcaggcctggaatggagttcgtctgaccctctttaggatcctgccttttacgaggcctcattctccatagtctcacattcctactcctctgctaagagcactggctccttatgaccagaatcaagaccccctgcctcatttcccttactctcaccctgatgcttaaacctagctttcctaaaggcaccccttcattccagctggggcggtcattgtgctattcctccttccttccatgcatgctgcgtagggtacaggacacaggcaacaaatgtttgcagaagaggtgagaaaataaatgaatgggtgtcatttgatcttgctgtggaattgcctggaagtgacctctcttgtcttaccatctagacaaacctcactctcattctgaatccaaacttaagacttctttgtgggacttcctggatgattctagccctcagcaaactctttcctaatttctccacccacataaattttgcctttgctgatttagcacctggttgcataattttcaatattgtttcttaactgtttcctgtgagttaggcaccataggctttggagagcaggtcttcctctttcttctcttgtgttcctaacagtggtgccaagagctgagcaagagatctgctgattccataactggttttaaagctacaatccacaaacaaaaggctcccactttaataaacacagatcggccg

SEQ ID NO: 1116 - DNA, 907 bp, Homo sapiens
  misc_feature (1)...(907): n = A,T,C or G
attgtgcttttcctctcctaagataaggaaatggggaaaatgatagatgaaaattcataaggcaagtcagcttctaaagagaaaatcatgcccaggagagaagacagactttgtcccattgtgtctgcagatacactgcaaacctcttccacattcagaagaaaaggtcatgaaaatctgtgcttgaggatctcactcacacctcacctgtgtccccaaagcctttcaacaagaactcttgccatgccggctgttcattgcttcaggccctgccttatcctacgttgattggcttaagaagcagcatgttcacaacatggagaaaccccgtctctactgaaaatacaaaattagccgggcatggtggcgggtgcctgtaatcccagctacttgagaggctgaggcaggagaatcgcttgaacccaggaggcggagattgaggtgagccgagatcgtgtcactgcactgcagcctggataacaagagcgagactccgtctcagaaaaaaaaagcagcagcagcagcatggagcctcaaaagttccggagaaatcatccataattagccacacagttagtccagctctgagcctggggctgagacatttgccacttcctgtcccatcagtgctcctataagcatgtcactgcccagctccacagctcagaccccaccacagtggagtggaactggataagtgagcaggagagtagagacaagagccctggggtgaatgtgatctccacggtctctcactccagttccagttctgctgctatgtccatgtgaccttggaaaagtaagtcactttctccacttgttcctcagtttttcccatttatacatacggtggttagacctggtaatccctttgacatgcaacgaataaatgacgatgccgnccagg

SEQ ID NO: 1117 - DNA, 777 bp, Homo sapiens
agcaagaaggccaccatgtgcaaaccaggaagaaagccttcgctaacagcctggccactcagcaccctgatcttgaacttccagcctcccaaaccgtcttccagtgtggcatggctatgacgcttgtagcttactcaatgtccctaaatatcccccaaaatatgggaacctgagagtgttcttcgtagaattcatgaatctcccctggaattttattccacagattcagttttgagactttttatccttttgatttgattgctcctggagtcctaccctgagctctgagtgaatgtatttatcttagtttgtctagaaaggcactctggaatctgcagtgggaacttgatgatagatggatcattgaaactggcttttaaaagtgacattttggttaaaagtcatctcaaaaaagaaaaacagcttttagaaagtgtatattcaataaaattccagaagccggccctggtgggctgtccctgaatctggctctggcagtgggtttgaaattctccagcctagttgagagcacagtgtcttcccagagcacagaggccaggctctgctcaggaatcccgcccccaagacagaggaaagcactcccaaggccacgcgcaaggtttgcatctgaattatagaccgttcttgtgaagactctctctgccgacccataatctttcctcctgagatgcgaaaaaaggctccacacggcatcacaaggataaatgcaccacagatacatcagttgattaatttcaataaacgtagatgcggcag

SEQ ID NO: 1118 - DNA, 814 bp, Homo sapiens
cacagactattactacactcccactttcgcagtataaataacattctttcaactgcagcctggactcagtgtaaaacactgtattcagaatacaaaactcacgtaaatgaaaggctgactttcacagaaccaactgcaggacttgagtatatatggattttggtacctatgaaattatttttaatttttaatgcactaatcatcagaggaatgctgatacaaatgcaaaaatgatatatcacctcatgcttactaggatgaccattataaaaaacaaagcaaaaacaaaagacaagtgttggcaaggatgtggagaaactggaactcctatacatgatgggaatacaatatggtgcagctgctatggaaaactgaaaaacaagttctttaataaactgaaaatagaactacaatatgatccatgaatcctacttctaggtattcatccaaaataactgaaatcaggatcttaaagaaatattagcactaccatgttactgcagcactattcacaacaaccaaggtgcggagacaacctaacttttcattgacagatgaatacataaggagaatgcagtatatacatacacgtggaatatgtattcagtcttaaagggcggaaggaaaattcctgcactatttgacaacatggataaccttgaagacattatgctaaggaaaataagccagtcaccaaagacaaattcttgcatactgcatgataccattcctacaaagtatctaaagttgtgaaacttcacagaagcaaatatttactggtgccaggggaaagattataaggtgccaggggttg

SEQ ID NO: 1119 - DNA, 385 bp, Homo sapiens
atttcagagtctccctatggacagagtgtcactgctcttgacctcttaacacctgtacacttccatgatgacagtgcaaggggctattaattgggccaggcgcagtggctcacgcctgtaattccagcatgttgggaggccgaggtggtcgaatcacaagttccggagatcaaaagcatcctggctaacacagtgagacctcgttgggactaaaaataccaaaaattagccaggtgtggtggcaagcgcttgcagtcccagctactcgggaggctgaggcaggagaattgcttgaacccaggagacggaggttgcagtgagcggagatcgtgccactacactccagcctgggtgacagagtgagactccgtcaaaaaaaaaaaaa

SEQ ID NO: 1120 - DNA, 845 bp, Homo sapiens
tcaggccggcaccggcttttattttacataatgttttcagggatcatctgtgtagtagcatggaacagtacttcatttctttatattccattgtatagatataacacattttctttattcattcatcagttgatgggcatttagattgttgccactttgggccataaggaataatgtagctatcaatatccacgtacgcatctttgtttagaaatgttttcatttttcttgggtacatatctaggtgtagaattgctgtcttctatgttatatcatttgaggaactgccagattattttccaaagcctctgtaccactttacattcccaccagtaacataaggttccagtttttctacatcattatacctgttatctgtcttttttgttgcatgcattttagtgggtgaaaagtttccatccatctttctgtttttgcattgcgtctccctaatgattaacaatgttgagcaccctttcacgagcttattctttgtcatgcaactttttttgggaaaagtctattgaaatcattcgcccacttatttgttatttgtctttacattgttgaattgtaagcattctttatttattctggatctttatggagttttgacagagagcttgataggtttccttccatgcttcagaggtttgagttgagcattttgagacgcttctttatgtcagcaccacaagtttgctggggattgcattctgcccagcccggctgcattctgcccagcccggctgcattctcccagtaaggctctctcaaactcttgagaactctacattttcaaaagttttgaacttagttcttcggacttctgtagcggtggaaaa

SEQ ID NO: 1121 - DNA, 306 bp, Homo sapiens
ttggcttctcggatctctagatgaggacaagaagtgcccattggcgtccacattccaaagcgagcagccagcgatttggttaccaactctctaaactaagaggagacgtggaatggaagtggaaaacagaggactaatagttattaggcggatacttggaattgggaacattgcagagaaagggtctcgttatgttgcccagattgaacttgaactcctggactcaagtgatctatcacctaaggcttccaaatagctgggactataggcatataccactcactgcacctggctaataaatgcaga

SEQ ID NO: 1122 - DNA, 833 bp, Homo sapiens
agatggagtttcaccgtgttagccaagatggtcttgatctcctgacctcgtgatccgcccgactcggcctcccaaagtgctgggattacaggcgactccactctgtgccacctggatcttatgaatcagcagctgctttcaacatcaactggacaatcagcatccatggtcatagggcggggagcttaattatgagacttaaacttctaacatgaggacaacaattttgtttcgattcttaaagtctatgaaaggagcttgtcttttctatcccagcaattgaattatttactatttcaacttgcctaactgatgaagtaccctaggggcttcttcaaagtttataatacaagtgttaataaccacactttaaacctctaacagaagtgtaaaataccagtagatgatgataaatctcagagtgtgcaatacaccctgttatagttgaagagcacatttttcttaggctaatgactatctgtcatgtgtttaaaaaccaaagacctcaaaactccagtgtataaaatgaaatttaaaaaggtctaaaaaatgcaaattcccctagaatttgtgaaaataacttactgctttaatttttatccattgtttttgcatcagcaattaaggtaatatgagtaaactttaatgctatctgctaatatttttatatcaattacattagatctcactttccagacatatttcttaagttgataaccagatatctatcacatttatccacaatgttctttaatatctacatttttcattttattatacatattttcagtaacttgaatatgaattacaaataataaagaaggatcggccag

SEQ ID NO: 1123 - DNA, 687 bp, Homo sapiens
  misc_feature (1)...(687): n = A,T,C or G
catagatgggatctctcttctgtcactcaggctggagcatagtggtgtaatcaatgatagttccctgggctcaagggattctcctatctcagcttcctgagtagtcgggactaaaggtatagagttgtccttttttaatttgaaatcattatattagagaacatttggataccacttacctctgagacagttcttttggaaattataaatatatttctttccgggtatacatgaaagatgaagtgttgaatctgaattcacagctgctttatgcaatctggaaaaagtacgggattcctcattttagttcagttgaggcctgaaatgatatatttgaatttttaaaaatattcttcttgtctggctgtgtaaatgattgcaatcaatcagattttctttgttcaaaatatgaatatttttcacatgtaattctagttatacagtgggcaatgactgacagcttaacaatgtcccactgtggcaagagntatgtgttattttggaaaagttaacttgcaataagttgattctaaaagtctccttggaaaataattgtgaaggtcacaaaagtatatttggagtctattattttacaatnttataaactaatttctgttacaaaacagaaatctgcagcaaaaataaatgatctatttcatgggtggttataatatacaaacatttcaa

SEQ ID NO: 1124 - DNA, 409 bp, Homo sapiens
tcctggacacaactctttgtttcgggattctctagtttcaacctatcatttgagaattcacctccactccaccaccaatcttctgctgatttctatttctgtcttagggttttcctgggtcagttctggtacccagtctccatacaaaaatcagcatctgaatccaagaaggaaatgtctgaccatcttttactcaaaataggaggattttcttctttttggaattttactttattcttattgcttccatagctatttcatttctttcaaaatatttttctagctactgtagaggaaacgctggtctactgtgatctattacatcttgtccataagcaaagttctctctttactacgtgttaataaaaatgctaacaaaatagtccaatttattataaaaaaaaaaaaa

SEQ ID NO: 1125 - DNA, 767 bp, Homo sapiens
tcttctgtttttaggctggaccatagtggtgtaatcaatgatagttcactgcagccttgaactcctgggctcaagggattctcctatctcagcttcctgagtagtcgggactaaaggtatagagttgtccttttttaatttgaaatttctcaagaattctttcattatattagagaacatttggataccacttacctctgagacagttcttttggaaattataaatatatttctttccgggtatcaaaagaatccacatcaacatgaaagatgaagtgttgaatctgaattcacagctgctttatgcaatctggaaaaagtacgggattcctcattttagttcagttctcaaagctttgtagatagaggcctgaaatgatatatttgaatttttaaaaatattcttcttgtctggctgtgtaaatgattgcaatcaatcagattttctttgttcaagaaaaaaacatgaaattacaatatgaatatttttcacatgtaattctagttatacagtgggcaatgactgacagcttaacaatgtcccactgtggcaagagtaatgtgttattttgggaaaaaatatttttacttaacacacgttcacttgcattaagttgattgtaaaaggctccttgcgaaatagttctgaaggtcacaagaggatatggggagtctattatttcacattgtataaactggttgaaagagtgtgttaagaccttacctggtgcggaacataagccggggcacagagaggtgacgtattt

SEQ ID NO: 1126 - DNA, 1483 bp, Homo sapiens
agatgggatctctcttctgtcactcaggctggagcatagtggtgtaatcaatgatagttcactgcagccttgaactcctgggctcaagggatcctcctatctcagcttcctgagtagtcgggactaaagaacatttggataccacttacctctgagacagttcttttggaaattataaatatatttctttccgggtatcaaaagaatccacatcaacatgaaagatgaagtgttgaatctgaattcacagctgctttatgcaatctggaaaaagtacgggatttctcattttagttcagttctcaaagctttgtagatagaggcctgaaatgatatatttgaatttttaaaaatattcttcttgtctggctgtgtaaatgattgcaatcaatcagattttctttgttcaagaaaaaaacatgaaattacaatatgaatatttttcacatgtaattctagttatacagtgggcaatgactgacagcttaacaatgtcccactgtggcaagagtaatgtgttattttgggaaaaaatatttttacttaagaaaagttaacttgcaataagttgattttaaaagtctccttggaaaataattttgaaggtcacaaaagtatatttggagtctattattttacaattttataaactaattttaaaaaatgtattaagaccttacctgttacaaaaacagaaatctgcagcaaaaataaaatgatctatttcatggttgtttataatatacaaacatttcagaggggtatcattgcctatttcaaaagtgttacattaattacaaaacaaattttaaatattggaaaaattatattacaaaaataaattccaatggcaggatagattattataatcaaatggatgcatttttttgccattttgaaagaaaagctatgttcactggacgttttataattacactgtttcaacaaatcaaaactaaatattttgtgattttgcttgaagattccaaaatgagttcaattttaaactgtaaatatacaatatttaatataatttccccctttgagttggagattttactgtaaaatttgttttatccataaaacaaatttagtataaatattgttgtaatcaaatattatacagagtttgagagtgatgtccacaaaatggtaaataaaatagaagatctccggccatcactcctttcaaaagagtacaacaggaaactattcaaaccaaaattcaaggaagtagtggagaaatccctgggtccatgtggagtttagactttagactttatcttacaaacaaagggaagctatttacaggttttaagcaaatgattatgtctgtgttttaaaggtattatattctagatgcttcatggaattacgtcatttatactttataaatctataatgtgtaactgattaaaaacaagcttggaaacataaactcaagttagaaaatatgggtttgacacaaaaaaaaaaaaaaaaa

SEQ ID NO: 1127 - DNA, 774 bp, Homo sapiens
caaacccagaagaaaaaatatggagcttatcaccacctcaggaggccttgaaagaatcagagccccaataactgttatggagaaagtaggataggggttagaccctacacaagtgtgcggagaacttggaaagttgggaatggaacatggataggattaaagcaagagtctttctgcagccactacacaagccaatcatgcaccaaactgggaccaagaaggaaaactggagggtcacctctgggaagctgagcctctgtgccatcagtactcagtgggtctagagccgagcatctggtttgtggagttggcaccactgttgttcaacaggttctgtggacatgaatgtgagctgggcatggatcagaggacggcgaggacaaactggagcccagcaggcacttatgtgttcacctgacattatatctgaccataacaacctttacggagtaatgataattgcttccctaccaccttgcaatttcatggactacctcctttagccaactcttacctgtaggcatgccagaggagatgagtctgaaaaatgtattttccagctgaactaatttcacactttataaatccccaaaaatctgggtgcacagttaacgttggtagttgcatatgaattgcacttccagtattcttgattttctttaacccccttcccagttgatcctgacttgttattggggtttactggagcaaagggacattaccaacctggtccaagcagaaacttgtaagcattctcttattggaacagtgaac

SEQ ID NO: 1128 - DNA, 723 bp, Homo sapiens
ttttttttttttttttttttttttttttttttttttttttttttttttttttttttttttttttttttttttttaaaaaaaaaaaatttttttttttttttccccccccaaaaaaaagtttctggggtttttggggggtataaaattttttttttttttcacccccacccaaaaaattgggggtttttttttttggggggggggtgaaaaggtttttttggggttttttaaaaacacacaaaaaggggtttttttaccaagggggttttttgggacccaaccattacgggatttcccatgggaaaaaccctctttccccggggggccagggggctttctatttcccccatttttgggcccagagggggggggccctttttttttaaaaaaattcgggtcccggtgtctcttttctcaaaaagaagggatttattatttttggttgtggacaatttatcaaagggccgttggggtggaggtaaacattttttcatacggtagattttttggggggggggtgttaaaaaaaaccctaattattgggggtacaccttggtggtcactcccaagggagcggggaaaccaagttggggggggatctagggagtggggattttcgcgtgggtgagatttttttgtcaactccacaccctcgtattatcaacataaaaaagagtttgttaggcggggggtccaaataaattttgtgtgtggggaaaactt

SEQ ID NO: 1129 - DNA, 992 bp, Homo sapiens
  misc_feature (1)...(992): n = A,T,C or G
ggcctgagacttctttccaccgctgaaatagtcttttggatctctgatatcaagagcaaacatgtattacttgacagcattctaaactcatctgtgagagcagatttaaaccccctgattctgcctcaagctcctggttgaatgtcgtggcacatggcaagcctaaatgtgcaactcctccacgagactgtgcgtgatcaatcccagcacgccggtgagtaccgttcaccttcagaccccttttgggccaggaatcccactgaaatgcctagcaaagcttttcattcccagctaagaagagcaattgctctctctggaaaaacttttccaaatgttctttgaacaaacaagagactttgaagcttgcttgaagaaggcagacggacacagagctgtgctccatccccctctatcctgcataggttccaagaatcaacaatgaatgagagtgtggaaagaaattggaattgtagaagtgccaaaggtatcccctggagccagtgtgtatattgtgttgtcatgtaaaagagcccttgaaagataaaggaactgaatccaattatattactgattccatgttcatctgaatcactgtctaacttcaaacttccaaagatatcacattgcctgcaataattaattcaccctcttccaaaaacacgttagaaaattaattcccaatgctaaaatgaatttggcagcacaacacattacaattttgcaggttacctggcaatcattttgaacaccccccttgggtaaaatgtactcttgtatctgcctcacagacccagtctgtttgattcgtggactttacttatcattacattaaatatacccattataaaagaatacaacatttatatagatattaaaatatattttaantatgagaacagtaaccccaatttttantacaagtaagttaggacaaacattttgctcatatgaaaacaaatgaaaaatcatgtaaataaataaggatcggccag

SEQ ID NO: 1130 - DNA, 895 bp, Homo sapiens
attctctacatagacaaagatgtcatctgtggataaagacagcttgatatcttccttcccaatgaaggaatcaataaacgcgaacggaattcaaacggaataaatcttactgcctgaatcactcaattcagagtagcctcctgaggatttcacattaaatggccgaagatgattgatgactcttcaagtataaaaaggcattacttatcatatcaatagagaccatacatagcaaatctgttggttctttgccggttttactggggttaaaatatcctggtcttaatgaaataaactagaagatttggtgcccagcatgaagaatagttcctttcaagtacctgtatgtcctgaatgtattccttccagtgggttcttggtctcgctgacttcaagaatgaagccttggacccttgtgatgtgtgctcacccttctctgctcagctctgtgccctgggagggttaacctctacaaactgcatcaccaggcttccgccctctgggcttccagatggatttggccaatggggcagcaccagtgggaaaggagaggacaggaggagagacaggctgaggcctccctcctcctgtgtccctgacatacagtgacagtgctggcctgcagctcaggatggatgcagtcaaggacgacagcgcatggccaaaaaagctgtctgctgaacatttggccagcagattttagaaaaaagggaacatctttatgattttctgcgcctcagaagattccctggatcattctttcttgggccaaacttttagttattggtgttacatatcattttatattgtggtggcccttatggatctgcggtattggggaacttatctgagtggtggtaacctatacacgcgaatcaaataaaaacaaaaaaag

SEQ ID NO: 1131 - DNA, 680 bp, Homo sapiens
tgttttttaagctagagttctcacctcactgaagcaagactggtaaataagttttgaagatgaagataaaacagaataaattaaggaagaaaaaaaagaagaggaaaatctcccaaactggcctgtcttcaatgttcctttgaactgtctctcctactgcactctttacattttaatgacttgagtgtttaccatttatgcaggaacatacccttaatgtgctcagaagtgatgcatatcttctatacatgagacagaccacccagcaaaataccaatccagcttagggtctgtgaagtattatccatttgtctaaaatgtactgtactaaaccttataatactttgttagctggttatgtcaaattctcattgtaatataaagatttaagtaaaatatgaacaaattgacaatatccaataccaaaaggccataaaaacctttttcaaaaatataacagacttacagccttgcgtaggtcagcaaaaatggtatgtaccagagcatagttatgaaaatttaaagaagtgcatatttcttcatttattctgtacccgttcaacattgtgacaagcataacagatttacaattcttacatactttttgctatatttcccctctcaatatgatgtcattccatttttttttacaatttttacaaataaagactgatccggcg

SEQ ID NO: 1132 - DNA, 771 bp, Homo sapiens
ttttttttttttttttttttttttttttagtaacagaattaagtaaagcatagaaaagaccaaactctacaactgcaataaaaacagtcattctcttatatctcttataattgagattcaatttcactttctcctatctgtctctgcttattagtcagaatctctgagtgtaaagggtgaagtcggtgttttatcgctatcagagttggagagagaataaggcgtatgggttttctgtacctcttttgtgcatgctttgtaatagtctagcattcttttggtggatattcaataccagtagattgaatcttggcagagttggaaaataaaacacaatgttgcattcaagtatatataatactttaggcaaaaagaatggtaaagatccatttctcagttgtcaatttctaagatcaatgcatctggaaagggagccagaatctctgtagagtcacacctaggtatttctgcagctgcttcctggtttctgggtttgaattccagcttttttttttctttttttggtaagcctttcaaatgctgatgctacatgtttaagaatgtacatgtgaatatcacgctttgcatgtaggcgcgcacacattttcacctatgtctcaactcagaaaagatgcttcagtgtgactgagagagcccagtagtattcttagagtcgctgccgagctgcttcagagcttttcaacagcaataataactaaagtctttcaagaagctattcttgtctccaaaggaaacaccttttttctctgg

SEQ ID NO: 1133 - DNA, 698 bp, Homo sapiens
cttgctgctttctaaatctcatcagaatgtcttttaacaaaatggtaaaatggtaagtgaaaagatatcttctgaagtgttctccagaaactgtgcaggtggcggttctcttagaagaaaaagaaaggcagggatccttgaaatggtaatatttcagttgtttcatatacatagaagtgtctcacatggccagcaaggtgatcattttctcttatgtgcttatacctgtttacttcattataacttgatatggctcaaacctcaaggtctgtgggaattgtttgtttttgtgtatctgcatgagagccactcataccctaatccaaagtttctgcagcccaccctcagtgggaagctcattattcataaattgtttaaaattgaaatgtcattctaaacagatcctacaagaacagacatatacaatttagactgtatagtgcaatatatatatacacgcacatatatgtgtaaatatatatatgtttgtaaccctgttttctttcgtaacagtttcctcttgaatatgaagtgccttacttttcctgtttatggcagtgttatctgtttaaaatgtatttgtagcctgtagactttcagtctaagtgacaagccacctgaaacatgctacagattttagtagttatacaacctagtttaacaaactagctccaagagaatcaatgacgatcgccaag

SEQ ID NO: 1134 - DNA, 908 bp, Homo sapiens
agaacagcagttgaactccctaaatgtctgcagacatcaaggcaactaatttaaatgaggaaagcaggaaatatgataatgaaggaacgacagctgacatttggccaaggactgggaaacacatacccagtgacaggaactccagtgaaatagaaattgcacatgctatattaatagtatcactgaagaaggccatcccatgttgcaagatttatggaacttcctagaaaaacggaaatacccagatttttatgtgaaatgtatccatttttcaatactggcaattcattcaaggcatcacgtttaaatttaaaacactgtggaccagtaatggaagggttgtgacctgtgtcatagaacttcagtttttacatcaactcttcatcctcacaaaatctatttgaggtgcataagacaggtatataagctaggttaacaatactgttcactgttaggatcgggcagaaagaagctgaaaagtatctgaacaaaaattgtctatgtggcaggacagaggatgttggaatagacaaccccagagatgcagacaacgtagtgcagaagcaggcctgggctgagacttcaggaaataaggaattagaccaagctttgcaccacacatagagtgtgacttggagtcaagcattaaaccttacgtctctatctctcgtatctaaaatacagcttctgaactatattttctaccagattcctctcagatcaaaaaaatgctatgaatctatatgtaaactctaaattcctctaagatactggagaacagacagtaaatggtgaggctgtaagtctatgatcataatgaccactcctcataacaaaatcatacttaaaaaacacatttgtgcagagtattaaactatgtggttatctaataaatgacgatcggccag

SEQ ID NO: 1135 - DNA, 1193 bp, Homo sapiens
cgactctcttaatcttccaccgctacagatccagaagaaaatcatgcagtctctaaatctggtatcctagaagaactacaaaatttgatattcattgagaaacatggtaaatccccacacaggaggagatcaatgcacaatgctgtcccttcactttgctgcgtgtattcctgctgctggaggctcatttataacagtgtacctggagccataaggtcatggctagggtctctttctatggtacaacaaggacagatggatattataattcagcttgagagactaaaagagaaaataaggcagatggcttgctaaatatttgcttcatttcagggccatgctaagtttcctttggctgttgattgaaagcctgttgctgaaaaaaccctgaggctgcactgcagcaactgctgtgtctaactaagccgggtcgatgctgaaggcaggttgccccccatttctccacattgtcttgggctcctagaaataatatagccaatgaggcgctcttagcaacgttgttctcacttgggttgataaagagtgaacaagtactccctagctgagcttttcctcccagaagacctcagactgaattaggaatgccttcaccaacaaagcaaggaggaaaataaacatgcttacgcttaaccatattcaaacgtcagtgactggaacagccttttttgaggcaacatagtagagagtgacattggtttccattgcggcctattggtgataaatatgtgatgtgtacatttaaaagggtagcactcacttcatctgagcctttctttttcaaaacctactgtgtgcctggcattgctcaagatgatggaactacggtggttgagaggtaggagacaatgacgtaaactatgccaacataattttggattgtgaaggaaacaaacaaagatcggatagcattaatagggctgcgaggagacggatggtatagtccacgtgggaatggaggaagaatcagccacacagggagccagagaagccatccccacagaggacacagcaaatgcaaaggccatgaggcaagaaagaatagaaaatgctcagaaactcatggcagagaggaaagagtttttttgtgtttccattattgtttgatgattcagtctgtattggaaagctgagaaaaaaggaacaaatatatacaataaatcaagatcggaaag

SEQ ID NO: 1136 - DNA, 357 bp, Homo sapiens
atgtccactatgagaccacaggaccagctgaaacccgccagaaccaatatgaccgactggagctcgcgcaaggatttgccgggccacggggtgatcttttgacgtcaccgtctgaacttccgccccaagtttcatactaactccccctaaattttcacatgccacccatgaagaggcaactgcacatgggcaagggactttccaaacatccccgttccctggccaatcactaatctaccctgaaacactttcctccaaatccttcttttacaaatatggctttcaagccagtacaaggaagacagttttgagcccatctcctgtcacgttgcttggccgttttgcaataaaccccga

SEQ ID NO: 1137 - DNA, 822 bp, Homo sapiens
  misc_feature (1)...(822): n = A,T,C or G
ccatccaagttaattgtaacgcagtcagggtttttaccccccattttgaacttaagtgccagtgactctcttaatttccacggctaacagcagggagatgatcttccaaaacttcccttatctgtctagagatagattcttcaaaaggagcacttttgtcctctccatggaatctcatcaaccagggaagatgaacaaaatcatgggaaaggtaattgaagtggtaccttatacaaaactcacttcaagatgaaccaaagacttaaatctaagacctgaaataccttaaattctagaagataatattggaaaagcccttctagacattcacttagacaaagatttcatgaccaagaactgaaaagcaaatgcaacaaaaacaagtaataatagaagagacttaattaaactaaaaagctccagctgagtaaacagacaacccacattttgggagaaaatcttcacagtctatacatctgacaaaggactaatatccagaatctacaaggaactcaaacaaatcagaaaaaaaaaaaacagtcctatcaaaaagtgggctaaagacttgaatagataattctcaaaagaagatttacaaatggccaacaaacatatgaaaaaatgctcaacatcattaattatcggggaaattcaaatcaacactgcaatgtgataccatcttactcctgcaagaatggccttaataaataaataaataaaattatagatgttggcttgcctgtggtgaaacttttacaccgttggtgggaatgtaaactactcgttggcattcttaaagtcaataaaaatagatcggcncag

SEQ ID NO: 1138 - DNA, 405 bp, Homo sapiens
  misc_feature (1)...(405): n = A,T,C or G
caacccttcttagctaaggctatggattggaacacctacaagggggtggggcgcgtggacctgagctttctcaaacatggtgtctgtgttccaaagatcagaaaggggtgactgaagtanaagtgaagtcagcaacttatcttcaggcataactacttttcctgtatcctgaaccctcgagctgcaactctgcttagtgcgggggaggacactctggaccatcacctccaacggtaagatgctcccaagggctcagagaaatttggaccttggtggttccattgctgaatatctcaataatgaaagtcgagtggacctaggggtctttacacagagaaaatatggaagaattcccaagtaaaggtaggtacactatctcgtttcctactgatgaataaagacgga

SEQ ID NO: 1139 - DNA, 816 bp, Homo sapiens
agatagccagtcatgggactgctggatcaactggagacagatctatacaactacaaatacctggaatacgaaggaagatttacttagtgtgtcaattctgtgaaactgagaagagaggcgaaaaaagcaacaacaacaaaaaaaatgtagcatgttttgataggcctccttagaatgaacatggcacctgtctaattataagatactgaaaaataagaatctttaaacagacatctggcccaatgtgcccttgtcaaccatcttcagtctttttctgggggggctgagaaaaaaagtaaaacttcctggaatgcgaccttaattggatttggaattttgtaagattaaggcataagccccagctattttaaattgttgcatgatttaaattatataggatcttatatgaatatgaataaatagaatgtagttaatgatttacattttcaaataaaagactttttgtatatcattattattacttttggtcaataatattgttattttagggtaaaagagagacatatttaaacaattacctattaaaccaataacttttaataaaatatatgtctaatactaaatatatattttatcctatttttagtctttttatatatttaattacattttcaagtaatatagcttagtggaatattttccactaataaatataaattatatattcgaatctttaaggtttttctatgtgtaattttctttagcaattttctggtcatattttgtgcttgcaataattcttaaaatttgtagcataaagcaaatacatgaataaacaaaatgagatgcgccaag

SEQ ID NO: 1140 - DNA, 873 bp, Homo sapiens
  misc_feature (1)...(873): n = A,T,C or G
ataccagcaactgaaaagcagaagaaaaacacttggatcgtaggctaactcctaaaagattgatccctggtgctgatacaggtatggacatcctgacttgctatttctgggtatctgcacgaggaatggcagctggatcagagtggcctggactgggggcagtctttagttttattaggaacacagggccagatcaataatcaattagagttggcaggggaccagggacttggagcataaacaagtcatgaagggctaagaattcagttcagctacaaagcctcctatagaaggacccaaaggatgaggagccagcagactatttggaataaggcatgtggcatgcggcctgagacagaacaagaagcgcctgagagagaacaagaagttctttcacagaagggagtagggactgctggctaaaaagggaccccataaagcccacaaagcccttctgtgatacatgctttgctggaaagtctggctggaaagtgggagcaaggccaagattccaatggaggccagaggcctagaccaagtcaaccccacattccctaagtcacctttctttgtgagcatgttctatggaacaagtcccatagtaaaataccaaaaacctaagagttcagttgcacatgtgtacctttttccttttataaatattcatgactcctcctatagcttattaaatacatatattcagccaccttgttcaacataaattcctgtcccctttgcccctccctcagtttgtgtttctgacttctggccagaggctgtacttcccagactgtcagaatggccaccntgcagactgcaaccctntgagaaataaagctctcctttccaatttttaaaaataataaaacctga

SEQ ID NO: 1141 - DNA, 834 bp, Homo sapiens
atatcttggatggagcttaggcagccattttatactacacggaagaggacttcatcctcgggatggtggaatggagagttggaaggagctgggttcctgatcatcttgtggagccatcatgctaccttggactgcctggccaggattgctgctagtggctcacagctgccccttctatagagaattgctcctggctggatgggagccattttacctgggaggttatggttcctccaccgagggcatgagggcacgaatggctgtctcttttgactgaaggtagaatcagctccgtggtgcaattcacaccccagagatcctgtggaatcaggctgaggccagggtccagccaagaccacaccattgcttaaccccttttctttcccatcctgcttgcctccccctgcttctcctgggaaccctccctcaataactctcccaagaatccccacctcaggttctgcttctaggagactcaacccaagatactctcctcctgcttctctgccatgatgagacattgaaaaagaacctggcataacccagcaagctccctggctcacagtagggccgtaatttggccagacttccatctaatttcatccactgggttttggagtgggggacaagaaggagaggtcaagaaccccatcccaccagaaatcaagcctctggcagggggaagaatatgaaagatgaaccccttccccaggggggctggaggcccagagaccacttgggaaaaggcctttgattcattaggcactgggaaatccatcggcgcaatcccctctctttctgctctgcctgtcaagccttgttgaagtccaaggg

SEQ ID NO: 1142 - DNA, 435 bp, Homo sapiens
ctaccaagaaagaaaagcggcccctggtggccaggagctggcggccacagctggaccctggtgtcattcacaacaccactctctgaccactctgtaaagtgtgtgaacacagataaaacatagtcattgtccaaaccacaaaaatgaccaaactccctttcctggctaatatgagtgactgctgcttctttattagtgaccatcattcctgccttctcgatgagaactcctatgataccgactcttagaatgctgattctaagccagcctcccgctgtcatctaacccagagcaaagcctgtttcctcaaaccctttcccaaatcccctaacaccagcttgaatctgtgaagtcctttcccacacactctttctgggatgccccgcaactcccatggttgcatcccccttactacaacgagtcaataaacccaga

SEQ ID NO: 1143 - DNA, 337 bp, Homo sapiens
ctaccaagaaagaaaagcggcccctggtggccaggagctggcggccacagctggaccctggtgtcattcacaacaccactctctgaccactctgtaaatgaccatcattcctgccttctcgatgagaactcctatgataccgactcttagaatgctgattctaagccagcctcccgctgtcatctaacccagagcaaagcctgtttcctcaaaccctttcccaaatcccctaacaccagcttgaatctgtgaagtcctttcccacacactctttctgggatgccccgcaactcccatggttgcatcccccttactacaacgagtcaataaacccaga

SEQ ID NO: 1144 - DNA, 1102 bp, Homo sapiens
agtttccctgcacaagccctcttctcttgtctgccaccctgtgagacatggcttttgccttccaccatgattgtgtggcctccccaaccacgtggaactataatgaagatattataccattatatgctcttgaatctgtctcattgtgacttggcgaagaggcagtgaatctgccaaaaagaagtagagcagctgtgaagatgccaacacaattgagtactctttctctacatatttctaaatatggcaatttattggacacttatgagcatggaatgacaatggggtcaatttaaccatacggcaatgctgagacaccttcattatgacctttccctggtataagttatgtgataatgaatgcatgtttagtcacacactgtaggtacagatgggaaaaaagaaagcataaaatataaaacatgatgtccaggtttcaaataagaattctaaaatgttatttaattaatgaaatgaaaatactttactttagaaaaagaatattgaatctctttgatgtataaaatgtatatttcaaattaaaaattcaaaagaaaaaaattagatataatttattttgtcctcaaatactcttgatgactgcacaattcctttcatcttcaaattttgtcaaattcaagtatcacctgtcttcaggctaagtgttgaccatatggcaaaatgaagctcatcatactacagagatctacttggggtctaattttcatcattataatccaaaattttccttcaaagacaaaaagacaaaacagttgataaagccttctataagattattattactgattatttaaattcctttgactgggtcaaataaatattctgtagacaaaattaatttcatatcaaagtgagataatttttgaattgtgctccaaaaagtcatttttaaattataaatttgtacttattaattgacacatttaacaaaaattcattcagtgctatacagcaaccattatgccaagactgaaacatttccttcccccacaaatcaaaaactatattgtaaatagtcatgagagtttcaacactagctccccaaaaggctattcatcccaaaataaacatcgatcgccaa

SEQ ID NO: 1145 - DNA, 149 bp, Homo sapiens
aggataacctacgtattttgttggaaacaaaccagatgatcttgaatttgttccaaggccaccagcaaaaagcatgatgaaagaaatgattgatatggtggctgctacacaaagtccctaagtgactattaataaaagaggatccgccg

SEQ ID NO: 1146 - DNA, 218 bp, Homo sapiens
aggataacctacgtattttgttggaaacaaaccagatgatcttgaatttgttccaaggccaccagcaaaaagcatgatgaaagaaatgattgaaatggtggctgctacacaaagtccctaagtgactattacaaaaagagatgctgctgaccatgatggacatgcaaggagagcaagaaataaacctttgttgtttttaaaccacaaaaaaaaaaaaa

SEQ ID NO: 1147 - DNA, 1008 bp, Homo sapiens
cagtgagaggtgggaaagtgacctcttcaaacctggggaatgccagctgcctgaaggaatcttcctccctgcgggtgaggtgtccggggccaggtctgcagctccgactggctgaggaaccttctttcctgcacagtgaggtgtccggggctaggtctgcagctccaactggctgaggaaccttctttcctacacagtgaggtgtccggggccaggtctgcagctccgactggctgaggaaccttctttcctgcacggtgaggtgtccggggccaggtctgcagctccaactggctgaggaaggaacacatatcctcccaggggaaaggtggaaggtagaggagaagaatttattcctccagaacacagatgacccatagtcggcattacgtttgtaagtggtgacggagacacagcttgcagaaggaggtgccccagctttaaccactggacaggtggcctgcaggtcctccagaggggagcaaactgtccatcctgtagagcaccatgggccgacaaaccagccttttgagaggacggcctggcccagccaagctgctggacagcagctcagaatccagggctgactcatgcctttgtgcctggccaggagcgatgccaccaaagaatctgacctgtgacctgtgccctatgcccttacacttgggagctcagcaggcagcttgcccctggcaggcgtcaggagccccccagagcacagcagtggggcaggcagagtcagggccaccctgccctggccacggcctccaggcttccttctcaagaccccatggccatggggtgagcctgcccaggtatgtacgctgtgaacttggagacacgtgctgtgaattacgctgtcacactacgctgtgaacttggagacacatgcagaaaaatggtgcaccagaatgatgcagcccgggcgggcaactcctcacactttcagagattttttccaggtgcaagatgttacttgttgtgaataaagaccgatgccggccggaa

SEQ ID NO: 1148 - DNA, 795 bp, Homo sapiens
caacctatccaggataccatgtttcatttagttgtcatgtctcattgttaccagaaagtggtcccaactcagactccaagagagagtttttggacctcaagcgagaaagatttcagagcaagtccacagagtaaagtgaaggttctaaaacactatattttgggagtgcagcaagggttggcggaatggaactgaataaacaagtgggtttgttatccatctccggaagaatctcttaattttcttgccatttaaagtgtattcaagccagaaacatatttcaggttccttttaaatcttctgtaaaaagaaagccacattcaaaggatttgaatagacatttctccaaagaagatacacatggctaataagcacatgaagagatgctcaagatcattagccattagggaaatgcaaatcaaaaccacagtgagacaccacttcccatccattaggacagccagagtaaaaaagatagtaactattggtgaggttgtggagaacttggaactggcagggatgcaaaatggtacagctgctttggaaaatagtctggcagtttctcaaaaagtaaacatagagttacatgacccagcattcctgttctaggtatacacccaagataaatgaagacgtatgtccacacaaaaacttggacaagaatggtcatagcagcttttttcataaagggccaaactggaacattccaggttacgtaattggtgaaaagataatcaaatatgcatagccaccgtcagaacattctgaacataaaataactcggatgcgggcgtt

SEQ ID NO: 1149 - DNA, 519 bp, Homo sapiens
cgaaagctcaaagaagagcctcaaggattcaaaaaagagattatatgagcaacgggggaaaacaaaaagcaagctagtggtgcacagaaaagccaaggaagaataaagcaaaaaatattacagagatgaaaaaagcacactgcacactagaagcaacaaaaaatagaataagtgtaactaaaatgtttcctctcggcctctcaatgcagggacaaaatgaataaagaacaaagacattgaaattattttggagaatatatgaatatatgacacagtgatccaacatacagacagaacaatagaactgaaaaaataagataaaagatataatgggagaaaactttcctaaaataaatttggtaaaatacaaattgaaaatgcacaatgggctgggagaaacagtgttgaaacagaatgggcaacaatgaaacatattctgaaattcaagaatgaagaaaaaaattgtctaagcatgggggcctgaaaagtaaatcacctattaaaaaaaaaaaaaaaaaa

SEQ ID NO: 1150 - DNA, 816 bp, Homo sapiens
atcagggatgcagtatagcatagtaataaaacttttgctctcaagtgagactgcctgggtttgaatcctcttttcaaaactctcctatgatcatggtggcgtgtgcctgtagtcccagctactagggaagctgaggcagaagaaagaagaatcgcttgaacctgggaggcagacgttgcagtaagccgagatgattccactgccctccagcctggcgacagagctagattccgtctcaaaaacaaaaacaaacagtacattattttagggctacccacaaaaagatcatgcggaggcaatgaattagtctcaggaaggttgccaatcttattccccactatttatgcagcaaaagactacacttctgctttggagatacttcagaaaatgctgaaaagaagaaatactgaacctccatggaatattctctctgattataaattattctactgtgaagacacatgcatacgtatgtttattgcagcaatatttacaatagcaaagacgtgaaactaacccaaatgcccatcaatgatagactggataaagaaaatgtggcacagatacaccatggaatactatgccgccctaaaaaaaaatggagttcatggtcggttgcaaggacttggattgaacctggaaactatcattctcagcagactaacacagggaccagaaaatcaaacactggatgttctcactcataagtggggagttgaacagtgagaacatatggacacagtgagtggaacatcacacactgggggcctgttgaaggggtggggggcaagtgggagatacatttagaacattact

SEQ ID NO: 1151 - DNA, 841 bp, Homo sapiens
gcctagcgggcgactggctctcggaaacttcaatttccccgcccaacaaataaggatgatacaggtcttacttcctgggaggggggcagtgagacagagtgtggaaagtgttagtacagggcctggcacatagtcaatgctcagtaacagctccagaggtgctggctggggtaggaccatccatgctatggacagtgacagctgggggcaaaaagatgcatggcatctagtcgaatcttttcactttacgatgaggaaaccaaggcccaggaattggaaatgagtttcccaagggtactcagacatgtctaggcacaggtgggattggaagtcgtacctcctcacgccccatgctctccctgggaccaggctgcctaaggcctgtcacactgcttcactttcgacagctggaggtcttatacagagggtctcagcagtgagactgcccaggtgaggatgaagcagaaggaaacctggttcaacttggcatgtactttatatccaacagatacttctgatcaacattaccaaccaagcatctaagattgaaatatgatagtgtcttcacagctcattatttttcctgagaaacaatgagtgtaataaagacaattaaaatcaagtcgatggctcaagaaaagcccttacctttggggggccaaggtgaacaaaatggctcaagttcaggaatttgagaccttcctgggaaacagggtaaaccctatctatagaaaaaatacaaattatcctggcttggggggcatgctgtaatccagatctaagagggtgggtgggaggaaactgaggcagaatgtaacctgaaaatcttgatcgacattga

SEQ ID NO: 1152 - DNA, 372 bp, Homo sapiens
gggggggggttatctgctaagaaaccagcactggctttctgtatggtgggctcagggcagcaagagggcaagagttcaagctgcaaaatctgcaaggcctcatgtgactgaagctcaggaatcccctagtcacttctaccacattttacttgataaaacaagtacaagaccagactagatgcaagaggatggaaaataaactctacttcttgacagaaagagtggcaaagtcacactgcaaaaagacctgcccatagacatgggagaaattattgagaccatccccgcccccgaactgtggcatatatgtaaaagcttttaacatagtgctttcccttactttagtagacagaataaaccaggatcggccag

SEQ ID NO: 1153 - DNA, 786 bp, Homo sapiens
  misc_feature (1)...(786): n = A,T,C or G
tttcatggagcgaatgtcccacaggtgcatctggttgatcccagagaggtacataaccactatctccattcctacaaccaaacagaaaaagtacgtgcttacaggatcaattctgaattcctcagtctggtaatcaaggcgtcctctagcgagtcccagcagtggcgggcaatgtcccttcatttgaggacatgtgcctgccctttacagagcagtgtgctttagtggaaggaagttgagctctgaagtccaccagagtaggttttcatatcatctttgtcacttactagatgagtaaactatagacaaattaattaaactttctgagcctccatttggtcatatataaacntgagatgtcaaaaactacnttttcattttcagtgaattgtaaggatcaaatatgctacctaatgtccataacgtgcctaccacatagcaggcatttattgtacagtagctgttcccactctcggccccccggcatatacactgtgtcctgaaattcatctgagcgatccagtctcctgattttttcttctcactccatgaaaggaaaagatgacagataaaacgattaggttatcagaatgatcagaatttgggggaggttaaagccaacttgaaggagaaactgggcttgaaagaacctcacccctgtttgtgtaagttatattagatattagcatgacaacttaatgtcctttcttatcttataatactgataaaaccttagaagaaatttgcttggtaggcattgcatttaaaaagtaaaataaaagacga

SEQ ID NO: 1154 - DNA, 809 bp, Homo sapiens
actctggggttctaagaagtggaggagaatgcagatccctgcaggacaagacatcatgagaagcagcacaggcgggcaggaagaccatggactttggactgtgacctggatagaagaacctgctctgcctcttcctagctgtgtggccctaggcaatttgcttaacgagtggaggcttagtttttctcatcgttaaattgggaataataacacccttcttgtagggttgacatggggaatatagataacgggactagcacaatatctggtcctgttagataacaaatagcttttattattataaccattaatgatgtgtttgaatttctcccttctcctttagatgactatgagctacttattttcttaaagcagagggtgctcaactgtgccacttacgggatactgacctccaggcactaactttgtgaagtggaaagataattcccagagtaatgtcctaagagaaatagtaaattgtatggagtgggagggctgagtgtcataaataaactaagtaattcctcattcagtaaattacaccagaatatcaaggggggtcctcctacagaaattagctccctattgagtggggagagaccaaatgctcaaagaaaatatttggccaaccattcttgggtagttaatgatagggaagataaaccaggagaataacagctcaaagactgaggagcttattcaaagaattatctaaggtccttgggtaatggacttattgcgtattggtgggcgcgttctctctatacagtatccagagagggggagtgagaggagaaacaacttcattt

SEQ ID NO: 1155 - DNA, 782 bp, Homo sapiens
gctataaattcttctttttgaagaggggcttcaatttgttggggtggggggtcatgtctgtacgcctggaggaggaatgagaaaactgagcaagattttgtgactttcccaaggtcctacaccaggcagagtaggcaaaatttaaacctagaaaatttgactctaagattacattgtcttgtaatgcaaaggtttctggaggggctgtgaagagttcaaaagtggttaaaataacaactttacgtgagaagaataagacaaatgaagaaattctgaaggattctgtattcatttttcttttataacagtattataaggcattttaataatgggctgtaacctagatatcctcttagttaaagaaaagaagatcctttggagctactggcacgggaagacttttcaaactggaaaggattttgaataaaaaagttggaacattttaagttaattaaaggaataatacaacaacttgaggaaatttattgggaatgggcttatcaataaaaggggatagaggctttttttgttcctttaagaagaaaataagataaggatgggggccggtttccctttagggggggggtaattcattgactcttggttactggctcgggtggggttagggggttcgcctccggaaaggggcgtactctacttgaagggggggatacgggttggcccgaatgaagggattacgggggaaaagcctggggggcaaagggacgcaaagggccggaaccccgaaaagggctcggtcgggccgggtctgcacatgcccc

SEQ ID NO: 1156 - DNA, 844 bp, Homo sapiens
cttaagctgcagtgactctgtccatgacattttgaatgacttcttgcaacttcttttatttatgtaacagtttcctgagcacctgctatttgcaaggcatagcagtaagatgcacaacatcaatgacatcatggaatttactctccggcagggagaccaacattaaaactaatcacatcgttagtaattgatgttactacagggtatttatctagttcagattcaggtaatgctcctgcaggagtgagtttctagatttgaacataaaagatgagaaggcaataaacagacaaaaagagaattagtctagaataatggggggaaatgtctagaaaggactctcttgtatcaggaaattatcatggaagcctatgtgaccaaggttacaggagttgaagcaatggatcaaagattggataaaattctcccttcagacttctgcagagaatttgaggcctgtgaatccttactgcataaaactttcaggtcaaatgagatggagaggagcagggacttcatgcattgtttttctgaccctaaccatatgagtatcacaatgcatggtagcattctaaaatgcctttaagagagaagcctgtttaatattcattttagcagtgagccctaactcacttgcctatagaacctttcattcttcataatttttgttataggtctgaggataaactttttaaagtactagactagattatcctgaccggtccatcctaactctgaggtccttttgatttgaagccaactttgtcctctcctcctttagtgatggtttctcaaataaatcagaatctgaacacttacttcccaggtataaatgacattcaac

SEQ ID NO: 1157 - DNA, 132 bp, Homo sapiens
atcgaggatgccttctttctaccactctcttctctgaaacaagaaggcatacgggtttactattttaccaggaaattattcaatagagcaattgttttactccctgaaaattaaaataccctaattttattc

SEQ ID NO: 1158 - DNA, 273 bp, Homo sapiens
gaatgagaaacagtttcatctttgtatgaaaggagtgaaaattcctgatcatttttataatttaccaaacctgaaaatgaagtataatcctcaaaactatgtattaaaactctggagcactaagggaagaagtcttggaaaggatgcttggaagacaagaaaatatgttttctgaactcttgattattcatggaacctacaagatttttcccctgtaccttaagcatttgaaaaatgtgtgtaacgttttaaaatatagctgtcaacagaaaa

SEQ ID NO: 1159 - DNA, 247 bp, Homo sapiens
ttcaggtgttggcaatatccttgaagagactaaaagaactcagaacaacactgaacaagccagcagagccatgcaactcacccctacagtctccatacacagactccatgaaagcattggccatcagctctcactggtgtggatatgtcaccagtggggtagagttgttcctctctctgacactgtattagtccattctcacactgctattaaaaaacaaacaaacaaacttgaaaaaaaaacaaaa

SEQ ID NO: 1160 - DNA, 458 bp, Homo sapiens
ctggtggcaagcatgacagggaaccttggacaaaaagcagggctggtcacatcagaaactactaacagaaacagtcaagctctgcctctggctctcagcccatgtcaccctgaacaccctaggcagcccagaccaaggctcacctccttcctgcaggcctcactgctctccatatggcagctcactgacatcaaagaagacggaagaaattatctaaattcaccaggctagttccactccttcccttgaattgtggaagagtcgctgatatctcaattacctctcctgcaatagtacctttttccctgcatgctaagattttgcaatgctaaaaagcagggtgagaagtgtatactggactaacagatggaagattaacaacaaaagaccgacttgatgggggagacaaaactacaatgtttgtatacctataataaaaacttggcctcgtggcctca

SEQ ID NO: 1161 - DNA, 725 bp, Homo sapiens
atatatgatcagattgctttgaggactgaagttgacttttgtggagccgataaaatgtcccttggagagactggccttgtaccttgtctacatgattcccttacaagcttcctgattttgtgatcgcttgccactggattactaatctgatttctctctccatagctaccaatcctactttaatatgtgaaaccttttgaaaataaagcttcaaacaggagactaaaaaatcaatatttcaccccaaaatattgctgatctaaagaagcagctcaagttctaactccttcccccatctcccagtcctctgtcctccccaaagcataggataaagctgttctctaaaattccctcatctatctagaaactggacctaccaaagaggaacacaattgcctgcctcgaaattttattaaccagagaagactaaaattcatatcacagaggaagaatcccaaaccatttcttctttctgccccattccaatttccaaatggttagtaaatttccaatttactaaccattgtcggaccattaggcccatttgtttccacctaaaaatcatttattatccctcagattgccacacttcccccattttcccttcccctgtgaagaaggggctataagtatcttgtcccccattgggttattgggcaataattctcctgcaactcccctgtgctatgcacattaaaataaagtaatggcctcgttggcctcaa

SEQ ID NO: 1162 - DNA, 228 bp, Homo sapiens
tgatatgatcagattgctttgaggactgaagttgacttttgtggagccgataaaatgtcccttggagagactggccttgtaccttgtctacatgattcccttacaagcttcctgattttgtgatcgcttgccactggattactaatctgatttctctctccatagctaccaatcctactttaatatgtgaaaccttttgaaaataaagctttggcctcgttggcctca

SEQ ID NO: 1163 - DNA, 208 bp, Homo sapiens
cttgtcctgttctgaaacaactaggcatcactccgcaagtttcttaccccttttcactaatgtggagatgccagaagtagaacagccatgttgagtctcacatttaccatgtaaaaaggatgacagagccacctaccagccccggatgtctgctgaccactgacttgttacctaagagagaaataaacccctggcctcgttggcctca

SEQ ID NO: 1164 - DNA, 928 bp, Homo sapiens
aggccaatcgtagaactttacacacattccagtacaaggcaaagacacaggtgtgactactaggagttgaagaaagtatacaaggggtggggaagcaataagtttcttagacaaaagctttggttctttgtaattacttcacttattttaggagacatatataataaggtcagcctggtgaagcccaagagttttaaggtaaaaacttgagtgtgaattcagactcttacatgtattagctgtgggccacttaacttcttgaaacctccatttcctgatttatgaaatcgtcccatgtaggatcatgatgaagagcaaacatgcttgaagtacctgtgaaaatcctctagacagtaaaaaatgccacacaagcattcacttgctagaaaggtaacattccatgcaatgctctctcacaccaaagaaaattgcaggaaacaaatgacaagataagtatgagtttggtaaatctattcctactcatcaatagaatgtagcagtttgatgacttctaaaaaacctttcaggaaatttgaatgaatagacaaattgaaatataataattttttgttaccactgtgccctgatgctttcaaatatacaatggaatcaatcatcgttacaataaagttgccaagagtgtttaggatctagaaccaaataatctggttttgaaatattgttcataaccagcataggtctggcaaacaggcagtaacttgagaatccagttcaattttcaaatcctctgcttactcctgcacatttatcaggcgagagctgatctactttggctttgagacacttagtgtgttatttcgcaacatgctaataaaattagtaagtttgacatgcagagatgggaaggcaatgatgtgtcttaagattgtggaattctaaaatattgaaataaaatcagatcggccag

SEQ ID NO: 1165 - DNA, 548 bp, Homo sapiens
gataggaacttctgaatgaagcttaaaactcaagcagccaactgtcaacctatgacacagagaagacatgaatcaaaatctctccggaaaaccctgcttcgcaaagataggatgttggaaatggaagcaggcttttcatctgaggatattctgccttgactttaatcaagaacgtatggagatttgaagttgcctcaaacatactttgaaggccaccagggacagctgtacaattgaagtggcattttctaaatatcctgaggaccaaggaggagagaatacattttccagcaaagaagaataaagtagatgcccagagagaagcagatacaagggatgcagggagattcctggcagcttcctggccctgttctccatctgccggtggttcctgcttcatccctgtcctggggctccatgagacacatccctttcctgttactgcatttctcttcactgaagctaaggacttctgttccttataactccagcaattatgtctaatacagatagtaaatatgcttaaaaaagaaaaaaaaaaaaaaaaa

SEQ ID NO: 1166 - DNA, 916 bp, Homo sapiens
ctgcccgcatcttgatttattaaaatgaacaaaaattcaagacccaacaaaacagctaaatgtttaaacgataggttatttagcgaaagtatgtccaaaaggattttctgggaaaaacgattaattgataacaatgtgagtgcaaatctgtctcttaaaattttaaagcatattgttcaaagttttagcttgtgtgcatgatataaattccatacattgttttctcagtgacaataaaaagcacagtttattaaaaatgtaagtaaaaattaattaaaatatcttttaaaaaattggtcacagttttgtcattggtatatggaggttgttccaagggcccatccaaagctcttcatcatcagactgtgtgtggtcactatgaaattccaaagcctccttgatgttcttactgtcaatcatggactcctgttcaactgtgcttttcagcctgttccttagtggcttcaccgctgtattgtcagtccccacagggcaaggggcaaatgtaaccagagttggtcttgcattcattttttcaagagaaaaatggcccctttgataatgtgttcaaaaggtacattctcctaatgtgtaactgccacttggtctaattttttaaagggccctcccagtcgaacaggggaaagcacttttaatttgtccggaagcaagcccggcgggtttctaccacagaaccattctgggaatatttttttgccggtgatattacggggatcctaggatgggaaaaacggtgtctttgactttaaggacattgctctttcagtgaactcggtttatacttctgaacaacactaacttatacctttttttctgcccccttcccctcaatttatccaaacttccaacacctaactattctcttgttaattggggaacaatgacgcgaactccg

SEQ ID NO: 1167 - DNA, 347 bp, Homo sapiens
cggcggatcaaattttattcacttcaaagacattgtaaactaactaaaggtataatatggaattctgcaccatacaaagttcttaatacatatttactaagataataaattaatacactaaggaaaatgatttgaaaaaatattttatgttttagaactcttaaataaaaataatacctaataacttgtagaaatatattccaacataatgtgacttgttcttccaaaaatgtgacttgcacctcccataatgttgcaattcaacaaatctgtatgaggtctctgtcccatctgccatgatctctctcctttctctcctcttagagaaatttcttgtatattattgt

SEQ ID NO: 1168 - DNA, 1177 bp, Homo sapiens
ggtaacacttggattagctctacacgcaccgagctctccaggatctgcagcttgcagatggcagattttggacattctcagccttcataatcatggctcgtcccaagtggatctttcagaaagcccttctctgaccacaatatagtgctagtgccactgctgcccaccctgtggtgtgctagactcgtccaacttagaatcaccactactccctgcaagtgtgtcttggtgctaaacatccccaagtatttgtatatagtgctttgtacagggtgatttatgtgcattcatgtgatggttcagaatctcaacgagaggacgatgtttgccactgctgtacagaagaagggtctcgctctatcactcaggctggagtgcaatggtacaatctcggctcactgcaacctctccctcctgggatcaagcaattctcatgtctcagcctcccgagtggctggaattacggctacatgttgcagatgatcctatggggaggcccatgtggcagagaactaaaggaggcctctggccagcagccagtgaagaactcaggcactctgttaaaagcccatgaagaatggaatcccgacaaaaatctcttgagtgaacttagaagaagatccatccccagtcaagcctgaagatgagactgcagcccagccagcaccttgattaggccttgggagggaccagagaactcagctaagccatgcctagattcttgatgcacagaaactgtgagataatgactatgggttagtttaagtcactaatttggagagagtaatttattaaacagtaataaataactagtacagcaatgtccctacacatatacatctatagaacttaggaaatccacaataaaataaccaactcaacaatggaagttacggttttgaagaatgaccatccatcaagatggggcaagcaaccagaagaaaatttttacaaatatccatttttgaaacttgaaatttatgtacttccttgtttgatgatgcattagcatgaagtgcttaccataataaaaggttttccatcatgatgtagaatattttttaaaatcattggaggcagcagaggaagtagactttcacattcagtgatgacttaggactgtcctttgtattcaatcataaagctttttacaccataataaagtctgatcggcaag

SEQ ID NO: 1169 - DNA, 738 bp, Homo sapiens
cacttcactgacgtatgagttgacatcatttgtctgaaagagtgatgctttttttgaaagattgaatatgaagtgtttcccatatcctttcatcaggatccacaacagagaaggaatgaattaaaatgaaagggcacacattcacgctgctcttcacggtctaccggtgcagaagatgggcgcttcaaaagccaatttgtgtagtgtaatttattctagctgcccagtggaagactcaggcttactaccagatggactatgcagcagttgacccctttccctgcattcagctgagaaccttcctgaacaagaagccttcatgagagaaaggatgaacaggaaagcagttcccagtcaggaacccctttgatattttacaggatatctatatctccaacatattccataatgccatactttctataagatgttaaggaagtacattcaatgtcaatggtaataaagcatgagcctgcactgagaacctgctttgctacattgacttaggaaatcctcacaacagactttggaagaagaggtattatctttctatacagaaaggcacttgagctaagtgtggcgtgggcgactaactcagtattgcccaactggtaacgcgaagaggccgattgttgcccataatctttgggagtctttgttcacatcaccccattgcttttataagggaaactagtgaactgttaagcggattagaagctactggcgtttcttaaggat

SEQ ID NO: 1170 - DNA, 776 bp, Homo sapiens
ttctgacatatgacttgacatcatttgtctaaagagtgatgcagtttttgaaagattgaatatgaagtgtttcccatatcctttcagcaggtgctaagggatgccatcagcaggagaaaggaaaacaacttaacccaagtaaaatggggataattcccacccctgcctgtttcacatagcttgaaatgagaatgtggacatgctaaaagcattggcacatttaaatagaaaaaaaaaaaatcttgtggtgtatattttgcaggatccacaacagagaaggaatgaattaaaatgaaagggcacacattcacgctgctcttaacggtctaccggtgcagaagatgggcgcttcaaaagccaatttgtgtagagcaacttattctaactgcccagcggaagactcacgcttactaccagatggactatgccgcgaacggaccatttcagtggattgagctcataacctccctgacccgcaactcttcgtgacagaacggacgactacgtacgtactgcctaccccttacccaccttggataagcaaccggaccgtcctctctcccaaatctctacgtaccggccacatttgcgtcccacgctcaagaccccgaatgctgcggcgtggatgtccggtaggttattcctacctaggcattgtactgaggccaccgctcttcgaccacgcatctacctttaacatacgcaatcacccgccgcctctatgccgatccgctcaacgataccgtcgaagtgtcgtcatcctcacctaccgcaat

SEQ ID NO: 1171 - DNA, 1189 bp, Homo sapiens
  misc_feature (1)...(1189): n = A,T,C or G
atgagattcattatgggatccatttcactgacatatgagttgacatcatttgtctgaaagagtgatgcagtttttgaaagattgaatatgaagtgtttcccatattctttcagcaggtgctaagggatgccatcagcaggagaaaggaaaacaacttaacccaagtaaaatggggataattcccacccctgccagtttcacaaagcttgaaatgagaatgtggacatgctaaaagcattggcacatttaaattgaaaaaaaaaaatcttgtggagtatattttgcagtttaggcctttttccccattatggtaaggttgccatgacaatccaagacaattgagtctccccaggacagaatgattcattaaggatccacaacagagaaggaatgaattaaaatgaaagggcacacattcacgctgctcttcacggtctaccggtgcagaagatgggcgcttcaaaagccaatttgtgtagtgtaatttattctagctgcccagtggaagtaagtcatacccttgggccctctcataatgcaggttattttattttttaagttggatgagcatttctcacatcattcaggtgcactaggtatctaagagaaaaatctctcaccctgggggttatatgtactctgcttcccaggactcaggcttactaccagatggactatgcagcagttgacccctttccctgcattcagctgagaaccttcctgaacaagaagccttcatgagagaaaggatgaacaggaaagcagttcccagtcaggaacccctttgatattttacaggatatctctatctccaacatattccataatgccaaactttctataagatgttaaggaagtacattcaatgtcaatggtaataagcatgagcctgcactgagaacctgctttgctacattgtcttaggaaatcctcacaacagactttggaagaagagttattttctttctatacagaaagtcacttgagctcagtgaggcgtggtagacttactcactattacccaacttgtaatgtgaagagccagattgttaccccaaatctttgtgattcttttttcacatcaccccatgcttcttcaaggcacactactgaactataaatggaatagaaaataaataacgttccggccggcntatttnnttcctctccccctcactcatccaccttt

SEQ ID NO: 1172 - DNA, 882 bp, Homo sapiens
tctctaataaccaccgctcagctgaggtgatgacagcaaaccaccaccgccacaagcctcatgccatcccagcctggaattctctccccggcgcagagggtgcccctgcagagatgaggccatgaggccctcggatctacttccccatcccattgtttgttcttccactttgctatacaaagacaaacttctgaccaggtgcggtggttcacgcctgtaatcccagcgctttgggcggccgaggtgggcagatcacgtgaggtcaagagttcgagaccagcctggacaacatggctggctcttgactcagatgtgttgctgccaagggagagcctgaaagaccgaagcgaaggccgaatgacaagaaaccggggaatctgcatcaaccacttgcaaacaggagacaggcttatggccgaggctcccttccttatccatgtatccatgttaggattaaaattcagatgctgttagaattctcaaggaggtgtataataaggttatcttgggctggccactgtggatcatgcctgaaatcccaacactttgggaggctgaggcaagaggatcacttgaacccaggagtttgggaccagcctgggcaacatagtgagaccctgtctccacaaaaaatgcaaaagtagtcaagcatggtggtgcacacctgtagtcccagctactcgggaggctgaggtgggagaattgcttgagcctaagagatagaggttgcagtgagctgagacgaagccactgcactcaacctgggcgacagaggagaccttgcctcaaatctataataaagttattttgaattgaaaataaagtcgtatgcgggccgctcccttatctattctctctaacaccacaataatgttctctatt

SEQ ID NO: 1173 - DNA, 1174 bp, Homo sapiens
agactctctgcagactgctaaaaggacctcatttgagtaaactgagtatgtgaatgccctatagagctgttacggagaaagagtgtgacggttaatactgtcaacttgattagattgaaggatgagaagtattgttcctgggtgtgtctgtgaaggtgttgccaaaggagtttaacatttgagtcagtggactatgaaaggcagacctaccctcaatcagctgccagcacagccagaataaaagcaggcagaagaatttgaaaagactagactggtttagtcttctcgcctccatctttctcccatgctgggtgcttcctgacctcaaacaccggactccaagttcttcagttttgggactcaactgggcttcctgggatcctcagcttgcatacgatctattgtgggacctcatcttgtgatcgtatcaaccccatctcagtgactgcattctctaattctcttgtgcaatggaaatgctagcatgagagaagcgctacagcaccacctccaaatctgcagacatccaccctttgatgtagaacaatcacactggccataccacatgagatccataatttgtattattcatttgagaatatatcatgatcagaaagcaacttcatattcaaagtttaaggaattgtctttttgtgtaatttaataaagtatacacattcccaaaataatgacaggaacttgctttatccaacattccttgactatcactaaaagtagtagaattggcatttattctttttctgcttcagctcctggttgtaaaccctacttgaacacctacagtcataatctgtagctttatactagaacttactataaacaagcagtacaacagggaccataattttccacgaagaaaatgcactgtaggagacatacctggttctcatttaacttcagaaacatcagcagatacccaagactcttcaaaaattgattcactgttttgagaataagttgaagttaaatagattctttcatatggatgcactattgtatttaaaactggaaaggctttggagtagcagaaacaagtaaaagaggaaatattttgctagagaatgtgaattgtactgatggccattctggatttattttagaaagctaatgtatcacagtatggtaataaaataaaagggagaatgctgccctg

SEQ ID NO: 1174 - DNA, 922 bp, Homo sapiens
aattgcaggtccagtgttaagaaggctaaacggatttttgacaaaggcattaagaacataccctggggaaagaacagtctcttcaacaaatggtgctgagaaaactgaacgtgcatatgctgaagaatgaaacaataccccacacacaccatatacaaaaatcaactcaaaatggattaaaaacttaaatgcaagactggaaattataaaactgttggaagaagacatctaaaaatgattcaggacattggtgtggacaaatattttatgaataagaaagatctcaaaaacacaggcaacaaaacaaaaataaataggattatatcaaaaaagcttgtgcacagaaaaggaaacaacagagtaaagagacggcctgcaggatgggagaaaatatttgcaaactattcatccaacaaggaattaatatctagaatatacaaggaactcaaacaactaaacagccccctccccaccccgccaaaaaaactcaactacaaaatgagcacatggtctgaataaacatttctcaaaagaagacacagaagtgggcaataggtatttgaaaaatgctcatatcactaatcagggaaatgcaaatcaaagccacaatgatagtagtccagttaagatgcctactatcaagatgacaaaaaatcacgaatgctgatgaggatgcatagaagagaaaactcttatacactgttggtgggaatgtaaattagtatagctattatgcaaaacagtatggagggtccttaaaacacaactaccatatgatccagcaatcccactactgaacagaaaatgaaatcagtatattgaagagatatctgcactcccatgcttattgcatattacatagcaaagatatggaatcaatctgtgttcatcaacaaataaatgaataaagaaagatcggccg

SEQ ID NO: 1175 - DNA, 624 bp, Homo sapiens
atagctgcagcgacatctccaatactattctgaggtcctggggattaggatttccacagacagatttgaggagatgcgattcagcccataccaggtgttacatggttttaacccacccacaaaccctgcaagaccttcaagcttgactctccaggggtggaaggggatgcatcttgccctaattcactcagccagaagtggccgggtcacctctcattccccagtgacacgttttccttccacgtccacagcagctgaaatgtcctggcagtaacctgaaaggcagtgagtaaagggccctgggagccccgtggttcagtgtcgcccgggtgctgaggagaatgtgaggaaacccaggagaggttccctccactcaggacgggtgcagtagtgttgggctgttgttctgacacccaggggataattgggcgctgttccagtctctatcctaaagaacatggaaggaactcaacctcaagattcaagattccttaaagattcccccagccacctctgggacagcaaggacagggaggggaagggaggccctgctgttcctggaggcagctgtgtccctgccttccctggagttgcatcaattttccaataaattacgatcggccg

SEQ ID NO: 1176 - DNA, 751 bp, Homo sapiens
gctgaggtggtctcagatggagatgaggaacttgttgggaactggaataaaggtgactcttgctatgctttagcaaagagactggtggcgttcttcccctgacctagagatctgtggaactttgaaattgagagagatgatccacgggtatttggcagaagatacttctaagcagcaaagcattcaagaggaattagagcctaaatagtttggaaaatatgcagcctgtcaaatgcaatacaaaataatcccccgatttctggggagaaactcacacctggctgcaacatttgcttacctaacagggagcataatgtatacctccgagacaatgtgcaatacgcccctacggatttacatgaccttgagcggcaatcctggtagaactagcctatagcctctattggggagaaattgttttcaaggcgttagttatagagcggccccgcggcaggaatcactttttcccggatgtccttcccactaccatgctgcttccgctttatatttgcgcggttagcgcccattatgttgtttgttttcccgcccgcgaatcacatataatctcgtgagtttcacctctccgacggtacttttttccgctccgacttaatttgtaccccgtttacttgtaacgctgctcacattaggtagttatcgagccgttttttattatagtaggggattatgcctctacagaacggtactagagtattagacttgatcaattagctctcgaaagaggtatttg

SEQ ID NO: 1177 - DNA, 882 bp, Homo sapiens
cggccgatcgtactttattattccagtctagtacattgtgatggtgctagctaggcacaatctcagcaaggatgttgtacaacagagctagtagaacaagctagattactcctgttacatccgagcctgatattcactacagctctccccagcacgtggggattacaattcggattacaattcaagatgagattttgggtggagacacagccaaaccatatcattctgccccgacccctcccaaacctcatgtcctcacatttcaaaacacaaccatgctctcccaacagtcccacaaagtcttaacagattccagaattaacccaaaagtgaaaggtcagacgtgcgttccacctatgaacctgggaaatcaaaagctaagttaacttcttcgatgcaatggggatactaaacttttggtaatacacccattgtaaatgggataattttgcccaaataaatgggctataagccccatgcttcaatagtggcaaaaaatgaaagtattacgtaccgagaatatcttacttggactgtatgatgaatatagtcaggtcatataagtattataaattgcacgaagatagaccgcagccatatattgtccttatagacttcatatgatacaaaccctgctgttcgagtcgagagttgattctagattagacacagacataaaacgacattcatattctatccatatttggtttatcccaccatacagggtttgttagcaatataaagtgcatctgtttactttgctataggctatagaaacaatgctaatatatcaccgcttatcatatatccatcctggcaaaattaccacgacctacgagtatggcgaatgaacagagttaaccacattcagacatacttatg

SEQ ID NO: 1178 - DNA, 248 bp, Homo sapiens
agaaatagcaacactttcacctcccgaaaataataaaaattatcactggcctctgggtttctttcctcaaaatcaacgttgtggaacccaagatgtgaaggtgaagtgctcacacccttaaaagttcttttctgaaaaacaacttcctaccaattgactccagggggttactgagtaagagcaacaagaactaagaaacattgtttggtacttacagaagatcttactactataaaataaaagaggat

SEQ ID NO: 1179 - DNA, 220 bp, Homo sapiens
aaagctcaacgacatgcaatataacatgtttagaagtgtgtgatgtaataaccagactcttcagcagcagaaagcaaagagttccataagaatattactcttggcgggacttagtagaataatgtaagtccaagaatcttgaattatatacattgaaatgaggcagtatttctagaagatctgagaactagtacttttatacccgcaaaataaagatgga

SEQ ID NO: 1180 - DNA, 1146 bp, Homo sapiens
caaacatagaggataaataaagaatgaggtgtcccccaggaccatcatggaaaccccacctgtgcctcttaaatagggaacgaccaggcgcatatcagagagagggatgtggggggaacaagaaactaaccagcctgcaggagtcgctggaggtaatgctataaatcggccaaagacaaatattttcgccgaggagaatttggaaagtttcgcagtatataaaaaaagaaaattaacagtctccatcataccatttatcagcaaccattgttagcacttttgtgtatttatctgcaagtacttcccctgctccccctctcgcttttagataatttacataatgatgatgatacactatgtacagtttcacaccctgctgttttttccttaacatacttgcctaaggttgttcctatatcattaaaaaattctttataaaatacagtctttcgaactttatactcttagagagttttgcacaattttatttgcacatgcaattaaacattacattatttgtgtagggtttcagttatactcatatgggaaggtcttagtactcactgcaaaacccatgttaatggcctttatgagtcattagagaacttgccccttaatatgtccaaaaagatagccatagtaaaatcccttatggacccttcttcagcagagtgttttacccagacagaactggactccgaagtcagggaactcttttggactggagaagaggtagctcctctggacccataggcccagggagcctggggcagaaaactggattccaggactaaggctttgagctcgtagtctgacagaggaggaatggaataatttaggaagttaatgctgcgtagctagaaggtccctggtcaattggtgaaaagaaaagtcaacataggtctgtaaaactgcttcaatgccaaggtgaaaatttgcctgctttggagtcagagagatgtgacttctgatcccacacttagaaactgtgtgtgactggtcaagttgcttaaccttctgagattcttttttcatcaataaaataaggcagatagctgtacctacttgatatgattgttgggagaactaaatgaaataatgtgtgcaaagcttttaatatgtcataaataaatgacgatgcggccg

SEQ ID NO: 1181 - DNA, 1153 bp, Homo sapiens
ttatgcttggagaaccatccagataatgggaaaagaagtgagattaatcgataaatgaagcattctcacttaatgaaaacaaaatgatgcttaaatgactcactatacagatgaaggtttgtcatggcgcaacagccctgtctatacgcagtcaccctacagcgactgggtttataccatgacatcccagtctcgcctcaccacaggtaactggcaagtcaagagcagctaatccaactattcggtatcctatggcatgacctggaggaaaaacaggagctgcatggtgtagtcttgcatatgaattgatgaaatcttaagctaaagaggtgtcagagtccacccccaagatgtccctggagatctccacctcctagcctttatgtcttgtgtcgtcccctcccacagtgaatgggactgacctgtggcaccaatagcatattgtagaaatggcaacatgtgacttccgaggctgggttataaaagcgagctgcctccgccttgcttgctcttggatcactccctctgggggaaggaaaccagctgccatattgttaggacacttggcagcctatggagagcccacatggtggcaaactgagactcctgccaacagccagatgagtgagccatcttggaaaaagatcctctatccccagttatgccctgcaatgactacaactctggttgttgtcttgactacaccctcatcacagactctgagccagaaacacccagctaaactgctctgaattcctgatcaccagcaactgtgtgagataatgtttattgtttggtgccactaagttatggggtaattagttacagagaaatatatatcaaatataagagatggcaccctgaaggcatcttttgggaaattcagggaagatctggggctatcaaggacccctggtatttatacccctcatgatgtaagtcccatctgtatgcactaagaaaggaggtctaggggttctcatgggtagttaccaggattgctatgtctggaggcaaatatgactaggaagtatattttggtaatgctctggcctattgggtagagacacataatgtagaatcatgacataagaaattagtcaaggaaaagacacaatttcaacccatatgtaaaataaagcaggatcggccg

SEQ ID NO: 1182 - DNA, 767 bp, Homo sapiens
agtcatctgtgcttggaagtttattgcagttctgatgttgaaggacattatgccaagagactgcacggagagccttgtgtactgcccttgtctagatatgtgctaccaggaagtccaagaagttaatgccttgtggcaccaatctttaactaatagaagaagcaagtgaataatttattgctgctttcttccgttccaaaggtgcggttccaagaacacagtgttcctctcttcttggatatgagaatgcagaaagaaggcaccatcttggaagcagagagtgaaatcgcatcagaaactgaatctgcttgcacctggagcttggacttcacaacctacacaaccttcacaaccctagaactctgagaaataaatttcttttatttataaataaggtattttgttatagcagctgaaacagactgaaaccctaactttgaatattttatgttattatgcatggtatattggaaagtatatcgcatgatgatataaatatggtataagatgggatgatatagtgggtttgggttctggctctgacaagaatttatataactcatctgtggaaaggtcttgggcaataaaaccctcagagaggattttattattggattaaatactgcccccagccttcaggaagggggctaaccatttctagggcttttggggaaaaaaactcagagtactcaggggaatgagaaaaagaatgtttcttctttcaaaattctaaaccactatggggttgagaaataaatttgcatctt

SEQ ID NO: 1183 - DNA, 479 bp, Homo sapiens
ataaatggagatgagcaccatcctgtacatctgagaaggctggatgctagatgcattgtgatgataccaccttctatgcagtcctctcaaggggcaatgactttctctcctatatcactcatccttgaatacagcaacagtacatctttcttttcattgccatgttcatatatggcaacacattctcttttaaaacatacagcataggaaaagcttgtgccatgaccttataccactaattactatccttgttgcaggtatttctgggaatacttgggtaactcaccctccattttagattgtaaacccagctactgtaattttctccaccactaatcttctctttgagtgttttcgatatcttcaagatacccaatttcctggatacactaagagtagagtaataagagcattctaccccaggtacaggtaataaaggtaaaattgtctttggaggattttaaaacaataaacaacga

SEQ ID NO: 1184 - DNA, 640 bp, Homo sapiens
ttaggctgtcttaactgtgcattacagtatcaccagtgccaccaccagcaccagtggcagagcacaacttcctgagcgctgcgaactgcattttcctggatgcgcttttccaggagtgctggtacagttggcctttgggggaacattaacaccatttggaagtttcttgggccaaatgatctttacatgactacatcacctgtaagagaactcttcaagagctagaaatgaattactacttgaattatttgaattgaagagatgagaatgaaaccccaaaagatggtggaaccataagatagaagccgcctgcctgcctgaatcacttgttgaaaaaacttctcatggaccagaatcatccaagttgggtcatttatgaagccagaaatcaaaagtaattatgtttcagtcaatatgcatttctgggtctatttgttactatacccaacctaattaatacaataaattgaatcacattgttgtttgcatatttactttttgacaaacctactaatgaattcagaatcaggtgacaaatacaagtataaaagttatgcttgttaatttaggagaaaaaggtgtttcttgatttcttccacttattaaaattacattcctgctaactcgaaaaaaaaaaaaa

SEQ ID NO: 1185 - DNA, 778 bp, Homo sapiens
  misc_feature (1)...(778): n = A,T,C or G
tttgattttcatcgtaaaacaaagttggtacaccaactaggacttagttggcagtatgaagaagcaagaaagagatggcaccttctttctgtgtatccacatggtaaacggcaaatgatcaccctgaggcctgtttcataaggacaagaattctattaatgagatcttcacagtcatgaactaattccctcccatggatcccacctctccataccaatgccttggagttgagagttccaatgtatgaaatttgggggaaaaaaccattcagtctatagcacagcaatatatgtttgctttgttttattgggaatcaggaaactaaaaatacaaagaatacgcaatagagccaaagtctgtaacatactgttacaaatatacatactgtttgttttggtttggaggcatgtctgaagatcacatggaaggaagggttagctcagtcacggtagcttgaaaccaatattgcctgcctatttcttccttcatagcctgtgcatgggaggtgagtatgtttgtggacattgtcatttgaatatagtttaggcctttatttgaatccaaaggcttaattcttttaatgtagttttcattcccagagccagcagaatctaatttaaccccagtgattcttaaatgaggccacactagggcatggctggaaggcagtttttgatgtcacaatggattgtggtgctaccgacatcttaggggtaaaaggccgaggatgccactgacattcttcaatttagagtggtncctgcaaaagataattttc

SEQ ID NO: 1186 - DNA, 520 bp, Homo sapiens
  misc_feature (1)...(520): n = A,T,C or G
tctctaagttatcaccgctacagactattggctgagcaatgaagataaagcaacaaacaagacaaagttcctgcaacgtgtggaacttccatatgcgtgaagaaatgaggcacttgacaagagattgtatgattccattgcattgtgttggaacgggaagcaggcactgaggagatcttttggtgacagattaccaaaaccttgagaaagctttgcatactccacattgtaaaagtgctctatatccagaattatcttgaagatactgaaaggaagaaatttatccggaaaatacccacagattttgtggagaaacagccatggaaagaaaaacattacaacacaatatgacagncaccataatatagctactgtatttataanatggatganagtatganggaagatgcgcctaccctttggaccagaaaaagaaagtcttcttagaaattggaattgagttaagaatgggaattaagtaaacataataaattatttaaagggataatataggtccgtg

SEQ ID NO: 1187 - DNA, 393 bp, Homo sapiens
tgtggatctgccacaaacccttcctctgaaactccaagccaatgatattgaagctctttgcctctttccaaacaactcgtgctgcagactggggagtgaccccagaacaaaagccacagaaacacagatcgcaatcagcacatgttattttttaagttgaaacctatcacccagtgtttgcctacagttgtttgttccaatggttctttatgtagttgtcttttgtaacttatcccaagttcataaattttatctgacattgatttgtctactaagaggcactctgccattgctgagactagaccccttcatgaattttaaaattcattttataacattgtgcgacttctctatgataaacaaacattagcaataaatacctgatgcgtccag

SEQ ID NO: 1188 - DNA, 773 bp, Homo sapiens
cttggccgcatcggagtttatttgtctgccaaatataggggcacgttagtattgcggtcagcttaatattatttagaaggcattaaaggctagaacagtggtgcaaaaagctgtaggtaaatctcttctatgctggctgttagcagcgcactgtgatgctatataattgcagcaaactttttttttggttctgctgcactgcagctcataaagggagcactcattctggaaaaaaaaaaaaaagttaaatctagcaagtggttagcaccagcattccaaaaaacttcagcagcctgtgttttcagcctctgctccaacttcattgctctttggaatcaagagcttcatgttcaggaatagccaccattggatgactcagctgttcagaaaagaggtcgctgttatcttccaagtatttactgaaagggttgggttcatagacttcctcctcttttttcagaaatattctggattttacaggtactgggcgaattactccaggcttagtcagctgactctcagatactgtataagttggtgaggagagattcgcatatttgggttctcgaccagctgctcttggaagagttgtaggagtctccactggtggtcctaatgtgttgtcccttgagaccctttatgtcctggctggaatatcaaaagagcttctggctcaaaccaatgtgcttttttagaattgacaaaaaacccatcgtccgttgacctagcaattaatatgctcacacttctttttgctgaggggcataccatag

SEQ ID NO: 1189 - DNA, 454 bp, Homo sapiens
atgctagagagtgattccagcttgcaaggtgactgtggaacagctctgatgcagcctcaggaaattacccttcttgtgggctgcaactacatccccaacaagatctggccccgatcctggaaaaccaatcattaacagctttcatttcagaaagccaagcaatttatatggactcactcccataaacacaattctgagtgtcaaccaattgagaacaattttgttggagtaatcacattttggcagcgaatgtcaacctacttaaacttctgaaaggtcaccaatccctgacttttaagcttccaaaaattctggtataaatccaccagcttgctctttttagagaggctatacctgaccagcatatctctattcactatagtaaacaataaagcacgatgcgtcctaatcctttttctcggcgccttcacttcatgactacaagcctgaaaaa

SEQ ID NO: 1190 - DNA, 471 bp, Homo sapiens
agggggggccccctttttctccacgggaggtgcaaagaagaatgaaatattgtgtctgcctgtgatgcacattgcttaatatgaatactaagaaaaatagtcatctgtttctgttcctgtccccctcactgcaaggtgatttctttggggttctagtactgttttacacatatcacttcctagagtcagtatggtcaataaatacattcaatctcaacagccggccaaaaatacatctgggggaaaaagtagatgtgtcatatgagaactacaaataaaattcagtgatttttcccaggagaaagattgcatagggtgggggtagggggaagaaatgtgcttggcttgaggattaggcggtatttaagaagctaagccgggtatttgggtggtctagcaaggccctgatgggaggggcttatggcgctgggaaaccctaaaccgcttgcgggctagcatattttcttgggg

SEQ ID NO: 1191 - DNA, 784 bp, Homo sapiens
gagtttctaatttagagaatgcaaaaccaaaaaagagaaagttattccggagatttatgtctgaaaataaaatatttgaaggaaaaactgtgaatgacaaaatctggcaggaacacagcaagcataagaatgattcccacatcagaaggccctgtcagctaaaagatctaaatgaagatgattttctaagtaacaacatacatacctatcaaggaaaaactctacaaggaacttcctatcaggtgacctctgaatgttggagtccatttcactatcaaagacatgttgagaccactgttgatgaactggctcaagaatttatgtaaagtaacaaaagaagatacttatctagtcaaatgtccccaaggatatttgaggaacaatgaattcctgtgatccaatccttcaatttaaagatgaagggctgaagtgcagagaggagaagtggctcactcaagttcacatggccagtcacaaagcagattttcaaagcagaacaatcattagtcggcacacaagggcaggttcttactctaggttttcttaacatttcttgtgtatatgaaataaatattagataaaaatgtttttttactgtgtaattttccattcatagctcctcttcttgctaagaatccaatagatacttaataaaaattaattaatttgcatactggctcttaaatttcctattgttcatatttttgggcagctaggaggtgtacccagaaacagaaatgttcttatgagtagttctagaaacttcttcaaaatttcagagcag

SEQ ID NO: 1192 - DNA, 587 bp, Homo sapiens
  misc_feature (1)...(587): n = A,T,C or G
atgagaaaactgaagcttagagaggcttaaagaacttggccaaattacgtagctagaaaataatggagttgccagtcacactgtgctttctgcccttccaaatattaattttaattgtgctattgcttggaaggacgaagaagaagctggagagtgtttggcactgaggaaaattgacaaaccaaactaagtagcagtaattcatcctactaccaacagcctgttcttgtgacgtctccagtggagagcatatgcccaggaagggagctctacccagnaaaggctgaggggtttaaaaaatgcttgttggggtttgagaaaatcaacccccatcgtgattagaaatgccttgtatttctccaacacctaatttgagttgggcccaaaggcttaataaacactcctgtgtcctcaaaaaaatggcaaccgaccgaccgaaaaactttgtgagatgcatattttgccttattcaatattgagtatggccgggtgcgccctttcccttgggggggggaattattgcccccgttaatgcccgccaaaaaaggccttaggatggggcaacgtactcaattactaaagggtgt

SEQ ID NO: 1193 - DNA, 744 bp, Homo sapiens
  misc_feature (1)...(744): n = A,T,C or G
agttgcacacagggagccgtgggggctttccctctccagaccccagccaaagaccaccgggcaaaggagatgggaaaggccagcctgctgcctccaagtgggaccagctctaggtacacttcacactccagagcccctgggggcccaggccacctcctggccgagctttccctcctcacaccgcttctcctgagagcacccccatgcatcatcagaacagaagtccgcatcccagcctctggggaacccagcctgaggcaggaactgtttcagagtcatgaagccagcaacgagagaagccaagaccaaaagggaagcctgtctgacttaaaatcctgccttctaaaaagtaaatctgntggggtttgactgtggcctgcccctaatacatnttgttgaaatcctaacccccaaggtgatcggtgttaggaggtgggggtctttggggaggcgcccccccccataggggtggggctctcatgactgggattagtgcccctataaaagacaccccagagagacccactgccccttccaccacgtggggacacagtgaggaggtaccgtgtatgtcaacaagacataaatgtttgttatttataagccccccccgtacgcggtattatgtggtaccagcccaaatgagctaaggcaaaatccaatatccccaaatgtaaaataaaatcagatgcgccggaagggccccccctcgtcgacatcgctctctcccccccgccgccaccg

SEQ ID NO: 1194 - DNA, 783 bp, Homo sapiens
gtcccacccaggatgccacactgaatgtagtcctcaagtctcctgaggctcccctgggctgtgccagtttctcacactgcccttgtttttgatgacctcgacagttttgaggagaactgaccaacagtttctgtagaatgccattgaatttgggtttgtctgatgcttttcaccacgggttttggggaggaagaccattgagtgccattctcatctcaccatgtcagagacacctactgttatggactgaatatttgtttcctgctcaaattcatatgttgatatctaaatcctcaataggataatatctggaggtagggcctctgggaggtaattaggtcatgaaaatggagcccctcatgaatagaattagcactgttgaaataaaaactttattttattttaaaaaaaaaaaaaaagaaaagacgaaagagataaaaaaaaatagaatatgtaatacaaatccaagcccctttgttttaaataaggattaacctccgctcccccctcctttcttgggggtgattcatgcgctccccgctcaaaccatgatacgcctctcgaatgggagcctcccctataactattttccgtgcgacgcgccgtgaactacttttttcagaggcgcacccacagtatattacagtgtggataatcggcgcacggggcgttagatgaccgtgggcccgattgtggtggtgataagagcggttttatagccgagaaggagtgcgcggtagtagctatgatagtggtcgctattcattgattcacccagatttt

SEQ ID NO: 1195 - DNA, 780 bp, Homo sapiens
aggtgaagatcaaatggtaccttgtgaagaaatagcatgcgacacctgtaaggtggagagttctacaatgaatacagtcaacaatgagtcaagcttcactcacaatacagagagcttgctacaggttccatctctgcttaaccatccatgacagttctttccaaattcatacgactctctaggtttatacataaatgtagctattattaatgatattacataatgaacctccaggcactggagtgacagcacagtggctccactgcatccaagggactccatcgttgctgttaagtgatgaaaaaaaaaattttaaactccctgacctcaaactctacatcttttaagaaaaaatagcaataatagtgactatattgttggcctgaggattccatgagttaataaataaaattattctaccccactacttatttttgccctaacacttcccacatatataatattttatagatataacccatggttttattctccataacattttaaaatataatttaaaaaacctcgtgaatttttttatgggccttaagaagtaatcttccttctttacagtgttaacaaatctttatgaaaggcttctgagtttttttttaaaccggggaaaccgatatgcaccaaaacgctctgcggatgggcgttttcctaaattaataaacgtctggttcgtaaacatattcacccagaattacgcgccctattttccaacattctattaaaatatgcaataacaaccgaaatactcaaaaaacacagccgcgt

SEQ ID NO: 1196 - DNA, 478 bp, Homo sapiens
tgaagatcaaatggtacttgtgaagaaatagcatgcgacacctgtaaggtggagagttctacaatgaatacagtcaacaatgagtcaagcttcactcacaatacagagagcttgctacaggttccatctctgcttaaccatccatgacagttctttccaaattcatacgactctctaggtttatacataaatgtagctattattaatgatattacataatgaagcggaaagccagggatcgtggttaaaaccactctttctgtgttctagcctccaggcactggagtgacagcacagtggctccactgcatccaagggactccatcgttactgttaagtgatgagaagaaaaattttaaactccctgacctcaaactctccatcttttaagaagaaatagtaataatagtgactatattgttgtcatgaggattccatgagttaataaataaaattattttacaacactaaacaaaga

SEQ ID NO: 1197 - DNA, 784 bp, Homo sapiens
catcaatcatccgacaaaagcattcacttacaacatcattgtgctgtgtttctcttgtcaaacgtcaccattcatcttagcagactacaaaaagacatgggaaagaccaaaaacacatcgctggatgccgtggtgacagatttcattcttctgggtttgtctcaccccccaaatctaagaagcctcctcttcctggtcttcttcatcatttacatcctcactcagctggggaacctgctcattctactcaccatgtgggctgacccgaagctctgtgctcgccccatgtacattctcctgggagtgctctcattcctggacatgtggctctcctcagtcaccgctcctctgcttattttggattctactccttccatcaaggctatcccgtttggggggctgactggctcaactgtatttctttcacttcctgggcagcacccagcgcttcctctacaccttgatggcctatgacaggcacctggcaatatgtcaccccctgcgctacccactgctcatgaatgggaggctatgcaccgtccttgtggctggaccttgggtcctcgcttaatgcatgggcatatccagggcaccttgaccttgaccctgctataacggggggccccaacacgcgcactactatcatccgcgcatatccgccactctcgcaccgggctgcccgtttaccacccctactgcactttttacctcctgcgccctctcggtcccccttatcgttcattcattccactcccccttacctagaacctggtcattgcgttct

SEQ ID NO: 1198 - DNA, 813 bp, Homo sapiens
  misc_feature (1)...(813): n = A,T,C or G
acccaaaagctacaggagacaagaagcaggccaaaagacacactggcaacttctatgtgcattcaggggtgagcatcctgaagcccagagctgcaaattctacaagagaagcctcctacctgtaggtttccttaaatcttattctgctccagaaaggcattcaagatgagttgtgggattttaactcatgagaaacatgtaaggcacatccaatgctggacacaaaagtcatcactgcaaagtatgagctggagcaggaccaaacacagggagtcgtgttccttcttgncccaaacnaaacagagacaattacttttaaagatgatgcanaaaatcagaagaatccaagaaaganattnaaaggtcttcataattcggacactagagatagccacaatggtcttttagtgtgtacacttttgacaattttttntgtgggtggtgattgtgtattgtgtgtgtaccgtggacaccccagatgagtgggggtgatgaatcacctggtctccataattgggaaacatttgatgcctaatatcctctactggttgtactcaacatttacattattgaacatgtttggcataatttatatttataccaagactcgtcgaaaataattttttttgagttatttccacgtcatgtatataataaatgtatattcgtgcccctttcccttaattgaggagtaagttataaacccctgttaagtgacctgctgccctctcggtgtttacggcaatatgccagccgggtttaatttcgctatgaagcgacaggcacatgtatcctatgtatgcccccacaaga

SEQ ID NO: 1199 - DNA, 1054 bp, Homo sapiens
  misc_feature (1)...(1054): n = A,T,C or G
tgtaaaaggggaccaagagggctgctagccgcttgcacagatgatctcatttaacccatgagggtaaaatgaataaaggaacaataccaacgtttcaaaacgactaagtctttaaaaatcaagtggatcatcagagctggaatatggcaacctaaagaaaattcacagagcctaggaactggacaacagtcccctaggaagagggcagcatgatccaggtgcccaggtcaagttccccggtctggagactaagatacagagccagattccaagcttcaagggagctatttacaggaatgagattagcaggcctatctgcttctcacccttcactatgacctacaatttagcctctggtaatactaaaattttcttacacttcactttatgtctcaatttgtttagaattcttggagggaagagatgtacttaatatgtacaaaatgttgcaaacactgctctgggcccctgaatacatatttatccacttcacaattctgcatggagtttagagtgcaatgagttttgagctgcattctngaaattggaacaaggtaaagagantaagcattctaacaaaaaacaaggctgtgggcagtctcaaagttggcagtgctcattatgcaaataggaattgatccataagggttcactggagaagcaagagaatccttctccctaccttcagctctcctttcctggagtggattaggagattaaagaacctctgaggggcacagtggctcatgtctgtcatcccagcaatttgggaggctggggcaggaaggtcactttagcccgggagaccacaatcccccccggaaacatagtgagaccccacctctacaaaaactttgaaaaattacccaggcaaatatatatatatatttacatatgcatatgtagtcccagctattcaggaggctagataggaggatctcttgagcccaggaggttgaggctgcacccccgcactgattgcaccactgcactccggcctgcgtgacagagaaagaccctgtctcaaaataaataaataaacaaggatcggcca

SEQ ID NO: 1200 - DNA, 563 bp, Homo sapiens
aactactgctctaaggaaaaaaggacagctacatgaggaccacacaactcctggaagaggtttccctggcaacacaacttttccattcatctggttgcagtgttttcatccagtagcctgtcacctcactcaaaagcagggcaatggagagaaagaaacttaccaagttttttcttttaactagagagtagcctacttattgggccctgcaattaatttcagtactccaggcagatttataaaggaagctgctggaaggaattcattccctttttgctgttctgccttccaccttccactgtgtgaggacactgcaagaaagccctcatcagacaccaactgccagcacctagatcttggaattctcagcctccagaactgtgagaaacacgtttctgtttttctataaaataataataataaaaaacttccatgcaggaaaaaaaatcaagttcaaaggtcctgtggtgagggcataccagctttgtttgagaagcagtaatcatgcctgtgtgactgtaatgaaagaataaaagagaaatgagcacagaaaaaaaaaaaaa

SEQ ID NO: 1201 - DNA, 332 bp, Homo sapiens
tctctaattatcaccgctacagtgatttcactgttgaaaatggcccccaaacatagtagtgaagtgctgtccagtgtccctaagggcaagaaagctgtgtgtgctttacagagaaagaagaagaagtatatgcagagcttacaatcaaattgctcctgtgatgattcataatcattttttaaatggcacattaaaatgtatttggcagttggggaaacttgttcaacaactggttatttgatgattttaaacaatgattcttaatttacttacgggtaaaatagaatgtatttatgttttaaaaaactatttttcacaaattcataactgaa

SEQ ID NO: 1202 - DNA, 782 bp, Homo sapiens
  misc_feature (1)...(782): n = A,T,C or G
aatactagacattgggaaaaaaaacttggacttgggctgctgtaaggataccaacttcccaggagctcatgaattgacatttgcagtgcacctggggaggtgtcacaccatgcccagagcctagagaaaatgacagggacatgagcatcacctggagacaagatcttccttgtggggtgaaggactactgattgtttggggacatccgaaatcactcaggattgtggtgaccagttgaacagagatatgccaaaagcaggcagtgatttatatccctgcagagaatagggatgattcagaagctgagctgagtcattgaaaaacattgaaagagaacacatgagagccgaagagaatctagcaatctgaatgtcctccactctctaaaagacgttcagatgacccccagagagttgccactggttgtgctgtgtccactcagtcaccagtcagaacctgcagccagcagcacctgcttactacaaggtggttgaccatggtctgtggacaagagaaggagtctcgccctgtcaccaggctggagtgcgatggtgcaatctctgctcactgcaacttccacctcccgggttcaaatttctcctgcctcagcctcctaagtggctgggactacaggtgccttgccnccatgcctggctaattttttgtattttagtagagatgggggttaggctggtcttaaactcctgagctcaggcaatctgccctcctgagctcaagcaatctgccctgcctgggccttccaagtgctaggatacaggcct

SEQ ID NO: 1203 - DNA, 709 bp, Homo sapiens
aagagtggggatgaagtgaggagacaacatccttatcaatgtctgacttctatacttttcagtccttaaggctttgcttacaatctgccctgtggggatccccgagaaatcttggaagctgtgttactggcgatgatgggacaagagattggacacacctcgttataccccctcgtcactaactgacattatttattgcttcttatggattaaacagaaacgagccattctgaaagactccacaccaatatcaacaaactccctgatgctttccctccctgtctgcagtttcaacacaactaaccagtacttctctcttataagaccatcaaccactgagtggttctggcaagtctatggaggatgcacagtgaggttttttttgtgtcctgtttttcaccttttgacatcagagggccaaaatctctaccctcaaatcatgctaatgctgccatgggacccatggagaggcatgaagctcaattgtacatatgcatgcttgtcctttcataaatatgcattactcctcttatagcttatgaatatgcatatttggccaccccattcagcataaatccctgtcttgttctcccaatccttgaagtgcctgtttatagcctctaggccagagactatgcttcccagcctgtcagaatggccaccctgcagacggcaagccatttaaagaaataaagccgtatcgcaaagg

SEQ ID NO: 1204 - DNA, 1195 bp, Homo sapiens
cggccgatcatgatttattgttctacttccaaacccagaagggtcctcacatttaccaacaacctggaataataaggttctgacccaaattttaacaattgaggatttttgaatcataaatgaatataccagcaggactgtttaggatccttttctctgtttccttgcaatgttattcactcctatgttaatttatacctgcattcctcaagtatttactatgtctcaggtactatgctaagctttggatatgcatgactttatttaacccttattatgactctatgaatgaggaactcatgccttttctgtagagaaggaaactgaaccacaattaagttataaatatgacgagtccactcagctagtaagcgacaaagacagccattaaacccaagcagcttgattcagactcgatgtcctttgcttttggagcagctactgtgtgcctggcactggggctacaaaaatgagatacatacagtttttgctctcaaagactaatggccctaataaagacttgcaattctaatgcaagggaggtaaccccatcacaagacttgcccatcgtaaacattgctaacggatcctcacagtctttcccactgaatctggacttgtcacgtagggttccaggaaatcactgcaattgcttgaagttggcatttcagatgacgcttttttcccgttcttgctacagtggaaatctaaaattattaatctttattgcctcttgccttggcctgctgcagtgcaatctttaatccccatcatgtattaatcattcctctgcaatataataaagctgcttctgtcatgatggcattgaatgtaaacagtcccaattactggtaattctcaactgttttgcagaaagaacaatgtggtatgatccatgggcttgggatgtgagatcagggccaattggatgaaaatgggaagtcacttcacgaaccagacacaattgctcaggcagccttcatgggtggtgaacatttcccacgacggtccgttcccacactccaccttgcacccttctcaaaacagtgtcctcaaagcttctaccagtcatgcacaattggctctggcatgaccttaggtcctgtttataatttggtattttattgccgcaatgagtccattttgtcagccttatgatctctattttaacattaatgctggtcggttgttgtgt

SEQ ID NO: 1205 - DNA, 780 bp, Homo sapiens
ttatcctggctcaccttccgctggacacaatgacttctgctggtgaagggtagttggaataaaggtgaattaaactgagatatagtaagcaataaagaatctgtcttagaaaagactggatgtatttctctgttctcatgctgctaataaagacattccaaagactgggtaatttataaagaaaaagaggtttaatagactcacaattccacatggctggggaggccttacaatcatggcagaaggtgaaaggcacagcttacatggcagcaggcgagaaaagaagtaccagcaaggaaaatgccagacacttataaaaccatcagaccttgtgagaactcacttgctatcacaagaacagtatgggagaaactgctcccatgattcagttatctccacttgggcccttgacacatggaaattattacaattcatgatgaaatttgattggtgacacatatcccaaccatatcactgggtatcccgtaacccaatttatacctttaggttgaaaacccatgtagaatgcattgtccaccctttcttaattttaacctataaattgacaagttacccccaggatggtattcacaatttcgcgttaacccttttatgggccttcaatgcacatttcccttgccttctcccccatatgctggctgccattgactatccccctcccacggcccattgttatttattattccatcctttccacaaacccgacctttactccccgcattatatctgcaacgaaccccatccaatacccctcaacac

SEQ ID NO: 1206 - DNA, 576 bp, Homo sapiens
aatccagctgtggaagtctgatcgttttggaggaggaagtctagcacaatgttttgcatgcagtgtgtggatatgatctagaagtcagttcaaggactgcaactcatccacaagaaagtttgctcccatcctgttcaaagacccactgccctggagattagaaatgacatactaatacaatggattttaatagaatctttgtcgatggatttcaaggcattcattagcttattcaatcctcatgatttgcctaagcaatcactttctaatcttggtgggaggaatgccctcctcactcctccgagaaagaatagaggagagaaaatggcaggcatccaaaggattaagagatgggtccaaatctggtacaggagtataaaaatataaacttaaaaatcagaagggcatccttatgataattaggacatcccttctgaaaatatttatatctggagaagaaaagttaccaatactcaaaaccttattttcagagggagaaatgattacaaaaaaaaaactttttttccaaaagctgatgcataatcatcatggacatgtcactctagaaatgaaccc

SEQ ID NO: 1207 - DNA, 371 bp, Homo sapiens
acgctgattgttctccactcatatctcccaccttgatcacctcatcaaccactgcctaacttccaagagaaagccaacccctggcttcttggcttcttttcctgagggtgctctcctgtccctgaagactcatttgccaccttcatgacagcctgcaagagccaggaaatgaaccatcatggagcagtcctcatcaaaaacatctaatgaccaatggcattgacatatggacactcatctacattcccttcccgtggcagctagcttagaggcacctgttttgactttagcaactggcctcccttccctgtctcatttccccataaccccatgtatttctttcaattcacaaataaaccacgatcgccagg

SEQ ID NO: 1208 - DNA, 1018 bp, Homo sapiens
  misc_feature (1)...(1018): n = A,T,C or G
accttggaaaaatggttgtgctgaaaggaaggaaggaaggagaaaagaaaagaaaaggaagaaggaaggaaggagagagaaagaaagaagaaagaaaaaggagaaagaaagaaagagagaaagaaagagaaaaagaaagaaaagagaagaagaaagaaagaaaaagaaagaaagaaagagaagagaagagaagagaaggaaatccaaaaactaaaatactaaacactaaaaagagcgcaagtaaagcaccaaagatacagtttcactaaatcacaaaatcatctcaagatgggaggccttttctttaaaacctacatcacaggtggcaaagacagaagtgtgggaaaggatattaatacaaaggatttgacaatgtggaaggacactaaagcaatacgtttattgcctgggcaaaaatcttttctctgatggtgcaatattgccttaaggctttatatacatcttaaacacaatggactttcaggagcacacagagccctagggccacctttatgtttaagtagtcattactgtatctataaactatacaaaatggaggcactgcatttctattttcatttgtttctcacttacagaagacaaccccctgccccatcaaccaacttagaaaagaacatgggtgtgagtcaacagactaaccactagctcataagattgttcaaggcctaaccagggctataggaacagttatgtaccattgacctttccacccctccttgtcaccaacaccactcccacacacacatantcatgtccacctattttttgtttaacttaacaaaggagcagaagatataatcaaaatatgtgtacaattgtataccattcacttctctattaattaaggctggtgtcttgcattgtaggacccccagggattcccntaagggnnaacttgtcactagctccccatccttttttttntactgctcagtatcttttctcccntgatgcccatattggaaataaaagtaaaaataaaactggatgcggccag

SEQ ID NO: 1209 - DNA, 773 bp, Homo sapiens
tccggccgatcttagtttatttacaatattcaaaattacaattttacaatatccctgtaactctcaacctaaaattggaaataataataagattcaaactgggaatcgttcttgttttagcctttcaaccagatttcactcattggcagtgattctttcttctgacccatttcaaaagctgactcttttatcttgaattgattccaggtaattgtatctgcatctgaccctagggaaggaacagtcgtttggaaccagtgctatagggcaataatcaggaactgtctgagacgggcagtgtccagtagctaccacatgacaagagatatcagaattagaaaggtccctctgatattccttgctcttgctaagagagacatccggtgtcagtgattccatctcctcgtcaggtcagttttccttgagagatttcttatgtaacaggggatcgatctggaacaaatggagcccttgggagttcagcaggggtgggcccaggaaagacttggatggaggatgctgcaggatgtggtggcggtgattcagtaggtggccctcttccatcccagggtggtgctgagccaacttcagcctgggttatggagcactgagctacaggagaaccatctattggatgagacgtatgactgaggttctgaccacttctgctcattaaaaattccaaggcatttttataaggttaaggatgcatccttgtgttctacaatcttgatccagttgggtaggaatattactttttagtaaggtcagcg

SEQ ID NO: 1210 - DNA, 367 bp, Homo sapiens
ctagggcacacaggatgtccctcatgtctgcaagcaacacctttcatagtgctgcattttctggctgccagatggagcttttctttcacactaaattgatttctgtgaaaagtctttgtcacctgcaatatgatgatgcttctaagtctatgcaccatcttaacagaaggtccccaggtggaccttgagccatctttctgtgacccctctgtgacctctctgtattgttgcccttttttgatatttctgatgatctcctctgagactccagctgcaacatcaccctctcagaagcacagatttcatcctctggaaataaatcctggatatatagtttttaaattgctctctttgaaaaaaaaaaaaa

SEQ ID NO: 1211 - DNA, 165 bp, Homo sapiens
gaacttcagcatgatgttgaaaaggagtaatgagagaggacattcttgccttgttcctgatattggtggaaaagcttcttacgtctcaccattaaggatgttagctaaagcttttttgtaattttgaaatttttctttattctgaaaatttttaataaaaacgga

SEQ ID NO: 1212 - DNA, 877 bp, Homo sapiens
cggccgatcctgctttattgagatataattttttttaattgttttttcttttctttcttttttttttttaagagacagtctcactatgtctgtcacccaggctggtctcaaactcctggtctcaagcaatcctcccgtatcagcctcccaaagtgctaggattacaggcgtgagccaccacacccagcctaatcattttcttttttgcttatatgtttatagaatagctctggaaggtgacacaaaagactaccttgcctccatggaagggaactgagtacctgggaggcaaggataagagacatttttattttcccaattttgaaccatgtgaatgcattacctattcaaaagaacgtaaaatagttccttttctgttgcaaatatgtgccactttgcacttagccctactctaatctaccagagatacaattagaaatataacagaagttttccttttctaacaggaccatgaaggtgtttgttttgtttttaaatcttactgactctccgaaagcgccctttacctctgaggtgaagagcatattaaagggcacgaatgcagaacatgtttgtcctccattcttcctgcccatgttttgaggggatggagtggtggtgtataaaaaaagctgggcctccctgcggagagggaatgtttttccgcagctgcaccaaatttttgtagtttggtaaaacaaaacaggccagttcacctgtgtaatggtacaagccctgttgggcgatacctgtgctttgggagatagtgggaaaagaattcttggaagcgcctttaggtggggtgtgtgaagcgcgtccaaaaggagggacttgtgtgcaggggttttaaaaggtatgggggcatttggaaccgctg

SEQ ID NO: 1213 - DNA, 761 bp, Homo sapiens
ccgtctgcatcgttctttattttatgtatttcttacaataaccttatggagtagacagattatacataaggatacttacatctagagaaattaaagaacttgcctagaaatgtaaagcaagagatacagctaagattttaactttcttcctaaaaagctgttaagtgttcccacttcaatattctccttccatgtagcaccaaatattcactgttcctcttaattcttgcttcttcaatttcttgagtcagtcacaggcactatagtccaaacattcttgtgaaaattgagaacaggaaaataagtctcctagtttgtttcctatcaggtattcctgttgagagtgagcccagtgaaaaagttctgaactgcctctcagattcccttctgacaatgcagtctcaaggaagaaggccattgccgcgttgtaattgagacgagctgacttttgtgctgtctctgtgagatctgcccctggcaatcacatttcctggcccttaacttgatgaatgttggcacagcacagtgactattgcttgcaggaggcttaatgaataattgcattctgattgacttctagaccagacaaaatgctgaatatattctgtttcaatacccagaggctcttccattaacatccaggtgagttttacatgtagaccaaagtccctaataaacttaatgttagattcagtcacaaaactacaaactgtccaatgtgacttgcagcatgtggagacatcaagatcataggtgcaaat

SEQ ID NO: 1214 - DNA, 865 bp, Homo sapiens
aatgttatactgatacaaaactaaaatcgtgttttctctgtttcaacgtcaaatgtttatcagattactggtttgctcttaatagactgtaaaagttattctttacttttctacattatctgcacaaacagcaagattctcagttttactatgaaaacctatggtttctgccaacttattatgtccttgattatttaaggaacaagtttctccttcaggaaagtttcttgacgatcatgttaccacttatgtttactttcaaaatatttattatcacttgggttaaatataaagtcatctattatttcttggtaacccacgatcctatcttaattgaagttttcaaatctcctggcaacttttaatattttaccttaccaaaatcaaatcataaatatcatttgcacctaaaactgtctttgagatttcccagatggtggtccccgaaacaatcacaaagatttgttctttcacctttttaaaaaagaagtgctagaaaataattaggtttatctgtcatgttgttattgatgagttgtcaagtcagaagaaatgcttagccttctctaggttaaatgtgtataggtaaaatgttgtaaatatttcagactctgcttgctatagaagttaacagaaaattgtcagtgctctcactgacaatgatacactgctatttatcagagtcctggtgctactttgttcgatattagacaacacagcattatgggtcataatttcagttttgtttttaaatgttgacttggtcccaacttaatttgaatctagtatcttccaggccagtggttttcaactggatattcacattacttacctatgatgttcattaataaacacagatcggccg

SEQ ID NO: 1215 - DNA, 745 bp, Homo sapiens
tatagactatttgggaatcctgaacaagaatgcctgtatgtgcacaatcaccacttctattcaacagtactggaagtcctaaccagagcaattaagcaagaaagaaaaataaaaggcatccaagtgggaaaaaaagaagtgaaaatttatctgttcactgacaatatatagaatgccataaataatccatcaaaaagctgtcagagctgataaattaattaaagctgcaaactacaaagttaacctacaaaatcagtagcatttctatatactaacaatgaacaatctgagtcctatttacaatagcataaaaatacttaggagtaaatttaaccaaggagctaaaagatcaatgagaactataaaatattgttgaaatcaattgaaaatgacacatataaatgaaaagataccttatgttcatgagttagaagatttaatattgtcaaaatatccatgccatcaaaagtgatttacagattcaatgcaattcctatcaaatttctaatgttgttcttcaccgaaataggaaaaacaatcttaaaacttgtataaaatgacaaaatatcttgaatagccaaagcaattttaagcaaaagaaagaaaactggagacaccacactacctgacttcaaaatacattataaagttatagtaatcaaaacagcatagtactggcataaaactacatatatcaaccaatggaataggatagaaagcacagaaataaaccccgatgcggcag

SEQ ID NO: 1216 - DNA, 506 bp, Homo sapiens
ctgtcgatctctctttattgtgttagctcattccaatcttaggaagtgtggcagattttattttctaaaagtggccatagcagtgttcctggtcccatgtactcttccggagcctggctgcccccgtgaagaagcagcctatttcttctctccttgagcctgggcaagattttgcaattgcctagtagtagaatacagtggaagcgatgctgcatgacttctgaaaccaggtcacaaaaaatgatgtagcttctgctttctctcttttgatgtataaggaagcccaggccacgtggagaggctgtatgtgagtttgggctgactcccctagcaaagggcttagtcgacagccaacagcagccaccaactgccagctgtgtcagggagtgaggctccagatggttccagctgctaatctttgagtcttctacctggagcccatgcatgggcacggagagatgagccatccctgttgtgtgctctgtccaagttcttcattcacaaat

SEQ ID NO: 1217 - DNA, 701 bp, Homo sapiens
aattaagcccagaaaggccaagagacttgtcccatttaggtaagaagagtgctcaccagatccctttctggtttggaaaaagaaatcccttcttttgtggatgtcatctctaccatctctcggtgaaaaatatttcaagagaatcttaagatggagagagcattggaagtcatccggcccaattcccttgtgcaattcaaagcttctttgtaagaaaaatgcccccagaagtttgtttgcatcatgaagatcagattttgaggatccagtctggctcttccctgtacaaaacattcctcacaaacagaatatggacaattgttaaatgtcaaaggtaaagttattgtgggaactccttcaaaaagttcaagtgagagcccattctatgaatgaccacttacatctaatttttttctgtgctatgttacttattctgaagtggttgatccaattcctaaaagggaatatttcattaccttttatttcctatagcatccattctgaccccttttcggtttaattattccctgattccagtcttcattcactcatttatttgaggaatatttattgaccaacaactatgccaggtcccattctatgtgtagggactataaagttgaacaagacagaggaggtactggcctcagaatttacattctagtagatgagaaagtaaaaataaacacctgatctggcag

SEQ ID NO: 1218 - DNA, 219 bp, Homo sapiens
tggcccccgaaatccagctgcttctctatgctctttaacctctgctgcaagaaggggctcctggctgccaggcgttgaggatggaagagctgctgtcagtccacgctaatgggtccatgaataactgtaaggaccacttgttcacttggagcagtcaccctggactgtttcacataaaagaaataaacttctatattcctgaaaataaaaaaaaaaaaa

SEQ ID NO: 1219 - DNA, 159 bp, Homo sapiens
tgtgaaccattaccacaatccagcataagaacattttcatcatcggagagagcaacctcctgcctgcttgtataaacccttgcctccgggtctaagccctgggagagactgatctgctggccctaaaggttgtgctttctctagaaaagggcaaaaaaa

SEQ ID NO: 1220 - DNA, 541 bp, Homo sapiens
  misc_feature (1)...(541): n = A,T,C or G
gaggatataagaagatggctggctgtgaaacagtaagaggaccttcatcaacaacccaaccacgatgatgccctgatctcagactaccagcctccaggactgtgagaaataagtgtttgttgtctaagccaccaatctataatgtttttgttagtacagttcaatcgaagacacatagctaggggcatatttctccaagtcagtctcaaacacatttccacctgggcatggtggctcacgcctgtaatcccagcactttgaggggccaaggtgagcagactgcttgagctcaggagttcaaaagatagcctgggcagcatggcaaaacccctctctgcaaaaaaatacaaaaattagccaggcatggtggtacacactggtggtcccagctgctcaggaggctgaggtgggaggatcacctgagccctgaaggttgaggctgcagtgagccgtaactgtgccacttcactccaacctggagaacaaagtaagaccctgtctcaaaaaataaaaaagaataataaaaacatgatgcngacgg

SEQ ID NO: 1221 - DNA, 1097 bp, Homo sapiens
  misc_feature (1)...(1097): n = A,T,C or G
tctctaataatcaccgctacaggttgcatcttccttcaccagctttgagctttggagatcgcagcagaggtagttactggaagacaatctcaggcccacattgatcatggaagtctagcttttaaagataagtgagccaaccaagctgtaaggctaatcaccctgtgcaagtatgaatttatctaaagaggatttcatgtggaacccccggagccggccgccaaagggatgactgcacactttaagaaagttcgtgggacttctntcaatcaactgtcaggccacataaagggtctggaacgcgctgacttaagcaaataatattgagccatctaaggataccgtaaggcccaagatnnngcttagnaggcgctgacaggaaatattgatacatatnaagtttcactnctgatgcataaagtnatatgtgnttnanttnnngnactatttcntgactaggaaacanctttgttttntttagatagnncangtggggggnnggtcnatgttanncccttntnatncncctgnntttnnttcanttnnncngcnntgntnnagtgcttngnagtangnatnttnttgtncngtnccgnttaactgtnnnnntnannanntntnnatnttntttttttngagntgtanacnngnccncctttatcntntnntccnnnttcnccnncaacnatgnaaanccnagncntnngntcnctntgnnantcanattnccnaatanaantnnnnnnnctagnnntgnngaagtnnnnngnngtannngannntatgtnnttanttattntngattnttnatctannnattgnttnatntaaagnnttannangtaaagnncnccgngttnncaaattgattttngnnantnctnncgacccanctnnnaantccnctgtnctnangngaccnntcnattttgatnnnnntcacanatnnatnngtttnnatnatnnaaagatntnnananattagnnncnncttgacannttnnangangananttangtgtntatannnnctcnnantgnntnanantcatatgnncncntataatatggtncagtnnnntgtgtgatngngagat

SEQ ID NO: 1222 - DNA, 935 bp, Homo sapiens
  misc_feature (1)...(935): n = A,T,C or G
tccggccgatcatgttttattgtgctgttagaaaattcactttcctttttagcgctacaatcaggattctagaaatgctatttaatgccaacgggtatttcattaacaccgccacctccagcatcttcaaggatatcacctcaggcacaacgttactgatggagaatgtttagagtattctgataaaatagggttctttctttttcctttttaaattaaatcctccaacgcaacctttattctatggtaacagcccgatgttccctatcaaattttcccaagacaggacattacagtttttcccctgtaattaaagccacaaatgtctaaaaatgatgagtcaataggattacagacattacttctcacaaaaaattgagttttgactcacatgtcctattgaggggatttgcgacttaatagccacatatttcaatttactttttaggccctgtaaccacatagttgtaatatagtttagactattgtaaaagctgagaaacacacccaaacctaatcagtggcaggtttcctaggttaataaacttaaggaatagttttggggttatggacagggttcacttgtcagctagacattctgagagtttgcaaattcaaattccatacatttgggtgttttcaaaaggagacgactntttgctaattccctatctcatgaaaatgtaatcccaggatagctggaaaacccatggaagtgctgggttggacattgtcctgccccacctgtgctttctttaagccagggtttcctaacagaaatggggccaaaggaaccctttgctttttgataggatggtcttgattgttaatttcctcgcggccacaaataaatttgggcatacgtcctaatggtatattattctaaacagcgcgcacactttatgcctgacgtgtgggaacgcccatttttaatg

SEQ ID NO: 1223 - DNA, 1154 bp, Homo sapiens
cgatctctccctgtggtgcctaggttggtttaaatttcttggcctcaagcgatcctcccaccttgagttcccaaagcaaggtgttattagtaattggctcagagaactcgccattaggggcagtgcatcacttaacaatggctgggcgtgaaagagagccctgctctactgacccttcaatgtgcccgtgtgcctaaatattcctggtcgtgtgaaaagaacccaggtattagctgaactaaggagcacaattctgcaacattttggcacccaaacacggggcttgagaaatgaatgcaattggagaaactggttgttttaccaggcgttgattggaaatgtgtgcttccctttaagcagtcaagctcaacttgcagaactgatgggaaccccttgggaaaactggcctcaaatgtttgtctacacagtccacatacagggttcttaacctgcgactgaccctgcttgtgcctgtgaaccaaccaacaatctctggctgcagctcagaaaggacaaaagagaatggatgagggaaactccccagggcttgtctgggtatgcccacagtggactggagcccaaaatgcacactggaggaagtggatggagccaccgtggatgtcatgccttatgcaggggaggagcctgctctcttcagctcctgtggtaatgtgggaatcgatctgtgaggaaacactttctgaaaatgtcagaactcttgaaaacatggatgaggaaaagcataagtactgctttatgcttttcttatgaattttaaaagatgtaatttaaaggtactttaaagtgttatttgtgcccttgtaactgattcaaagtagactgctaaggacaataagtaataagagtctacaaatatcagtaaattatgagaaaaaacggtctaatggtacttaaaattgcattgtgatttattaaataacattgaacagctccacctgtaacattaagattccatttgagcatatagaaaatatatttatcgcaacctgaagtgatttggaaagtatgctgggaagaaaatatatttacaaattagtctcagagggtaggtatcctgtagccagatggaataagaagagagggaagggagattttgttcaaagggggagcataagctaaggaataaagccagg

SEQ ID NO: 1224 - DNA, 403 bp, Homo sapiens
cgccgtctggatccgggagtccaggaccacccataacctgatgccactctccactggagcccaggagacctcaggatggagaagcaggtccaagtgaccccggccaccctgtctctcagccctcacaagaagaatgccccaaactgtgctgggagaggcagaccttgtccctgaggataaaggaggtacaagttcaagagattcacttacagcatggtgactatactgaataacagtgtattgtgaacttgaaaatcactgggagagcagactttgtgttctcaccacaaaaaatttgtaagtatgtgggataatgtgtatgttaattagcttgatttaaccatttcacaatgtatatgtatatcaaaacattacaacataaataaataccgtatcggccagg

SEQ ID NO: 1225 - DNA, 237 bp, Homo sapiens
aactcctcctcaaaacagaagaagcctataggattttaacctggaaactactcagggaatctggaatattccttccagggatatctgcagctgaaacctggcagtaatttaaacaaaaccagacaactcttggggtatggttggagcctgaggtctacagatgggtcattttatatgatgaggtctgaacaagatgattttaaccccttaaaatgatggaaacaaaataaaacagga

SEQ ID NO: 1226 - DNA, 376 bp, Homo sapiens
gctaaagaaagtgaaaccatggatgtttcagatccattaccaacaatcacagaaggcttcctggaggaggagagatcagctaattcctgagataagtgatgtgctgaagaaaggaaaggaaggactcagctcttcgtgtgcagctttgatacactcattacttaccctccaggccctgggaagaatcactctccccatgtttgtcaagaagggctacatctcctgcccaacacgctgcacagatggaggctggtgaaaatagaaattccaaccttccttctgccctctccccactccatgccctccccccttccttccttgtgagcaataaaacaaaatacaaagaacaggaatcaaataaagacagatcgcaaag

SEQ ID NO: 1227 - DNA, 399 bp, Homo sapiens
agcaatctcccatctttaacagatgaagcttaacacaagagcagcacaaaaaccgtgaaaaagaaggtggtaaaaaatccatcttctcagactaccttgctgatgaaaaaaaatagctctgtgacacagttcaagccgatgaggtatgagcagaagagttctctgactgtctggaaagtctgatttcctgatacagacaccactcttttccccatgcctgaattctagatgtgttgatagatactgtggcagccatccagggaccatgaggggtagaccaagagaattccagaaaggttgactttgttgtaacttcaacctctgaaccacttgcctactctgaactatgctgaatgaagcaaaaaataagtaaataaatccctggcctcgttggcctca

SEQ ID NO: 1228 - DNA, 613 bp, Homo sapiens
caccttgtagccaaaaatggctgctggaaccccagtcatattgtctgcattctacgctggaataaagagtaaagcaagaaggagaacagacataaaacataactggaagctgtgatgctccaaaaatatcacaggatcggatgacacgaaaaccttcaccaaacttgggaccatgacaccattcacacctggatgtgctgaaatggaggaaacagcaagtcaatatttaataaatttttactaaagactctgtgctatgcaagactccaaatagtataaaatactgcccttaccctcattgagcttaccagctaggtgagtgctacccattaagtgaaagactaaacgctaaaaaagctgaacaataaagtaggtatatgtataatacaatcctagctttttaaaacagaaaggtatatatgcataacaagaaaaaactctaatgatagatcccaaattgaaaatagttattattcttgggaaatgtgatcacaggggttttatgtttctttataatgtgtttctttattttctaattttttataataaacatgttattttttatgatacaaaataaatatatcattaaaaaaaataaaggttgatcggcaag

SEQ ID NO: 1229 - DNA, 575 bp, Homo sapiens
agaggatttacccataaagatgaaatgtcaaacgtctaaactttcaatcagtagcagtccaggaccagcagatggccagatttccgttgccttgggttaaccctgaagaatgaggtgttcatttttttcctgtattgaatgccttctccccagatttaggacctaaaagctaagcatgcaagcaccaaggaaagaccatgtgaggacgtaaggagaagacagctgcaaactaggaagagacccctcaccagatctgctggcatcttgatcttggacttcccagactccagaactgcaagaagtaatgatctattaattaagtcacccagtctataaaattttgttgtagcagtctgtcttagcaggctaaaataggggccctgcaaattatgctcccttgcattccttgtttctctacatctaattgtaaattgccagaaaaccagggccatggaactcagagcggaacttggaatagatgatggtaaatatgacagctgggagtgctgtattacagcaaacagggaagtctgtttgttacatgaaaagacaagtaataaaatggtgaaatggaa

SEQ ID NO: 1230 - DNA, 354 bp, Homo sapiens
tattttcttatgggtgtatagtatcccattgcatatatgcaccacattttctttatccaattgaccattgatgggtacttaaattgattccatgtttttgccattgtgagtagtgctgcaatgaacatgcgagtgcatgtacgtgtctttttggtagaataatttgttttctttggggtagatatccaataataggattgctgggcccagtggtagttctgttttaatttctctgagatctgataactcccaagaatttggaagataatccaggcccttggaccttggattcatcaacagcccaactatatgattccaagtgttgcttcaagaggggggccactgcttctaaat

SEQ ID NO: 1231 - DNA, 1257 bp, Homo sapiens
  misc_feature (1)...(1257): n = A,T,C or G
atcgcatcagaagatttatctacaaaatatgcatgaataaagagaggaaattcttgaatacacagagattgaagacaggaaaaatctgagccagatattggatctcaggtatatattgaaatctactgtaagcagtcaattttctctgtagcttttaaaatattacctttgatttagaaatatgaattattacttcaacagggtgagtcaaacatggacttctcaattttcaaatctcctcttttcttgtaaccaaaatatactcatttctgcaattatatttgggtcaggctcttaaataaagaatttcagccctccagcagaatgactatcacctgagatgctactgcaacccttgctggagtgccatgacaatccagctaccccagccaggagagcctcccaccaatggtaccctgggcaccagnactggagcacctatgccagttggcccctacatcataacaactatggagggctgaagctagtggtaanggaaaacctanacntctncagnctaaatggggtctgncctnnaaaatgatcnnnnagananantnttangtnnnancntnnnctcgcncnntncnatnanttttcgcntctccnntnnngnaaanancaataannntnnanntnnnaatantctcnnncaatcaannaatntgttccccncancctnnctnnacaantnttcntattnntttaanaanantcananaaanncnncnngganncantacngnccaannantnnttccatnnnatnnnataattacantntnanaaannaangggntttnatatctatanaacacgntaantanattgattaatanntntnantaaaanantannnananganngnaaccactnntanntttttncnnttacatatctnnntacnnnatngananacnaaatnnnnaatnngngtngacaaannnatataagantnntcnacnnaantaaantnnnncnnaaaantnaaannacnnttcccanntnnaaaaattanccttnnacttanntnnttttcancnananacnnnacataatnnnnntgntttnnatcgatnnncncnngntggnngntnannnatncnttnntattnncannnaaantcttaactcacccacctnnannangacatnncnnnnntaanatntcaanancctnnnncnnnntcnaacgtaatcataanacaannncattacanantncnctncannntgantnnccacttntanatatt

SEQ ID NO: 1232 - DNA, 763 bp, Homo sapiens
  misc_feature (1)...(763): n = A,T,C or G
atcgcatcagaagatttatctacaaaatatgcatgaataaagagaggaaattcttgaatacacagagattgaagacaggaaaaatctgagccagatattgcactgtttatgatactgaagacatggagtcaaccaagatgttcattaatggtgggctggatgaagaaaatgtggtgtatataaatgatggaatagcacacagccataaaaaggaatgaaagcgtgtccattgcaacaatgtgaattaacactggaagagaaaaccaaatattgcatattcttacttatatgtgtgagataaacattgaatacatgtggacacaaagaaggaaacatgtgaacactggggactacttgaagggggaatgtgggaggggagtgtgggaggggagcatgggttggatacctcttgggtctatgctcactatcngggatgataggatcattagtacaccaagccttactgacatgcaatatacccatgtaacgaacgtacacatgaaccctctggatgtaaaaatttttttaaaaaaaaataatgtataacatcagtggatctttctcattcccctgaaatgttatactaaaaagttactactttttaaagtgcctggactcccctgtgaaaggtgtattagaagggtattttcacattataattcttatatttggcagcatatttccttaacttcttagatctatgtatcatgtttagttggttgttgtatttttcacaaacntnaataancccagtatcagaaga

SEQ ID NO: 1233 - DNA, 1055 bp, Homo sapiens
  misc_feature (1)...(1055): n = A,T,C or G
acattcattggagacattcttttgcttgttaacccatacaaggagcttccaatttattcttccatgtactgtgtgaggctgctcaaatctctgctgagtgtgagacacttagggtgactttctgtgatgctgctgagagacactcagcacagcggcactgtgtgctgggaggaggggatggaaaagatcccgtgtggcccggtgcatcctgattttcttcaagatcttagctccctaagacattgctgctttggtgattttactatccctgccattagatgcttgatttgtattttatccagtctttgtaattgttcatggttaggagaatttgactgatactagctgcttcattacagctatagggtaaaggagactacatctntttttattgcattggtgtcagaagattatttgccctcagatacctagattagtttggcatttcatgcctctaatttttaattctgtatgcaccaaggggtgggaggggaaagagagagagaaacgcacccaacttaaagttacctattgataatattatttctggcttatgtttatggtaacagttgattgtagagttaacaagaattaacagtgagacaaaagtcagctttgaataattgaatgaaacgttaaaaaatgactcttatttggatgcttctatggatctagaggtaaagttttgagtattagccaaactttaacataatattttttatagtatgacacagtttgtcatactatattgtatcttgtgatgggaaaaaaactgttaacttgtggtatgtttgtttttaaagtactgacacaatagtagtattagggcttcagataatacgttgtatttgcagttttttcagaaatacacattcatagagagaaggagaaacacattaagagacatatttgtttattaatgtaagaataagatacaatacattgagatcattaccagaatagtttattaaaactgaaaatggctaatgcaacttataatttatgtaattatataaataaaatctatatatgtttcaataaataccgatcggcca

SEQ ID NO: 1234 - DNA, 393 bp, Homo sapiens
aaggatactcctcagaaggtcatcaaatgttttaagctataaaaatagatccggagttcccaattctctgaccagacctattcaagatgcaagaacatctgctaagccaggaggctgcactacccgaagctcagcaatgatgcaaagcatgtctgtgagtcactaaggccacttttgaattgaactgcctgatgtctgtaaagaataatgcctttaaaatgtcataaaagatatatatatattttaaaaaaaactggagcagaagagaaaactgtttattccaaataaatgttttcactttgtccacagcaaaggtttctgtgagataaggccatgaattaaaacagcacacagagcaaggttactgcccatgtaataaaaggcgatcggccg

SEQ ID NO: 1235 - DNA, 445 bp, Homo sapiens
atagagaagactcacagagttacagcagcctagacttcaaccagcttgtcatctccaatcaattatttgtggatacattgagcactgtgctgacaggctcagctttaatgtcatgatctcctgttatttcctgtgcagcctgtgtatctgcagccatctgggcaaaacagagctgccgcagtagacaagcaagatcgtcctatgaagagaaacaggaatccactgctgatgctaatttctctgagaagactactggtcagttctacctggcatgcagcttccttctctttgacaacaacaaagactattttaatcttcctggcatcagcgctttgtcgtaatctgaaggacaagaagatgcagtaaagcaacaataagtaactatgacctcatatgtggagcctagaattataaaaaaagagtcagaaatacaaaaaaaaaaaaa

SEQ ID NO: 1236 - DNA, 475 bp, Homo sapiens
ttctgccaaccctgagaagccacctggagactcagatgcaaatctcagctgtgctgcagaacgcggagacgggtgcctgtagtcccagcactttaggaggccaagcctggcggattgcttgaggttaggagttcgagaccagccttgccaacatggtgaaaccccgtctctacaaaaaataaatacaaaaattagccgagtgtggtgatgcacacctgtaatctcagcgactcgggaagctgaggcacgagaatggcttgaacacaggaagtgaggttgcagtgagccgggatcgcgccattgcattccagcctgagcaacagagcgagactctgtctcaaaaaaaaaaattatatggacatggtgttgcacacttgtagtcccagatactgggggaggagggattgctgagcccaggaggtccagactgcagtgagccatcattgagccactgcactccatgttaggcagcaaa

SEQ ID NO: 1237 - DNA, 140 bp, Homo sapiens
agtcgagttggaagaaaatgacatccgattcttatagaaggaaagcaattacattttggcgtctgccttccccagcttgcatatgtttttaaacataaaaagaaattcttaatatgtaattgtcaggtaataaaaaggga

SEQ ID NO: 1238 - DNA, 776 bp, Homo sapiens
  misc_feature (1)...(776): n = A,T,C or G
aagatcctggctatacatatatacactgtatataccttccgtccctgtggtctggcatcatacaaagtcaagcacactgctgagatgccctccagcgtctcatctgatgaaatagttccatctgactgcctcgatggatgagaataagaagttttcctgctaatacgaagattgaatctcactgaaaaatatacagtacattattgtgtcttcatattaataaacattggcaaccagtgggcttcttattttattattttttatggttatattagtccacctaatctggcaatgtgtaaggcacatgtgccagacattaggccatcctgnacatcttgtgaccactgcaaatttacttattagctggcaagttctacatcagtgctgtccaatagaaacataatgtgaaagacttacgtgatttaaaatcttctggtagccacattttaaaggccaaaataaaaaggaataggtgagatcttaataacaattttttagcctaatatatccaaaatattttcatttcanatataatcaagataaaaagtattaatgggatatattatatgctttattgtgtctttgaaacccagtgtgtattttacacttatagtgtatatcttaatttggactaactgaatttcagtgctaatgagccacctgtggttggtggctactacactggacagtgaaatgttatattaccattgttgtgttattagataggggtaaaaactaaataaaatgttggcactttttatggaaaaaaaaaaaaa

SEQ ID NO: 1239 - DNA, 452 bp, Homo sapiens
tcatcaagaccaaaggaaagagcaatgaagttggggcatcaccttccagtttcccagtatcaaacctatattgaatttcttctggaaagagatgattttgtgtcaagatcagcaaattgctttgttgtaaaagatgacactctacaccaggcgcggtggctcacacgtgtaatcagagcactttgggagtctgaggcaggcggatcacctgaggtcaggagttcgagaccagcctgaccaacatggtaaaaccccgtctctattaaaactacaaaaattagctgggcatggtggcaggggcctgtaatcccagctacttgggagtctgaggcaggagaatcgcttgaacccgagaggcggatgttgcagtgagctgagattgcaccattgcactccagcctgggtgacagagtgagattcggtctcaaaataaataaataaataaatgggga

SEQ ID NO: 1240 - DNA, 780 bp, Homo sapiens
cagggtttcgctgtgttggctgggctggtctccagctcctaactgcgagtgatccgccagcctcggcctccccaggtgcccggattgcagatggagtctcgttcactcagtgctcaatggcgcccaggctggagtgcagtggcgtgatctgggctcgcaacaacctccacctcccagccgcctgccttggcctcccaaagtgcgagattgcagcctctgcctggctgccaccccgtctgggaagtgaggagcgtctctgcctggccgcccatcgtctgggatgtgaggagcccctctgcctggctgcccagtctgggaagtgaggagcgcctcttcccggccgccatcccatctaggaagtgaggagcgtctctgcccagccgcccatcgtctgagatgtggggagcgcctctgccccaccgccccgtctgggacgtgaggagcgcctctgcccggccacgaccccgtctgggaggtgaggagagtctctgcctggctgccctgtctgagaagtgaggagctcctccgccccgcagccgccctgtctgagaacagctaaataagcactggcctagaaatcagcgatatcaaaacaattacaactcatccagctctcagatgctttgagaaattcagaggatatatgacaataactgtaaactagtggagaagaaatagaaaaaaagaagggtacacagacaagatttgaacatggatagttattgctccgatcttcgataaaaccatttgaaaatggacagagtgtaaaataaaccaaga

SEQ ID NO: 1241 - DNA, 1334 bp, Homo sapiens
ctggcgcagagctccaccgctgaggccaacgaggccatacttttattttcaagatgtataattatgtctatggcagaaaatgatcttttctttcttatatttatacttattttctgaggtgtttttccttattactttaacaaaaatatcaaacaatagtaaataatagtaatgacaatagtcatcattgtttttcccagaattcgtctggttaaactatatagttggcagaatgagcccatgctgagtttttttcttgtgtctcaagataaccccctcagaaacactacccgactttaggatttatagaatgatatacagctatagttatcaaagagttatcaaagagtattagtatcaaggcaaacaaatcaatggaacagaatagattctatatagacttacacgtgtatgtattatggcctggatatggttggtttgtcccaaccaaaactcatgttgaaatttggtccccagtgtggcagtgctggaaagtggggcctaataggaggtatttgggtcatgaaggtcctgtcctcgtaagtggcttgatgccattgcagtagtgagtgaattcttgctctgacgagactggattcattcccatgagaatgggttgttataagtagggggcccgtaaaggttttccctcttggagaggggtatgtttccccgttgccccttatccgcccgtcttgtgtgcccaggcacaaaaagcctcaccatcaagtccaaagtcatgtgccttatacttcccagtgtagccaagagtgtaagttaaataaatctcttttctttataaattacccattcccaggtgttctgttatagcaacacaaaacagaataagacagtgtgaggaactggttttcaacacaggtacacatgcagttggtagagaaagcctagtcttttcaacaaattgtggtggtacaattgaatattcacatgtaataagtacatttttcaatccataccacacagcatatataaaaaaagagactggctgcattttgccccgtcttagatatttgtggaactttgaacttgagggagatgatttaggatatatggtgtaaaaaatttctaagcagcaaagcactcaagaggtgacttgggtgctattagaggcactccgttttaaaagggaaacagaaaataaaaggtttgaaaatttgcagcctgacaatgtgatagaaatgaaaatctccactgcagaaattttcataagtaacaagaagccaaatgttaatccacacgacaatgggaaaatgtctccacggcatgtcagaggtcttcatgtcagccactctcatcacaggtgcagagaccat

SEQ ID NO: 1242 - DNA, 903 bp, Homo sapiens
cttagcgcagagctccaccgctgaggccaacgaggccagtgttttattttttatcctatttcattgcttaaaacgtaaaaattgtataacattaaattataggatagctgtgtgacatccaaattaggtggaagattctaacaactgaatcaccagtgttttgtcatctgaaaaaactgagcattgttttagattattccagtaccagagtgttgtccatcgagtggctctgcataggcacccagcagcagtgagggtgagcagaagaaaactgcagacactggcaaataccatggtccagtgaggagtgagtgaataaatctattctttttccttatacttttgatttgctctgggtgcctccaactgaccaaactcatctgcaaccagagtgtaaggaaggaagcccatagagaagatcctcctggagcatattgtggtacagaagagggtggaaaatggatccgaattgacaaagggaaaatcatctaatgggttgtgggcactttgtagaacatttggaaaatgccataagtcacccagaggaataaccgtttaggggtggctttaaaagggcaaaaaagctttctatacatttttaggtagatttttaaaaatcataaacataaacccttggtttttgtaaaaaggattcctcagagctactatttggctatattttaaattctattggcttgactactaaagaaaggggtcaccataattatggccatggttaaaggtgtaaaagtctgctcacaatggcttaaaaggtgacacatagcaataaataaaggttttggaaggttattgtcacctcttcattaattggacacagaaatgcctctgtcaaataaaaaagagaatctctaaacttaaaactttgggctttactggaaaatt

SEQ ID NO: 1243 - DNA, 705 bp, Homo sapiens
ctagccgcagcagctccaccgctgatgccaacgaggccaatcttttatttgaaccaaagtgtaaggacacactgcaaagaagaagctgggtggtataccttcttttgccccagcattttagctgtccaagtcagatagtatcttttatgttcttcaccatcttgagggggaaaggccatatctttatttgtcaaaaatatttttcatataactacaattgtaaagttttcgaagttgtacattatattcatgaactattaaaagtgaaaaatatcataactaataaaatttgttgattttagagatgactgcttggcccaaaaaatttagtcaaatatatgcaaatcattattagaaaatgaagaccaagttccttagctcattatacatgacctgcagtaaattttacaacatcttcctttcaggcataattttccaaaagacaaggctaatcattgcattagtctggttaagttatagtatgctgcagtaaatatcaacttcaaaatctcagtgatttaatatagcaagtttactctcattcagtgctcatgataagtttgagtaactctcttgtatggctgccctctaactgctatccaacctcccttggtactgtaggtgctgccatgtcaccctgagtctttgttcccatggctggagaaaaaggactgtggagaattcacagctattctatttttgtgt

SEQ ID NO: 1244 - DNA, 908 bp, Homo sapiens
gaagggtgcaagtttgattgatgataattaattatatttctggtcgcagaactccaccgctgaggccaacgaggccatttttttattgagttgttacatctttaattaagtagaagatagtaaaagaaaaaattactggagaaaaaggggaacattacataaagattcaaggatgaacccatcagggagacataaatattgagatatgtacatatgtaacagcaaaactccaatatatgaaacaaacactgatagacctgaaaggagaaatagaaaaattctcaattatagtttgagacttcaacagtcttctttaagcaaccgattaaactactaggcagaaaaatctggaaatgtttaggatatatgaacaacacaatcaaccaacaggatctaattgagatatatagagctggcctgtgacagaagaatgaacgattatgttttacaactattcatggaccaatctatcacaatagaactggagtctgggacataaaaaaacttgagaaaattgtaaaaactgaattataaaaataatattttttaccccgaaattacaaaagatcacagtgtatttatgatttagagacttcaatttttgcattttaaataatctatgactctaaaaaacgagtaacacataatttttatcctcgcggtttgtattaacttccaccaccagatggaaaactagataaactcactcaaagatggtcggtttattgttttttttattggatagattgaagattagtcgtggagctatttatatatgacacgtaagttatatataaacaccggattgttatttccatcgctggtatacacgtatatctagatgaggtgtggtatgtgtatattgtaataactgtattaatactgtatatgtaagtaaatagatatag

SEQ ID NO: 1245 - DNA, 850 bp, Homo sapiens
tggccgagagctccaccgctgaggccaacgaggccagaggtttattgaatttgacaaatatcaagtttattgtgttgcaagaaaggtagtaaaatgtaatggtagaggactcaggatctagaatgagagcttcagagttcaagtccaagatagtggaacacaagcttctacaccctggaggaagttatgaaaccttttctctcatttaatcttctctacgatggggcaagtagtggtgcttgactcatagggcatgcatccagggctcacagctataatggattcaaagtgaggtacatggagcgccacatggctccggttctacagggacaggtagcaataaacagaagagctggtcagaacaatggataacaagaaataagagaccatctcaaatcctggtcatccatgattgtctctaaccatctgcataagaagatatagaactgtagtttgtccaaccactttctttcatttcagcatctttcaacaacacattatattgcctgagtgtcccatgaatcctatgaggttaagtataaaaacaaataattaatgtgtctatttgtcatgacagaaagccccagaatggagatggggaaatttgcagactctctagatggtggttgtggtagtgaatttggagaagcaggaattttgcaggtacccccaagggattattttcagatacagagctaagggtgagcactaatccccaagttacatattcatcaccggcaatgttccttgaaacactggagtctaaattttaactttggctttaaagtaatactcttgcagggggttccaaggttactgccttgtggatctggctgaaacatcttttttt

SEQ ID NO: 1246 - DNA, 807 bp, Homo sapiens
aaagatgctgtaaaacctgccataaacaaataattttaatttggtttaacccagagtttcccaaacgttctcttcttttgcataatctctgctacaaggctttgaggaatacactgtagcaagtacggatctgtgaaatcaatagtatggaaatcaacaccaccatgtgtcagcaggtcaccctgggacacaggaaaatgatatgatgcacagcagtgcctctcaaacctcagtgcacagaggtgtcacccagggagcctgtgaaaatgcagattccacatcagcaggtctgggtggggcctgagtttctgcattcgtgaaaagctccctggtaatcctcatactgccagcccaggggccacactttgtgtgatgagattataaagaatcctctgctacaacagaatttcacctgcacccattctttcaacagcattgggagaccaatgaccacctccagcagttcccgaatcaggccatcagccccatcggcagggagctgatcttgtctccccatgctggacaagcaagcccccttaggagaaggagcagccagacaggggcagcggctggagctaatgcattgaccatggttagggatggcaaagttcttcgagctgcgccatgttggcagagtctgcatgatagaccacagtcggccgaactcccccacttttttgtttttgcgccctatatgaggcgtttactcgaccatgggcttgttgtcccggacttttgcttagctgtaacattacatcgcttcgttaaggggaaatcatagttgccctaaacattaaacgagtgggg

SEQ ID NO: 1247 - DNA, 831 bp, Homo sapiens
ctagccgcagagctccaccgctgaggccaacgaggccattagtttattgtgaattggaattcttttcctttccattgagcatcagtttcatacttactcctttcattttgtcacttaaatgattatgaaaatttcagtactacgcctctgaccacccacttgaaaaccctactgaagtcatatctgtttaactgacccaatatgttttacagaatattagaaaatttctttgtttgtaaagtttgcttaacttacaagaattataatattattaattgttcaattaccatgtaaaccccattaaaaaggaaggctgatttttttctgtgtatagatcagtgaatgactgactctactctggactatgccctggactctaagatataaaatattcacctaaagacttggactaagtattatacagcatttgtaaaaaatttattttttgagagagagattttccaaaacttagatgatttaaaaaaattgagtaggtattttagtccattttctactgatttagcagaataccacagactgtataatgtataaagaaaagagggttatttggctcacagttctagagtctgggacacccaaaagcatggcggctggcatctgggtcattcatgggcagaagggtggaaggcaaaaaaagtgcacagatagagagaagaatcaggcttgactattctttatgtaggaacctattttttgtaatgaatgagaaaagactttgttaatatctggagaatagcttgagatttagaatggagttagtcaatctaacttatttgggagcttaaaaaattgttttgttttcctttcttt

SEQ ID NO: 1248 - DNA, 874 bp, Homo sapiens
  misc_feature (1)...(874): n = A,T,C or G
cggccgcagagctccaccgctgaggccaacgaggccatatgtttattacagtgaagggacacagagcaaaatcatgaaaaaggacgtgtgtaaagtccagaggaaagcaggtacaagcttccacaggatccacacaggacgagcataactgccccggcaccgagccatgtcaagtgctgtctgccgggaagctgggtagagactccaggcccagggtttccatcagggctgaccacatgggcaccccgtgcctggtgcataccaagttccagaacaaggaaagcaggtttcagcacagaccatgttgtttgtacagtcaattcaggcacagcgaaccacaactaccacctagggaattggggagccctcctgaaatccggactccagccgagggcaagcctgcagcaatcctgtctgaggttgtatctcgggccagctgttagctgtcttctgcacagaaccatgattaaagtttgtcagtttcccactgttagatatttaagtagttatctttgtttttctattaataaaaaatgtgatgattatctttctaactcagttatttttgctttttacagggggagtaattnctagaagtagaaaaagtagctttactgagcattttaatatgtgttatatcttcctaggatatttatggattttgggcttccgttatcttcttttaatgggtatcagaaaatattcatgggttatatcgataacctattgggtggattcttcaaaccatttgatcttattaagattttttaaaggtgttggggattaagggacattggagtacttgnggctaacttttgggtaaagccctggaagcccactgggacagttaagaaattaaaggctttgctaaggg

SEQ ID NO: 1249 - DNA, 845 bp, Homo sapiens
  misc_feature (1)...(845): n = A,T,C or G
ctggccgcagagctccaccgctgagtccaacgaggccagcactttattgaatgccattgtagaaaagtgtgtgagaataaagggctgatacagaactcaggcccagggtgcagggcccgcaatggacagcgagtacctgggcgctactgctggccttggagattctttatcatttgagaaattgcttggaatattatcatagaactactggtgaaaaggatgatgagtgttgtggtcacacggatgcccaggatgagggtgcaaacgttcaggcacttggctgtggaggcgtaggcctgggccccagtcaggtcgccaaccatcttcctgtccctagacttcacggagtaggtgaatgctatgaagcccagatggcatcaattcatgaggagagtgttgaacagggaccagaaggcatggctgggcacagtggtctcactgtggatgtggatcacggtggatgtcgggggaacagggttgtggggcaccctcagcacagccacctcatgctcctccttgagcatttcatagttgagggggtggctggtgttggcgggagtgaagacggtttggacagcgtggttcatcgtgtccagggaagatcagttgtggtcgggatggtgggatggttctncagctgcatttatttctgtttccccttgaatctcactgggtgtggtggcgggcgcctgtatcccagctctccggaagctgangcangaaatngcctgaacctaagaggcagacttgcagtgagcttaaacatgcctttgacttcaagcctggccacagagcagacttcattggaaactggaggtggagtgcagtagccaagatctaccatg

SEQ ID NO: 1250 - DNA, 846 bp, Homo sapiens
ctagacgcaacgctccaccgctgatgccacgaggcccagctttattatgttagcaatttcacatcatgttatatcaggagggtcctgggttaatattgcttttttccaaaagataacattactgcttgtttccatcaaacttaactctgtgtttcctgtaaatacagcttctgggctggttgcagtcatgcacaaacatggcagtctccacatgcaggaagccctggcctctattgggcagaagctgaatcccacttataggatcgtagtactcctaaattggaagaaaaataaaaagagagctaaaggagcatttgccaatatttgtatgcaatgaaagggaattattgggccctgagaaaccgcaagggaccaggggtaaggactgtacctacatttccttatgtaatactgagtattacttcgaagaggcattacacatactcagtggacaaataaatggcgtaacgactatgaggaagaggggagggagtggcctaaggccccccgccgtaggacaaaactgggggtctaggggacttgaaggcctgtgctttggccgtaaaactcgtgaagggaaagccggtgagttgagcggagggtgatgtgtttaaaacgccgagggggagcgggtttggagggggtcgagcgtgagggagaacaacggcaccaggggagcgagggggcggggcgcggaaaggggggggaaatgggggggggggggaagcacaggggctgagagaaaaagggcgctaggtcgggcccgggaggtgcgcggcgggaaagagggggggttggagccgaggggggggctggggggtgggggcgtcggcaggtcggggggga

SEQ ID NO: 1251 - DNA, 888 bp, Homo sapiens
cggccgcagagctccaccgctgaggccaacgaggccacgtgtttatttaaggggtacatcagcttagtggacacgtgttttgaaaatttgagcttagaataaagaaaacgagtttttttaaagaattttgaggcaggcattatgtgaagtaggaagcagctttatagaagtgagaataaaggctgctgtgatattttggcaatatgtcttatatttccgggaaaatttggtttgccgcttatgcttatttgttttgtgaccttggaacccgagggaagaaagaaataggagtttacaatatgtatggagggcagatatggttaatgtttttttgggagagacagttaatatgttttttaactttaattttggggggggctatttaaattttttagccttggttaatatagcagtttattttatgagctattggtacttttttattggaattataattattatttatgctattattttggtatatttttttaattttttaacttcaggagatggctattttcttgcgtggcccttacatgcactttccttggcccatcatgcaaggggagcaagggaactttctgggggctttttggcttcctgtgatataccaatcctggaaattagggactcacccctacgggttcttgaaacttaataagggcccaaagctttaaatatactttttaagaaagactgaaattttctgggacgggggggaaaaaaggcaccctataggtttaattttccctgcaaaactggactggagggctgtgccgcttttggaggtggattacccgaccctgggctttttgtttccgggacctatcgctatattgtgaaaaataaatcccgttgataatgtgtggaagcgtatgtggcctagag

SEQ ID NO: 1252 - DNA, 808 bp, Homo sapiens
tttttttttttttttttttattttcaattttgttttatttgcatattttttcacataaaggaattcaggaatccatcagttttcagccagtttagaattataacttcaggtttaagaaaaggtcattcatttatatggacttacaggtaagaataattgtgaatttctatgagcaactcaaataacagtttatgtagtcacatcactttttattaagtataaatattcaaatgggatagtaatttaaaacatttctaacagtagaaacaatttttcagcttcataaattaccaagggatgccatttctagttgaggatagtccagtgaaaacattagcatacaagtttgtttttagaccatacataagaacacacaaaaattaattcactgtgacataatattcttctgtttaggagtttgcaatattcaaagaaaaggaacaaattgtattccaaggacatctcatgaaaaattagaaggagtataagtagtcaaaactaaggaaataattacaaaaactacagcatatcaacttatggaatattaggcagccattgaaatttaaaaactattatagcatattaaaaagggtctatgctcttgagtaaagatagataccttatcaaagctgaatataatcaggtgggatggtgcatgcctgtactcccagatgcttggggaggctgaggggggaaaatccccttgaacctgggaagtggaggagacaatgagttatggaccacccactgcctacaaatttcgcttggcctgaccagaccctaagaacttggagttggccctcctatg

SEQ ID NO: 1253 - DNA, 866 bp, Homo sapiens
  misc_feature (1)...(866): n = A,T,C or G
cggcccagagctccaccgctgaggccaacgaggccaggcttttattttganatataacttctggtaccttctgaacatgggaatacaaatacttttacaaggtagtgattttatttcctctgggtatatagccagaaaaggggctgccgagtcatatggtaattctatctgtaatttctttaggaactaccataatgttttccacaatggctgcactaatctccattcccacctacagtgtaggagcaatttgccgcaatatggatgaatatggatgaatatgctaagcgaattaagacacacacagaaagaaaactactgcatgatctcacatgtagaatcttaaaaaaaagttgaatacacagagatggagaataaagcagtggtaatcaggaataggagtgcatagggaaaaaaaatgggagatgtaggtcaaaggacacaaagtaccagatatgtagggggaacaagtacagagatctaatgtacaaaatgaggactatagttaataacacatacggtattgtacttgggatgtttaatgctaaaagagtagattataggtgccctggccccataaaaggggccaactatgtgagaggagaatatgttatttgctgactgcggaaaccatttatatctcgatgaaacaagttgacatctaaatacttacattaactttctaaaaaaagttcagttaatctgcccagtgctatcttttcccctagctagtattttattacccataattgcccatacaaaattctcttatattaaaatatgaaaatttcataatcaaaagttggcttttatttccaaacaaaaacttaatggcccaattcctattattgaacggcttcctcact

SEQ ID NO: 1254 - DNA, 188 bp, Homo sapiens
aggtctgtgattctcaagccatgctcttgcagggcactgatattcaggatgcaggagaagagtactttgcaattaaatcagaataaaagcagttttttccaaatctgaagaataaaattgagctaatggacagaaaaaaaaaaaaaaaatggcctcgttggccacagcggtggagtgctgcgtccagg

SEQ ID NO: 1255 - DNA, 832 bp, Homo sapiens
ctgggatcccaggctagtagggcccgatccttaaccctacattcaagcaatagtgaaccatttgtagtattggaaaacatcatgttattctatacccagacttccatttcactgggtgggcaatccattgcaacccacatcataagtcctggaattgtttgctagaaatcatcctagttgccttcatccaagtatcctgagtaacacaaggcttggcacatagtagatcccaatagtttttgttgagtagataattcagtataaccaggcagttctgaagaataaaatatggcaggcacactgtcacagatctttgcctgggagagatgaagacatgttcaatgtattctaagatcacaggatcaaaaatgaacagaggttaaaaacaaaaagactgaccacttccaggagtggtgaagacgaggagtcattagaactctcataccctgctggcaggaatgtaaagtggcacaaccacatggaaaacaatttgggcagcttcttaaaaaagctaaacatatacttaccataccatccagccttcctagtcctaggtattcactcaagagaagagaaagttttgtccacagagatttggacacaatgttcattgaagttttattgcaatagctaaatatggaaacatttagatggttccagaaaacaacggggatgggataacaattggggtcctccttcagttaacacttctcacataaaaagcatgaaccttgttactgctcaaaaggataatttcaagaatgtgctccgaagggaccgccaagaaaagttgacttgccaatcttattctaatttgaaaggcactaggtaa

SEQ ID NO: 1256 - DNA, 846 bp, Homo sapiens
cggccgatcttcttttattcttgaggaaaattcctaatggttgttttcatgagcatcggtgacagggagtttgctaccagcaaatattccctgccagtgtcttcttggtgaacaagtaagtatcagaggttaaaagaatcttagggctcatagaaaataattggccaaccagggcgagaatccatttcaagggctatttaatggtcatcaaattaaatacttccagggactaggaactcactacctccaaggccagtttattttatcattggacagtcttgactgttagacatttttcttatatttttccttttctgaaatgccacccttaatctctaacttacacttccaaagtcaaagtgttcccattaccttcttagtgtctcattgtgatttccccaaaccacaatgactgttttctcgtaaagcatatgccttgctcagttattatttacttttatatatctttatcaaggtataattgaaattcaacaaatagcacatacagtatagagttagctgcatcttcacttacctatacaccctcaaaaccatcataattaaaatagttgaatatgctcctcatttccaaaattttccacatgccccttttataatatctcctttattacccctagctcttccattctcaggaagccctagcttgctttttatccttagtttgcattttctagaattatgaataaatggaatcgtacagttcatactctttctttgtctgggtaccttcacgtagcatcattactttgaaattcatcctttttgtagcatgtatcaatagttcattgctttttattgctgagaagtgtttaactgtatggatgt

SEQ ID NO: 1257 - DNA, 630 bp, Homo sapiens
cggccgcatctccttttattgctagttcaaggatgcgtgtttttgaagataatttggtaatttttaaagtgtaatacttcatgtattttgtatatttaaaaattctcatgcttttatgtcaaacagaagacgaattatttatatttttaagaaatttcgtgaagtctaaagactgaatgatttagcactttcatcagttattgaatggccaatgaatgaggaagttaattaaacaatttaacaactttcagtgggacatgcatttcttatcaacccagagaaatgtacaaatcctgctgtatgattggtaaagttttcttttagtttacctgctattgggctccaggtttttatcagtgaaattctgctcctcactgccacccaggaaaagcaagtttccattacgactcaattgatattgagaaacgaggccattgggcttttctggcagactccaatataattccactgttgtagaattgatgataatgtgtcgaggtgtcacccaaactccctcaggagctgcctgcagtgtctgacctagaaaaggctcgcttgaagtgcacccagcagatgtacaagctgtaagagtgaagctgtagttggtgtatggctggagacctggatccc

SEQ ID NO: 1258 - DNA, 286 bp, Homo sapiens
cagatgtctgaatggcttaaagtaccatgcaacattcatttgaatgttctgagtgatcaaagtgaaatggctacaaccggaacacaatgaagaggtacagaaaacaaaactcaaacatcccaaggaaatgcgtgttttggaacttttggggagacagcatggtgcagccacattccatgattggctccagtggtgatccaggaagtgcctatgagtaagacttgtatatttctcatcactgctctttcaacttctagcacagcacctgacatgtaataaatattga

SEQ ID NO: 1259 - DNA, 373 bp, Homo sapiens
cggtctgtatcttgctttattataaaagttattttaaaatatacaaatgggaaattaagtgtatattttggaagatgatatgattacaattacaaattcaatacacaaaaaccactcatacaggccaggtgcgatggctcacaactgtaatcccagcactttgggagcctgaggtgggcagattatttgaggtagggagtttgagactagcctagccaacatagtgaaaccggtgtgatggcaacgtgcctgtagccccagctacttgggaggcagaggcaggagaatccgttgaacctgggaggcagacattgcatagagccaagattataccacttcactccaatctgggtgacagagcgggactctgtct

SEQ ID NO: 1260 - DNA, 919 bp, Homo sapiens
ttttttttttttttttagatattaaatgtgtatttattagtcttatgggcacaaaatgatttataagggcaacacaattcaagcactattgaatatacaggaggatctgcagggaattggattaccgggaaggctgacagcagtccatttaactaagtgagctgataggagtttggtggacaactgataaaagaaaggtaaaagttcctaatcttcacactgaaatcaccacatgttaaagagaggcttcatgaatttctatagagcacattccaagttaagctttgtagaaccccatcctatgtcacaggacatatccattcttttttctctcaaataacattgcctatgcatgtattgtaaactatagttttaaaaaatctgtcaactgtattcttatttttctgtaagaaaaatttggaggtactctgataatacaattgtgtgtcatattcataacccttcacttttgggaaatggaaagttttaaattataaaagacaaataatggtaaacaaatgactgtgtgctaaaattctcaattcaggtaagttatatatcattacacttcataaagggatattctaacttgcatttggattttgttgggacaaacattaatccaaatgtacattaattcaaattaattatatttgtcacagaggagttcatattgtagtagcattggctgcacattttgctgattctaaaggacatactaaagaaaatcaggagtatcgtggtaatgttctctctttttatttatcaaattaatgtctctttggcttttttccccctggttttcctctctcacttgacttcaaatcttctaattcacctgattgaagcactcctgaattcaaattaaaatttattttcatagaatccttgtttctctcttttcttctgtttttatcct

SEQ ID NO: 1261 - DNA, 544 bp, Homo sapiens
tacaccgccgcacccagcatgcaattctgggcccaagagtacctgcgattggaacatagcaccaaggaggcaaaaatcatggacttattcacaggaaggacagggagaaaaattatctccatgactgctgaatgcctttaacctcaacttgcaactaggcaaagatgtttgcctaatccaacctggttgcctaaggccaacccaagagaaatcctgaccgcccatcagtacttcctaaaaaaatgcccttaacattcaggccctgctggtggtgatgtcatcttcctgaagtcagcatgttccatttttcgtaagcatcatcataacgtttcctggctggagtctagaatgccaattctctctctcattgctcttgctacgtcactcctaaaaccagcttgatgtgccgttgaagacaagattccagtctatcctaatgacagagaagagaatttctcaaaaccttgattttctatgagaaactttgaactcttcctattcatgcttatttataatttatttgaataaatccctgatgcgcccg

SEQ ID NO: 1262 - DNA, 321 bp, Homo sapiens
catatttcccaggatactacctccagtacaatgttgaatagaagtggtgaaaaaaggagaaagattcttaggagtgaattagcagagaagattcttcgtcagagccttacttgggaagaatagggtttggaggaagagagtgaacagatgggcattgctcctggctgtccagaaataaccaaatggaacgtcttgcgctttgtgtggcaagccaatcaatatcttttttatttcaaagtcataaagatttgaatatggcccctgtactgtgagaagtggaccagcaggggacatactgaataaataaacacagatgggccg

SEQ ID NO: 1263 - DNA, 1060 bp, Homo sapiens
  misc_feature (1)...(1060): n = A,T,C or G
ttccatgtctaacatccaggtcacactgatgtaaaaagtgggctcccacgtccttgggcagctttgaccctgtggttttgcagagtacagcctccctcctggctgctttcatgggctggcattgagtgtctgaagcttttccaagtgcacggtgcaagctgtcagtggatctaccattctggggtctgaaggatgattgcctcttttagctccactaggtggtgccccaatagagactttgtgtggaggctccaacccacatttaccttatgcactgtcctagcacatgttctccatgagggccctgcccctgcagcaaacctctgcatgggtgtccaggcatttccatacatcttctgaaatctaggcagaggctcctaaacctgacttctatgcactcgcaggctcaacatcatatgcaagcttccaagctttggcaacttgcaccctctgaaacaatagcccaagctgtaccttggtcccctttaaccatggctggagcagctagaacttnnggcgccaagtccctaggctgcacagagcaggaaggccctggacccatcccaggaaaccatttttccccagtaggcctctgggcctatgatggaaggggctactgtgaagacttctgacatgccctggagacattttccccattgtctacgtgattaacatttggctcctcattacttatgcaaattnctgcagctgacttgaatttctgctaagaaaatggagaaatggtgncttctatgacatcatgaggctgnantnnttttgaactntgatgnngcattnnccttnnanaactgaatgctntnnacagtnctaaantgnctnactagaatgctgtggtgcttanaaatntttnntgtcnnatnccctatttgatngtnnctcaatngtcnnacnnttnaatatntctttggtnatggtnanaattgctactccctgttcntttntnaaacntntcnnnanttnngttntctttnaattnctcatnnatnnggttnntnntccngttnnancnatttnnttnctncatnnnatgaangnaaat

SEQ ID NO: 1264 - DNA, 172 bp, Homo sapiens
aaaagtgagactccaatagattgaagagtttacatcgatcctgactgcttctggtgaaatggaaaacaggatttattaagatatatcataaataaatattatgaggttgttttttgttcataatacattactgagattaaaaaaataatgtggacgaataaaaaaaaaaaaa

SEQ ID NO: 1265 - DNA, 960 bp, Homo sapiens
  misc_feature (1)...(960): n = A,T,C or G
actcagagcaggaagacagcaaggaatagcagtgaaaagcatggtgcttaatccaaccccttactcactgctgagacctggaaatgtgttcatcagctacaaaacaggagagatgataactcattatgtatatgtgatgataaacagagacaatatattgaagagcttatatgagtggcagacacgggacatgcttccctgtggctggccagcgtgtcatcttctccatgtgtccagagaaaagctttgcaaatcaacctctcgatgaatgatgacggcaccagtgaaatcaggggaggcagaaaatcatgttagtttggtttataatgcaagaagttacagaacacagagtgctcaaaactaagaatgtgctagttgtataacagggtccttcttgggactcagccaggattcaaactataaaggaaaatcgggtgagcaggtgggatagtcaagtgattctatttgcatgaataattttgtgagatgataccttcttgtccaggaacattgagcagngctcgtgctgggtggattgtgatgtggaaaccctgggagatgtcaccgtctgacatcaactnttctcncaggtgacanntgctccctttaaaggcttctcaaatgacagagctcaatgaatatagaagggaaaagtatgaggatgacctatgagcacagggtggacagtctctgcggtgggcaggcattagcaaaggagagaccttctgtattatgcaggtatgtgcaagaaccaaagaaaataactgtcatgagaattctgacctcattaatacccacagactagagacaccaggaatctaagcttgcaaaagcataagggaacataagggttgtgttcccttgcccttggggcacagcttttcaccacattttgtactaatttaaccatgatgcagatcgaagagccccagtgattcccaataaaatgcgatgcggccg

SEQ ID NO: 1266 - DNA, 1067 bp, Homo sapiens
cctcccctttgtaacagccggcacccaatttgctttatatggtcatgagccctcttacctgcagcatcaaatgggaggcatgaagccacgataaagaacaagcaaagtgagctccgtgaacgggctttcccaggctgccttctgcacacatgagcctacccagaggggacacagaacagggatgaggcctcttgcatctgtgggggctatgaagacaaatgttatgtgtacctaaaactaaaccagcactcactgcttccaggaagagttggaataaaaaggaaggagaaactcaccggaaatgaaactcaaaggccaggagtgagggcggttacccgccacactcctgtgagagcctacccatcatggcgaagctggagagtgggcagatcctttcccagagcccctccaagtcaccttggagataccatcagacttccctcttttcttcagatttcttcaaccactccacagacatatttaaagcacctgccacagctgtctgatcaaatagatccagtccggcaaaaacattgtaagctgaagagagctgtgaagaaggatgatgccaccggatgactcccctgtgggggacgccacaatggaaggcgtggggcacaccacagtggaaggctaaggtgctcactcagatggcttcccagtgagttttggggcctggtgttccaagggccctttgttttatttgtaaaagataggcgctgcagcattgtgaagacctggttgttttatgatttttggaagaccagcaagtttgtcataaggtcaaatatgggtcctccatggctgaccctggactgttaaataggtggcccatggcagaaaccatgtgtaggccattttctttgacccaccacctactccttttatcacatggccaatatacgagattctcctctcccagagaaaggaatcagttcattaaatttggatcattgagtttatcaccaaaacccagaaacaacacaaatgtcccttggttggggaatggataaacaaccatggtacatttatacaacagaatatcaacaataaaaagggatgtgccg

SEQ ID NO: 1267 - DNA, 398 bp, Homo sapiens
gtctcattctgtcgcttaggctggagtggcaagggaactcagctcactgcaacctccgcctcccaggctcacgtgattcttgtgcctcagcctcctcagcagctgcaactacaggcatgtgggtaggcttgaacttcctgacccccttgtgactgggtgaggctttgggactaagtctaactaatgaattgagattggatgtgatatatgtcacttagaggccaaaatgtgtcttgctaatatgagaccctccattagtcttccttctgttttggcaactggcaacatcccagatggtgatttcacatcagtctgggtcccagaggatggtgaagtggaaacaaaactctcatccaaccttcgatggacacacagtgtgagtgaggaataaaccatga

SEQ ID NO: 1268 - DNA, 565 bp, Homo sapiens
aaatactttgttcagcctcttccctcagatgccggcagaccagatgtccttgaagcaggcagcaaggcttcgtgcaacgctgacggcctctcagcttgtccctggacactcttctcagaactctggttacagtttacctctgcttctctaatgacacttaatcactttttatcttaaattacggtgtggttttgtttccgttttgtgtttctgatcatgcttaatggctcattagagagtctggctcttggagcttgaaggcaggcgggccccacatttgtgtgtgtttgttttcatgtttgttccctccacagcacctggctgtgcatgctcagtgaacaaatgactgcaatgtgcagtgatctatttacagttgtctgagaaatgtcatttatggtggtggataatcctaaaatatatatgaaaatatatggtgccatgatcaaattttcctcctaaaataacctgtgcaaggtgttcatacttttataccaacactgacattttcattctttagaaccttaacattttatgtctgtgactttaataaacatggatgcggccg

SEQ ID NO: 1269 - DNA, 768 bp, Homo sapiens
tatgtttcgaaagcatgactagctaaccatcttgaaagatgttaacattcaagaaaacatcagactgggtatcaggcatctgtggactcattctggattccagatgggtgtttgagacacaacaaatgaaaagccctattttaatacatttgcctgctcttgttttttcacttgacttcccaatctaatttctttgctgccaagggttctcactcatatcaccatttaaaatttaaaagcaatatatatttaaatgcgaaacaaaatgcttatatggagactctgccacagtggaaaatatgacagtgggtttcatttcaaagagttctggatgatctcccgagtggtagagccagaggagcaccctgatagagtgatcagttacatggaacttactgcttgcacaaccttctgccaccaaggctcacaatgaagcaaaaacgtgaaaagctcaatataaatgaaaaatattttatatgatactgtatgcatacttaccaagaatgtttatatgttttgtaataataatttgtagaatatacaaataagtttgtgtctggagtcaatagtcaaaagtgtgcttggagagcaaatagcaagttattctggcagtgaaatagggcaatggactacaaaaggtataacttcaaatgtatcttttccgactgcttttgtctttgttttgttttgtgtaccttcaaaaaattagtctgctctttcctgtggaagcagcactagtagttatatgaaataaatctagatcggccg

SEQ ID NO: 1270 - DNA, 495 bp, Homo sapiens
agagcatatgttggagaacctggcgttctatgtcatgagagaatgaaccagaatggggcatatgcttctaacctgaagacaagactgcagaattgactatatacacagtcctgtgtcacttaaagacagggatacattctgagaaatgcatcatgaggcagttttatcattgtgcgaatatcatggagtgtccttacacaaagctagacggtatacacctactacatacctagcctctatggtatagcctgttgatcctaggttacaaacctgtacagcatgttactgtattcaatactgtaagcatttatgacacaatggtaagtatttgtgtatctaaagatatctcaagatagaaaaggcacagtaaaaatacggtattataatcttatgggaccaccattttacattcagtccattattgaccaaagcatcattatgcagtacatgactgtatttgtgtaaggaaatttaaaaataaaaagcgatcggccg

SEQ ID NO: 1271 - DNA, 793 bp, Homo sapiens
acatgtccctcagtcactgtcctagattattaaattcaagcaaaaatctaaaggattattcggggcacctgaccgattggatgaggagagctacaggcagagatggaatttagatttcaagactacaaagttacaaattgtctatttgtttaaatcatataaataataagaaactgtagaaagcttgcaagaaaatcttattaaatcacttgtaatcctaccacctattaataactttgtgcttttccctttaaacttttcaaaaacatagcactgcagataccatatttttacatttttatgtcctttccatttagtgtacttttaaacttagtttaatatgtttcgatgttgccatttctatcaaaattttgtatttaatagctaagtaatattccacctactatttgccattatatttggaatttatattatttcaattttttgcctattgtaattacattgtataaatattccaggcatatgatgttttatattatttccttcagacagagtctccaaagtgagataatgaggtaaattttttgtatattttatgatcttgataatattattttctaattaaaaaatagatgagtcttcctgttcaatttagattactacatttaacaaaggaggatgagcattttctcattttgtataaatacaatatgcatgcattgtgaatgcgtgttcatgtcttttcctcattaatgttaatttgtatgagatctttatactggaatatattaaatactggttgtattgactgaaaataaaactcgatgtggcg

SEQ ID NO: 1272 - DNA, 667 bp, Homo sapiens
atgtctttcctgaacagaatgttccttaatggatacagcatactgacttctcaaagaaaaacttctgagtctcaaattgcagtgaactggaagaaacactgagagaagaactgatgtgaagtatagacagctaagtggtaaaaggctgtcttttgttacaatactgaggtgcttcaggccttggaagcacgcctcaggaaacaggctctctaaccttctcctgccctcctctcacttgctgaagacaggactctaatatgactatgggttatcagaccttcattccagagagggtcttgctgcatactctggaggaaggaatgctgcacagaatgaccaagaagaatctgaatagacaggaactgctgggtttagatcacaccctttttgtgcaatcacattttgaactggttgtcccttcttcaatcatggacaatcaatgaagtctccatagaagccccaaaggacagggttcagggaacttctggggagctgaacatatgaaggttgacagaaagatgaagaactcatccacgtgctgggagggtagtgcaccccaactccccaaagacagaagctcctgtatttgggaccctttcagacctcaccttatatgtctcttcatttggatgttaatatcctgtaaaatatccttcaaaataaaccg

SEQ ID NO: 1273 - DNA, 740 bp, Homo sapiens
caggggaaaacaaaaataatagcaggaagaacctcaccatcagctcaggggaacagatggagtgaaaatgctagtgcatcctgttattagccgaccttgaatcaagttatacacccaatcaatggaaaaagaggaagagaacaaaagaagcggagattgctataaaagcctctagctattgtaaaagggatcgagttcttaatttgattccctgcttggttgctgctggtgtataaaagagctactgatttgtgttcattaatcttgtatccagaaactttgctgaattcttctgagagttccagagctttctggaagagtctttagggttttcaaggaggatggtccttgtgtgcgactttttatattactttgtccgaaaattcagcatgccagtggaaactaatcaacttgtcactggatgctggactcctggactgactccttcatattccttctctctatttgagttccctctctgtgtttttatggcaggagctctgaaaaataaatgcgaaggtgttgtagaaacatgactgggcaaatacatcaataaagggggaattgcaatggaaagaagacttgtacacatttaggttataaatttatagatataagccgtttaaaaaaaattaaattcctttaaaaaataaacggccgagtcgggccgcttcccttttatggagggtaaacatatgaatacttgcttaactgaattcgctgagccacggccgtccgag

SEQ ID NO: 1274 - DNA, 1130 bp, Homo sapiens
aaatgaggcagatggcggggtatgataaaaacgggacccggccgcatctggttttatttaaaaagaattgtaaaagaaagaattggcaaaccttctccataacccaccatcaaagagagatccagaatatagtataatgtaacataaaaaccggtgctattccactcaggaagcaaagagcataactatgacaaccattgtgatttttcttttatagtagacaggctcagcacaggcagaaagaaataaaagcttcttagcattcatgagtatattgttccaaaatgcagaaggtgaaagtcatggtcatggagaagtcaagtgacctgggaagagaattggccatggctccccaggtgaggaggagacagaaatgaagctgggagacttacacccttcaacctcgttcatggaaccaagctcaagcctccctcccctgctcgcagtataaattgaacagagaagtatcaatgagtatccaactgcagggcttaaggaggaatattttgggacatttcaagatgcagaaaaggatccaaacatcagttctcaaatgaacgatgaaagcccgggtaccatttgttgagatcccttctgtgccaaactctaaatgcccttctgctgtcatgtcacctaattctcaccatcgaagtggatttggggatggtcttcatcctattttatacataaaactatgaagctcagagacctgcagtaagtagtccaagaccttagtgtagagccaggattaaaatccagctatccctccctccaaggacctatttgattgccttgctgtggcattgaatattatcacacataaggcttataaagtggggagaagacacctttatgcagtgcccgtgtttttttggcctcatttgcgtcttattttctagtccaaaacatcacagtcctcccactgcacagctgcctatacctggcctgtgccttcttgcgaaaagctctttggtgtggctggccagacttcagaactgcatgtttcagaaatgccttaggagattcatctttgtctgtgaagctggaggtgtcaaaggagttctgctctttgctttgggttcatggttcattccgggaggctgagagctgaggctctgccctggtgggtt

SEQ ID NO: 1275 - DNA, 879 bp, Homo sapiens
atttttttttcatctttttcctgcatgtagcaagtcaaggattgccattgcttttttagtgtcttgatatacctgttggctttttaatcattgcacataaaaggagccagtaataagcccaacttcgtgattccatcaaaacccatttatttgtgagtaattgatattggaattttcactgttttcttgaggtctgccagaccctagagacatacattgttagtggtgacaataaacattacggggtagtcagagtcagaaggagtaggatggcaggggagcatactaggatgctttcctaaaaaaggagaccatttgactttcccttgttaaagcataatttctcagttcctgccatggcccttgccttctcttctctgttctctaaccttagccctgataaatagtgaatacacaatgattcaacatttaaaaaattatcaagtaggccaagatgtccatggatattatatccctggtcatcatggggcatcttaggggacaagtgtcttttcctacaacaaggagattattcactagagtcttctgctaattcctgatacatggggataagatggcattacacagtctagacacactgaggttgatctctcatacttcaagaggccattggctccaaactgattgtgcgtcatgttttcatcgtggatcttggtacagtttagggttttgttcacttttattgtctttaacaggccaggtctgaggattttcagtggaagtggttacttgctggcccaggagagctctaaattcagtggtagaagatgctattgggtgagacttctagatagtgaagttccttttcttctcagcacatcacctgttaccatgcttcaggttctgaaagacatgaat

SEQ ID NO: 1276 - DNA, 848 bp, Homo sapiens
ttccggccagactcctagatttatttctggtaacaaaaacaaaataaacaaatggtactatatcaaactaaaaagcttatgcatagcaaaggaaacaattggcagagtgaaaagacaaccaatggaatgggaaaaaatatttgaaacacatatatctgataaagggtcatctccaatatttagaaggctctcctacaaggcaatagaaaaagaaaaaaaatgaatgacctgattaaaaactggattaaggacttgaaaagacatttttccaatgaagacatacaaatgaccatcaggtatatgaaaaaatgcccaatgcccctagtcatcaaagaactacaaatcaaaacaacagtgatttaaaaaaaagacaagtgttaatgcagatatggagaaattggaatctttgcacaccaccgatgggagtgcaatatagtataatgctgtggacaacagtatggaggtttctcaattaaaaatacaattaccatatgatccagcaattccacttctgggtaattatcccaaagaattgaaatcttccctatttttatttcaatattataaacagcatatttctcctttgatgattaaagctggttcagatccttttattccaaccagattctacttggaatgcataatttcaactgtcggacctgatacaaagtgaagaataaaacatgatgtacgtaaggcaaagtcaaattgatgcgtgttctttgaaggcaaatattttctaagtgccagaaatccaaaatggacccaataggttaatttttggaaacaccaaatcaaatctgggacatcttttcagacatagattcgtaatcaataatagcaacacg

SEQ ID NO: 1277 - DNA, 859 bp, Homo sapiens
catttgaaaatagaatctggaaactgtgccagttgactggaagtggaattcaaggtcaatttcctcatcctgtctattaagacaaaagctatgtggatcttcttatgttggggatgaatatggagaaaaacagtaacataggaagagcctcagaactccatggttatgatggagctggatcacgcttttacttagtcttcgaatgggggggcccgaccacgtaatatgttgtgcgaaaaagtatcctcgcgtggcgattgtcgtcccgccaaataaatccggtgttatatttgccaggagacacgtatattgaacaatttggggctcgtcttggtacgttggagcagagtagatggaccgcagtttgctgtcaacaccacgtacgcaagaagcgtgcccggtggcgtgacgagagaagccgaccgacgatcgaccttcctctgggcagcgggtcgtgagcctgggagtcagcagagtagggacggggctggcggcgcgtgatacgaacagtgatggtgcgaggtggccggttttggcggttgagcgctagagaggagactggcagtgagatagtgagggtagtgtgggggaagtggatactgcgtcataccgtttctgttgccgcggcgcagatgctcgcaccgtcggcgttatgacagatggaggcattcaccgttgttatatgtggttggtcatagaaatatcgagcgcagcgacgattgtgaattacgccggttctgtcgcgcaggccgtataggtggccgacgagccatccctagtcgcgcaggtaagatgggacgtaggatggtatattattttaccatatatttatagagagcggggtgtatagttatgtgct

SEQ ID NO: 1278 - DNA, 659 bp, Homo sapiens
ggtggaatgtcaagattaaggggtttgcatttgtcaagtgccttttcgctgggtcatcccatgatggaaggcagaaggacaggagagaaacagtcttccagaagctgacagaaagcaaaataaaataaaagaaggcaagagaaaagaaaactggtggaaaataaaaagtgctaagtatgactcttagtactttgatacaaaagaaaacagaggagggggactggggaagaagagatgagaaaacgtgttaaatcctcaccttgcctcagagatgatgatcaatagaagacatgagaattttttcttgattaatcacccatgtacacccttaatcctagtgtataaaaatgtggaagaatgggaatctttacttctgccttacaaatttcttggcggaaacaaaaacaaaggtaaaagtttgtgattttgctcctaagagccatagaaaaattctgaaatacaagtactgcaggagttgctctacatttgacaaagaatagattgtgcatgttgtcatgggatagcgtatgactggaggcgcttgtgcatttgtccttgttttacataacctacctcattcacgcatggcacaaagatcagcccatgtattcggcagaacagttaagtaaatcccaatccactcaacttcgacaccaatc

SEQ ID NO: 1279 - DNA, 441 bp, Homo sapiens
tctcttaatttccaccgctacagaattctccaaagcctgaagtcatccaaaggccaaataagattgcatgccaggagtgatatctgaaagtagaaaatagaacctttggtgttccagtcaaaatgaagggaagatgagaaggtgttcaagagatgacattgcgtagtgtcacagagaggactgaattgagagttggggggtctgggctgagcacctctgcctggaccccaggggaagcacatcccagcttgcttttctatcacatgtgtggggaacacagctccccatccatggatctccagaattcataagaagaagcctcatgggcatggaggcaaactaccaagtttccaaaaattcatttgtcatctaataaagcagcgtacgcgtgccgaaccgtcaaaagaaattacgaaaactaacagtcgacggacgtcagtt

SEQ ID NO: 1280 - DNA, 377 bp, Homo sapiens
cggacgcatacggggtttattagggagtgctctcaggatccaaacctgcaggaaggaaggggagggagaaaagcagggcagacgaagaggctgggtaagcccaaagtgactgggagcctgaagctgggatgtaccttcagaggtggatgcacctctctgtgggatgcttcacagaggcaaagggtaaggcctttatagtcctgtgctgacaagttgttggatgcaggctgcccctcctttctgttccattaatccatttacagctctttcacccagacctgcttcatcttgattttccaatctctcttgatcaaatggttaagcaattttcttgttcatgaatccatacatattctcatctggtgatgatattggga

SEQ ID NO: 1281 - DNA, 404 bp, Homo sapiens
atgaaaagtgaaccactccacgtggcctataggactctccatgatctggtctttcctgaccactccagggtcacatcatgccaccctctgcttcaccctggcacaaggcaaagggtcttctttcagttcctcaaatatggatcttccctagctccctgaaacaaccctattatatgcatttgagtacaccgtatctctttacggcttctagtgcatttatcatgtatttatttgtttaagaagttccctacatagctgttggctctatacccaaggtcctgtgtctgttttgctcaccaatgtatcaacaatatctaagggaatatcaagcacaaattagcctcccagtaaaatttgcttaatgaataaatgaatgaaaaagaataaaaaaatgatctgtcagg

SEQ ID NO: 1282 - DNA, 987 bp, Homo sapiens
cttgcgatcattgtttattattttaattgattagtactttacatgatttaaattacaattttgtttaatcatacatgctccctctctagttgtttgacaatgtagaggtaatttaaaataaagttaacacacttcctttttatttcaactaaattacagacgttccttccaattatagaatttaacatttccaatatagaatattcacaggaaacttgaaggataattacatgtagtattgtgtatagtgtatgataataactgtaccaaaattgttcttatttaaatagcatattacatacaatatgctggacttcagtctgaataattgtaacaaggcacccctgccttagctacccagagatgctttttgcccatatgccatgcactactgctttctccagccataaacttagtactctagagattgaaccatgagattatttgctttatcatgtgaggggttggggggagacaaagtatgaactgttcattaatattcatatattcttctattttgcgatactgttattactcgcccacctcatagttggccaaatgaaaaaagagaaacattaatcatactggatgtgatctgatgaaaaaattatcaaccagtttgtatgcatgagaattaaactcactgattctcttctgttcgctcctcctaagcagacgaatagtagtgatgctaaggtcttcaattctgtgtatactcttatctactttcttcaccaaatcttaaactgacttattgtaacatctgcgtttaaacaacttgtcaactcacgggcatctcgtgatccgcccgcctcggcctcccaaagcgctgggattacaggtgtaagttatccttttctttcccttgttggaggaggactcaattccacagcttcatcttagatttggcgtatgataaggagtccatgcaacccccctcacgacacgtttttgttccaaactcaactccaagctttaggtcaaagc

SEQ ID NO: 1283 - DNA, 960 bp, Homo sapiens
  misc_feature (1)...(960): n = A,T,C or G
gctagctgcaacgactctcttaatttccaccgctcagcaggttggggcctcagggccgcagcagcacagggagtgtgtccagctgcgatgtttccctaaggatgacactcccttcctcatctcgcttctgccgccgagaccaaagagaccagagcaggtggcttatccgtgctcttatcacgtataaagaccatctctctggcctgggaatctgagcagcatttggcggctagcctcccaactccatgcacacgcacctntgtgcagctgcaggtgcttcctcagaacttgagaagcctcaaaacacaagggacgccttcacgaaagctgacaccaataccagccagcgcgtgcaccccggctcgccaggccgccgctggctctcaggcaggtgatctgcaccactacgcttctgatttcttactgggacacaacagggaaggaacttggatcatcatcaacctgaagttggtgtgtacctgaacctcccagaaaagacaagaatacatttctacctcctcattttacaactgattacttcagcaacacatcggcggccatcaagttttactaaattgagaccagaccaactccagagtcatcggacagaggcagatgaggtagcatctggctagagagatggcgggcacctgtcaatggctgctcttgcaaaagttactgagactcgcagtaagaattacagccttcaaatcaaaagaaataagcgtttaggctgcaacacatagcataagacagttgctgtgggactttgcctgtgaatataatttctgttgcaatgtcatggttccaatggaagtggagaagcattataaagaaatagttaactgctttctgcttttaagaaacaggtttgagtcaggtaacccaaatatatcgatagatattctaacgatataaaatgttgattttggtagagaaaaataaagcttgatcggcacg

SEQ ID NO: 1284 - DNA, 488 bp, Homo sapiens
ccttacagttatgacactaggaagaacatattcattgttccaatcgttgggtgagttttgctggttctccagttctccagactaagcaggaagcagagaataagcaggatctttctctgccatccaggttggagtactgcagtggcacaatgatagctcactgcagcctggaacccctgggatcaatcagtcctccatctcagcctcccaagcagctggaacctcaggtgcacaccaccatgactggctaattatttttaaatgtgtttgtagagatgggattttgctttgtttgccaggctggtctcaaatgcctgggctcaagtgatcctcccacattggccttccaaagtgctgggattactaataaaaaatagtccaaatgtattttaatcttaaataaattgcaatacttaacatacagatacactcaaataaaaggagatgcggccgttcccttccttctttctttaacattatacactcct

SEQ ID NO: 1285 - DNA, 662 bp, Homo sapiens
cttaggtctggcaatctcaaagcttcttaagaaggcaatggatcaatcccttagcaataactctctcatctgcttttcattagcaataaaatagctttcctaccatcttctgggaaataacttaccatagactcacagaactgcaatggacttcgcagatcatctcatcaaggcacttttcctcaaaaaggactatactgaaatcacagatggtgtctacctatcctgttctttatgtcttcaggatcaaacagtgcacaatctcctttacagttttagattttaaaatctatactgtaaatcatattttaaactaataagttctttccttttctgacttaactttttattggagttttttctaatgttaggtcccctgagaaaatttttaaaagctgtgtttttgccattacaagtagcgtgctagtagccgtttaacgactggctcttaggataaagagagaacaccaatttgtaatatgtgctgattttcatggtgtaaatactcccaccacggccaatttcaaagtgcaaatataatgtcactcaacaccaagaagggaaagatggcataattccaaaggcacaagaaattagaaaaagaagggcaaattaaatacagaacaagcacaggaaagaaataataaagatagatgcggcag

SEQ ID NO: 1286 - DNA, 394 bp, Homo sapiens
atgctcacaaaatgtctcggataacagctggactcataatgtcctcatcatgaccgatccaagtttctgattgataccatgcatctttgcctgaagaacttcctgaagacttaccaattttagtgcggaggaggaagccactttcatgtttaaggaaaagctttaattgcctgtactctaaaaaaggaaaacgttaacatggagtaattccttcaaccactacccttgtaacttcttctgaccacatttgatgctgtctttcagatgagttaaattgaagagcatcatgaaattgcaggatgagctgttaaaaaactgttatcatttgcaattgttctatgtaatacagaattgtttttatgtgatgcaacccaaagtaaaaccagatcggccg

SEQ ID NO: 1287 - DNA, 680 bp, Homo sapiens
atgcccaggatgccctgagagttctgctgaattgttctggactgcaacaggtggatattactctaatgaaggaaaatttctgggaccagttatctgaagatctgtgttactatcatggagtctgctttattgctaaaactctcagtgaatataactttccacagtttccggagaccctgagttatctctataagctctcagtagaaggtcctagaaggtcagaagacactgtcatcgtattaatattcctcactgaacttctgaataacttcttcaaggaccctttaccagaagaatttttggtcctcttcataaactggatcaatgattccaatcctgtagttagcagactgatccttcatagaattgtccacatgtcaccaattatcaataaggtcgactgaatttaagcacgttccattttctgtaattctacactccaaagtatcttgcaaaatgctgacagtgcaaatgttctataaatcattacttttataatacatccaataataaatcgttgtttatctaatgagcatagtctctgagaactgaagcctatcagtggacacccgttgtgcatttagaatgacataagccatggtctgtttactttaaataaataaaacaagatgcggccggttatttatccactacccaccatctcccgtgttatcccactc

SEQ ID NO: 1288 - DNA, 326 bp, Homo sapiens
tcctgagaacaccctccagtgactgtcctgtgcactgatctccacctctaagttggcttctctcacctcagagcagaccatctatgggccgaccctataaccagacttataaccagaggtttggggggccagtagaggcccatttcacttctatttttacaggcacctggtatagaaaaatgaaaaaaaaaaagctatatcaggattacaaaatttgtggtacattttcaatgtttatattaaatatgttaaaactttttaaaaagtagacaaatgtaatatgatcttgctatgcatgagataatataaggcttaataaaaaaaga

SEQ ID NO: 1289 - DNA, 787 bp, Homo sapiens
ctgtctgaaccttcttgccaagttataggtaaccaaaaacatctttacaaagctctctaacagaacaatgtgaatgtaggaaaagcagctccagcactcttgtcaacattctgtgccttcatgcactgggctgaggtgaacccttcaaataaaagaggacaacctactaacaaaacaatgaggcagaagaagtgggtgctaagaggaaaagtaactaagaggagaagtaactattagcaattacttgttgccagtaaatgaaggatgagagacggagtaataaagactatggaaatcatgttagacaaaatcaaattagagcaactttcttattcaagttcaaaatggcccataaagtagtggagacacctcacaacatcaactatgcatttggcccaggaactgctaatgaacatacactgtagtggtggttcaagaagttttgcaaaggagacgagagccttgaaaatgatgagcatagtggttggccatcaaaagtcgacaatgaccaattgggagcaatcatcggatgatccttttacaacaacacgagaagttgccaaagaacctcaatgtcaaccatttggatagtcattccggcattgggaacaaattgggaaaggggaaaaaagcttggggagtgagtgcctcataagctgagtgaaaatcaaaagaacttggcatttagaagggggctccttctattaatcaatacaacacattaaaccatttgttgattaaattggcctgatcgaaaaaaagtggtcctcattgaacagcgggggtg

SEQ ID NO: 1290 - DNA, 1002 bp, Homo sapiens
atggagtaccttaccagactagcctttgaaggaagcagtgacatgagaggctaaaactgaagactggcaagactctacagttgagctgtccaatatgggatcaggttaagcctctgtctatatttcactgggaagtcatcgggattaagctgtgcctttctgtctgtcatactgacagcacctgcaacgtggactcgattttgataagcccctccactcgtcatgcaactccttttagtcaaaacaggccaagatggaatgaagagtctgaagcagcctctgtgagacatcaggataggcatcgatggggtttgctatttccatggatgctcagactctaaggttctacaggttgaaattgcatgtcctaactgactcaggtgtcatggcttgaattgggttccccaaagatgatgtgttgaagtcctgactccctgtttctcagaatgtgagcttgtttggagagagggtctttacagaggtaatcaaattaaagtgaaatccttagggtgggctctacaccaatatgatgggttgccttataaataaggaaacatcaaccacaaagtcatgcacattgggggaaatgccatgtgagataaaggcagagatcagaataatgaatctataaaccaaggaagtgccaaagctggccagcaagctgccagaagttaggggagaggcccgaaacagattatttctcacagtcctcaggaggaaacacccctccaacaccttgatctcagccttctggcctccagactgtgagacaatagcttctgtggtttcagctacttagtttgtatccctttgttagtgcaagcctagagagctaataccccaggaggctcctctagtcaagcaatgataaacctcttctctcctggagtcctagttcccaactaggaatatggatttcttcacctaaacacacatctctagtgtttatctgagaggagaatcagtgggattcagatatgttctttaggttcaaggagaggg

SEQ ID NO: 1291 - DNA, 860 bp, Homo sapiens
ttttgaaacaccctttttgtactacttgcaagtggacatttggagtgctttgaggcctatgttggaaaaggaaatatcttcaggaaatctagacagaagcattctgacaaatttgtttgtgaggcgtgcattcatctcacagaatcttcatgtggatatttggggccctttgcggcctattttggtaaaggaaatgtcatcaaataaatactacacagaagcattcagagaaacaattttgtgtgttgaacctaccttttgattgagcagttgtgaaagtctcttcttgtagaatctgcaagtggatatttggagctctttgcggcctacagtggaaaagataatatcttcaaataaatactacacagaagcattcagagaaacttctttgtggtgagtgcagtcatcacacggagttgaacctttgatttgattgagcaattttgaaacacactttttgtagaatctgcatgtggacatttggagaggtttgagggctattgtagggaaaggaaattgctttattttaaaactacacagaagctttctgagaaatttctttgtgaagtgtgcatttaactcacagaactgaacccatcttttgattgagcaattttgaatctctctttttttcaaaatctgcaagtggatatttgaagcgctttgtggcctactgaggaaaatcaaatatcttcacataaaaactacacagaagcattctgagaaacttctttgtgatgtgtccattcaactcacagagttgaacctatctttcgattgagaagttttgtatctttatttttgtagaatctgcaagtggatatttggagctctttgcagcctatggtgcaaaaggaaaa

SEQ ID NO: 1292 - DNA, 766 bp, Homo sapiens
attcaagatgtagtggactgtgaaaagttggatgactacctcctctaccttgaaaggtcaatgatgatggcttctgaagcactgggtaccaccagagggaaagctggggcggctggatttcttcgtgctgaccgagattatgtgccaccctctgcacaactggcaactgctggacggtactatcattatagcttgctatcctctgaaggggcttataagccaacctctttttcatatctacaaatcaaagcagaactataggccgacgtagaacagctaatattggatccattctctgtattcaggcctggactactgctaccaggtaggccagaatctctcccatgtgataggctggttaaaaagctgtattgctgcttaccaaactatagggccactgggcattctgtggatgtaccaaccatagttagaacagtgctgaacaatgtgcttaaaccaagatacaatcatgtgtatctgttagagaacaacgccattcatgccctgaggaaaaaacatgggtttctaatccctgagcgaagtggaaaattgacacaaaaagtcaccttaaaacccatgacgaaatggggaatttgcggtactaaaaaagttagcatttttaacccgcgccgattactatgccgaggccttcatcacatacgagaactgatgtgtggttgcattaatgggcacagccttgtatccctctaagcagttaagagacctaaaaaaacagccctggcgccccctcaataaacccgagacg

SEQ ID NO: 1293 - DNA, 932 bp, Homo sapiens
ggggcagcgttcaagaggatgactagaagattttgatacatattccctgaagttgaaggacatgtggacttgtgtttgactgtcatgtgaaaaatcaagagacagacaaacagtatagatgctgatggatgagctgaagtgaaagtagctgctttaggatcagcctacactccaacagcatgtgaagccgtaatgacagttgtgattggacaagagactgatttcagtaactttctcccgataagaagaccatggaccatggattggttctagctggattgtagaagctgcaaacttgcatgccttcatgtcctgaaaagactttttgacacctagagcctaattataatacatttaaatgctcagtctccattccaaaataaacgtgagtcctatgttatatgcatgttcactcaatatgcacatgtcaaggaccaccttcatgaatatccatagctcctcctgtaacatgtttaatatgtatgttttgctaaccctttcagcataaagcttccatcccagcccctcctcctttaaagagcctgtctctggtctttgcctgaggctgctctttttagcctgtgggatagctacccccctttataaaaaataaaagttccttttctaaatttaataaaagggggttttgaaagttaacattaatacccattttatgggaactatactttagaaatccccaagagtagtgacggaggagctgctgtataattgtgttagctaagtttttatttagtgtcttctctcaaatacacattattttggtaactcttaagtcaagagttttcttttaaaggttgtcctgctgattatcactctaatatcttactgtcagcttaccagtggcaagaataaacaagatgcggccgtactataaacaggagaataaataaggaatcggaactatcaacatt

SEQ ID NO: 1294 - DNA, 441 bp, Homo sapiens
ctagattatagaaagagcacatttcaaacttcaaataacatgaatgaaagccagagatgactactactccttgtgaagatttttggaatacccttttaactaccttcttacttccattccttgtccttctgcagtttattctccacccagcagccaaaaagatccttttaatcacgaatatgattatgtaatttctctgctgaaaggctctgaatgcttccctgtctcccatgaagaaaaaacttaactatactattggtggaaatagtgcagccattatggaaaacaatatggaggttcttcaatgaaatagaactaccaggtgatacagcaattctacttctgggtatttatccaaaagaactgaaattaggatcttgaaaagatattagcactcccatgttcattgtggaaccattcacaataaaccatgatcggccg

SEQ ID NO: 1295 - DNA, 427 bp, Homo sapiens
aaaaaaacccggcacgcttgctttctttattgtttaactgcaagtacagatacaatcagctcattaaatttaagcatcatggcgagtggaggagaggacattaacactctctcataaaaattaattggtgacaattgatacatactatatacataaatcatcatgttgggttatcagcaaatacttttgactcaatttaaaaaattcgaaagttaaagtcaaagcatgacaaattactacatatcatatacggataaaaaggaaggtatctcactggtcttagtcccacatcctggaataagcttcaccatgagcatcactgtgcatccataacagggactttgaccgggaataccagcaagggaggcatcccaatccagtgtgccaggagatatgccccttactaagccatggagtataatgaaac

SEQ ID NO: 1296 - DNA, 1076 bp, Homo sapiens
caataaggtaagaagacgtggattagtcttagctagagcccactcattgcaaaaatatcttcctacactcaaggctacactgttctgcgctaaggaattacagcttccttgaaaacttacactggtcagtaaagaaggtcattggcaggataggatgaaggaaaccatgttgtgaaataataattcaaaaaagagcaaaggaggaggaggaggaagaaaggagtaaagaatcccaaaacaaagagaaagaagaaaaagaaaaagaaggaacaaagaaaggaagaagggaaggaaggaaggaaggaaggaaggaaggaaggaaggaaggaaggaaggaaagaaggaaggaaaggaaaaagtaggaagaaggaaaaatacttcagtcataatccaggaatgttgattaaaacctgttaactggtatatttggtgggcaattttatcaattagttatgctatagaatatatccagtgtgtctcatctttcaccaatactacactgtcttgaatgttgtggtttaatagtaatttttgaaaacagttactgtgagtcttcttttgttttaattgttttgacaattctaatttctttcctttgccatgcaaatttgaaaatcagcttgtcaattatacaaaaaaatgtggttcttgcaaggttgaatttggggatagttgacatttttaacaatattgaatcctccaatctatgagtatagtgcatgtttctctactaattgaatcttttcttattgctttcattagagttttgcagtttcagcctatagattgtgcacatattttattagatttatccttcagtatttctctgtgagtggtattgtcagttataataattttatttaaattttactagttaatcccccaaaaatccaaaatttatttttttaatgttgagctttagttagaaacattgggaatttttatgtagacaatgatgttgcctgtgaatagacacagttttatttcttcttctccagattgtatgccttttttcttccttacctattgtaaaacctaagacctctataatgatgtaataaagatggatgcggccg

SEQ ID NO: 1297 - DNA, 847 bp, Homo sapiens
cggccgatcgtcctttattacaaaaaataactcaaaatgaattatggaattaaatgtaaaatgttaaactgtaaaacttttaggaaaaaatttgcaggatctaagcatagacaaaagaattcatagacttgaaccataaaagaaaaaaattgggccaggtgtagtggctcatgcttgtaattccagcactttgggaggctgagacgggtggatcgcttgaggccaggagttcgagaccaggctggccaatatggcaaaaccccgtctctactaaaaatacaaaattagccagacatggtggcacacacctgtaatcccagctacttgggaggctgaaacatgagaatcacttgaatgcgggaggtggaggcttccgtgagccgagattatgccactgcacttccgcctgtgagacagagttagactctgtctcaaaacgacaacaataataacaaaatataaagaaagaaaaaaaattgatcactttaatctcaataaagtttcaaaccatctgaattctgaaaagcttttgagtagaaaaaagcacccaggtgcagaggcttatgcctgtaatttccggatttgggcattaagaggtttaaccatgggagttgaaatacagtttggcaacaggggggaactcctgtcttttacaaaatattttttaaaaattaacttgggtggggagttatagcttgtactccggcctcttcggaggtttaggtgggaggattccttgattccccacggtggaaaaatggaaccggatttacctccatccttaatggttcactaactttaccttttattaatatttattttgtcctaggatgctgggtaatacttt

SEQ ID NO: 1298 - DNA, 305 bp, Homo sapiens
gctttgattttcatgctgtcccaaagttgcagacatgttcacgacacagctgcgtttgttccttcatcttgttcagcaacctttggaaaaggaagatcgtgatagtctgtcattgaaactgagctcataccctcaggtgaaacacctgggtgcttcattaccaaattcatgtctttcctattctgagaaacatcctccaagaggatcacctattttgggacttgggagtccacatgtgctagatggtgtagccacaggatggagaagagtagctgacctatactgaacatttcaatgagtgaaaa

SEQ ID NO: 1299 - DNA, 485 bp, Homo sapiens
ctgcaggttggcatgctccaacagcatcatggacggggcctacacctacgccgaggtgaccaatgtctccaactgttggatctgcacaactcttccagcagcagctggggacagcttgttctggcacgtgcatccagcttctatgcagaagtggacatggctagagacttggggtcctgcagacaacagagtctcactctgtcccccaggctggagtgcagtggcaggatcttggctcactgcaacttccgcctcccagattcaaccgattctcctgcctcagcttccgaagtagctgggactacagtggcttcaacacctcttgacactaagctacagaaaacagaagtgtgtcagctggcggttcctgagctcaaacctcatggctttatgattaagtgatcttcccaaagattttttttgaaaacacaaaactcacacaaacaaaacaagcgcaacaaatattgaaacaaaataaacctaga

SEQ ID NO: 1300 - DNA, 309 bp, Homo sapiens
aaaaacaggttgcatccttgcattaaaggagaatgggaaccaggctagagccaaagatcttccagcctttctctggaatggaccgaatatggaataacatggacatgtctgatgcacatctggagatgggacggcagcgcataatacttcctggaactgcgagacaatggggttgtcttttgacattgaggcaggttattaaatagaagtgtgaactattaagagatgatcttgaccctcaatacatttttatcaaagtcaaaaaatatttgacaccaccgaacagcttatcacaggcacaaaagtaga

SEQ ID NO: 1301 - DNA, 794 bp, Homo sapiens
aaccttctgtttgattgttcttaaaattggccttaacaacaaaacaaatggagagaggcccccagaccagagctctgtgaagtctaggaagttcttcaactcttacttctccaggatgctacaggaatcagcaagaggagatcaagtgaatttagagatacaagcttttcccaaagcatggcccccgggaagaccaccttgagtcagaaaaatggaaatcaaacagtacctggaagtcctgaagggtagagatcttactggacaaaaccctctgccctttcttaggtaggaaaacataggttttgtatagagttacaaacctgctatccaccagagcactcaggactgtggcccgcaatttacgtgctggcttgcagcttcattgccctatgtgttgccttctgtaatgtatttttcctggttacttagtaactcacatttatgtaaacaccatagcattttctgaaagctctgacttcgtccccttatttggaagatgctagctatctccccacactggtattttaaaatccagcattaattacagtaattccttctactcatccatacaggcacatgcagaaagaagtgaaaagttatttgtttcttttttccttcataaagagcctaaagaaatgtgttaattaactacaaagttagccaagattggatttcatttttttgattttatagatggcctcagtgcaaaaatatccggctaccgagaatagttataaaaaaaaacgaccgtccgactgagcataagtcactataagtgcctcttatcgggttct

SEQ ID NO: 1302 - DNA, 589 bp, Homo sapiens
atgttctccatcacatttaactttcaatgtgagtgctgctgtctgaggaagcaaagaaaagaaactctaagatgaatataatttgaatgtgtgaagggagaactcttggaagaagaaaagaacgttcttaactggtatacgttcttacaaggaaaggatctagtacatgacctgtcacacagctggatctcaagaatgtttgttccaatcctgaaacaggcaaaaatgttgagagtcaagaaagagagaaaggaaagaggtcttaaaatgagccatcatgtacgagcagaatgcattccggggcaaaggggaaaatggaaaagttcagaaatccatctagaagaaataggatccgttggttgaatccatacatgcagaacccacagatatggaaagccaaatgtgttccaggagtattatctgtatgggccattgaatacatagaacttaatgtgacttaaaacattatattataaattaatttagcatctaaatgtatgttaaattataagcggactcttatttttaaataaacctggatgcgcgctgtagtttattttggtcgtcttacgccttttcatctctatac

SEQ ID NO: 1303 - DNA, 428 bp, Homo sapiens
gaatttcaatccccacgacaacagtactgtccagagacagacatcccatcatgatggagcaaaccaaggctcaagaaccaaactaaagccatcggtaatgtagagccagacgttatacttaaacaacaaatatgctttctctggaattacaggtgtgggtcttcacctcacacaacccctacggaatcacaagaggaaaataccactatttctcagtcaggcggaggactaagaattcaaggcctggatcagctcaattacttgcctactctggacctgagcagctgtggataaaaacaactggagaaaatcactcaacagacagactcaatttactttaaaatatgtgatttcaaacctcaaatgtccaactcctggcaactgcactatattccctaataaacttgctttcccaaactccaaaaaac

SEQ ID NO: 1304 - DNA, 701 bp, Homo sapiens
atgcctacttagaaaatgatgctgtaagactggagatgagaaatttcctccttctggtcatttcagtgacagcttcattacattctaaaggcaagaagtctgagatcaaggtgtcatcaaggttggatccttttgagggctgtgaggaagaatctgttccatgccttcttggcttctggtggtttgctgacactctgctgttcgttgacttgtagacatatcaccccatctctgctctggatttcacatggagttcttctttggtgcatgtctgtccccagatttctcctttttattggggcaccagtcattacggatgagggctcacctaatgagctcattttaatgtgattattcggtaaatgtcctatctccaaatcaggtcatattctgaggtactagatgttagaacttcaacatacaaatgggggcagggggaatataattcaacccataacaagggctctctaattctcagtttagtaagtcttattatttcagaggccatgaaaaggggaaggaaggaggaaggcaaaattttatttaacaaacaaacaaaacaaggaaatactccaaatcctttttcccccataagaaatgtaattaacagtgtaaacatattagatggatttcaaggggagaaggagcaatttctaagtgtcctgaagtgtttttgtatacaaataaacatcgatggggcg

SEQ ID NO: 1305 - DNA, 667 bp, Homo sapiens
ccttgccgcagagctccaccgctgaggtccacgaggccagccctttatttgttaatgtggtatcacatttatagctttgcataagccaaacaatccttgcatcccagggataagtcccacttgattatcatgaattgtctttttaatgtgctcttgaattttgtttactagtattttattgagaatttttgcatctatgttcctcaaggatattgcctgcactttcttttcctgtggtgttcttgtctggctttgataatagggtaatattggctgcgaaaaataaatttgaaagtattctctcctcttcaatttttgggaaaaaatgagaatatttggtgctaattctttaactatttggtagaatttaacagggaagccatcattttctgggcttttctttaatgggagacattatatcatttattcaatattcttactcattattagtctgtgcagattttctacttcttcatagtttagtcttggtcaattgaatttgtctagaaatttatccattttttctaggttatctaatttgttggcatgtaattgttcctaacaggttcatgattccttctgtagtatcagttgcaatgtcttctttatttatgtgagtcttttctttgttttgtagatctattattcttttatttctctcttgctt

SEQ ID NO: 1306 - DNA, 389 bp, Homo sapiens
ctgccagctggttgtggctaaggagagacatacatggcagagaactgatgtctccagacaacatccagcaaggactgaagtctgccaacagttacatgagtgagcctggaagtggatccttccgtagttgagccttgagatgaccacagcctgggtagacacattgattacagtctttgcagaaactctaagccatgcccagttttctgacccatagaaactgtgagataataaatgtttgttgttttaaactgaaaaattatggggataatttgctgcacagcaatagatgataaatatattatgtacaacaagctgagttagacagataatttaaaatgcatataatctaaataaaatatacaacaaatataccaaaaaaaaaaaaa

SEQ ID NO: 1307 - DNA, 1140 bp, Homo sapiens
  misc_feature (1)...(1140): n = A,T,C or G
actgcaaacaagaagtccctctacatctaatttttaatatttgtatatggatggaacatcttattggaaatccaagaattcatccctgaaaatatattactttatatgtctttctatgatgtattgatttatatgaaaatattgaggaaactaaataggtcagtttggacaatcactacagtatacacataaaggagccaagaaaacactagccttgattctgaacttgattgagtttgctcacaagaggagagtttcaacataaaaatatatctcctccaagtcactttgagtattgcctgaagcaaagaagaaattgaagaaaagccaggagttcaggacactgacaactttgccacaatgatatttttctttcttctatctaatgagcatcaaaagggaagatgttgctcagctaccatagaggtatgtgaaaaattttcctcaacagccagttctgctgcttcagagaatctgggagaaaaggaagcagaattctacatggcaagtaaggctattagtgtaaccactcaaatataaagggagacatgaatccagtctaacatgaaacaacattttggataaacttttaaaccacttatgatgtgaactttaaaactggagaatatataatgattcacatnatctgtnagacaaatatttgngtgatccacctaacgctgtttannaagtgccaaataattgnnctttatctcactatgtcctgtggggtgaagaaatagtggaactgattgtcggacattataatgacttattgtatttacacctggggtcatattgttgatgaataatgttggataacattttcatacatatgtatgaaatatatcataatagcttattcttttttcaaagtcaactgtgtcagacaaaaaatataaagataaacgtgaagcagaagcatcgtatctcttgttattattatatattaaatttattttgatcgtattaatttttatatagtgcaattattgctagatgaatcgacactcgaggttccggattgactcagtttttgtagataaataggaatgacaacgatgctcatgcccaattatagttgtgcttagattaaaaataagatagtttattttaagttaactacctcatagtgcatat

SEQ ID NO: 1308 - DNA, 394 bp, Homo sapiens
atccagaggaagaggagatctgactgtcatctgcacatggaacaacagaaactgattttttaagatatggtttcatctgatgcactgtatcactgcctaagacagcaatcccttgatgtgccagagattctgatgcccctgtaggtgattgctgggaacttgtttttctgtttcctcttttgggatcataattggaaaggtcctgatcacaaataatatttgatggatgggcagcattttcggcaaggacacttgcagtttctgaaatatttaatttgccgattactggggaagaaacatagaattcatggtctttgtctgtagcttctgtaagatcattctctttctgtgaatattctgtttgaccaataaaaagctggcctcgttggcctca

SEQ ID NO: 1309 - DNA, 1500 bp, Homo sapiens
ttttcagggtaaggcagagtagaatttactgaatgaaagaaaaactctcaacagcaagaggggaccccaaagagcgtagccgtctatgaggctgaatccagggttttatgaacttagaatggggggaacgcatgctgattgatttatgggtgggcttggaaaggggagcatttgattggctaaaaggcatcattcagaaagaaccaatagagagagagtaggtaagatggaaatggaagttctcattctggtccgtgaattctatctgtaactgttgcttggttttcaggctttagactgttcttggcttgaaggttgagtttcaccagggacccatccatgtctgccttgtctgtttcttgtagctatcaatatcatctaggtttgtgtatgtacactctatgatgttcacacaagggcacatttacctaaaagtgcatttctaagaatgtgtcttcattgttaagtgatgtataactgtatattaaaaagttctgtcagaattaaatgaactagtcaatgcaaataaacatattatcaaagttcttgtcatatagtaaaagttcaataaattttaactattactattatagcatagattaattcctttctacacttcaactgtggaataaatactctttttttcagttttcctagatcaacttaattttagactctgtgacctgatttcacttcagtgaaattcaacttcaagtaggaaaattttacttcatctaattgtggggcttctctctacatctgagttttgctatgatgccaagaacccagaatttttggtagtatcaaaaatgacgtagagaaggttatgtggttacccatcatctgtccacatcagttaacaatgaggcacccattttcccatcttgtagtgtcccttcatatcctttgctgtattttgacctgttccaggcagaataatctttggcaagtcttggattcccaggcctcattcactctctgatgaacactagggtaaatgtttattccaggctctgggcaccacctccaacctgtgacttccatagccctctctccctccttcttcaatcttggaaacttccttaatttctatgccatcgcacattactggtctctctcctacctctccgtcctcttcttctctcctgcctttgttagttcttctttctttaacttctttaatgtctttccacgcagtcctgttctcactctaaatttcctcccagggtgattgcatttacatagatggattcaagtacatctgtatactgatggtcctcaaatttacttctcttgtcaaggcattttctttcagctccagactcatatgtttaattagctcatccgcatctatacatggttttgtctcatcttctcatcaacatcttcaaaactgaatttttgatctttcccatgaacttggtcctcttccagactcatccattgaattaggtcattcatatctgcaattggaagtttcatctttatgttgtacctagg

SEQ ID NO: 1310 - DNA, 1093 bp, Homo sapiens
cggttggttaccgacatccccatgcaatggagtgaaaggagaatggtggcattttcaactagccattttcaaggtgtgggttattgattattacttccattagattcacctgaaggcttttaaatatccacttcattagcttctttttaaacttgctggaccagaaatactgcagaatgattcacgtggccctgcatgtttaagaagcaagatatacatgccaagtttcgagagacataaaccttaaagggtcatgggtagagttggaaagcaatgtccaaagttctgcatggcctccttgtgtctagaatcagctcccaaaaaggggaaggtggtagaaaatcatgttgactcttgggaggcaggccctaccttttgaagatttggaacttcaggactccagtcaagtagactggggatgaaaattacttctctaaacccagcaagggaaaacagaatactaggaagatgtaggggcttgtaaaatacagatgagagggcattattggttttggaagtttctctagagggagttgaaatttgctcagccagccccccaagtttgaaaagctcatgtgaacaaaagcttaaacctgggaggtaagccgagttaccagggactttttggaatttaggatagggggggatgggttaaaaagtcagtaatcagaggctagaccgccaaggaaactacatactcctgttccaggctgggtgtgataaatccatgggaagatggcaataggaatatggaggattgagtctcgtgcttgagatctgtagtgcagagtttcttgtagagtctatcaaaatggtgcatgacaaaacttagctgggtgtggtggcatgtacaagaagtctcagctacttgggaggctgagtgagagtattgcttgagcccaggaagtcaaggctgcagtgagccaatatcacatcactgcactccagcctgggcaacagaaggagaccctgtctcaaaaaaagttggggaaggagtgcacagagggaaattttttttaatgggcaaggagaaatgggattgatatcttgctctctatagaagaggtttaagagagttcagctgcaggctatg

SEQ ID NO: 1311 - DNA, 284 bp, Homo sapiens
cggccgcagagctccaccgctgaggccaacgaggccatctttttattgatgttatccatgtttaggagcatgttttgatcactgaaatagccaagtcccctctgatgagatcttctccctgtgttgtcttcactgataaagcagccactcaatggtagccttgatgaccctgtggttgaagagggcaatgatggtagctgccaggccacagtccacccaggactgctcttctcacctcccacctcagggtcaccagaagaattcaagaagcacttgaatttcct

SEQ ID NO: 1312 - DNA, 777 bp, Homo sapiens
aggtctacaatctctcagctgttatttcaagaaagaaaaaaaatagaataaacacaagattcttctccactatcccaagtctgacacagacacacttggtaaaaacttgaaactgttggagacttaagtgaaagaggagaagaaggcctgaagacacaggaaaaaataatgtacaaagcatttctaagtcagtgaagcatgaggaatccagtgcacagcatctccgtgaagaatgaaggaaagaaaggcacctctaagaaaatgtctatccttaaattaaacactaatgtatgataaaacgtgcatagtagtctatattcctgtttagacctgtggggtttggtgacatttgcatttactttccttgatgcctattagaaaatgattaccatgaaagcagatgataataccttctttgcatctatttagatatttatctctgacaaatagaagtaaaccttaccaagatatacatagattaaccttttttggttgctgttgacctgcttattttacctatatgaaaactctaatttttggactcatttacagaatttttccttttaacgcatgatcgaatgtttatgttatccctattcggaccaatgctaactaaagacaagtaacttttatgtcacatccttatcctccgtaaaaaaacattggtctccttcgccttataggttgatttttgtcacctttttcttttaggaagggtaataacgatccgtacacattactccctcgcgctaggtcttccggctgcgtaagcgccaa

SEQ ID NO: 1313 - DNA, 309 bp, Homo sapiens
tttcaggtcaccaatctctcagctgttttttcaagaaagaaaaaaaatagaataaacacaagattcttctccactatcccaagtctgacacagacacacttgaaactgttggagacttaaatgaaagaggagaagaaggcctgaagacacaggaaaaaataatgtacaaagcatttctaagtcagtgaagcatgaggaatccagtgcacagcatctccgtgaagaatgaaggaaagaaaggcacctctaagaaaatgtctatccttaaattaaacactaatgtatgataaaacgtgaaaaaaaaaaaaa

SEQ ID NO: 1314 - DNA, 175 bp, Homo sapiens
ctagtgcactcacccaggaaaaaccacatgaggaaacagcaagacagcaagacagtggccacttacatgtacaaaccaggaagagggtccccaccaggaaacgaatccactgtcaccttgaccctggacttccggcctccagaactgtgagaaataaatagttttttaagccaaa

SEQ ID NO: 1315 - DNA, 180 bp, Homo sapiens
cagtggcacctcacccaggaaaatccgacatgaggaaacagcaagacagcaagacagtggccacttacatgtacaaaccaggaagagggtcctcaccaggaaacgaatccactgtcaccttgaccctggacttccggcttccagaactgtgagaaataaatagttttttaagccacccaa

SEQ ID NO: 1316 - DNA, 750 bp, Homo sapiens
tggccgcagagctccaccgctgaggccaacgaggccagggctttattcagaatacataaagatatatcacaactcaataatgagaaaaacaagctatttaataaatgaggaaaagatttgaaaagatgtttcaaatgtgtggcgggggcaaggggtatatgggacatctctgtaacttcctttcagttttgctgtgaacctaaaactgttctaagaaaataacgtctttttttaaaaagcaggcattttatagcataggctaaaactgcatatgcagccatgatataattctatggatacacgcacatcatatggaaatgttccttgactgggtcttaaaaagtaacataaaatgaaataaagaaaaatcaaataatttctaatcaatcagtttacaatcctgggaatttttcatttagctaaacttaccatagagataacataagatgcaagaaacaaaccaaaaaaaaaaaaaagaaaaaaagaaagaaagaaagaaaggaaataagaaagaaaggaagtccattaagcagaattcaaggttgtcacatatttatagctcctcagaggggccatttgttaccgccgatgacctatgttgcacatcatatcactcaaagtccacagtttacattagagtttgctattggcggtggcaccccctaaagccttgacaaatgtataatgacacatatccatttttatagtgtcatatagactagttcactgccttaaaatcctctgcgctcc

SEQ ID NO: 1317 - DNA, 901 bp, Homo sapiens
cggcctgagcagctccaccgctgaggccaacgaggccaggtttttattgaagacatcacaaaaggctggttctggctaccttggccacctcataccccacaaatggttttgtttccgctcacttacggctgcctgccagtcacccagtaagcaagccagcacacttaacaagctggcccatcaccacatttaaaatatacaacgcaaatgcaggcatttccaaaccctgtgctggggaaagaaacctccccagtgagttttcccaacattttaccttttagaagccaaactgcagtcatttttccctttgactctcaagggaaatctgacagggaccacgtttcagaaaacttgtctcccatagagcaccagagctgcggtattttaatagcctctctcagcccctcccctgggaacatattattatgtgatcattagtgatgggcaaacctcactgggtttccaggtttgagtctgtgccaaaagttcagagttctttctttcttgacaactcacaatctcccctatttttcccttttattcattcattcgatagttcatgtgcggccttgcttggttccttcctatgttaccacactcttcagccttttttccactttacacacagaataaagggatggagatggggcaaaaagataaaatttctggctggcttttctccattgggggcgcctgggatgacacagatttgtatcagggccccattatccggcacaacccagaaaagagttgcttaaactcttgctataccctcagggacaccaatttcggggggaccccaagagtttggtaggtagtaaaagaaaaagcgtttcttaaaaggggtgccatctaatcgtggatgctaggaaaacaggccattaaattgcgaccaaggcgt

SEQ ID NO: 1318 - DNA, 580 bp, Homo sapiens
aaaaatcaagccaacaaactcatcaccactacagtgcaaaatcagagctcagactccctggtggcagcagctcagggatggacctccagaatatgcattttcaaatgttcctcagcactcacactgactcacccagagcaacttccagtactgtaagctccatccatggactgaaactgaacacccattgaagagtaactcctcatttccccttccacagtccctggcaactaccattctcctttatgcttctaagactttgaattctttaaatactttgtataagtggaatcatgtagtacttgtctgtggaatcatgtagtacttgtccttctgtgactaatttcatttagcataatgtcctcaaggttcatttgttttctagaatatgacaatattcttctttttgaacagccttccttttaaaggattaataatatttcactgtatgtatatacatattccttatccatcaatgaacatttagctggtttgtgtctcttggctaatatgaacaatgctgcaatgaataagggagtgtatatgtctctttgagatactgttttcaattcttttgaat

SEQ ID NO: 1319 - DNA, 396 bp, Homo sapiens
ctggccgcagagctccaccgctgaggccaacgaggccatgtttttattttaaaaaaatacatataagctgggtgtggtggctcacacctgtaatctcagtgctttgggaggccaaagtgggaggatccctcgaggcaagaagtttgagatcaacctggggtaacataggaagaccttgtcttacaaaaaattagaaaattagctgggcatggtagggtgcacctttagtcccagctcatcgggaggctgaggtggaatgatcacttttgaccccaggagttcgaggtaacagttagctttgattgtaccactgcactccagcctgggcaacagaacaagacccctctatggtcccggagaaatagtgcggactatcttaatatacaactatacgtg

SEQ ID NO: 1320 - DNA, 329 bp, Homo sapiens
tgaggccaacgaggccagttttttattttaaaaaaatacatatgagctgggtgtggtggctcacacctgtaatctcagtgcattgggaggccaaagtgggaggatccctcgaggcaagaagtttgagatcaacctggggtaacataggaagaccttgtcttacaaaaaattagaaaattagctgggcatggtagggtgcacctttagtcccagctcatcgggaggctgaggtggaatgatcacttttgaccccaggagttcgaggtaacagttagctttgattgtaccactgcactccagcctgggcaacagaacaagaccccatctct

SEQ ID NO: 1321 - DNA, 326 bp, Homo sapiens
tttttttttttttttttgtaataaaaattcatttgtttattcctgaatctgaaatttggcaatttagactgcactcagcatggcaattctggtcttggctggactcccccatgcatctgtcaacagctctgcttctgcagttactggggtgccttggctctcctccttgtgctttctcatccttcattggttagtgcagacttgttcctttggggaaggaaggattccaagagagctaaagggtggaaggcctcttgaggaccaaggtggtaactggtgctacgttagttctatcatgttccgttggacaaagaaagtcacaggaa

SEQ ID NO: 1322 - DNA, 845 bp, Homo sapiens
cggccgatctttctttactgacaagaaacctgcgtacagaggagctaaaccaccatcccaaggccataaaactactgcgagtctaagccaggatatgtctgaatatgaagactcctctgaatgctgggtcccagaagcactaagcttggttatgaacctcatgggctctacatagcttctcaccaagttgggtcctgttgagcctattgtgcaaggaaggagaccaaacaccctggaggtttgctcacctggcctgagttacctggccgtggaaggcccctgggctcaagttccctgagaggcaggggttaaaccatgtgtcctagaacctcagcttgcatcccaccctggaattttcctctgagttgcaaaatcaggcaagctgccaagccatatatacattgccgggtagccaggcaacaccgtgctttttctgggaaggagcacaatgtggtcactgtgctgccgacgccaggttccagatggaagaaagactttaatccccagcttcacggctgtttggcacacttcgctcctgaaagcctgctcgggccagttttcactctgactctcagtgaggccattttgctcattccgtttctgatgtttaaatgctaatcctttacaagttggttttagtggagtaggaaatggcggaaaaggcttggaggtggattcaaatgcaacagggatggcacttacacctttcgatgaaaaagacgtgtgattccgcgattttgcagttgtgaattgtgctgctatacgcatgtgtgtgaaagtatctttttcacataatgactccttttcctctgggtagacacccagtagtgggattgctgggtcaa

SEQ ID NO: 1323 - DNA, 185 bp, Homo sapiens
ctggccgatcctggtttattgaaggttacaaagtaagtaaagaagctggaattcaaaacccatgcaatttcactccagagcccatattcttaactatctctctatgtcatctcaattattttgttgactttaaaagaaaataatctttggccagggcagtggctcatgcctgtaatccccgtcac

SEQ ID NO: 1324 - DNA, 632 bp, Homo sapiens
tttttttttttttttttattctttaaatttttattatgccttgtacttttgccttcatagtgcttgacaacaccacttttcaaatggttatatgtggaattattctgtttttctgcctactgtaacatcaatacgtattccatgccaaatgtgcagaggaggagtttcagaaatctatgtttaaatgtgaataaatgaacttgctctaggtgatccatacataaaggataaggatatgcacagagaaaatttcagtgggattctctgtgaatttcataccaaagtatcagacctatttctcagttgaaaatgcaaggagaatgcatgcactaacttagtctcattctcacacaaatgactaatccacggtgagagtgaaactgcatttcttttcgctgctctctctttgccctcttcatctggctgaagagaggaacaagtagtcccggccacatcccagctccaccagcttctggcaggcccaccacagatggccattcaacaagggggtagggaccctttcgttcaacagctacccagtgctggggtgtcatttctcatccaatgaatgatccggatcacagttctgagtgagcaaacatttttcgatgtgtgtcagtcctcttgtaact

SEQ ID NO: 1325 - DNA, 254 bp, Homo sapiens
cggccgatcctcctttattgttggggtgggggtgattctcttctgattgtatgcagtgcattttatttttctgttcttttctattctttttcttatacagtggatgcactgtctttgcccttatggccagtcaccccttccttgtgtgtggattccatctcctttcacagtctcaaagactttgtcttcgtaaattgttgtttctctgacatcatcagttttctactttcttctggatcattcccttttagaat

SEQ ID NO: 1326 - DNA, 503 bp, Homo sapiens
cggccgatcagggtttatttctgctaggtaggattacattttaggaacagctcaggcaaatagtgagggaaacaagtggatccatctaagtccctgtaagtaacacctggtgcactggggtggggtgactgaagaagggttgaataaaggcagttacaaagacatgtgcgcagttcagagaaaccagcagtgatagggaagcaatagcaggggcccttcctgctttctcctaagcctgaaggggtaaggagaggatgctgtgatccaagcccagggagagaactggagctctaggagtgggggcatggactgcagctgtgactctggtagagggattatattagtttgttcaggtaccataacagaatcgcacagatgtgataacttaagcaacagagatctatgtcctcacaagtccaagatgcaggtgctggcagggctggtttcttctaaggcctctctccttccagtcttcacgtggtttttcctctgtgcctgcatct

SEQ ID NO: 1327 - DNA, 837 bp, Homo sapiens
gcatccggttttattcatgatgattattagagggcatggatattgggggtgtgttgatgttgggcaccagagaaatggaaagaggcagatggaggatgcaaatcattttcactcagaacctaaaatgtttactgttagataaagggtagagaagaatcttaatttgactttcaaaacatatgattagttgaagttaccaaaactatttttttaaataacatttatcttaagagctataaataaagaggaaattttgcactagagatgaagttgtgaacatttcattaactctaaagagttaatgaaaaactagttgattatatgtgttcatttataggttgacacgtgaatttccagagaagtaacttgtatgtttttaaattccaatccttatcttacatctgggcagaatcagacttgtgaacgtcccattccaaacaaatggctaaacactttgcagactttgtctagaagagtgccttacccatataagccctctgttataaaattgttttaaacgttaaattagctgtcaagctgttctgcatcagtggcaccacctggtagcaaggatggagatctctgccacccaagatctctttagtgctaacgtcatttctccaccgcaaggaggatttgcggggtggacgatgctccctatttagtcttctgcattttgttgcttacagttcaattaacatgtcagttagagatgacttttggctgcagtaataaatatctgaccaattgtaccttaacacagaagaggtgatattttttgtagaacaagagtctggaagcaggtagttgaaactatggaagaggtcctgatgtctt

SEQ ID NO: 1328 - DNA, 297 bp, Homo sapiens
acaggtcaaactcccaagagtttgaggtcgaatttgatggaacacccagatgtcctcagctgccatggagaatacttaccatatttgcttgcatattttccctattatactggcagacacttttagttgttaacatagaggaaagaggtgaattaaggaggtaacctattaatcactgtagcttggggccaatatcaactttgatgtaacccaaggctttcggctttattatattttttttcagaaagaagccattgtttcacatgtggctaataaaataataataataaagataga

SEQ ID NO: 1329 - DNA, 1003 bp, Homo sapiens
ggatccagtagtctgggcttttgctgttgcaactggaagaggcaaagaataatgattattaaaaagtaggtatgtgcaatattgagatcatccggtggttcttcattgcaatccaacaggcaaaggagtaagaagtaagaatgcttaactttgttgagcacttgctatgtgctaggccctatgcaatgagctgtacattgtctatagtttttagttctcataacagtaatatgagtacatgtgaagggcactcaactgcatttgtcattaaggaagagaaaattacaaccacaaggcaatatctcaacctgtcaagatggctaaaataaaaaagatgatagccttcggtgataataatatagaataattgggactctcatatactgtttgtgggagtgtaaattggtacaaccacactggaaagctgtttggcagatcttctaaagttgaatctacacatactttatgacttactaatttctttctgaagtatataccttaatggacatgtttacatttatttactaaagccatacataagaatgtataatcaaaatacctattggcgaaatagttaaaatagctccaagctagaaattaaataaatacttatccacataaaacaagtaataaattatattatatttacaaaagggaatactgtgcagcaacgataatggacaaattataagtacatggaataacaaggtgatcctcccagatgtaatagtaagagaaagaagccagacagaaaagagaccaaattgtatacatgtaaatatcaagttaaaaataggcaaaactgatctgtgatgctagaagtcatgagagtggcaaatattggtgagatggtattgatcagaagtgaggagaaggagaccttttgtttcttgatctgtgtgctatgtatatgagagtgtgttcactttgtaaaaactcattgagttgcatatttataaactatgcacctttctgtatgcgctataattcaataaaaacatga

SEQ ID NO: 1330 - DNA, 362 bp, Homo sapiens
cctagaactaccttacaatatacattttctgatccattagcggaattattaaggaaaatacattgaaataggtggcattcttgtcaaagatatatatggacggctagatggatagataggtgaaaatcatgttccatgaaagaagagttagctcagcctgcaactcaaacaagtacagatattcttccatggaatgaccatcatacttggattgtaataaaaatgctttaggcaaacttctcatttcatccttggcatattaaaaatatgtatgtatgtttaaggcttgaaacttaacactgtattttaatgtttcagtaaggtaattcttcttaaataaaatgatggcctcgttggcctca

SEQ ID NO: 1331 - DNA, 503 bp, Homo sapiens
atgtggacaagaaagcccaatagaaaattttctaaacccccatgaagctagaaaacatggattagtatgagatgagaaaaccaagactaaaagaggacaggaatatctcttctctacacaaagccacttgagcccatttgaaatgtaacttttgccatggaagaattctaccaacacttttgtcgtcatttaaactacccactaaataccttttctattttttatactattttttgttactgtgtgtgtgtgtgttttatttacttttcttaatatcataacaaaacaaaattaaacaaaaaaattgggttttaccagtgttgccatccaaaatatagaatacccagtttaacttgaatttcacgtaaacaaaattatttaactggatatctcatcttttgtttgccaatctagcaaacttagtttttgcaatcagtaatgtgttggttcctaatgctactataataaattactataaacgttgtgtcttaaaaaaaaaaaaa

SEQ ID NO: 1332 - DNA, 1129 bp, Homo sapiens
cctagtttggcgtcagaagtgggatggtggaggaaacctcccatgaccctcagaagcaccaagtgaccaagcattaagtccattgctctcttgcaacaagtgaaggctgtgggggattcacggaaaggactctaacaagtacaggtttctggtaactttaaaatcccatcatttgactaggacacagaatggctcttttggaagtgacactagagaaagactgcccctgagccccactggagagaatgataccaagctcttttaagcaatcatactgcagcaaaactttataaccttcagtcttggctccctatctctcaactcaagaggactcctccaagactgcacatcttttggagacctcaaggcaaaactgaccaaggagatttctcttcagaagaagatgacatcctagatgtggccaactttccccaaaacaaggatcaaaacttctcccctctctcattatgaaaactttgtcttttttattttttctctgtgtttcttttctgtttacaaatggtgagataatgccaaaatcaagatttcatagttgataacttctgcagaaaacctaactgaatgttgactatgtcatgttaaaccaatatccctacatgatcttagagatcctctagttcaccctgaaacaaaagttactgatattccaaatgtgaccattttctcatattgcaggtttgattcttctatagggttagacttttagattcacatattcatattccttgtttaaagctaacagtaggcaaaacatataatgagggttttgcagttaattatgccagaaattgaataagaacaacaaaaaatagtttggcattttgtagacaaatatataaccctaattgttgatgggctctaaccatgctatgatttgataataaagccttggataaattttagtgctttcctactagtgacccttaaatcacaagacatcttaaagggaactgtctgttgtggctcttgaagatatatttttatttgtagagaatttaaagatcagccgtgtgctgatctttttgactccatgtctcaaaaagaggccaatgtgggttaggcattttaacggcaccactcactccataatcaactgggatcggccgga

SEQ ID NO: 1333 - DNA, 595 bp, Homo sapiens
taggtggggaatatggagcttatgaagattaaaattcaaaatgagatttgggtggaaaaaggaagcctaactatatcaactggtgatttattctgtgctcacatggatccctggcataaattgtgggttcttctccgtgctgtaaagtaccctgaaactgtgaaggtgccctcaattagagaggctgagaaaacaaggatcccagagcaagctcttcaagcctcagacagagagcctgccaaaccagtctgaatatttttagagtaaacaatcattaataaatatgagctacatttatactcacaggaatccagattatactcatacttttttaaaaaatgggttgcctctaagtgtattcaattcacccatgaagaaattttgttaacatttaatggtaggtgtctaatgaacatctgtggaatatggaattaaaagaataagttgatggttcttaacatactattataaactaaatatgtattacaacattttccttttgtagatggaaattattctatacttcacagatgttgcttatatagttaataaataactggcctcgtcggcctcagcggtggagctcgtccggcgg

SEQ ID NO: 1334 - DNA, 869 bp, Homo sapiens
cggccgatctgtatttattgacttaagtttattatttgcaactactttgacgatccaaagagaaatgaacagtttctcaattcagagacaagcatattgtagaactttcagcctttggggggaaataaccaaaggtaaatagcctcagggcacaaatcacttcgctaatggtacagtcaggccaccaggaaccagtagtcaaatttctactgctggctttttgacttatcagttgttcaaaaagaactttagtgactaggatagtacatctgacatctttatgtccttcatattttctctagtaacaaaataagaaacattaaacacattttatattaggtatattctttatgctcaggaggctaagatatagtccagaggaaattccaatttgggaaactaaatttccattgttctctaaacacatggacccaaatccatggcttgcatccctgtatgttgtaagacagtggtaaaatccttctggttgtatgatccctataacaaggaaaactgattattttctccacattagtttctcccactgcatgctggtcggtaagagcaggttccttagtaatcagctggtagcggggatcccaatttttttcttttttttcccttcttttcacggggtgggaagaaatctttggtcttttattatttggaaagggaagtttgtgagaatttaataacaagaaggccttaagcggaaaatataaaatccattggtgcgggggtaaataacaaatcagtgtactttaatctgagactgtgtgtcgaagcgccgactggtagacaattatgtggaaaaggccgcattgggaaaaaatccttgtttccccccgtggtattccagatgagtgcaa

SEQ ID NO: 1335 - DNA, 608 bp, Homo sapiens
gataaatgctacactgtgtacatctcattgagctcaaggacagagcttcccctctcctcactgtctgcagtgcctggtccaggcaggacctgccatcaagtcaatgctgaaaatgttggccacacaaaaacatctgcaccgtcggaaggaacagaagctccagaacaatgcctgggcttcaagatccaatggaactttgtcagttgagcgccagtcttgaatccaggtcttcttgcttccaaatgtggtcctctgctgtctcatcagcttcttgaggcctcacgctgggctccagttcggggtgtgaggagacgccaaatgcttctcagaatggcctatctgggatctcgcccagtgcctttctccctcctcttgctatttttcgtgtcttttctcttccccctctccctgtgtcgggcgtgtttacttgcagcagccagaaagaccaccttccacccgccctctcttcggttcagctgcacctctctactccaataaaccgtttgcattccatctggtgagcgtttgctctgaagacatttccttgtcaatctctcccgccacattaaaaatctgtcattacgattgcaaaaaaaaaaaaaaaaaaa

SEQ ID NO: 1336 - DNA, 618 bp, Homo sapiens
ccagcagcatatacatggcgaggcccgaagcgggtcgctattatagataccgctcggagccgagcgcgcgacaatagccgtacttgtggcgcgtaaaatcattagacttttagacaaccattggcgatcggcaatagagggcgtaacacagagtgtcgacctgtgaactcgcggcgaggggaacgccgcggcagagggttgggagtaagtagccgccgcgtaaggaggctcgacagattgatgcgctacgactattgaaagtcaatagagtggctagatgacgatgtagtactcttttcgcccagcctgcacctagcgccatggggaccccgagctgccgattcaccctcgttaaagttttctaaatctacagctcctcatcggtgtcgaccgcatcggtatttatttattttttccaaagatcggggtctcaccatcttgcccagactggtatcaaactcccgggctccagcaatcctcctgcctcggcctcccaaattgctgggattacaggtgtgagccgccatgcctggcctaaagcaaggtttagcccgtactttctcatgctggccatctatgttctggttctaacgtttgtgtggttggtgttaatgttag

SEQ ID NO: 1337 - DNA, 629 bp, Homo sapiens
ctggccgatcctgctttattcttatgatttcaagtgatgtcctctttcatttctttgggaagagatgccagcaactctaacttgttaccttgatgtctgacagaaatgtcaggctgtgtaaatttggagatcgtactgtttggctcttatgcagggtaaacattttggaggctgtgtcctgtgtttctgccctgctgtgtttgggctgttggctttggtggcccccacacttgctgctgtttgtacatgtcccaggcaggtagaaaggggagcacaagggtctgagagctgccctttcaataagggaagggatgcctgcatggatatgagcttatatttcattgtttgacactgtattggtttccaaaaacaaagcaccacaaactgggtagctttaaacaccagaaatggattctctcacagttctggaggccagaagtctaaagtcaagatgtcagcagtgccctggtccctctgaagctctggggaggatccttcctgcctctccagcttctggtggtgggcggccatccttggggttccttggctagtggatccatcactccaatctctgcctttgtcttcacatggccttcatcctattccagtttctgtgtctcttctctttt

SEQ ID NO: 1338 - DNA, 178 bp, Homo sapiens
tttttttaattgctcccctaggaaagtacagacaactatagacaggaacaaagtagagaatagaactgaggccatttgaaagtcttgcgtcatgtcatgaagtgacatctgtatgattgaaataaaccagactgctactcgtgctgtgaccacctcaagttaccttaataaagcgaga

SEQ ID NO: 1339 - DNA, 707 bp, Homo sapiens
gactctcttaatttctcaggaaggggagcactttcttctcatactaaggcatcgtctgcttgtaaaatcatgtacccacctggaggaggtatctttcttcattcattcttataaaggtgctggattggtattacacatttatatataaatatacagcagtgttatatatctcaatggtaatcaaacatcaaactacttaaagtgataatagaatgtccatttttacagaatcttttaaggcaaaatggaaaaccccttcagtgtctaccagttaaatgtctaccttatactcctagttctcttattctaacatttatccctagattaaaacacacatagcattctaaatggcttccctgtgcttcactcacacggaaataaaagttcctttttcttaaatttgtgtttatccaaatatcaaactgcattgtattaccggtgggatggtaaaaaataagtaaaaagaaaaatagatagggaatatttaaaaccttttggagtttttgtaaatgttttgtgttctgtgcatatatcctatgtacaaaattttcctaatgtttattgataaatctattcagctttttagcctagtctgtaagaagtgcctcctgcattagcaagaggctcagttatataatctgtaggcatcagtagtgataatgctgcctgctctaaaataagggttgaaataaaagcaagtcaggcct

SEQ ID NO: 1340 - DNA, 784 bp, Homo sapiens
gtgaatacagaagtcaaatcattcgaaggaattgtgattaaccaacctaatttcaagacatacaacgttttcttaagtaaaactcggctaagaatcagaagggtgaaaggaaaatgagatttcatagccaaagagatttccaagaagaaaagaagtttaaaaggaagtaaaaatgcgcacatgctatactattttaatgcaactttaccaaaaattacacacccacacaaggaataaataccaaaataattaacaaaaatgtggccatgggtagttaatactgctctgcccaatgttccttcacctttatatttcactcaggaagcatactcactgaagaatatctggtgggatttgccagtgaggacaactacagaagagtaagaaacattctaaatgacaaaagctcatgaattctgggaaagcaagaaaaactcaagtcccaaaccatactaagcctcactcgcccaaggcctgcctaatccaacaactgacctggggcatgtcctgaagaaggtccctcagtggacactggtcctttcctggaagaggagacttccttgaggacactaccctatataattttaagtagatcgcataacctaagaagaaatgagaaatgaaacaattccaccgtgagttggaacagaggaaagccagtacctgaaagtaatggttcttggtacgtgacttttaagaccaagaaatacaaaaatactaaattctaagaatactgaaaataaatacttatcttttatatagtcaataaagaaggatgcggccg

SEQ ID NO: 1341 - DNA, 635 bp, Homo sapiens
cccgtaaacaatgatcccaaatggagcagatgctcatatctacatcctcaagaataaatggcttccccgtcagaacttgactggatatgtgggggttaatgcagtagcttggattgggggaaggaaagcaacatcacctgcagctgtttgaatatggaatagcaccacagggcataaataaagaaaataaaattgaaagaatcaatgaattctgaagagaaaacaaaggcagaggccttcttattgaaggttttagacagaaaaatagcaactcataacaaacgacaatgtgaaaactctgcactataaactagtgtcctctctccgacatgtgccagacttatctttcctttggatttttatccgtccttatctacttgccatacccaaacagcatgttattctcaggatgaaccacagccacaagagacctcgtgctctttgagtgttctgtgcacctgcatgtgctgtgcactcctgacctttaacttcttgctcactcctccaggactgtacccaaaatttcaccttctctgtaaaagctcattgaactgcaacacttaaaaatggtgtatatcattgtaggtgaattacagttcaaaaaataaaagttaaaaacaaaacccgatcggccg

SEQ ID NO: 1342 - DNA, 1033 bp, Homo sapiens
catgcatttggccatgttacacttgggatgcaagttctaatctgccttttgtgaccttggttccattgtctgttcaagattgttgagcattttcattgttattctgattagtcccacgtgtgcacaaaccagtggccagcctgagacctggatggagatctactctgcacctcagttctcaaagcctgaaatttattatttataggcaaattcctgctacactgctgactttgaagatggagaagggatcacaagccaaggatttaggtggcatctagaagctggcaaatgcaagaaaaaggattctcttctaaagcttttagaaggaaactagccctgttaacaccttgactatcagcttagagaaactggatttggacttctggccttcagaactgcttctggaagtgaagcataccgaagtgtaattttaggaacaagaggctgaagatgaatagaaatgaagaataatagacataagcgggtggaataacaaatatgaaccaatatgccaggttataaaatagacaagtaggtactgaagtcacccagcaaaatgttaggaccttgagtgaagaagagaaccaacagcatatctatatccaaaatcgtgactaaataaggtagactgggagatgctcagctcaaatagcaaaagcttcaaaacggcaaaatgttttacagaaagaacagggcaccgttgagctgttgcaactgttctgctgggatgattagattcaactattgagggaagagttgacgtaatctacccaaacgtgttcctgagtcatcgctgaaaatgtgtgtatccacggactgatctcagctggttactaccctgagaaatcaaaaaaacggttggagttaatcggccactggatttggactctagttaaatgcatccacaaatattattgatatatgtcttatgccatataaaactttttcttttcatgattcctttcctgtccaaagcttttagtttttgaactaaatctcaacaatttaagctcaataaacctagatcaaccgg

SEQ ID NO: 1343 - DNA, 336 bp, Homo sapiens
aagaaacttcaagaaacttcaagatacttcaagatctgagagggaaaacattatgctgacagtaatcaggatcaatacagttgaaaatctacctgcttgtctgaatggatttggaccacattgcatgcgtggagttccttgctttcctgctatctctacacagttttcaagtttgatatgtttctaagcactcagtcattgttactgtgtctgaggttgacgtgggcactctggcttgacttttctatatttatgtgattcttcttcctctttgacagtgcctgtgtagactgaagttatttgttccctgagactatgattttaaataaaggctga

SEQ ID NO: 1344 - DNA, 1208 bp, Homo sapiens
tggcattcctcctaatgaatctctcacatatctctttgcatgttggattcatcttcttgaagaaaccaactatcacaagatacatatttccctgtacttcactgctacatatgcaccaagaaaggaagtaattcttttataggatgagcttctagtatttacttccaagaggacacataagaaggataaataaaacatatatattggggggaaaccagtaatataaataaaaatatattgattctctggtgagatgagatcatctagttattctcaataacatcaactgtattttgaatgctttggtagttcttagttttgaaagttgaatcttaagagtccaagtgtttctactcttattcttagggctggaagatgtcaccctttgtctgaaaaaagttactgaaaaagtaatgaatagcagatggtattggaaggacttttgattcagattttcaaaacgagattcaaaatacttggactgtatccaaatgagagggaactgggaaatgagaactgtaatcatagatttaatgtgattgaatagagtagatggaaggtgttttgtttggctctaactaaacattttttcgtggtttttataaaaatactatttgtaatatatataaaatgaatactattagaagcagagttcagagtttcataaaccaaagaaacaaaacaaaaagcattttataacttgaaactagttaagctacccttgtgtaaatgtccattgaaattcaatgttgaacattcagtgtagatgttttatagttatttgtaagcattgaaagttagaagtataatagaataatccagggaggcaaaggaaagaagccaagtccaaagttttcacatgtttctttgattttggtggcttctgaccactaaaatcactgccaaagaaatcatcattagatttcaacaaatttgaataggaacaaaaacagtaaccagaaccctcaggtaatttgtgattatcacaaacatgttaattatttcaattgttcaatttattagaaaatttgaagcttgttaaaattgctcttgatttttatgactgtttaaagcattagttcattaatagctgttctcattaatgctgaaggaaatttggcttcaatatattactttgttaatgcattttgagataataggatgtttatggtatttcactaaatggaaataaaaccgtgatcggaaag

SEQ ID NO: 1345 - DNA, 463 bp, Homo sapiens
gactgctgcggacgactctcttaattttccccgctacagaagagagcctgacgttcaggtgagctcaagaacacccagctagaagatttaccaccccgcctcccttgcagctgggagagtcatgtgactgaattgccaagatacacctcaaaggtcagctgagaatccccttcctcgaagaagacatcccagactccccagatgaaattcatctcttctttctttctgttcccacggcattttgtctccgcctctgctcaacccttggctctgtctgctggttttaagacgacatctgtgcacaactctcccaactggcaaagccatccttgaggactgaccatcctttgggtcccccaagacacttgacccacggccccgaatgctaaattcccacatgttgaattgaatgtgtgtctcagtatttacctagctccatcaacctgaatccaataaagttaga

SEQ ID NO: 1346 - DNA, 148 bp, Homo sapiens
aggacatctctgcaaggcatttgccaaacctgcaaaagcttctgagagcagaatgctaaacttctagctgacaagtaacagcaactgcaataaaaagggttctgaaggggatagagctatgtcatccctgagtgataataaagagcga

SEQ ID NO: 1347 - DNA, 716 bp, Homo sapiens
aatgatggatccatcagaggcaatgctctttttatttagatcgaaaaaactggaaggacgactgaaaagtgctttcaataatcccttctggcaagtgggcatagtcattgcccctcttacacaccagaaccttattaggatcaaatatgatgatgcaatcataaagagaaaaaaatcattcatctttggtcatcagctgttttctccagtctgcccatgatctgctcagagaaagaagataaatgacaaccactgaacgggccaggataaccaaacccagacttgagggagatggtttgtcccatttctgcagcttttgacacacattcaattttgtttggggaaatgcaaggaccatgtcaatgggaaaatcttggtcacaaaatatatatttagagcaactatttcaaaattatatttttcacttcttttttagctctaatgggagcacatttaaaaaaggaatacataacacttatacctttttagaaaataaggtattgctcttataagccatttattcctaattacacaattagtttatcattctgcacttgctgaaaaaaagactataaggcaaagaatgggctgacttaagttttttttttttaattattaaaaatgttaacaatctagtttcttttccttctggaattcaaaaatgttaaagctactaagtatttctcatttctggataataaataacgatgcggcag

SEQ ID NO: 1348 - DNA, 775 bp, Homo sapiens
agagaccaagctgcatattctacactttgctgggaaaattccttagctaaaggtccaactgcataacatacaagttctaccttccactcaaaagaagtcaattcggggtctcactttgtcaccaggctggagtgcagtggcaccatctctactcactgaaacctctgcctcccaggttcaagcaattcttgtgcctcagcctctcaagtacctgggactacaggaagaagaaagataagcgctttggaaataaatgccaaatgcctacaaagcaattagcggcaggggagagatactgaaaaatgttctctttgaagcactggtcctgctatgatctgagacaagagtagatgacctgggaaaaaactttgcatactcccttactaagcctgagaatgaggcaatgaagtgccttcactggaggaatggcagtagagctgagagaaatcccttctgagttgtagattgctgggattgctatagtctcaagccaggatgaaataactcaaagaaataattcagctattacccactgaataaatcactgtctacctaccctctgggagggtcaggcagatcagagttttgacattggtgaggaggtacaaagacctcgatgaagcctgggggtatgaaggagacctgtgacaaaatatccaagctccacgattccaatccctgctttaaaaatttgtatgatcctgttctcaaagattgtgaagcctgtcatgtttcaatgtaacaaaagaaaacaaataaacaccgtatctggcag

SEQ ID NO: 1349 - DNA, 751 bp, Homo sapiens
gcttgctgaggacactctcttaattatcaccgctacagtcctctagtcctccaccagtgcctcccagtggcctaaaccagcaggagccatatgaaaaagaagtctggaagttgctagtccttcacaggaggatacaagaatggcgacgagaagatctgaggactaaactacgagatttaggatgaacaaatctaggagccagaagatgtacctgctagtaaacgctatgatctttaaaaagtcttgagccaacgtgaccttcggaatttttcatctgtaaaatgaaatattggactagacggtccctgaaacttcttaaagtccttgattctacagtggaatggttggtacagctttgatttcattgtctgtttatacctggctgaattctcttgtgacatgtgactgtccttcttaagaaactgacaggcaaccaagtagctgattgttgagatatcgaaatgtttcagggaatgcagagaatacagcctacctgatataaagtctgacagcaacaacaaaaaatctctctgggcaattttatttaataattaaaacaaaaggtttggaggaaatattcaaattgccactttaacaagagaggaacctgtgatgagaatgcttcaacagtgatctggactggcattagagctaaagaatcccagcctgatgtgatagtgactctggctgctttatgttcctcaggaatcccaggattctttcaaacaaactaatgaatccagatcggcca

SEQ ID NO: 1350 - DNA, 866 bp, Homo sapiens
caagtaagaaaagactgaaaggaaaaggaactatgggctgtcccgtttttccctttccttctatgtcatcattttttatgatgaagtctgaagactgaagtttctccacaccctgcatgtcaaagtgccttgtaccacttgacatatcaaggctgcagcccgggtccgagagagcatggcttctttgtcacagcagcttttccatatcttagaaggcctggaggagcagagtggtgaccaccttcttgatgtctgaaatctctcacctccactccccaccaggctggttctcaagccacacatgaggataacattgattcctgccttagttctgtctttagaggggcttcttgtgcccaccttgttctgttctcagaaattagtccttccttctattcctaagactttcataaacaatacaaagtttttaataggaaaaaacaagaaagagaaaaggaaaggataaaaacagtaatctcctggaagaaaaattaatatggttaataaataaaaaataaataaatggatggataaatagatgataagtgatgtgtatcaccagtgataagggatatataaattaaacatcatttgtcactgatttgttaaatgttaaaaagattgacaataatccagtctttaaattaatgcataatttatgatatgttggattcctacattgaagacatgaatgttgtttcctttactataaagacactcattttagataacagactttagaccctaagtccaagctttttaagcagagtactgaaatattattgaccccattcacgtgggcaaatttaaatacatcttattacccaataaataatgaatgtaatttcaagccccatggttagtct

SEQ ID NO: 1351 - DNA, 216 bp, Homo sapiens
actgagtgacagcattggacaaagatgtgtggagcaggatggtagctggaggagtgccagagagagacccgggatctcaccaaggttacagtgtctgtggctttgcaaagattcctcctaaaattctgctcatggaaggatttcaaagaaagactgagtgaacttgttcctgagaatgcttgaagggacggggaaacattaaaaaataaagctgga

SEQ ID NO: 1352 - DNA, 684 bp, Homo sapiens
aattctacaaaggaccataaatgtgaaaagtggatttttatccaagtcatctgtctttatggaaatacctttgcctttgtgagtcttaggttgcttgttcataaaaaataaaaggttgtttcagaagaatgggaaggtcctttctcaactcgacatgagaggcagactatgaataaggtatggggcaccactgggctttggggggaaccacagtggcaagtcatagttgttggagaccaatgagaaacccagaggctctaggaattgggaggaaacaaaattgcttattgaaagaaggtagcaaaagaaaggaaaggatcagggcttgagtgaatcagaagacaactcctcaatttttccccatgactaatgaatggaaaagtaatttccatgtgtcttgaagaatattacttttcacaaaatatatcacgcaagagatgagagtgccttaaagtgttggcagtagcaataaagaaaaatggttgtaaatacaatagctttgtaagtgaaattgacaggacttagtagagtgggagtgaaggaaaaaagatgtagtggattaggagtgcaggataaaggagaaactggggtgtttctaaatttctgacttaggcaacagaatgcttgtaggtgacatttaactacatgggaaagactagaaaaagaataaagcaagatcggcaa

SEQ ID NO: 1353 - DNA, 893 bp, Homo sapiens
tggaccaatatttgcaaagatttccataggtggggaggaacaagtgtagtgctccaggctagctgggttttgcattgtagagattctcttttcttcagctgccacaaagcaagacagtttttccaaataatatgggtctgtgtgattttgtatgtggcagagtcttttctgtttctgtgaatctaattgcttctctcaggtgttttctctctctctccctctcccactccccttgccctgctacccctaccccaaatcccctggcttctcttgccttactcctaatgtttcttgcatgaaattaaacttgcttttgcatgtaaaattattttacattctcttttctagttctcagaagatggagtttgtgtttttgttttcccatctcttcgttgcttgcttttgcttggtttcttggagaagatggggattaataaattcgtggagtcatcatcctggaagttctccactagaaattatgcatcttcctgttaaaagagaccatatcgattgtataagacagccactcaattgatgcttgaatccagcactgttttattcatttccataacgtgggcactgcagaaatgtgacagcctagggtaagattaagctgggtgccactgaaaaagctctgggccaaggaaatgacagacctggtttttagtcttagctctactactgtatgaagaagagcaagacagttatctgtgtgagccttcaattctccaactgaattggttgagatgatcactaccagtccccctctttggaaaggccagcagtttttgtaaatattatgacagatttgaagcacaacagacttcaggaaatatcaacctagcttgtacagattacactatatgtaaaaataaataaaacgagatcggcag

SEQ ID NO: 1354 - DNA, 502 bp, Homo sapiens
tagacctggaagttctttgcttcctttgcaatgtcagtggacattttgcatattcatttttgtcatgaaatctatttcgtcccatgtaacgattcctggtgaaacaacaaaagaaaagagcatgcatgagcaccactgcttctacctgatgaatagcaaaaaggatttaaaaaaaggcctcttccactccattgggactacctttgaaaacagtgtgaagttgggggctgacatttctttgttagcacacaggagtacaatatctccagaaagccttggccacacaagtaggaaggaaatttgccattctatgcaagtccttaaaagttaaaagtacttggttatgacttgtttatacgtgggacatttgcctttttgtgcctggatcttgcaactcaaataggctatatttcacaatagccctgttaattttacaaagatagtttccttatacttacttgaagtgataaattgcttcatcatgaacacaaaaaaaaaaaaa

SEQ ID NO: 1355 - DNA, 185 bp, Homo sapiens
attcagttgcctgtctgaacagtgactaccatgaaccctacatgctgtctacttctaaccctctttggcctgactccagcttcaacacctggaaacatggcaaaaagaacagggggacattggcttggactggagccacgtgtcagagtttgactcaaggatagttgatgtagaataaagcgaga

SEQ ID NO: 1356 - DNA, 795 bp, Homo sapiens
caggattcagttgcctgtctgaacagtgactaccatgaactctacatgctgtctacttctaaccctctttggcctgactccagcttcaacacctggaaacatggcaaaaagaacagggggacattggcttggactggagccacgtgtcagagtttgactcaaggatagttgatgtagaatgaagagaatgagcagggaacaagaggtgatgaaacagaactgagatgatagagtgtccagcgtgggactcgccaagaacccataacggcgccacaagagaaagcccggttatccacgaaccttagagaagggacggtgccaggtcccagctccctgctgcaggaggctgtacattctgtcctggatcccctctctccctgggcctccctgtgaagggtcagaatccaaagggatgtgttggaggaggagggcagaagtcaggagagcagaactgggctgcccctgtttctcaaggcagtggcatcccagccaaaccgatggcaggaacaggctggaagtgggctgagagtgggctcttacctggactggacattttttattattgaaagaggaattctgtttgcttactcgaggtgagcagatgagctttttatcacagaagagtgataggaataagggatggaacctgtcaagagtttgttcagctcaggaaaagaaccatatatgccaagtgggttttcattttgattttttgtgcatcacgagttttttgcataaatgttgcttttgaaaaatattgcattaaaatattatttatttttaaaaaaaaaaaaa

SEQ ID NO: 1357 - DNA, 256 bp, Homo sapiens
attgattcagttgcctgtctgaacagtgactaccatgaactctacatgctgtctacttctaaccctctttggcctgactccagcttcaacacctggaaacatggcaaaaagaacagggggacattggcttggactggagccacgtgtcagagtttgactcaaggatagttgatgtagaatgaagagaatgagcagggaacaagaggtataaatgtgcatgatgtttattcattcaacaaacatcatttgagcccct

SEQ ID NO: 1358 - DNA, 842 bp, Homo sapiens
gatagagagtatgtacattcaccacctccaaaagaaaattgtctaagaaatgtggcacgaggaactggcttttggaatagttctgaactgaaagagaagagtgatacagatcatctggcccaatttttttttcagatgaatgaaagtgaagctgagagaagtatagtgccttgtccaagatctcataaaacagataattacaaagggagtgtctagaatttcagtccagtaatagacacgatgaagaatatggaagtttctccaaaatatttaacaactgcaaaaacagctcgctgaaacttctgaagtgattgtgataaaatattgaaagttgaaacacctaactatttaataaaatacattataagagtcctctgaaatttggaggtcattatagactcaaaactgcctagaggttgaagataccacgtgatcaagtccagggttccaccaggattcaatcctaggattcagtcaatttcaagtcacatggtgtaaactttcttttaaaaatgtaaatggtgtggttcttaccacttgttacttatttttcccaatgtggtatagaattaatgaaacttgtcaatcaatgaaggataagccaaacatccaataaaagtcaggcgtgggagggtcagagttaaagtgacaggagccaggatgaaaggagttgacacgcctcagaagttgattcttttttgagctttcttgtagttttctagacatgtgcttggatgaacctagtcttctagcttcttgattaatcccaaagtttatcttttaaaataattgaaaaaatgtgatttcaatattcaaagcaaataaaaaaggcggatcggcag

SEQ ID NO: 1359 - DNA, 635 bp, Homo sapiens
aacacagcgttgaatgaaatgttattcgaggacctgctatatataagattgacacttgggatagcagtgcttagtcatatatgaaggacaggaaggagcccattgtgcctgaaaagtaggaaataagccagacaatggaagatgtggttggaaaagtagcaacgcctggattacagggggcatgtcaccttgagagaatgcactgaaggaggtgaagctgaaatgaaagcctggagaccaacatgaagttgatgcattaatacaaacaagagaacagtgacctggactaaacaagtagcagtaaagaagggagaagtggccgggcacggtggctcaagcctgtaatcccagcactttgggaggccgaggcaggcagattacctgaggtcgagagttcgagaccatcctggccaacatagtgaaaccacgtctttactaaaaatacaaaaattagccaggcatggtggtgcgtgcctgtaatcccagctacttgggaggctcaggcaggagaatcgcttgagcctaggaagcagaggttgcagtgagccgagatcgcaccattgcacagcctgggcaacaaaagcaaaactctgtctcaaaaaataaaaataaataaaaataaaagagatcggccg

SEQ ID NO: 1360 - DNA, 951 bp, Homo sapiens
attgtttagggtgaacaagttactaacctatcattcgtatgacctgactccaaggaaagtatcctatcaatcatccataccaatatgtgaatataaaatgaagatgtttaatgaacttaatgattctttttgatatgtaagtgaggggataataccaactagaaatggcatctatcatcttgggcaaatgcatatcagtaactgaaagaattttacatgtataaagagactgtgacacacatatgttaaaaaaaaaacaactcctgcatttgtggaaagcaacaaataataggaaagaaaataaaattttaaaaagcagcttttcaggagtgatgataatggagtatgtagctccaagagcccttctctccagataaatattgaaaaaatgagtgcaaccatcagactccactttcacatttgttccaactttggcaaagagtcaaaggtttacagcaaccacaaccggcagatgctgaattaaggaaaagctcagaaatcacagagggtggaaatgtggctataacagaaggtatcccttgaagatattttaattcaaatgaaaaatccactgcaacattggaaaaaggtacagttgagcaaattataggtacactgaaagcctcagaggacaactcaaggagaaaatatatgtggataattaaaaattatttttcttcttcctggtgttcaagcaaatccctgtccaaaatgagctgcgtatagctaaatgaccagagaattaagagactacacataacaagaagaataaaggatttacaagagtaatttagaaaagttactgaacaaagaactacttatgcaaagtaataaaagcaaaccccaaggaggaggatgaatataattttcagagatgccatattataatattcaaaatgcccagttttcaataaggaattgagaaagaaagaaataaagagagatcggccg

SEQ ID NO: 1361 - DNA, 373 bp, Homo sapiens
gaaagttccagtgggtgactaagatagcctggattttaagacaagaagtattgaaatcaactttacatctatacttccagactctgatcttttaagaaaatatggtattgaccaatgacatggagagctgcctatgtgtttttcttccacaatcaacttgtgaacaatgttctttactttcattatattaagtgaactaatacttcacatcattttgttgaaggagaaaataagcaactttggaattttacatagaggcaattttgaaaattaaaccacaattagattatttacatttaaagcatataaattgttcagaatgtaatacaactattctaatttgagaaataaattgttgacaaataaaacgcga

SEQ ID NO: 1362 - DNA, 681 bp, Homo sapiens
aacccagaacagcaagattttaggaattattggaaaagcattttttgaactgtgtgttcatcttaaaagccaaattctccctcccttcaaaggacagcatgaggtataatgaagaatcttgaggtcctcctggattaccaaagtgggccctaaatccagtggcagaagacacagacacagagaggagaccaggtgaagacaaaagaaggggctggagtgatgcaaccatcagagagtgaaaatattcagttacctcctggtttatgaggcaatgaagtattccagcacataaatattgacgctgagacccatgggatgtaggagtgctgagcacatttgcaagacataaagaccgaaggtaccttgtacaagtggaatcattacaatatttgtgcttctgtgtctggcttaatagccgcattttttcacaatagctgaaagatattcatcaacagatgaatggagaaacaaaaatgtggaatacgcacacaatggaatattattcaaagggaattaattctgatacatgctgcgcaagaatgaaactagaacacaaagcctctactttcaagaccattgtctcaccaaaggggtcaagaaaaccaactctgagactcaaaggagatcagtggcctcattgtttactctttcttaccgggacaaataaaacgtgatcggccg

SEQ ID NO: 1363 - DNA, 1092 bp, Homo sapiens
cctactcaacgtgaagaccatgaggaagaagaccttcatgatgatccacttgcatatggggagcaaaaaaactgacgcaagacacacagtttggaagagatgaagtcaggatttaaatgcaagacctgcattttaactgctatggtctacaaagtccctgccctcaaggagctcacaaccagtagagaaataagctcggcttttggtggcaaatgacaaaacccaacttgaactacataatggaaaagcagaaatgctgctagacctcagggacagtggaaattcagaacaacggaaactgcctacactcgaaattgccaacttgacttcattctcttagtttagcttcttctatttgatgaaaaacacagctgctagcagcatctgaaactctaaacttacaacttgtgctcttcccgctccacctcctgcttctactggttcttcttcctcaactccaatttggaaaagaaaattactagtttgggtcttgtgctccccatcagatgagtcaattgaggttttcgcgacaaagtaatatcatcggacccatttgattctggtaaccagcatagaatcagcactgtcactaggaagcgaaggtaatataagtacatgttcaggccccaccatttactggctgtgtgatattggaaaagctacttgatttttctaggtctccttttcctcatctgtaacatggaagaaatgctaattcccaacttagagcaatattgtgaatattaaatgaattaatgtacatgaagtgattagcataagatcaggtacatatgaaatgcacaattaaatagtgaatagtatttttaaattattatgttcatcatcatcatggaagctctcgttagaatcacatttttggaagagggaaaggtgagttccccagaaaaatagtggaaagtattggacaagtaaaatagatgttttatttacaccgctgctagaacaacttattttgaaaattatttttgagcaagaatataaaaaacggttaaataaaaaaatgaaaagatgaatcattcatctaatggagaagaaaaacaaggataattagaataaatacagatgcggccg

SEQ ID NO: 1364 - DNA, 632 bp, Homo sapiens
ctgtttgagaaaaacactagtcctaaaggactcgtgggaaggatgatggcccccacctcattggagcccaggactgaaggaagtgtcgaaagcagccagctgatatcaagggatcaacagtgggacatttccactgtgggtatctctgagaaacccacagcattgaagagtcagcttggaacatctagatcgcgatactaccagtagacaataccaagtcccttttctacagacctagccctgaagcaagaaagtgagcaaatgagggagaagttgaccacgtctctatgacctattgcagactttcatgactagagctgacccaagcctgcagaaggaaaaaactaagtaagatggagtttggagttctcattatcacactggattgggtctctaaatgtcaaaaacaaaaagacagtttatgtgttacctacaagtgatctaaagaactgtgagacttgtccaagatttcacccaagggcaaggaatggtctgtttgatggagcaagttcactgaggagtggtgacatagtataaatgtgttttataattgtattctactaagctcagcccattcagtataattgttgcattaaaatcagatgaattttgaaacaagatgaaagtattaa

SEQ ID NO: 1365 - DNA, 1003 bp, Homo sapiens
  misc_feature (1)...(1003): n = A,T,C or G
agcctttcgctggtctcagccagtctcttgccaagtaagctgcctcaaacactctccttacttacttctggtgcatcctgtcatttctcttgtgaatcctagcagatctgtttgaaatagacgaggtttcaccgtgttagccaggatggtctcgatctcctgacctcgtgatccacccgtctcggcttcccaaagtgttgggattacaggcgtgagccaccgcgcccggacgaatatttgctcttcaacaattgccttgaagcacagagatgtggctatcagtgtgttgaataggaatccttattataagtggtcattgttcaagtgaaggaaagaaaaataagtcatgcgataaaactcttcggctgtacaaaacctagaaaatcttagttactccaggacaataagaggagtaatgcttacttgggcacttggagaatgaacatgaattgccttacccaaggcgatatttgcattatgcaaaaataaaaagtatctgcatgaatatgaatatgactataaatactactgatattacaaattatatngattttcaatctaaaaggaaccataccaattttccttttcctctagtattgcataaaaatttctgattattttgacttcttcctttcaaatatttcaatgattacttatttttttcaaaaagatgaattagatttacctagatctaattagctaagatgcggtgacactggagtagggcagactcgtaatccagactggtgtccttataaaacagagaaattggagcatatacatgcacacaggagaaacaacatgtgaaaatgaaggaagaaattaggatattgaagcatatgacaaagaacaccaaagacgtagagcaagtaacaagacgaaggtagaaaagaagcatgggacagatttcttactcacagcccccagaaggaaccaaccctgccaatacctttatcttgattctgacttgctgatcgtgagacaataaatgcagatgcggccg

SEQ ID NO: 1366 - DNA, 386 bp, Homo sapiens
aacatcctattcagcaagagaaaggaaggaaatttcgcatgcagagaaaaaagaatgtgaggaaaagaagaaaagtaaaatgcctggagacatcaaggttttgcacactgtggttgtctgggcaacagtcagaggacaacagaacttcacaaatagtggaagtgaaggtctatgaacatggctatgacccactgcctggggatgaggatcctcatcttccatatacccagaagtggtggagaaacctgtgttggtagatggttgtaagatctatcattaaaactaatttatttcagtcatctctttatttttcaaaacataagaatctatatctaaagaaaattaaacagtttgtccacagttacaaaataaacactgatcggccg

SEQ ID NO: 1367 - DNA, 785 bp, Homo sapiens
caacacgtctgaggagagcacctaattgatgaaaaagccagatggtgatacttactgtgagaattgaagaaaccaagaatcttggattatgttaacatgaacaatatactgacatacagatatagcaagttttgtggggatgatcgaagacgcaaccctttctgtaaccatatggccgaatcgtcatggaagaaagaacatcctattcagcaagagaaaggaaggaaatttcgcatgcagagaaaaaagaatgtgaggaaaagaagaaaagttaaatgcctggagacatcaaggttttgcacactgtggctgtctgggcaacagtcagaggacaacagaacttcacaaatagtggaagtgaagttccttcctcaggaaaggacctttgggcagcaaggaaggaaggagggaaggaaggaaagaaggaagaaaggaaggagaaaaataaattatccaagatctgaaactcaccagatcaccacatcctttcaacttatggcccaagaaaatagaagtcagaatcaaaatccagcatgcataacttgttgtaatacatggcagtacagaatttggctaagtttggtgattgaagctgtaaagccattaaattaaaaagcgcaaggaaacagcctgcctgctgcatggcacgagtgactacgccaccatcttgaagaaaaccattacaatgccaaatgtttgactcctgcgtttaagggggtctgaaagcaggcctttttccccaaaataaacaagtccaagattggaattctagaaggcaactagct

SEQ ID NO: 1368 - DNA, 515 bp, Homo sapiens
caacacgtctgaggagagcacctaattgatgaaaaagccagatggtgatacttactgtgagaattgaagaaaccaagaatcttggattatgttaacatgaacagtaatgttgattaaccttcataaattcctccaattgtctacgtgtataaatgacaataaaacaaaaggactgccctatttgaaatattggcaagtgaaatgatcactctggagaatacagatctttgaaatcaattataatctaaattcccaatcactctaataaaagggaaatgaattagcaagatctgtatgttatataattctgaagcttcatctttataatagatgaattgtaaatgtattagatcaaattttaaatttgtactagataaattgattgtgctagatcaaattgtaaagttgatcatttatctgatccatcatttattcatgaagtgctgaagttgttgtgcctggtaaaaatgagtgtcaaataaaagtctaccatgacttctgcaaaaaaaaaaaaa

SEQ ID NO: 1369 - DNA, 619 bp, Homo sapiens
tttaataaaaatgtatatacagttttagaattttgctgaaagaagtaagtgtgtgagaacatacctgcatgtcaactcatcaagaagaactgattcagagactattctattacttttgaagtgcaagtgggtctgtgaggcaagaaggacacagacaatgcagatcctggtcatgtggagggatggcacctgtataccttggtcagagctcagaggacacatggttggcccccagtaagcgtttattaaactcaatgtttctgcagtaagacagcagctggatactctgggtgaccatgggaaagtcagcctttgatatttggaagaattgacttttgccaaaagtgtatatgcttgattggaagtatgttattaatacatttattgtatctgaaatgctatgcactgctgatcaatttaatagtcttacggtgttaagtattttacttccagaaaatgagaaatgtaattgattcactttcactctttgtagatgaagtgtttgagtagaattctagaatgtcaagatatcagatatgcatgttcctgccttttgagaggtccacaattgtaaatcaaattcctgcagcataaaaagaataaatctgtatcggccagc

SEQ ID NO: 1370 - DNA, 781 bp, Homo sapiens
  misc_feature (1)...(781): n = A,T,C or G
attaaaaatatataccggattgaagttgtttgttcgcgtagaggcggccaaaaccctagctgcgataacctctcttaattattccccgctacaggtccttgatctctgtggctgtgagacgatgaatcttgggtgtcaccccagacaacgaggctgcttcaaaatcccaaagtccaaaggaggactgcttcataagggaaggattgtttataggttggtatactgagcaaaattaagtataggaccaaaaacagccaagacatttgaaagttggaaagttgatggtttttttttactgggattggaaggcagacctcctccgctgatgagcaaataatgaggctgtgctatgatcaaggcattgtgacccctgcgacccacacctacatatccataatgtctcctgtatccataaagtcttgcacaacaggaaaaccttaatataataatcccagttcctgccttagctgattagccaaccttgcgaccttctaccattgtaacatgctataccctaactgatcaatcaacttcttgacactgtgctctgtgacccctcccaccttgtgataatgtaccttgtgacattcttcccttgcccgcaataaacgggcccttattgtatctttccactgcattactcctaacctataaaactagctgcaatcccaccaccctccggtggtgggactcccttttcggactcagcccgctcggacctaagtnataaacatgtagcggcagctttttcccttgcttcctgaacgaatggaatatatct

SEQ ID NO: 1371 - DNA, 840 bp, Homo sapiens
gtgaaagatatctccttcaaagcttttcaggggcccaactggaaaatcttaatgttaatttaaggtcaaaagacataatttagaatttgttttggacaggcacatagaccaatggaacagactagagaactcagaaataaaatcacacctctacaaccatctgatcttcaacaaagttgacaaaaacaagcaatggggaagtgattctctatttaacaagtggtgctgtgagaactggctagccatatgcaaaaattgaaactggaccccttccttacaccgtatacaaaaattaactcaagatggattaaagacttaaatgtaaaacccgaaattataaaaaccctagaagaaaatctaggcaataccattcaggacacagacgtgggcaaagattttacgatgaaattgccaaagacaaaagcaattggcaacaaaagcaaaaattgacaaatgggatttaattaaactaaagagcttttgcacatcgaaaggaactatcatcagagcaaacaggcagaagaaggtggaaggagctgacttgctgagtcttcccaccttcatctttctcttgtgctgatgcttcctgccctcgaacattgaactacaagttcttcagcttttggactcttggaaacttacaccagtaatttgccaggggctgttaggccttcagccacagactgaaagccgcattgttagcttcccaacttttgaggtttgggaactcagactgaaccaccactggcgtctttgctcctcggcttacaggcagcctatcatgggacttcaccttgtgatcgtgtgagtcaactctaccttatgaacacagatcggcca

SEQ ID NO: 1372 - DNA, 267 bp, Homo sapiens
ttccccttgctgctgccatgtgaagaaggacatgtttgcttccccttctgccatcattatccagtgactcctcccagccctgtaatcagatacttgcttcagcctgattaatacctttgagctaatgaagaataaaggaaatgctgccctgagccctcattaggccacagtttgaagttgatagaacttaaattttattgctgtttcctcaagaagcatccttgtcatttaagcatatagttgtatcattataaataatctacgatt

SEQ ID NO: 1373 - DNA, 571 bp, Homo sapiens
ctgcaaatcaagataaactctgctggaggagctatacttgaatgatcaccttgaggagtctcaaatacacctgggatgatttagataatgagaactggactttcagcatgagccagttatggtaataggatgagaccttgggaggataatgagagtattttgcatgagggaaaaagagttgacagtgatcgccagttgagaatcttgaacatattccttgttaaactcttcgctgtttctgcactctgaccagaaaaaaatataccatgaaaagaaatgtcagactatatggcaaatatggaattaggggggttatcaggtgcttcaacaacgtgtatgttttcacttggcgggggttaaccaccatgagttgtcacctgaattttttcccccattaagagtgagttaaacggcttggaatggacttaaacatggtagttatctattttttcccaatagcgcagaaagatgtatgtgcaaactaaaacatgccacaatatctatggtttccatgatgaaagaatattttaccacgcttcccccattagcgcttgagatacagtcgcgtagg

SEQ ID NO: 1374 - DNA, 803 bp, Homo sapiens
  misc_feature (1)...(803): n = A,T,C or G
tttttttttttttgagacagctctgtcacccaggctagagggcagtggtgtgatctcagctcactgcaacctctgcctcccagaccagcaatccttccacctcagcctcctgagtagctgggacaagtgcaagctaccacgcccagctaatttttgtactttttgtagagatggtggtttttgccatgttgcccaggctggtcttgagctgtattttagagcaatactgtttttcaaggtcccagatatttttacaggctccaaatatttcacaagccctgggcctttcctgccctgagatctaaagcagaaaattgatgagctctctggcaatacttaagtctgattctctttgcctctgccctcttttaccaaccttgctgaggttttggattctgacatatcctgcagatctccagggtttgccactttccatgtctgtgatggttaatgttaggtgtcaacttgactgggctaagggatgcncaggtagctggtaaacgttattcctgggtgtgtttgtgagggtgtttctggaagagattagcatttgactcaatagactgagtaaagcagaaccactcttcctgtgtgggtggcatcatccaatggtttgagggccaaatagaacaagaaaagtggaggaagggcaaattcttttctctggctccctaatttctttttcctctttcttttaagctggatattcatcttctcctgcccttcaatttcaaatttctggttctaaggccttatactgggactggatacatattcagtttggtggttttacagttgaaaag

SEQ ID NO: 1375 - DNA, 745 bp, Homo sapiens
  misc_feature (1)...(745): n = A,T,C or G
cttaataggctaggcgtggtagcatgcgcctgtagtcccagttanttagggaggctgagcaattcaaggagaattgcttgaacccaggaggcagaggttgcagtgagccaagatcgtaccactgcactccagcttgggtgacagaggaagactctatctgaaaaaaaaaaaaaaaaaagaagaagaaagaagaaggcccactttatgccatctgcaagctggagaaacagcgaagctgatgatgtaattcaggcccaggatgaaggcctgagaaccaggaatgctgatgtgggagggcgggagaagatggatgtgaccgcggggtaatatagagggaggagtaaggggagggagacttatatagagaggcggacatgaggagggaggggggggggcagaaagggtcctctaaatagtctatcgcctacaaacacaaagggtcggggtcgcggcgcgtggcaggggggggcgcaagggcgcggtaggtgcaatccccggtgcttagtggctcgtcaaacatcctcccctccacgtcaccgtaaagtttaccctcacaatcatacttgtacagtcattcaatatatatattcacagaaagattgattactcgcttatcttgagagtccgcaaggggccgtatatgataggtcttacgaatgaccccgaagaccactaccttgcgttttggaacaacgcagatggcgggaataggcgtagcgaagaggtgccaagtagggtgagaggg

SEQ ID NO: 1376 - DNA, 703 bp, Homo sapiens
gctagacaggctactcatctctttatcacttaattttggaatagccaagcggctgaagcttcatattggtcagatacatggcttgagaaaatatattctttcagactccctacaagtcttccttctgtgtcaatgaagatgtggcttgaaatttgaaacaccatatgaaggttggggagtctcagggacagcccagctggggatctgaagttgctggagaagattttgcctaggctggccagcaactggcagacaagagtcatcctttcacaatgctggagacagtagaccttcttcaggaccacaagcaagtcaccatctctgggtcacagcttcctcaattaaaaagttagaagatagaatcacattgcctttgaagttccctttacctctaataaaactttaccaatagccactcctaggttttaccctattcccattttaagaagttttcttttccacacaaagtaaatctcctttccagatgtgctttacattggaaagaacagaagagctgagaacagaaagatctaagtttaactcctgctctctacttcttagcgttatgatatctgttaggtttctagctccatttgatttgtctggaaaataggatgataatgttgtaggaaacaatggcacttaatgtccttagtatgagacacatagtaagtactaaataaatatagcttattatcaaaaa

SEQ ID NO: 1377 - DNA, 236 bp, Homo sapiens
aggagaatcatgatgcagacctgcagcacaaatagcatgtcaatgcttcctgtcctccttctccacggataaaaaaatgaagatgctgctccagcaatgacgccgagcctgggggctcagacaggggacctccaaccaaggcatgcatgactccagaagacccctcaccacttcctccttaggcagaatccaaatagctcgtaacatttctgcaggtcctcccctctgtacctcag

SEQ ID NO: 1378 - DNA, 282 bp, Homo sapiens
ccagcaatgaggagagacggattcttcagcaaatctgctaccaagaaagagtcatctgctagtaagacaacatagtcatgggagtgacatttcatcccatttgtcatatcctgtagattagaagtacatcatgagtcctgcccacagactcctcaagtgaagtttatacaagggcatgaacaacaagaaggaagggatgatggaggacccctcaaagcctgtctgtcacaactctgtcacattttacaataaagatgcctttgaatatgaaaaaaaaaaaaa

SEQ ID NO: 1379 - DNA, 722 bp, Homo sapiens
gggtgcgaggaagacgataagggagggaagggggggtctttagtgacagtctcttaagctccacgggtacaccccaaaatgcatccatactttatgtagaattcatattaatggaaaaaatcagctgagaagactgaaaaggaagagatgccgttatttttgcttttaaacagacggagtttcactcttgctgcccaggctggaatgcaatggcgcaatctcagctcaccacaacctctgcctctcgggttcaagcaattctcctgtctcttcctccagagtagctgagattacaggcgtgcaccaccacgcccggctaattttgtattttgagcagagactgggtttctccatgttggtcaggctggtctcgaactcccaacctcaggtgatccacccgccttggtctcccaaagtgctgagattacaggtgtgagccacagtgctaggctgtaatgttgcttctaactggacagagtggccagtaaaaaacagatttgggtttcataagcacttaactctactaaaaaaaaagaaagtatgagaaagcctaattaatcaaatgtccatggaaatggagaccaagggttgtaaaggagcctatcttcattcttttatcctaaaatagactagattctaaatctagtaaaaatttctttggaaaagttgacagatgcctatacatatatattgtcaccatttctctacatcgttggacttgg

SEQ ID NO: 1380 - DNA, 1013 bp, Homo sapiens
  misc_feature (1)...(1013): n = A,T,C or G
ctctcatgatttcaggaggtatactgatgcaaacttaatatccagaaagaattctggtgcaggaatggtttggtatcaagaacgtgggctccagaggtggacaggtgtgtgtctccaggctaccttgtatcctgcatagctttgagatcttggacaatttatttctctcagagggccacagtttcctcatctgtaaaataaggacagcgatactaagttcagagtgtcatcgagaggataaagttaaagaagatcctgggtccacacccacagtgcctaacagcattccatctgcagaagaggtcttggttatttgatgggattgagtgcacagagtgaaaaatgtgtccatacagggaacgtacttactcctttggagcacttatttcatatgtggatcagacaagttagcaagatggtaggtatgctgccaactataacgacagagatatctacacatgtgtagattgtaagattggtgcttctggagcattaataacagatcagaacccgaggatttgttttaccacagattaggatgcaccccaaacaccttctanaatgnccaggctgattctcactctgntccctaaactctaagaatgagctataaatgagctattaatgctncattcacatgcaatggggggtaggttgaaaagtacaagcgtatgaaaatagatgggccggcctggggcatgagccctggagtgagtatgtgagagaagatgaggatgagactcacatcgggtgggggactgtccaagaccttctatttgtaggactaagcgagctataaatgtagatatctgactgaaagcgactctatccatgtctattagtgattgttcgttagaataatctccgcctgtagccgaaatgaaattgggtaagggatatcgcgctaaagtggtggggaggcccccgacgtctgcggggggctggatcgataaagtgttatttcatcagtgtagatgtcaatcgatattatatccttaccaccgaccagaagt

SEQ ID NO: 1381 - DNA, 782 bp, Homo sapiens
ttttcagagggaattgacttcaattttgaaagaagtcctagtggataaaatgctatcaaacatcactccatgttacagagatatcttttgtgaaaggaagtcaatcaatgtggcaaacttcattgttgccttattttaagaaattgccacagccactataaacttcagcaacaactaccctgagtcaacagctatcaacatcaaggcaagaccctccatcagcaaaatgattacaactcactgaagggtcagaaggttgttagcattttttagcaataaattctttttatttcattccatggtgattagggaaggaaataaattatttttaatagaagtctgtgcattttttagacaatgttattgcacacctaatagactacagtatagtgtaaatataacttttaaatgcactgagaaatgcaaaaatttatgtggtttgctttattgtgatatatgttttattgccgaggtgtggaactgaacctgcaatatctcagaggtatgcctttacagctactgcagtgtttttggttgtctagtgtttacatggtaagactttctccctccttttactttcaacctatctatggttttatatttaaccttagttctcataaaccacatattaatcgcgtcttgactttctggccatctggaaattttctggcctttaacccgtggggctatactatccatctaacataataattggggggattggattaaaatctaccatcatggttaaaaaaaattttcttccctcatagaaaaacctgcgt

SEQ ID NO: 1382 - DNA, 537 bp, Homo sapiens
ccatgtcctaaaagaaaaggatgaaccagagtggaactaccagtctgcaaacagagatggaaggaaatacaactttgttaaaggagatgctttttgtctgaagcccacaatcctagcttcattaagaaactcacaacacggggtcctgcatattgaaagagatgtttgttgcagatggaagatgaacaagtggatatagtgctagccaaagaatcagaaaattatgcaccaaccccacctgggaagttcagctgcataaactgcatgaaatgactctggtaatacttctggatttttgtgttttttaatctggatctggaagagtcatctatctgttgcctatctgacaaaagcagcaccaaactgccttcagaaagggcattagacctgtttgggcactcgaacaaatttgtcattaaagccctagagccggacaatacaaagcatgaaaaatattaccttttcctggagaagttgaaagcagaagcatgaagccctcaccagaaacagatgctggtgccatgtttcttatacagc

SEQ ID NO: 1383 - DNA, 690 bp, Homo sapiens
cagtaccatcaaagtggcaattcaaggaaacccggaagtgaactgctgggcttgctgtctgggggtaggcagtgtttcctgcatggtggagtactccaaaaggggcaactgtggagctacatcactggtgaccacagaaaaagaaatgggatggctgtttatttgttctcagaaccatcccctgctcttttcttctcagaattgtaggggccagagcctggacatttccatttcccagtcttccttgttgacctggtgctcagttaggtttattctgtgggaacccacttggagctccagagctggtattgtgaaagatgtcagagtcaaaatggagtcactgatgttaagaaaaccctgacaatagagccagggaaggccatgaagagagggtttcatgcttgtatgcctgatcatgaaaaagactctacaacaaaacacaactctgtacataaaatacttctgcaaggacttctgcccagcaactgccagtccaaccttggactggtgccaccattattattgatcttcatagccaaggataattatttcaaaacaattacataatcctcattttttcctttgaaaacctttgtgttccttcacctccctaaatatgcacatagtttactacggtatgtgcattcctattgcaatgttccaatcccaaataaaatagtatgcgcaagc

SEQ ID NO: 1384 - DNA, 817 bp, Homo sapiens
taaacatctaaaattgcagataaaaatgggcctaatatacacagcaggcttcaggtgatgacagagaggaagacagccaaacacatctcatccctggtttgcacttgggactgaaataccagcatcactaaattcttcaggattccaaccccaagggttgcaatgcttcttcggaggtgatggaaatccactgaatcaatatctaagtgagctccttggcacaagacattctctatgtttccaagtagaatacctgatgtaaaggaatgtggtacatataacagctttgaagagaaaaaaaacaaggaaagagcaaagtttttctatctgaaattaccagagtgccacagaaggccttggacagctgcttaggttcctaaaatggggtcaaaggtagggcgccaacatgcatatctgaccttgcaatgttatccagggcttcttttttgtcatcatggtccacatagaaattgctcatatatgaaaagcacattgggattgaagagatcaatatttcagcatccttgtagcatgtgtgcttttgtatactagatagaaatctctactgtaaggataaattatgagaagctttgctttgggcagatgacattggcttctaaggtgtggttgttgaatattgtgatgaatcccctgctgctgggttggcattaggtgtgaactcattcagttggagggctttcaccagaaaaatttctctatgacttcatcctggtatcagcgtctgtctcctcctcccaagagtgtgataacagtaggagcacagtttaaatagtcaataaaaaccgtatcggcaagg

SEQ ID NO: 1385 - DNA, 806 bp, Homo sapiens
cttgccgatactgctttattgaggtacacttaatataaaataaatgcatatatttaacttgatgagatttgatgaacttgtacatccatgaaaccatcaccacaattaaaatacagaacattttcattgtccggaaagtttttttatgcctctctgtcatctctccctccctctaccccatctctgtaagctaccaccttgttttctgtaagtatagactggttttcattttctagaatattatataaatggaatcaaatagtgtatacttttattttctggcctctttcactcaacataatgaccttgatattcaattatattaagtgcctgatttgtttatttttattgctgaatattgttttattggatgaatataccacaacttgtttatcattcatcagttgatggatatttgggttgtttctagttttgggcaattataaacaatgctgctgtgaatatttatgtgcaagtatttgtgggaagtacgttttcatttctctttaattcccccaatgtttaaacattgctaactaatataaaacatttttaacccaagtagacaaattaggaatggtgtacacaaaacactactgcacactggatccagcctggggctggccagttttccatggatatggaggttctgtggttttctcttaaaacacaaatattgagttatgctcttgggtaccctgccctttaagacttggcccagatttcattcacctccagagttaagctattcggaggccatgatagaagcactatttaaggcctccttgcgcctttctgccggggaa

SEQ ID NO: 1386 - DNA, 1141 bp, Homo sapiens
tcctgaatgcctccgtctcaacttgcatgaaatgtcccgtgaaattcctggagaggcttccaggccatatgctcgcagatctggtgctcacatgtcagaaatgatgtggctcattctttcctgcctctgccaccatatgcatgtgcccctaatctgaccagcagatcagcagctggggggaggacatgcccacggctggcagaaagctgcctggcaaatcttgacaccctggaagagagaagatggcgatggagattcactttctaagaatgcattcctttgttctcaaagaaaataatggatttggtgttttcttgaacttggggcatttaaatgcatctctaaatcaaactgcagcagagagctcaggttcaggtgatggtctgtcacttacctctcctgtcgccatggacaggccatctcacctgcctgtcttccatttctttagctggccacttggataccaatagagttgtgcttactgtgcttaaatattgcttttccaggggaggtttgatgactttgtctactcccatactcctcagatgccggaaaagacaggctctgtgtacccctgtggaccagccagattcttgagcagattttcctgatctgtttaccaggaaaatggtatacccaacagtttcggcaattccagagtccttggtggcctggcaggaatggtgtctctccagtcacccagatgtccctatacagctctctacatcagggtttggccatgggccaaatccagccaccacctgtttttgtaaataaaagtgtattggcacaaacctgcatatttgtttatgtaatgtctagggctccttttgtgctacagcggcactgttgagtagttgtaagagagtctgaatggcctgcaaagcctaaaatgcttactatctggtcctttacagaaaaagtttgccaactcctgctctagattgatggttacaaagtctgacagaggatacagttacagggacatggcaaagccagaaaaacgaggaccgggagtccagctttcaacaaagccaatctattcaatctccagactaccctttgtaccaaggttagatccatccttcctttcccattaaaatatcttaacttttatgaaataaaacaagatcggccgaag

SEQ ID NO: 1387 - DNA, 813 bp, Homo sapiens
  misc_feature (1)...(813): n = A,T,C or G
ccctctgggcgcccatatcagaatgactgaccttagagcagttggcagaaggaccactgtccgaacaaaggccttcagactcagtggagaaaaaacaagatgctttgaccaccacttattgggatgacaacgcagtcatcatcaatcaaagtagacttgtagattaaagatgtaattacaatgaagaaggaatgaaacaggggggattgcatcttgtcttccattttccctgggacttgaaaaggctgcttatatgaattctcctggaggaagccactactttgtacttgactctctacttgcaggctgacagctggcccagagacaacttgattgtgaaagtgtctactgagatggacttcaactgagaagaggcttgatttgtccacacacacacacacacacacacacacacacacacacaattgacaggccagccgccttctccatctttatccattttaactagatttaaaaatgtttgatagggatactttgctagttacataatcacataaggatatattaaaacgggctaccttttaaataaaactactacaaaatctacactttatttcttttttttgagtaaantaggttccgtacttagggtaaactaaaaaattgtgtgtttaaaagtgaaaggaaaatggtagggtaaagagaaaaacttttccaggctcctgtataaaaacatttcagggtggttttatatgtaaaaaatataagaaagggggggccttgtctggtctaatcccggcatatcttctaaaccaaatttttacttacaacagggggattgttcgcaaagaa

SEQ ID NO: 1388 - DNA, 616 bp, Homo sapiens
taatcagaagtcccttatgtaaatggcctgtttagcgggccatttacggatgctttgcaattagccaaaccactcgtttgtatctagatggatacaactcagatacagaagggtagacactgcaggaatccatttatgtgaagttccaaaataagcaaaaactatctgtggtgaaaaatcaggaatagcaatggcctgggtgagggaggttaatgtgggtggactggataaggaaatgagagaacttccagaatgtggtggtaaggttctgaattgtgatatggctttgtgttacacatataaaaacatttgtcaaaactcttcaactgaaacatttggtgcattttattctgtggctttacttacataaatgtaaacaccttttagactgtatgtaatgatatgcaagttgaattatgtaggggttgtgtgatgattttttgaaattcaagaaaatataagggattaacgtatgaataaacatatgacaaaatagcacaaaatgttaattgtggaacccaactagttgtttgctttaaagtctttcaacacttttgtatgtgtcagaaaaagtatgcagtagaaaggacttaaggttaaaaataataaagaggga

SEQ ID NO: 1389 - DNA, 631 bp, Homo sapiens
  misc_feature (1)...(631): n = A,T,C or G
agacattggctactctnanaacattaaagcggactacangaatgtcaacaacagtntnacctttttgacaaattcancaaccanaaattcatcttttcctcaataaaattcaagcaaccatcggtgggggacaaaaactattattttctttccattctcaatcaggtgaactatannacacttcctnanatttagaatttgggccattcngnttnaacncctattttttccaacacaatttctnttttgnatgggnaaanattttccaaaaccctntgacncttaaaggctgggcctaaantnngnttttcttgngcctggtntnnntttcccnctttattnntcccnggnncnnaaaacagggagattcttaggggaaaangaaanaangtccnaaaaanttttggnnattcnnnncnttngccaaaggngttgnaaaaaanaaaaaancngcccccnttcnttctttttnntacnccnanntttntcaaaantnntttttaacnccntggnnccttcctaaanttnngntttaggggttattnnggggaattgnnaaaaaaaatatttnanantttttgtttttgttgnnaantntntnannnanaagctttnaanccntnnggngggg

SEQ ID NO: 1390 - DNA, 651 bp, Homo sapiens
ataagacagtggcactctgagaggctcaaatggaagcttcctctcccaaaagccatccccagcatacctgtaaaacaaaagtggcgcatctcagaaggaccttggtggtgtcgctgaaatgttgatcaacaagaatgatacctgcaaggtgtaactgcgctttgcattccctgaagtacagtaggtgccccataaacatctgatggctggatgaattaggggcaagtcgtatatcctcatccagatatgtgggaagttccgtgaatacatctgcaaatatcttaagatgagatgctcctctccctgctgggaacctgactctagtgaaggaaagcttgaaagtgaacaccaaccgggcttatcctggcctcctctctacccatggtttcgtgcccctgtgtctgtcccactgccaacgtgacctgaaattgctagaggagggcttctaagagatgagctgctgtccatcccatcagtcctctacaccagaccaccaggaaggacagatgctcaggtgccacagccgctgccaccgtcccccaagataccacgaacagtcccttcactgtttccagctgtgtctgcctctgtgagctgcccccaaactccttccagatttaagaactgatgaataaaaaacgatgctgccgg

SEQ ID NO: 1391 - DNA, 441 bp, Homo sapiens
ctggtttgtccaattgcttaatgagataaaatacttaggaatccagcttacaagggatgtgaaagacctcttcaaggagaactacaaaccactgcccaatgaaataaaggatgacacaaacaaatggaagaaaattccatgcccatgggtaggaagaatcaatactgtgaaaaaggccatactgctcaaggcatatctgcttgggaagattattggccaaagatgcaagctaatgaaatgtaaaacctgccataaagtattacagagatatttgtaaaaatggatgagatgatttattgtttctatccagtataatcacagtcatatcaccctcagagttcctgaaaaatgttcaacaagaagtcaaggtctgttaaatatatcatctgtttatggacaaagattataataaagtaatcatgactgtgaaaaaaaaaaaaa

SEQ ID NO: 1392 - DNA, 173 bp, Homo sapiens
tctctaatatccaccgctacaggaagtttgtttttaaagggtttcttctgaagcagcatggcgggtcagttgcaaccaaaaggagtccttgaacctggatgaactgaatgaagaatgatccctcctatctcaaagtttttaaattaaagtttgcttaccatgaaaactgaaaa

SEQ ID NO: 1393 - DNA, 583 bp, Homo sapiens
  misc_feature (1)...(583): n = A,T,C or G
gaaaacagagagatggattctggcccaattttgacagtgatttctcgtnttattctccaatcaacaccaccagtcaaggtttctcatggtttttcccaaatgttcctttgagcaactatggtatccctgaagaaaaagtcttgcaacagggtgtaaattcctctatgtctggggctcccaattggtgtttataaatgttttaaaaatttctagcctgggccttcttactggggtacatggtgttaggtgggattggagggaactaaacaaatgctaagtaaagggctggtgcttgcgatgaaggctggatgggtgaaaggggagtgtgcggggttgtgctgggatctcagactctcccatctggaaaaagagtgttggttggggggggccgttgcaacgggttttgtgttttgttttaaaacagagtggcttgggttcccagagtgggtcgcaggggagcgaccgggggccgggaggccgcgcggcgtggtggtgcgctagggggtggccaacccggggtgggggggacgcgggggccgcgggggggcgcgatagatgaggatggggggtgagcggacgggcg

SEQ ID NO: 1394 - DNA, 257 bp, Homo sapiens
ggaaatcaaggaaaccaatacatagttcagtctggctacatgaagatttattaagtcataaaagagagacaatttaaagcaaaaagcaccatgaagaagaatggaaagaagaacaaagaacaagatatggagcaaagaaaaagaatactaaaaaataataaatacagtatttaccttaagaaaaaaatcaaaaggtatgcttaaaatctataacatatgaataaaatctgcaccatattcagtgaaaaaaaaaaaaa

SEQ ID NO: 1395 - DNA, 964 bp, Homo sapiens
  misc_feature (1)...(964): n = A,T,C or G
gtttttgagacagaattttgctctgtcacccaggctggtgtgcagtggtgcgatcttgactcactgcaacctccactcccctggttcaagcgattctcctgcctgagcctcctgggttgctgggactacaggtgcccgccaccacactcagctaatttttttttttttgtatttttcatagagatgggatttcaccatgttggccaggatagtctcaatctcctgacttcatgatccacctgcctcagcctcccaaagtgctgggattacaggtgtgcgccatcacgcctggccctgatctttttcttaatgtaaactttaatgctacacatttccctcttagcactgtttttgctgcatctcacacattttgatatgctttgttttaattacaatttagttcaaaatattttctaatttcccttgggattttttttcttttcacccgtgggttatgtagaagcatgtagtttaattttcaagtatttaagaatttttctagttataattttactattgattttaacttaattctcttgtggtttaaaaatactctatataattttagtctttcaaaatgtattgaaacttattttatgactcagcatttgtcaatcttagtcaatgttacttgtacatttgaaattaatatatatttgcagcagaaaattgtaatagtctataaatatcaattaggtcgaggggttgataaagttgctgaattcttctctatgttgctaacttttttggtttacttctgtgaatttttaatatatggctgtaaaaatttcccactatgattgtaaagttttctaattttccatatagctctgccaatttttgttactgtattttgaagttgttctccccaaaacanatngtnctgtttgcccgccaaccccncnnntttttttttttttttntnncccnnnccnccttncnnnncnnccnccttttttttccc

SEQ ID NO: 1396 - DNA, 867 bp, Homo sapiens
  misc_feature (1)...(867): n = A,T,C or G
attcaaaagaaggcaaataggaggcacatggagtcattggtacacagcattctgaaggccatccaagcaaatatcaggagtctatttattaagtctcgaggcctaagagtaattctccatggttcttggctctgcccttggggctttgtttttacttcagtaattgtacgactgtagcaccaacaggatacacaaaccggttttctcccttcaacctcagtaaaacttcccacaacttatctattttcctcgttcctttttccgtcagcataaacatcaccttaaaaataatcgcggtaatagagaagggcatcacaaacagtatatccctctgatctacactgtgcccaccaagtatcgacgctaaaatgcgggagatattttgaatatcccatcaaaataatagctatatggaaaccatcgcaaccccctgtagaaccgttaataactccccgcgtatttagtcacccccnctacgtgaaccacaacgttatatatttagtcaaccagacatttgatcaaatattgtggaaaaataacatacgttattacagggcgggatgaaaactcgcgccctggtacatgttacggcgtattcacgtgtggagtgaaattgtgaatgcacggttcgctcgggtattccgccacgtgtgaaaccagcgctagtataaacacaccactaaatacacaggtagatcagtgagaagcgtataatgcgtgggcaataagtacggtataatcacgtcaatctaatatgaatctcacaaagctggtgtcgtcgaggcagtgtgccattggtcactaccatcgcctactgccactccgttattacactacacctctgaccctgagcacttttggtgttcc

SEQ ID NO: 1397 - DNA, 950 bp, Homo sapiens
  misc_feature (1)...(950): n = A,T,C or G
tgagatttactggggggggtggtggaatggcgtggtttagttctgtgtccccacccaaaactcatcttatagctcccataattcccacgtgttgtgggagggacctggtgggaaagaattgaatcatggaggtggttctccccatactgttttcatggtagtaaataagtctcgagaaatcagatggttttttaaggggtttccactttcactggttcctcattcttttctcttgtctgctgccatggtgagatgtgcctttcaccttctgccatgattgtgaggcctccctagcgacatagaactgtgagtccagtaaacctctttcttttgtaaattgcctagtctccagtatgcctttatcagcagcatgaaaacggaccagtacacccaggctggagtgcagctgcataatcgcagctcgctccacccttgaccttctgggctcaagtggtcctcccacctcagccttctgaagaggggagaccacaagcatgtgatactatgcctcgctaattttttttgattggttttgtaaagattggggttttctgtgttacacaggctgggccttaatgacggatctcaagcgacccggctgcctcagcttctcagaatggtgggattacaggcttgagccaccaaccagcctgtcttggatgttattaaagatcaaagaatgttagaattggaagtaaattctaaatatttcatgttagggtgagaaanctgaggcttaaaggaactaaatgatattctcaaagttaataacagaactgaaaataccataaagactttttgaatcattacttaatttttcttctattatagcctaccctcacctatgataacagttcgaatgaatgcaatgcatatatgcatatgataaatatttatcattgggtaatttattgatatcaaatttccaccaaataaacattgatcaggcc

SEQ ID NO: 1398 - DNA, 351 bp, Homo sapiens
gccctgcctctggaaggtttttttctgtaaagcgctttgagactgcaggaatttctactggttttaaaaaactatcttaactatttggcaacccatgtgataaagcttgggaattccacaaacatactgagaaagaaaccagccaagagttgaagttccttgaatctccagattttgggtttttgtttgtctgtttgtttgttttacttcagtttgatgtgactgcttctgggttctttttttctctattccccatcaaatatcctctgctcccaaaagcatagattcccaaacgttgttccataacaaaaactatcaaaggcctaccaaaataaagcaggatgcggcagc

SEQ ID NO: 1399 - DNA, 545 bp, Homo sapiens
ctaggtgatgatattctgatctatgagatgcaagaagatgtgatgtgtgggacatccatgaaaactgattaatgagacctgacacaaattagagatcaagcccactacgaccaccaccatttttctcttctatcctatttttttgtgacctctagcatgaccatgatgccaagatctctagcagccacatagtgacctgaggtaaatctgagtatgaaaatcatgtgccaggatggtgtagaaagagggttttggatcctattgacgatggaaagttggtcttcctacctctgaacctctttatgtaagagaagtaacatgagttttaaaagccattattatttccattttctctgctgatgcagacaaacacaagtcctaattttatagagacctaatacgttctggacctcagaaagagattcctggaggaaatgttgttttcaacctactaactctgctaatttcaggccaagtgaggcattatatagacagtctgaccactgccacagttgcatacgttctaaatttgaaataaatccaga

SEQ ID NO: 1400 - DNA, 612 bp, Homo sapiens
ttcctgaggcctccccagaagcagaggactgtacagcccacaaaactgtgagccgattaaacctcttttctttatgaattacccagtctcagacggagtctcctgttgcccaggctggagtgcagtggcgcaatcttggctcacttattcatgacattttaaaacctatgtttatgctcaatctcatccttgacttaaagctccatgagaacaaggactctgctacatctctgcaagctggtaaagagaaggagacagagtctcgccttgtcacccaggctgtagtgcaatggaatcatcaaagctgagtgcagcctcaaactcctggcccccagagatcctcctaccttggcgtcccaaagtgttggcattacaggcatgagccactgtacatggccatgcatttttactttaactggggttttataagttactgatccctgcctccaccattctattagccaaaacagaaaaaagcactattttgttttaggtaggtattttagctactcattcactacattttctttgggtgaagaaagtaactagagatgaagcatagactacccagtttaaagagtaaaaaataaaaataaacaaagaatgcgaccg

SEQ ID NO: 1401 - DNA, 902 bp, Homo sapiens
ttttttttttttttttttttttttttttttttcgactttctggctttattcacacagtgtctatttcaagatgggctttgtggttttgggtcaagaaatgagacagatgagtctgttctgcacagttttagcgtgctgtcagagaagctggtgtggctctgcacctacacacgttccagggagcctccgtgtcacgtccttcccgctgcctccaaagggcattacggcttcagagtcatgtggctgacgggtccaacagctcttccaaaagcaggttttcccttctgctcatgcaggaaacccagtctcttttcttgggctgggagcttccgaagaggggtcctctcttttcagggcagctggatgacagcattcaggtgcttcttgggagatggaggtagaaggaacggggacgcctcccttcatgaacagctgagaaaaccggattctctttggtggtcgcttgcttcggctcgggggtctctctcgttttctcctgttgtctgcagtccgggcgccggacctgatttacgtgggagtaggcgatggatgtgcgatgtgccgcgttgcgtttcgtgtgctgtggcaccgtggctagtgttttgttcatcacttcgctcctgttctgttctgtggtctgcctctgtgtcaccgtgggttttgttggtgacatatttggttggtgttcgatacgcgtggtttgtgtaatgtgcatgatttaacgttgtccagtggggctcgtacctcccggctttttgtccgcctactcactcgttgttgatatacattggcatgctgcgataactcccacgctatggtggatagattatggtggttacgctcctattatatatcttctccttattctattactgtgtgctcgcactcgtcgtctgtcgccg

SEQ ID NO: 1402 - DNA, 485 bp, Homo sapiens
aaaatgcaagtcagactcaaggaacacgcatgctcgcagaagccattacaatcccgtcgtgcagcagcctgtgctattgaccagcctagaagtcatttttcgactcaaggggagaagggtgggtttctgctctttccttgcaccatctgaaggacacggcagaagataaaggaaaatggccatgagatgctccagcggagctgggtccaaggcctggcgctcaccaaagattgcactactctcagcatggtacaggaagacaactgatgggacaatgcaagctgggacaatctccaacccaaagggtatctcagaaaacagcactaggtgagaccacagcacaaccccagtcaacctttaaatcagaaaaggagctggaggatgcaattcattgatgtatagaaagttttaaaaagtaaaaactgaaatacagaaaacaaagtttgcaatgtgtaagaaataaaggactggcctcgttggcctca

SEQ ID NO: 1403 - DNA, 243 bp, Homo sapiens
ctcttgtggaacaatgagaaatcagagaaagaacaagaggtcatctgcagccaaacctggtcagaaggattatagaacattttatctttcttttgttccctcaatcctattgtcatcattcaattagaagtattattttgaatagctttaatagaaaataaatgggcttaattttttctgatttattgtgccctgcatttcaaaataaatattagtcactgagctaagataaaaaaaaaaaaa

SEQ ID NO: 1404 - DNA, 900 bp, Homo sapiens
cgggctgcatccttgttttatttaaaggtgtttttacctttcttagcattccacaagttacttcctccttcctttgttctcctctacctttgcctcttctaaaaagttctaagttgctagccaatcgggacaaatatagaatgtgaggccccattccagccaatggaaaccggacacagcagtaaggtggatgtgtcaggttataaatgaccctgtctcctttgtttggtgtactctcatggcaaaactgctggcgagtgtaccctttctgcagaaagtataaaaatggccttgctgagtaagttaaatttactttcaagtgatattctttacagcaccggagagcaagcgtttcaaatagggctgcacctggcaggcagctcaacagcccagtgtgccaggtaccaagcgaggtgtatctttctgtcctagtccttctcatgtccacctgcctagagctccattgagagcctgatctctgctgaaagatgaggccctcctatgctacattacacaacgcaaatgtctcaccactgaatctttcatcttcttggggagagggtcagcagctgactcttccagattttgatgtgaaaattgaggaaacaggctgggttggatgaatgacatcgatccagatgggggcattggtctgaccgcgcgagaatgtaataaagggccatccagaaggcctggaaatggtgataaaaatgccggggttggtgtttgtccttgtcagcagctggatgtctcgtgttattgggcgtattgcgcgagtgaatctagggtcagaccacacgaagttgtcgcggcaggcgagatgggatattgatcattagagggggtggtgctatatcgtgttattagtgtggcatcgttgccgtgggcgcagggggcagg

SEQ ID NO: 1405 - DNA, 655 bp, Homo sapiens
tgaaacacagtgggcatgtagagctgcgacacggagtgccatacaactgccatctgcagggtcgaggtgatggatgcctttcttgggtgtcaagctgaaaacaagagaactgtgttgtcatctgaggagaatgtaatcactccttccacaactgttgcatgtccctgtgggtacaacagagcaatcactgacctctctgccagcaagactggatggtctaaagaataagagacggagagtagcagaaggctttcttagtgcacttgccctaacccttggtggatcttgttatcaagtgtccaacaaaggctggaacattccaggggattaattcttcaaataggacaccatgaatctgtcctttggaaactcatcaaggcagaatttataatttcatcagttttattttcaggaattctctacaattaagaagataatttactaaaaacagtctttcctacctctgaggtgtgtgtcacacacactgattagaagtgctatagaaaagaaaattccaaatcgaatgaccttcaaaatttgcctgttaatacccaggtgtggaaacagttccattcattcagagaacttttgtatgcttgtggttgatcagttttaaaaaaagagaatagaaataaataaagtagtatcggcaagc

SEQ ID NO: 1406 - DNA, 739 bp, Homo sapiens
  misc_feature (1)...(739): n = A,T,C or G
ttacgttttaagaaagcagaagggaggcaagaagtccagcctgataactgaactttctgtttagaattccttcttctccattgggcctttgctaggtttcaataattattgctcaggcacatagtcttggagctttgctttttctcagacttgtacacagttctaggaagggttgttgccaaagccatcatgtgatttattgaccctccactgggacaagggggaacagatataactttgtgattttattataaggaggctgggttaatatttctaggtgaaacaagctactataccaagttcaaacatctgaagagggaggttaagaaaccctgagtgtggggtgtaaggattattctgtcctggggctgtacagacgtcgtctgaggcagggagcaggaaaagaaaggacacattgtgacccatttccaacacctnctgtgtgtagaggcggaagttccttgcctggtgtagaggtatatttgatctgcnnaaggagagcttttcactgccatctggagctcgtagaaaaacaattncatngggcagtcanaaatattatccncactttttcctttnattttntancccccaaaagcctttttnggatccaattcccattcccttttttaaaaaaaaattttggttttnncngggantttanncnggnnngaanaantgntttgggccacctttttgngtnaccanaaaanctttttttttttcccccacnacctcc

SEQ ID NO: 1407 - DNA, 585 bp, Homo sapiens
taagtctcatgagatctgatggttttaaaaaggggagttcccctgcacatattgtcttgcctgctaccttgtaaggggtaactttgcccctcattcaccttctgccatgactgtgagaccttcccagccacatggaactgtgactccattaaacctctttcctttataatttacccagtcttgcatatgtctttattagcagtgtgagaacagactaatacacctggtgtcggacactgcctgcctacagtgactgttggagctgctgctggtcacacgtatgcttggtccatatgaagcctgtgaaatgcatccagcaagttgcaggaaaccaggaaattataggtgtgctgtatttaaaagacaggtgagaagaagctcagctcctcttgccatcaagagtttatggagtcattgatattcccaaccagcagtgctgctgtttgtcacatggtttaaatctacaatgatttccttaataagccctttgggaagcaatgaactaaaaattaaagcatatgtttgttgaaaaattaagcattaaatttcctctgctcaaaagaaaaaaaaaacaataaatatcga

SEQ ID NO: 1408 - DNA, 645 bp, Homo sapiens
atagacattttctagctaagatctccagggaaaagtttgagggatcacgagagatggatgaatcatgaggaaggggatctacatatttctgaccagctcagagtaaggggtccatcttctccagactggcttggattgcaagaagctgcatcttcctacagaactattgtgataaaaatgtgaaacaacacggggtcccagttcagacctgaatgaggtaccaaaggtgatttctgcaccactgatgctcactctccagcaccatactgcaaccagatgccccattcacttgacgaggtgtgctgccaacaggactggcatttttgctattgaccaacattagctggcatggttacaagagtctggacagccagttaatccttaaagatatgtcttctttgattgtgtgctataacattattcttgcaagtactattttctaaaggacttctgaagcaatagaaaaagccgtaaattgctttccattgctaggaaaagtcatgtgtctgtttaagtatacaagcatcttcagagggttatttgtgattgcaacattttcagactcaatagagtacacataataaagagcgatcgcgacaagttccttctaccttttccacctttatatttattcatatatagaaa

SEQ ID NO: 1409 - DNA, 706 bp, Homo sapiens
tttctaatttattttgaattttatttgcatttattcaattcatgataagtgtttactaaaacaaaacacatttctgaaatgaaacaactctctcccaccctcggaagctcttgatagagagggaaataaaacttttcaactaatttttagtcctcaatgtgatgactacagagaagaaaagcgaccaaagcccactgtccagtcttttctgtgctgttctggtggctcttcctccagaatccgggcagaacaaagtctttcttcaaaaagagtcaccctttgctgcatagattttattcagtcagcactcgttcccagctctttcacaactgtgacatgttcattatttgaaaactctctctgcccaccctgcgtgtgaccatgcccagctcaacttacaacagatagccaggctagggcagcatcgggttactgcccttgtgaaacacaactttagtgctagcaggcgtagtaccacttaagagtgcaatgaaagatgttcagggtgacctgcatactaatggctgattggtagcacacagtctgcctgcctgcctgtgccttgaattgtggaacacgtccatgacccagaggaaaatgggattaccattctggcatactaaataataaatgtcgactagcctgtcccgtatattttgattcttcagcttgtttgatgcgtcccgacctcatcgtctttttctgg

SEQ ID NO: 1410 - DNA, 794 bp, Homo sapiens
aatttgaaggtagcagtatttctctgaattctaggaatgctcaagatccaggatgagttcagaccctgggctatccatggaccatggctgacccttggcctaaagccacatatccaggcctatgaaatggatttgacccatctgtgatctgattaccccaccactgcatgcctacagcacacaaggaatgcgaaaacatcatgttccagggacagtcttcatttgcgctagacaaaagacaaacaatccttccttgaatggacccactcttcttttttcactcatctcctctcactgatctccccgctggtggtggcggatagaaggcagagatgtggtcaacaccaaatgagattatgttctgggaattcagagattacagtctgaagaattcaagataaggtatgacctccataaagaaccttcatatcatcttgccctgcatgaaatatattagaagcctttgctctggtctttcatggtacttttaaaggatattatcatttacaaaatggaataccaatgacttttcacaagtggtctatcaactaagcatgtacttaagtaaatattttcagaggatttcattaacctctgagtgaatagttgaaaaaaaagaatgaaacagatataagtccatgtttttatttgtaaataaatgtattgccaaaattacatacaaataacaaataatgtctcgagtgacatgcaatgatcaaaatcctcaaaagaatacttttgtttagtagagatttgaacaaataaactacaatttaaggagaaaaaaaaaaaaa

SEQ ID NO: 1411 - DNA, 640 bp, Homo sapiens
cttaggtttctcccacacacgtgttatattatgggagctacagttcaagataagattcaggtcgggacacagacaaaccatatcaatactcttcatcagaaatccacctgtggaaggaagtctctggccttctcaacacacttagttatgttctttattcatcatcgaatgtataacttttaagaagaggtcataaaagacaaatacttgtttttttaagttgctgaataactaagaaaaataccaaaaacctgaaaaatccatgacattatgcaaaattatacaaatgcaaatattctttcttattctgaaaggatttgaggcagcattatgattcattttatttgttcttggaataactaaatttggtatgacacttttaaacagtatatttaattgtcattttatgtcatattgtgacacaacaaactttgagttttctttagtttttaaaaatgaagtgtatatttttaccttcacattttttgcctgcttcttgtaaacaagaaaatgctatcactgttatattaaaacagaacttactaacagcatggaaaatagtaaattacatgtgactgaagtttattcaataaagtttattctcctttaaaaaaaaatcggcctcctcggccttagcgga

SEQ ID NO: 1412 - DNA, 470 bp, Homo sapiens
cactttcatcttctccctgcaaccatcaagtcttcatagcacacctcatggattttgggctcttcggatttatatcatgcatcaggactacaggattgaaacttgcatcatttaaattatagtcaatacctattaggtaagattatagaatgtagtctgttaggtgtcataacctatcctatcaagccaaagcctgacttcatgctaggccacaagcttgaaggaaagaaggttgattctcctgaagaaggtggacatacagccatattgcatagggataatgaggtttataatgacaataagaattgatataatatcattgattataaacacagtttgctttgtggtgctgaggtgagaaagttgtaacttgtcaatatgtgtttactaaaagattagtttgaatggagaaaattaactgaattggagaataatgagaaataaagactgagaggccaaaaaaaaaaaaa

SEQ ID NO: 1413 - DNA, 1007 bp, Homo sapiens
atgccacctggaagtgttgcagcctggaatctggcctgaagacaaagccattgtggtgagaattataaaaaggaaaggcgattccttcattgtgccattgactaaaccaatcttagaacagctctgactgcccttcttgtcatgtgggagaataaattcctttactgttgaaaacacttccagctgattttctgttacctgcagccactgaaccctatattgtcaaatctcaggggctgatctgaatgcactacaacagaggattcactatctcatggcttcctgttagtttcaacctaagagatccaagagtggtcctgagacaatgagtggctggtgcaagagtatgaaagcccaactccctcgctccatcttaggacaatttctgagcccctgattttctgtgttcctgattttccctgtggggtcaactgatattattctgcacagaggattcagtacaaaaaaacgtgtggctaccttcttcaaaaagcaggaacaaagtgctattagaggctcacattctatcaacactcactttggcttactgagaaggaaggagtaaaagaaaaatgaactgtggtttgctttatttcccactttccttctgtgtcatcgtttttcgcataagtagtcactaacacagggaggtaactctagtaagaataaacctgatgtttctttggttgtgtgtgtatctgaaaatgccattgacttctttctgcattctcagcaagtggctgttttaaagggaaagcacagcttctaggagctgttggcaccctgatgtattcagtcatagactcaatccacttttggtgctggctttgagtcttgctgaactcccactactgctgaatcaccaaaattcctgcttatggcccattgcaatgcttcatatgattggaagggcagaaatgggaacccattaattgcactttcttcctctgctaattggatgctcccttttaccatcaacttcacccacaattccattgaaggatagg

SEQ ID NO: 1414 - DNA, 868 bp, Homo sapiens
actgtttcgtaatgaccagttacccatctcaaactggttcgaaaccaaccaaccaactaggaaaaatgggatatcttggctcacccagctggcagagacatcagagttgctcacaaaactgaaagaagaactacaggaacccatcttgtggactggatgatgaagtcacagggcttcatctctcatttctgctggtctctgcttggattcatgcagcagtcaagttcttgatgaggcaaagaaaatggctattggcacaccagattcacttcttccagtttagcaacctcagtggtaagaaaatgtctcttttccaatttctgtttgtgaatcccagagaagcactgtagttggttttgcttgggacaacagttgtgtctaggaaaacgaagtactgttgagacaggcaagccggcttatttactatcttaagatggtctggagggaaaggataaatgccctttctcaagctctatcttctgtaactctcatccaatcagttacaagagatccaagaaatcatttactgcaagttcctatttcagggggctagggttcctcagagccctgcatgggcagctagacttgaactccaacctagttactgcttcttcattttaatgctaaaattaatgcccagggtggagatttaaaatattaatgctgtatacaatgtatgaagaagcatgttgagccactacacaggcactaggaaaactcctcttacacatgccctgatgtgacctttctctatacaaagaccctataaaactaacccacacagtgttctcaaggagcagcctactcctttgtcatttcttagtgctggctaccttgtgcacaagctggaataaaacgagatcggccg

SEQ ID NO: 1415 - DNA, 333 bp, Homo sapiens
tgcgcgatccatctttatttgttaataggcaatgattggaaacagctcaaattcatcaacagacagataaacggtagcatagtcatacaatggaatacaacacaatgacaacaacgtcaaaacagctgtttgtatgctcaacaacatggatgcagctcaaaaacatagaatgttgaacaaaaggagccacacacaagagcacacactgtatgtacaagaacaggcaaaactgatgataatagaatcagaattcttgagccacagaggtccaggctgcagtgacccgtgattgcaccactgcactccagcctgagcgacagagggagaccttgt

SEQ ID NO: 1416 - DNA, 1410 bp, Homo sapiens
  misc_feature (1)...(1410): n = A,T,C or G
cagttggtgggttttgtgtatgcctgttatgtgatcagtatttccatggaagaagaagacacatgcttgttctgccaggatgatgcaccaagttaaggttccagatggctgagataaatgcctgtccttgcaaactggaaagaagatgattatagaagggaatgagagaagcaaggtccagaatggccatactttttcaaaggcacataaattttggaattgagtctcttgaaattgaacactctacatgcctacacaccatttaggaggtcttacattcacttggggcacaccttctccagtttgaagaccactggtctcttattgccgcccttctcactccccacaatgaggaagaatgagtatccgagacagagttggggagacttccagaccctccagactcttggggattgccctcagtgtttgtcaaaacaagttgccctcaaggacagttgaactatatcagttcttcacataagtacctgagactgagggggacaggacagagtgggaagcatccattttgtatagnattgctgagcagaaagaaggaaaaaatgnnggtaaactctgatatggacaatgcaggctcttggactgcatactctatacttccagcnggaactggctcaacatntgagcatttcattggtccccatgtgcttctcttcaatttcacaaggctttctgaaaggtgaagtagattttaatcttcctgaggcataaagaacacaaccataaaatagtgataaagcctggcacttgggcatcatctccctgcttggacatctcttcgggatcccaaagttatttcaggaagggggtagcacaaccccaaccacccccgggacataagcaacggtttaaggcactgtcaagtccactgtgcccagcagacccatcatggtgccttggtggccactaggtatgccataagcagccccaactgtggcctgtgttttggcacagcaggccgtgcctactgaatgctcagattcttcagacagtagacagcaacagatcagtgacactgcagagtagctcattctctcgtaacagcagcagggtttagttgccagctacctctgaaataactagtctctcctaaaagccttcattatggtggggtgctgcgaactcctctctgcagtctttgaagggcctctctgtgtgaactaagttgatgtcaagcctcttccccagctttatccttatgaatttatatcacggaacaagaaaatcacagtgtaatagcccccatatttgagttcttcaaatgtttctttaagatgttattgctggacttggcaacttgtaaaataaatgctgattagaaaagcctaatacctacatagcaggaacaatgatggaacagaaagcaagctcagaataaatgccgatcagccg

SEQ ID NO: 1417 - DNA, 537 bp, Homo sapiens
ctggccgatctgtctttattgtaatgtggatactgccttagaatattttcatgctttaaaatatgttgttccaaagaggtttggaaaaaactacatctccaactccaaggcaaacccatccaaaaaaaaaggtagcattagaagtgctctatatagtggttcatatttccttatacattttaatttcctcactcacaaatccttcaagaaactactctccaacattcctttttaagcacaatcttcaaggaaataagagagaaaaatcaagaaagcctcttgtcactgcaggtggcttttcatggtggcaagagtcatctccgggaaattgccttaatgttgcacatatccagctatttgtggtgagagcctagaaacccacaacagagtctgacaatttctctgagggacgttgtttgcttttgggaaatccattaactcttccagtctccgaggatccacttaatccagcactgtctaatagacatgtgagccacacatctatttttaaatttcaagtggctacaattagccata

SEQ ID NO: 1418 - DNA, 455 bp, Homo sapiens
agtgaacacaacaatgtaaccaccccatatcaagaaatagagcattatcagcaccctagaagccaaagccacctgccttttcctcttgctgcctaaagagcacaagcaggatgaggagctgcagttaccccgggatctgaaagttctagagtcgtcacttgctcttctggagtgtggagatgaataaggcccagttccgacatctgggattttgactctccaggcaagaggacaggaaaaagatgtttggcttctatgaactaattcactgtccagagcatcttggcatctggctgctgctgaggaaagaggaggatgtttgtgtgtgtgtgtgtgcacatgcgcccgtgtgtgcgtatctgagggaagctaaatattacatttcagggcttagtccttccatactttgaatttaatatgtaattatgaataaacatggaaacgtaaaaacaaaa

SEQ ID NO: 1419 - DNA, 425 bp, Homo sapiens
tttggggaaaataaacatctgacatcacctttatttcaagagtgtgtgtacgtggtgacaatgaagatataagaattggaaaagaaatttgagaagttgagagtaatataaaagattgttacttaaaacaataaatacaaataaaagctgcattgaatatttatatcttaatctcttactaactaaatgaagttaacatattaagtttaaatattcctaagcagcatcaatgcctaaggaaagatttatggtaatgaagtgttgacagttttttgaaattgcttatgtatatgttagctgacattaacataagtaaattgcttctgtctggaattcaccttgaagccattttcgaatataataattccctatcctctaatatgaaagtcatatttaaataaaaaatgagaagaaaaaaaaaaaaa

SEQ ID NO: 1420 - DNA, 948 bp, Homo sapiens
atcagaagttctggagtgacacttgtgagcagcattcatgagttgcctccacagtcggtgagatgggtccgctcaagtactgcatacagagacacaaaactctgcagactcagctgcctcttgttttgatagcaagtgacacctccctattctctaagacacaacaatattggaattaggccaattacaacccaacgtggacctctaaatgttcaagtgaaagaaagagtcgcacatttttcactttaatttcaaaactagaaatgattaaacttagtgaggaaggcatgtctaaagccaacagttgagataggccccttatgccaaacagccaaattgtgaatgtaaagtttttaaaggaaatcaaaagtgctgctccagtgaatatatgagttataagaaagtgaatggtactggaaaaattggatagccatatgcagaagaataaaactggacaaaaattaactcaagatcaattaaagaattaactataagacctgaaactatgaaaattctagaagaatatctaggaataacccttgcggacattggtctaggcaaagaattcatgactaagacctcaacagcaaatacaggcctgggtgcgcgtggctcatgcctgtaatcccatcactttgtgaggctcaggcaggcagatcaattgaggtcaggagttcaagatcagcttggccaacatggtgaaacccagtctctactaaaaacacataattagtcgggcatcatgacatgcacctgtagtcccagctacttgggaggctgaggcaggagaattgcttgaacccggaaggttaaggtcacaatgagctgagatcactccactgtatgccagtctgggtgacagacagagactctgtcaaaaaagaaaaaaaaaagaaataaagaaagatgcgaacgttctttcttctttcccttaatattaatgtctta

SEQ ID NO: 1421 - DNA, 723 bp, Homo sapiens
  misc_feature (1)...(723): n = A,T,C or G
taaccttcaccaatttgatggccaagaatggacacttactgtgtgatactgtngntncacgtgttgannanggaaaanantgcttggcttacccacttcanangcttatnctganatttttaantgngagannacttnncaanctacntngcactccctanntgcagtgnttttntattaggaggncctgctacctncctacctganggagnntntncanaacctccntgntnccacccntnactggnactcctgctgctntgntgggagaaacacnttttatggcatcacagatacagccctggatcatggggtcactgctgtgttaacattacaaatacacaggcttcaagcttcacacctttccacatgctgaaattaatcggagtcccatgtgtggtgagccttctggaagacacccaacaggtacagatggctgcatcatacagactttgtctgcatgtagttacacactgaactgttgggagattgatatggggacacactcctgtatctatcacatgaaaactctcctgggcctgcaaggtctggaaatgattagagtgggaatgattgcctctaggttgaactcacgaaggacctgctcctcaatgtactaaatttattgaacagccttctatgtgtgcgcgtgaggccctacttaaacaatcaacaagattcggccgttccctttgngagggtaattttaacctcctcctgacc

SEQ ID NO: 1422 - DNA, 314 bp, Homo sapiens
agacggggtttcaccatgttggccaggctggtcttgaactcttgacctcaaggaatccgtccacctcagcctccccaggtgctgggattacagtgagtgggtctccaggcttctatgacttgtgttaccaggctaaagataaagatggaatcctcgttaaatcagaccatgccagtctcaaaattgagagactgatcacaagggagaaattgttaaatgaaataagtggaagaccattgtcccaatgctgtctttctactttcagttcctgtgtaataaactacaacctaacttagtatgcaaataaagcgaga

SEQ ID NO: 1423 - DNA, 294 bp, Homo sapiens
gaaacttgcagctacttgggaggctaaggtgggaagatcgcttgagcccaggaggtcgaggctgcggtgaaccaagattgtgacactgcactccagcctgggcaacagatgctgtgtgaagatgaaggcagagatcaggctgatgcttatggaaagccagagattgccaacaaaccaccaaaagctaggagagaggcctggaagattctctctgagtcctcagaaggaaccaaccctgccaaaactgtgatcttggacttctaaaccccagaactgtgaaataataaatccaga

SEQ ID NO: 1424 - DNA, 763 bp, Homo sapiens
tgctaccttctgtatctttgtgatatcctttataataaatgaatatgtgtaattacaacatttttctctgaagtactgttgcaaggtaataaaacccaataaggagattgtggggaccctgatttctagctggttggccagagacacagctcccagcctgtgtaactagcatctgaagttgggggaaagtcttgtgctgctgagacctcaacctgagagagctgatgctgtacccaggtaaaaagtatcagaattaaattgaattagaggacagccagctggggtttgctgaataatttgctggataattgattggtgtataaggaaaaaccatcacacatctggagtcacagaagtattgagtatgtgagtgttgaaaataggaaaaacatacccttagtttttcttttcatcagaacaccttaaatataccttgtcaattttacctcattaaaattcagaaaaaataaagactaaataatattaattctcatgattcatgatcatggtatacgtaaaatccaaaaaaataaaaactaaatagtgttaattctcatgattaatgatcatgggtatatgtcttcatttatttagatctttctggaagccctgtgtataaattttaataattttgttaaagttatatctgaatattcattgggtttgttataatgcaattgtaaatgcaattacaggcttattgacatgtaaccatggttcaactcaacaagggacctttaacgggacgatggtccttaagaat

SEQ ID NO: 1425 - DNA, 241 bp, Homo sapiens
ctctcaagagtgaagtgagagaaacagaacctacttcacagggtgtttggaagattaaatgagatgaaggatgtgaagtgctttctactaagaccgatacatcataagccctcgacagtgccgggctagaggctgaccttccccactcccaactgtggtggtgccacgaggctgcgattcacaggctccggtggaaagaccagggaagaaacttatttacaaaaatgagaataaacacgga

SEQ ID NO: 1426 - DNA, 811 bp, Homo sapiens
  misc_feature (1)...(811): n = A,T,C or G
tgaacatctgggttgtcttccctgttggcaattgtgaatagtgatatgaacatttgtgcaagttttgtttaaacacctattttcccttattttggatatatacctaagtggaactgcagtgtcatatgggccatgctcaaggatgttggaattcagccttctgagaaacttttatcagagcaagctatcatcgctttgtgaagaatcattttaaagaaaaaaatctgcacaaattctactcaagatcaagacgagtatctttacaacgttgagtctaccaatccattatcaggtttacctgccatttaagtttttaaaaaatttatttgaatagatttttcagttttcagtgtgcatatcttttattagattgattcaaaactttttgtgatgctatgacaatagatttttttaaaacttccttttttatgatgcattatgacatgaatcatcattatttactatgtattcattaacccttacccaatttatgaattaggtctaatttttttttctatgtacaaaatcaaatcatctgctaagggagggcaattttatttttaccgggatgtgtgtgggtttttggtttgggcttaatgcaatgctcanggtcccagganaatactcaagaacaggcatcttgtattattccttatctcaggaattttagggaggtgccaaatatgatgtttactggatggtttttaatcagattaaggaaaatcccttctattttgttttttctctattccccctaaaccctaacctattaagtgctgatatgcatgtataaagatgaacatattttttg

SEQ ID NO: 1427 - DNA, 394 bp, Homo sapiens
ctttgacaagaagatggatcctccagctacagagtacatgtcattgttcatgaagcacttgcccaacaggaacttaaatattaattgtgaaaaaacagcatgggacttgacaaaacaaaacaccctgcgagagaaatcctgagcctggaggatctgacaaaggagcgtcttcatgtaccccacacagggtcatgttactcaccaaggcagggcactaacatcacaccaggtctttcatcagtggataatgaaaggcagttgagactttttgcagtgatttgtaagttttgaaatttacttacaaccacttaagaacatttagatccggattatcaatcagtaagtgcttatttggaagagatttgcatgtaagccatataaaaataaaatggga

SEQ ID NO: 1428 - DNA, 411 bp, Homo sapiens
caatattttatagctttccacgtagagtcttctgtctccttggttaaatttattctcagctttatcgtggtttattatattaaagacttctctggccggacatggtggctcacgcctgtaatccccgcactttgggaggccgaggcgggcagatcatttgagatcaggagttcaagacctacctggccaacatagtgaaaccctgtctctactaaaaatacaaagaaaaatgagccggctgtggtggcgcatgactataatcccagctactcggaaagctgaggcaggagaatggcttgaacacaggaagtggaggttgctgtgagctgagatcgtgagactgcactccagcctgggtgacagagtgagactctgtctaaataaataaataaataagaaaataaaatcaga

SEQ ID NO: 1429 - DNA, 802 bp, Homo sapiens
  misc_feature (1)...(802): n = A,T,C or G
catgccttctcctgagattcaacttggatttaagctcagagaggatctgcaagagcaaatgaataaaaataagatgatgcctgttcttagcgaggatacaatattacagtctcaagatgaaactgaacgaaatcaagctctgttacagactaggaaaaactgttcaatgttcattgggtcgtttcgccagtctggactttcattgaaccaccaaaatattgaagggccagaggctgaaagtcctgaagttttgccacacatagaaaagactctgcaagacccaaatccatctggattgcaaactttggctcatcaaaatatcacttcttgtgagccactaagtaataagagaaattcaaattcagtgacaaatagctctgatcaggaaactgcgtgtgtgttgaggagatcatccagactagaaaaactgaaagtaagcagagatgcaaagtactcaggtcacatgtataagatgccagaaaagattttacccaaaaatccttggctgtgaggacctaacaaataataactcttcagctcaaaatttcagaatgcaggatccggctttaatgattgatggtaaagagaagaatatgcattcagcaagggtcaagaatggaaaacagatcaggaaaatgaccatttttcaggaaaaaagaaaaatgaaggngaccaaatatctnttctagcnttaaccgganaacatttttgganaaacttanttttaaggtgctctcccaagatgctgaccttgtcgcattgataaaaaagggggaangtnancncttagttttccnggtgg

SEQ ID NO: 1430 - DNA, 583 bp, Homo sapiens
  misc_feature (1)...(583): n = A,T,C or G
ttctttgaggtcatttcttggaaggtcagtgatctacaaacatagaagagatcttcaaaatccaatctgaagatgacccagaacatatataggatgtgaaaaacagcttacaagacctatagtccttaagcactgccttcaataaacaatgccataagtagaaaagcaaagaaaatggagaatcagcacactgtaatccagcagagaaagttagtgaagcattctggactctaaaacagataacaggttataagatatgctcattattttcttgagaatgatacattcataaatcatctattttaataatttaaaatgtacacttttttcctaagtggtctataagaatctatctgtacttgcaatcccacaaacaaaaagtgggatttttaaatatcaatggcttgatcacacaaatatcatcaactgaaaaatttccaaaacacaagcggggatttttggcagaatggaatgatatggctataaaggtattgatcatattctaaatacttctaaaaattatntaaagtgtaatttcttttctgagtttaagaagctttttatatcagtttataagagataa

SEQ ID NO: 1431 - DNA, 834 bp, Homo sapiens
cttcagtgttttggccatctccctacctgatcaccctgaagcaacacccacaagcagacaagctctgcccaggtattcacagcttctcacaactttcctttttctccttctgtgaaaacaactaaacagggccttatcaaatatttgaggaaagcctctgtatgagttatgctgagcaatacattagcccccacacttagcagcttaaaacaacaagcatttctgatctcacagtttctgtgggtcagacattgagaacggcttagccaggtggttctggttcaagatctcttatgaggtgcacgtctgaagacaggaggatccacttccaagatgactcactcacatgactataggcaaagaggtcttagatccttgctggctgttggcaggaggcttcagtttctcactacatggacctctccacagggctgcttgagtgtcctcatgataggcggctggattcccccagactgagtgatctaagacagagagagcaaggaggaaactttttacaacccggtcttggatgctgcataccatcatttccagtttcttccattcattagaaacaaatcactaagtccagcccatgctctgtggaggagaattgggcttcacctcttgagaggaagagaatcgaaggatttgtgaacatatttgaaaactacccaacctgtaacaggaaaaaagaagataaaaataaataaatatctaaaaataattctaaaatgaagtagtacaagcagcaaaagagaataaaaaagtttaatgggtgtcttcagaggtatttgagaggatactatattcattaaataaaccacgatcggccag

SEQ ID NO: 1432 - DNA, 900 bp, Homo sapiens
atgtgcctgcttccccttcaccttttgccaggattgtaagtttcctgaggcctccccaaaagtcaagcagatgccagcatcatgcttcctgtgcagcctgcagaactatggagtctcacttcgtcgccaggctggagtgcagtggcgcgatctcagctcactgcaacctccgcctcctgagttcaagtggttctcccgcctcagccaccctagtagctgggactacaagcacgcatcaatacgcccagctaatttttgtatttttagtagagacggggtttcaccatgttggccaggatggtctcgatctctcgaccttgtgatccacccgccttggcctcccaaagtgctgggactacaggtgtgagccactacgcccagcagaaatacttcattttttaaactgaagaacaacaacctccaccaaggaacagcattaaaggcgacaggaagctgtaggtaggaggtccagttttcacaggccatctgaacagacttgtcttcgaacctcatatttagccccatagtggtcactcagcaccaggagcactgcaagacccaagatgtgacaacactgtccggccacttttgggataagtaagcccctgctaaaaccaacaaataaactaaaaggcttgagaatgtcggctggtataatcaaatgatgatatttgagtagcccaaatgtccagctcttaattattatctaaatatttatttatacatttatcttggcttcttctgtaccttaagattcctaatgtgttagactaggacctctgccaatggcaagggaatggaaaaaggagtcatatccaactttgctgttgtttggactagcaagaaaagtaataataataataaattagcagccaattagaaataaaccccgatcggcag

SEQ ID NO: 1433 - DNA, 768 bp, Homo sapiens
  misc_feature (1)...(768): n = A,T,C or G
cttgagctgggacattgatcttctactgcccttggcacttctggttctcaagtcttcatacttggactggaatctacatcatcaggccctccacttcccaggccttcaaactacatcaggctttcctgggtctccagcttgcacacagcagacagtggaggttctcagcccccataattgtatttggaaccttgctatgtttcccaggaagatcttgaatttctcacgtcagatgatcctcctgccttggtctgtcaaacaacacccagccttcatcaatcatttttaagttaatgtgttgatgagatgattatatagacagcaacaaaggatatgagaagaaaccaagagaaagcaagattctgaaacatgaagagaaagtagtcaaagggcttctccagtccccaccacccaactgcacaagccccacctctgtccanccttgctctcagccctgcccttgcaaaccaagggtggtaatatttgtatacacttgcttccctagatgttagaacacggctatacttcttgagtctaaaaagactctgccaattttgcagtggagtggtgagagtgggttcaagatggaatgaggttttagaagatgtccagacagtaaaaggtgacttttcctttgagctgtttggctgtgaaaggaggaaagaggacatgccagtagctgnaaaggnatatgagttcaatcaaagcagggtacgcgccccagcccctcctcctctcctactcttccctcctctgtggtgtctactt

SEQ ID NO: 1434 - DNA, 412 bp, Homo sapiens
tctcattttattagatttctatggctactgtaacaaattatcatgaacataatggtttaaaacagcataaatttagtatcttacaattctatggtttagaagtccaacagtgggtcatactggactaaaactggggatctttagagctgtgtttctggatgctttagtggagaattcattttcttgctttttccagtgtctagatgccaccacattccttggcttgtggccccttccttcttcttcaaagaagcaacaactgggtaagactttctcatatcagttcagcctcttcaaaagcatctgagatctccatcatgattaacaaatcgcatgccttctgagggattctttgaccttttatttccatttgttttcactttccccccattctttattggaaatcaacagt

SEQ ID NO: 1435 - DNA, 541 bp, Homo sapiens
actgttgatttccaactaaggatggggggaaagtgaaaacaatggaaataaaaggtcaaagaatccctcagcacttctccttgctgctgccatatgaagaaggatgtgtttgcttccccatctgccatgattgtaagtttcctgaggcctctccagccatgctgaactaatgcatgcgatttgttaatcatgatggagatctcagatgcttttgaagaggctgaactgatatgagaaagtcttaaccagttgttgcttctttgaagaagaaggaaggggccacaagccaaggaatgtggtggcatctagacactggaaaaagcaagaaaatgaattctccactaaagcatccagaaacacagctctaaagatccccagttttagtccagtatgacccatgttggacttctaaaccatagaattgtaagatactaaattcatgctgttttaaaccattatgttcatgataatttgttacagtagccatagaaatctaataaaattgagatacttctttccatttgaaaaaaaaaaaaaaaaa

SEQ ID NO: 1436 - DNA, 778 bp, Homo sapiens
atggagtctcactctgtcaccaggctagagtatagtggcacgatcttggctcactgcaacctccacctcccaggatcaagcaattctcctgcctcagcctctgcagtatctgggactacaggcacgcaccaccatgcccagaaagaatgccacgcaaagaatcagatacgcagaaaatgccatgtgaagatgaaggcagagctcggggtgatgcctctagaagccaagaatgtcaaagattgccagcaaaccaccagaagcaaggagagaggcatgggacagattctccctcccagttctcaggaaaaaacaaccctgctgacacctcgaactggacttgttgcttccagaacttgtgagaaattccccctccattttgatttcacccagagatgcagcactacctacaccaaacagaatgtgaatgtctgcaagttctacacagtatttcccaggagctaattggatcagaagaaaaggcagtgctgatcacagagtttgcctgtcggtccccaaactggatttctattttccaagttcctcatcccgaggctttcttccctttcttcttctgtcagtacccataaatcctgggcttcttccttatccacctccctcttgttcctgttctgataatcttcccagtacatttgtccatccaaaaactggctgcttgcttgctttggtcagatgactcctcttagggtctggatccttgattgacagctgggaccaggaacctctgagcaatccatccctccgatgcagactgtcctat

SEQ ID NO: 1437 - DNA, 891 bp, Homo sapiens
  misc_feature (1)...(891): n = A,T,C or G
cctggcgcatccagttttatttgtctgtttcattattcttacatcattatcatattatctcagtagctttgtgataaaaattaagatctactatgccaaatgtctattcactgtaccatttttcagaaaatctttttcaatcatctcatatttattcactcctgtagaatttaaaatcaacttatctagcctaacattaaacctcacaccctagaacaacaacatgtcgtagtaattctgactaaaattgctggaaatttatagatgaatttaggatgtattggcctctttatgataggagctttttattcatcaatgtgtgtttctccatttatttaggttttattttatgcccttaggaaaactaaacactgtgttcttcatatcattcttgtatttttttggtaaatttaataaaagattttataattcattacttttccacattttattaggtaaatccttcatgggctcttgaaatattgacagctgctaagacttctgatgcttnccctcatggtcctgaaataaggaaggccagaggacaagaagagattgggcggggcgcatttcctctatcacaggggtaaaggtggtggcagcgccacattagaatttggaatttctattaaaaggaacccctttcaaacatgattttcaaccaggcccaattgcctcttcattgaattgggggctgggaccttgtgtgttgggcagggcccccctggacctcattcttatttcccggatgggggcttcagggattaagctggacaagggggatttggatgggactggggggtggaaggggtggcctctcagccctgggaagagccaccctgttgacttgggaatccacactagccccggttaaggggggatttgaacata

SEQ ID NO: 1438 - DNA, 777 bp, Homo sapiens
ccatgtaagatgtgcctttcaccttccaccaggattgtgaggccttcccaaccacgtggaactagatccatgatgagttggagaaagatctgtcacctaggttcaaagtgaaggttcaaagtaaagagttggagaaagatctatcacacaaatggagaacaaaaaagagcatgggttgctattcttatatcgaataaaagagactttaaacgaaaggcagtgaaaaaaaaggacaaagaagggcattgtatattgataaaaggttaaattcaacaagaagacataactatcctgaattatcctaaatatatctacacccaacattggagcacccttattcacaaagcaagcacttctagacctatgaagacttagccacacaacaatagtggggactttaccacccccatcagcattagacacatcattgtgtcagaaaactaacaaagaaattttggacttaaaatcaacatttgaccaattggacctagtacacatctacagaatactccaaccactaaacacataatatacattcttctcatctatgtatgaaatatcctccaagattttgactacaggctcagcagtaaagcaagtctcaattaaatttttttaaaataaaattattccaaatatagtcttggacaacagtggaataaaaatataaatcaataccaagaaaatctctcaagaccgtacaattacattgaaattaaacaacttgctccagaatgacttttgattaaacaacaaaataaagacagatcggccagg

SEQ ID NO: 1439 - DNA, 964 bp, Homo sapiens
agttcgtgaagaatgggtattaaatctttagatgttcagtggaattcattcatgaagacatctgagactgcacttttctttagcaagtactgatctcacatcctgaagatttactgcacagttgaacagggtggaggagactcaagcgcgttctggtgggaacccatcataatgctgaaatctgagattcctgctctgttgcccaggctggagtacagtggcgtgatctcggctcattgcaacctccatctcccgggtcaagagattctcccacctcagcctcctgagtagatgggattacagccctggcaccagagagatgagaggagaaacctgacaatatccccagcctgagccatcaccagactccatcctcctgagtgcccctgaaccagcatcaccgctgaacactctggaagacctacagaaactgagagaaggttctgcaaagagctgtaaggatgcactgaatatttgccgttgcggatgaggctgctggagcattggagatccattcatcatgccaaagtgtagctcagggagtcacctccatggaaaatgtgtgctttccaaacgtggctaccaggtcgttgtggaattccatccagaagcaccttgttcttccatcgccatcattctggacaaggcagaatccacattccccatattactaactttaaagcaaaaatgttacgcctttgcctgtaattgaaattgtagtcatttgaaaatcaaatattgctaaaatttgatgttagagggatagatgatcaataattgggttgaaagaatactgtctctcattaagcaaaatgaaaatgttttcagagatttgtgaaatgttttgctatgaagacttttcactgcaaagcacccactttgtttaaagcaataaggcaacgtgctggatgaacgtaaagaagttttcaacacagaacttcacaataaaaatcgatcggccagg

SEQ ID NO: 1440 - DNA, 742 bp, Homo sapiens
tctcagaaaattaaaaaaccctaaggcataaaaagcaaactttaaaaaatcccaaaagcacagatgtctttaacaaaagcagtacatttagttgtttttaaagctaatcaactgaaatcagacactcatgtacaaagcagatgaaatgagactgcaacagtaaatgtaaattcttcagcttttctactactgacagtcgaaaatcaaaatcattaaatgttttcattaaacatttaatttaaaactactcataaggaacaactacaatattgtacagctgaagaaaaattacatgaaaaagctacaaatgtcatctttcttaagatgcaccaagaaaaacaaaagatgggaggagaggagacaaagtttctgacgggctgtacaatcatttgtatacaaccagccactaccaacagaaaaagagacacaattttgtcataaatatagatctagtgctctctccattgagtccccatttatttatttattttggttagccatcagaacacacctgctttgatctgagagactttttttttctaagtagtgatacaaagatatggtaagaccatgcaagccctaatgaattactttatgacaaagtaaggatgatgatcacagtaatatttctgtgcaaatatattgtaaagaaacttgcatacaaattacataataccttttttacaaaagaattcggaatggaacatatagtcattcgaaataaataaaccccgatcggcag

SEQ ID NO: 1441 - DNA, 285 bp, Homo sapiens
acacggggtttcgtcatgttgcccaggctgctctcatactcctgggcttaagcgatctgtctgcctggcctattcttactgctatgaagtattcagtaagaatggcatgtgcatggaacttatattggatgctactaacagattttagacaatattcaagtgactgacaatctgacattttatattgttcatgtaattggaaaatggggagaaggtagatgaagagacagagagatgaatatgaggaaatgaatatgaatatgaatgaaacagaataaatgaaga

SEQ ID NO: 1442 - DNA, 223 bp, Homo sapiens
tttttttttttttttttttactgtgcgaccttatttatatatggaatctaaagacgtagtatggctctttatccagttaaggatgtatagtctttctcaggttgatgctgttttctctggttaatcatggagcatataggaagataatgtgatggtggtagatgatggtctcaccagctgcttgtcatttgcaccaggatttagatttgttcttggtggaaac

SEQ ID NO: 1443 - DNA, 164 bp, Homo sapiens
ttgccgatcagtttttatttcactgatttttatttacataaaagtatattttctccatgtgatatatctgcagtcttgatcttgaagaagacacaatcaactcactgctgctccacagatgtaaaagaacaagttatgccagggaaatatccatgctggtccat

SEQ ID NO: 1444 - DNA, 391 bp, Homo sapiens
tttttttttttttttttaacccccagatttttcagaggtatcctgtatcaaagcaaaagaacactacagagtactttggagacacatttgaatatttacataaacctcatgctttatgcaatatgcaaacttaaaagctcactaccgaagttctctgagaattttatagctagaactatgattgtaggcaataatcataaagtagcaaatgtgtttgcgtttgtcctttcccttgagcaggagttagaacaggaattagccgagcagaagagtctccttcgctcagtagccagtcgtggagaggagattctaattcaacattcggcggcagagacctctggtgatgctgggtatgtttcaaaatgcttccattttctcttcattgtgtttc

SEQ ID NO: 1445 - DNA, 144 bp, Homo sapiens
ctctgaggttgaagagatgcgggggagcaacaaaatggaagacatctggatccttgcatcgtcacatgcaggaaagcaacacgctgccatggaatgccatggactgtgacatgagcaaacaataaatatctgttgtgttaaggc

SEQ ID NO: 1446 - DNA, 563 bp, Homo sapiens
taagtcccagtaacaaaccccatgtggcccgggtctttatgtggctattgctttgaagacaaagaatacgaaggattgagcccagcatcttgctattaaggaaaaggcctgtgtatcttacttcgccctccttgtgagttgccacttcctgttcatcctcctatcaacgtgatataaacaccaaaatagaccaaagtaattatctggggaatgtccagagggtgtttaccttcagaaaattaacagctttgagactaaattgatgacccagcaagaaggttctcatcagtggctgaccagatgccagaaacatgccattggagtgcccagccttcagaacaattttgtcttctacctgaggaagggagtgagacagagtaacatatacatagaacaacaaggatggtcgtgtgaaagaaaaatcaaaggaacagtgtaatagaaagacagtcgagctggcactccaactgctggagctgctcctgcctatcctgtcaatacccagctgtgttatgccttctcactccatcaaaacataaaataaataaaagaagatcggccag

SEQ ID NO: 1447 - DNA, 692 bp, Homo sapiens
ataaaagtgtggccaaaatgcaagaagagaataaattgccttgacgaaacaaggggcgtgttggagaggcctatgtggcaagaaactgagggtagcttcttgccaacagccagcaaggaatggaagctctcagtgcaacagcgcttatgaaactgaatcctcttaacgaccacgtcggtgagctcggaagtggatccttctccatctgagtcttcagattacatcagaaaaatcccaactggaggccattctataaaatgcatgagctgccttaatgtcaaggtcgtcaaaaaaaagccagaaagacttctatcaaaatgctaaatagaagccatgaccacagatgtcctgtcaaattgtttatctttggacaagagtttgtcatatttcactactaaatattataattgctctaaactttaaattaattttcactggttaacaaattttcattttatttccagtttgctaaaaaattttagtatgaatgactgttgaatttttatcaatttctttttgtatcaatcaacatgaacgtatgattcatcttgtatattctactaatgtggtgacttacaatgatatatttccaaataataaaccaatttaacatatttggaaagtccaatttatttgtgatatataattttacatacaatatattgctggatccaattttaaaaaaaaaaaaa

SEQ ID NO: 1448 - DNA, 1063 bp, Homo sapiens
  misc_feature (1)...(1063): n = A,T,C or G
gttactggacctcagatactaaaaggacaaagaaaagggacagatgagaacagctacgaagcgatagtgaaaacatatggtgtccatcttgtaagcataaggctccctggtattgctgccactctccctgtgctcgggaaagctggaagaagccagtaggcaatctggtgtctcgtcagaagagtgccagaaacaggtgttgctgacctaaccctttcctcctaccacagattctcttggtggccaggcgcagtggctcacgcttgtaatcccagcactttggaagatggagacgggcagattacctgaggtcaggagttcaagaccagcctggtcaacatggcaaaaccccgtctctactaaaaatgcaaaaattagccagatgtggtggtgctcacctgtagtccaagctactcaggaggctgacacagaagaattgcttgaacccgggaggcggaagtttcagtgagccgagatcgcgccactgcatgcactccagcctgggcaacagagcaagactccgnctgaaaaataaataaataaataaatanataaatcaaatgtctcaggttttttcttgattacaaaccattgataatgctatttccatgtctgatgttccaaggaaaatattatttcctctagaaagcccgactgcctctcagatttgttaggtgctttcctactgcaccctgtcagagcacaaaatggtaatcgcagtttgtctgtcccccttattagtctttaagcgaattagactttaaattctaaaagcagctatcagatctgtcttggtcctcattgtattcctaggaccttgctgtagagtgggtgctaataaatatttttgttaagtgaatgaatgtatgtatgaattgctttggctctaactggaatttgtctataccatggatcgtggatgctttgtctatggcttataatatcaattgttccattttgacttatttcattcctagaaaatttgtcctatgctttgttatttataatcacattaatgatttatttcagaatatacnntgtaataaacgatgtatgcggccag

SEQ ID NO: 1449 - DNA, 821 bp, Homo sapiens
atagctctgaaaaccatcatccctgcaaacgtagtgaaagccagcaacctagaagtcggccttggtctgtttaggctattacacaataccatagagtaaaaagatggcctatcagaaggtccatgcagatcaaagagctccaggacactcacagtacttagacaatgatgaccttcaagccactgcccttgacttagagtgggacatggagaaggaactagaggagtctggttttgaccaattccagctagacagtgctgagaatcagaacctagggcattcagagactatagacctcaatcttgattccattcaaccagcaacttcacccaaaggaaggttccagagacttcaagaagaatctgactacattacccattatacacgatctgcaccaaagagcaatcgctgcaacttttgccacgtcttaaaaatgctttgcacagccaccattttatttatttttgggattttgataggttattatgtacatacaaattgcccttcagatgctccttcttcaggaacagttgatcctcagttatatcaagagattctcaagacaatccaggcagaagatattaagaagtctttcaggatgaaatgtcattattatccttttgtggaccaaagatgttcgtgactctctgtcaagtgcttgtccctaatctaatcagcttaagccagttgagatgctggttatcttgtataaaccatgtttacctaggacggttgagaaagctctttaacttagaagaagcttgaatgtcacaggtacaatgtttcatttctattatataataaatccagaatgcggccag

SEQ ID NO: 1450 - DNA, 269 bp, Homo sapiens
tttttagatgttaatcgttttctgatagcaaaatcattatatactactcaaaagaatgtggaaagggtccaaaagtccaagggagaaagtgaagagcgtctacacaaccgcagaccagagaatgccgctgcagtgtgctgcgctgtgttctttcagtccttggcattatcatttggaactttagacagttttgaagcaaaagtggttaatgtgttgtcattgttttcatctacatttctgtaattactaataaaaaaagaatgcgtcag

SEQ ID NO: 1451 - DNA, 796 bp, Homo sapiens
atctgcctcttaccaactgtgaccttaggcacaggatcagccccaaattgagcctcattttgtccatctgtaaaatgaggatggcactagagccccgtctagggtgaatgtgaaggtcagagcctgcacaagttgctcaatcaagaagaagctgccaggcacagtggcttgtgcctgtaaccccagaactttgagaggctgagcggggtggatcacccaaagtcaggagttcaagaccagcctggccaacatggtgaaatgccgtctctactaaaaatacaaaaattcgctgggtgtggtggtgggtgcttgtaatcctagctactcaggaggctgagacaggagaatcccttgaacccataggcagaggttacagtgagccgagatcgtgccactgccctccagcctgggcaacaaagagtgaaactctgtctaaaaaaaaaaagaagaagaagaaggagaaggagaaggagaaggagcgggagaaggagaagaagaagaagaagaagaagaagcctcagtgaagtgctccagcatcttcacccccttggtcacttgctcatctcctttatgaacaaaagcggccccagatcagagccatcgagcacctgcagccagcaaggttggctggttttcattgtgtgcatttttaaggcatcttctatttatagaaaggattgtggtcttgcatttgtagcagcgatgaaagctttactttttggcaaaatgtgtgcaagttgtttagaagtgagtctgtttgaaaaaaaaaattaaataaatacatgatgcgtcaagc

SEQ ID NO: 1452 - DNA, 833 bp, Homo sapiens
agggaaagaacaataagcaaatgaagtaaaatgttggcagtagcatcatccaagactactgctgtggctatggcagcgagaatttactttagtatgtctgtagctgttggctgctttgattgcggacagcatgtacgagctctgatctaagcctcccattatggagaatcttcagaggagcacacgtctttgctggctggcatatcaacattcatgatcctggcatgtggaagaatactctgattattgcccaagacattagcattaaaattccttctaaggcatttctttattcttaagtaaatcctgttaaggaaaaataggaatgtataagcgattaataaattaaggtgagttactttctaatttgacagaattgggagcttttagcaaataaggacattgcccagagaggaaaagcagataattcagagtgctcagaagctagagttggctttttaggggaactaacttaagagtaaagagactcctttatgtctatttattgtttatgaaattgatgtagatgttactttaataattgacttacataacattattgatatttttctaccctgatttttcaagtgatctgtgttctttatattttgacttctctataatattttgcacaaatgataatcagaaatcacaatgtgctaagtctaaatgaactttagaaagagaatgacaaacaatttgattcaagattaacattataattgacattcttaaaaaaatatttcagcattactacataaggatcatgttacttttgtaatttttctattgttatgtgataaatcaaagaggtaaagaaaaataaaggatga

SEQ ID NO: 1453 - DNA, 951 bp, Homo sapiens
cagagggaaagaacaataagcaaatgaagtaaaatgttggcagtagcatcatccaagactactgctgtggctatggcagcgagaatttactttagtatgtctgtagctgttggctgctttgattgcggacagcatgtacgagaaatcaaaaggaaaagtgaagaggagagagaatactgacaagaggggagatggcaggacaaatatcctaggagtcctgctttccatgatcagctaagtatacacagctctgatctaagcctcccattatggagaatcttcagaggagcacacgtctttgctggctggcatatcaacattcatgatcctggcatgtggaagaatactctgattattgcccaagacattagcattaaaaattccttctaaggcatttctttattcttaagtaaatcctgttaaggaaaaataggaatgtataagcgattaataaattaaggtgagttactttctaatttgacagaattgggagcttttagcaaataaggacattgcccagagaggaaaagcagataattcagagtgctcagaagctagagttggctttttaggggaactaacttaagagtaaagagactcctttatgtctatttattgtttatgaaattgatgtagatgttactttaataattgacttacataacattattgatatttttctaccctgatttttcaagtgatctgtgttctttatattttgacttctctataatattttgcacaaatgataatcagaaatcacaatgtgctaagtctaaatgaactttagaaagagaatgacaaacaatttgattcaagattaacattataattgacattcttaaaaaaatatttcagcattactacataaggatcatgttacttttgtaatttttctattgttatgtgataagtcaaagaggtaaggaaaaataaaggagtatcgcaaag

SEQ ID NO: 1454 - DNA, 987 bp, Homo sapiens
  misc_feature (1)...(987): n = A,T,C or G
tgcccagcttgaaaaactttatcaccgagggttctggcatgtgtcaggcaaaattgggctctttctatagtcagcagaaacggccacggcaaagcagaatgtttagtcataaatttaaagcaagcgcagagcgttacttatttccccaggcgtaatttcacaaatgcctattcctgttcggcagtttaggggttgattttttaagctcttttcgaatttcctcatcacaatttttcagaaaacgttcacagacctactcatcctgccctaacaaggcctgtctttatttaatggtgaggatgtcacagatgcagtcctttgaggagaaatgcatgtgaccgtgcatcagaagtacgaggtggatctgtcggttggaaactagtttctaaaacgccttctgttccgcatgcgtttattctcttcttctgcacagaatttgctccgtggtgagcctggagatgtctctggatggggacagctccattcccagctacttctgcggggctggtggcgcagagatgggcgcaaaggctgaaagtcgcaagtcctgtgcttctggagttcaaatgcttcctttccagcgggtctccttgcgccatggggcagagctggggtgaatctttaggcaccaggaatatgagacccaatcctgaagctcagtgtaagttatccaggatataaacaatctgaaaatgcagtgaagataacattgggattccaagaggtatttgtatatattcctataaaaatggatctgtggtgaaatatcattgcaactccaagttatccaggactcttcactgccaaaaaaagcatatcactcngagtttcaatactgtactaaaggtattcatgtaatgaggtaaaatattttgaactctgcattagacgttgcctaccaagtatttttcccttagttgaaattttatgcttctaattttatttattttatctaatctacattgtttctgttgtaataagtcccga

SEQ ID NO: 1455 - DNA, 820 bp, Homo sapiens
  misc_feature (1)...(820): n = A,T,C or G
ctgcttgaagcaatttaatatggttcgatcccacagaggatgcataccgacagaaactcaacaagtgagagctggcttgctgagggcaccacagcacccccgccttgtagacagcctgctgcccagggctgtggcgggtctgccagaaccaggggttttcttctcatctccctcagggagcagggagctctnttttgtgataatgagcagcagtcgcagtggcggcgttcttcacagagacctggccagggcacctcttggaaaccaacccccggcgggatcaaagagggtcaaacttcaagaggatgactccaggttcacggttgaagcgggtctttgttcaaactattccacacctgaaaagaggaccctagagcaagaagcgctgtggaatagtgtaagaatttggagtcaggagtcctgggtgcaagtcttgattttggccactgagttgacctgtgcaactcactccactaaacctcattccttatgggtaaaatgaaaattatattacctactgcagaatgttgttgggatgtccctataacaaggtattacagtgttggtcctctctgagtcgcgcatagacagacggtagctttcgccctaggaaggaagtgtggaatgcctcccttggacacaatttgacctttggaagccccttagctcccaaggaactcaaacttaaagaaacgtaagtgcccttctggctaccttgaatgccttgccccgggaacccacggttattctaggggagctgactggagcctcgacctggacttttaccggcttcattgcagggagacctttaattctttat

SEQ ID NO: 1456 - DNA, 809 bp, Homo sapiens
  misc_feature (1)...(809): n = A,T,C or G
acccttgtgatcacacagcaccgtccagggtgatccagaataatggtgcatttcaagaatcttccccaagccctcgttgctggtggggacactccagttcagaccacgggtgcccaggacaagttaggatggcctgaacgttctgctctctgcgcagcctgccttgtgtgttaattcaggttcagagttcattttttcgttgacattggtaaggttaatgactgaaggacaagcatcagggaacagatttgcaataatggttatgctgattgcctcaagatgaatgtgaacaggagccccagagcaatatgttaaacagtgctgagtggctgcgcggcacttcctgatgatgggcgcgaggatttgggaaataccggagcattgtttgcagaagagtggaaggattttcttgcaggtttgcttggtgaagagtgcaggtacacagcttgtgaaccacgacacttaatggctccaacagaggtaatggggacagaggtagcgctgtcttagtatgggagcctgctagccacatgtggctattgagcctataaaatgtgccttgtcttattgagatgtgctgtaaacgtaaaacccctactagatttttgaagacttaatataaaagagccattgttggatgaatataacggacataggcttaattatctttagaattttaatttgattactactaaaatgggtttggatatattgggctaattaaattttttctttaattgaaaaaaaaaaanatcgcnagtaagcagggtcggcagttgtagtcacatatcagtcgcaaagttctcggg

SEQ ID NO: 1457 - DNA, 589 bp, Homo sapiens
agaaaaggatgagagaacatccaactgttttgagaaggatgaagaattactgagaagagtgtccataaatataaaaagataaggacaaaaaagagctcagcagtctatgaccacaaatggtgagagaacaaaagatggctttcaatcagatactccctcctcgctgatatacgttatttacatagctctgatgtttatgctatccttgggaagacaaaatgctgtggagcctgagaagttaacagctgaagtttaacagctgtggagcctgagaagtttagaatgccagcacatttggggtctcacatggtgaaggagatctgaggagctataaaagagacatcataccagactctactccagaatggaaatgtccaatgcctaatcagaagccagggagtagggtgaatgcgatagataagagatcatgatcccaacctgcagccctcattactgctcgttctatggagtagtcattttttgtttttgttgtttctttacttctctaagaaacttgcttttgcttaaaaaaaaataaaaataaaggagataagagaacatccaataaaagaaggcaaaaaaaaaaaaa

SEQ ID NO: 1458 - DNA, 209 bp, Homo sapiens
aacagaggtgcaagatgaaaaatcgtatttcatacctcctttgaagcttcacatgatcatgatgtatgtcccagagttgctctgtaaggacagaagccaacctgggagccagccagtggagagacatatgttaaatgactcagagcatatggatattactgaaaactgaagcagtaaataaataaaccataaagtgaaaaaaaaaaaaa

SEQ ID NO: 1459 - DNA, 624 bp, Homo sapiens
  misc_feature (1)...(624): n = A,T,C or G
aaaaccactttatgccgctcgacatgagacaaacagtattggccaaatcacttccccaggagactgtcatgtggagatctctcattatttccagagaaagactgttttgggccagcataacaccctactcacgtcaaactgaagatcaccttcagcgtggaggtgtgaaggataaacagtttctgaataaggtttttgggaagtcccctttcaactcattatgagagtgttctgttgcagcattcatgtgccagggctgttttcctgtttgttttttttcaacaacttcctgaaaataatcctaatattttttacctttttcgtaactccacaatacctaattcaataccctctacgtaaaactatcctttatgatcatttttcagaaacagaatggcatttagtcaaatgattagtactgtcacattgggcagattatgaatcttctccacgtttcagttccctgatttgtaaaataagaatatagggtttttattatattaaatccctatattggaaattaatgaatatgtgaaactctgaactacagatatctggcacaaagcccttgctttccatggcaaggttctcaataaacgtttactgaactcaaaaaaaaaanna

SEQ ID NO: 1460 - DNA, 145 bp, Homo sapiens
aaaatgtcaaaccagatgacctactttctcagcaggctcaaactgtttcttaagaaaatggcacagttatccaaatactacagctcagtcctttcacaggacttcttagaagaaattcattaaagccactggaaaaaaaaaaaaa

SEQ ID NO: 1461 - DNA, 314 bp, Homo sapiens
ccattagctgcagatgacttctcttaattatccactgcactccagcctgggtgacagagcgagactccgtctcaaaaagaaaaaaaaaaaaaaattagcaaatatttcccccaacctgtaggctgccttttcattttactgtttccttcgctgagtaggaactctctggtttgacgtaatcccacttatctatgtttgcttttgttgcttgctatattttattatgaaagtgctgcattattataaacggcaaataatttataagatgatataaatttgaaagagaagcttccactgtaaaaaaaaaaaaaaaa

SEQ ID NO: 1462 - DNA, 574 bp, Homo sapiens
atggatttgtccttgtcataaaggatatccatgtataaaaaagaaagaaggctttgggagctgaggtgggaggatcatttgaagccaggcattccaggccagcctgagcaacagagtgaaatctcataatcttcaaaaacagaaaaatcagctgggagtgggtagagacagggtttcaccgtgttagccaggatggtctcgatctcctgacctcgtgatccacccccctcggcctcccaaagtgctgggattacaggcgtgagccacagcccctggcctcaactgctgtttctttcaaagtgaaaatgaaaggtggtgaaactggaggcaaaaaaaaaaatgaagcaaagatgcttttattttctttactctgaagttattttgccggtagaaaaatgagggaacattgagataataaaagagcctgcagctgtgaagaaaagctctcagaattctcaaagacaagagcacatagtctgagaggttttgccactgacattgctaaatttgaaaactccaaaattctttctgcaatgtgtgaagaggactaagactaaatattataattgttaat

SEQ ID NO: 1463 - DNA, 678 bp, Homo sapiens
cggccgatctgtatttattcagttgtttaaatgattttacttggagttactcattctgttctccccataaccccatgagataggtcttgtgaatatccctaattgtacaaagaaggaaacggagatctatcagtgcacagctgagattagagctcagggctctgactacagacgccacaatgttccattttccctacctaactaggcagaggtgcacaataaacataacatttaaatataaaagcaagaatactttgggaagaactttgaaaaaccacattcttaattcattcaaaaaatatgttttgagcacgcactaggtgttgtaaactatttgaagtatggacgactgcagttaaacacatacaaaaaaatctgctttcaccaagttgacattatagcacagaatcaggtggcgagctgaagaagtaagttaggggtgctcaaaggtgatccgtttaatgaggaaagatgaagtcgacatatcaggaaacattgcaataaaggttgttggaaacgttaatttaagaaggtaacatttcagcaaaaatttgtgtctcatggacttcagaggaagactgttcctgaacgaggaaccggcaagtgcagaagtccaaaggtgggttcagggctggcatgtttgcagaagagcccagagcctgatgtcctggagatgag

SEQ ID NO: 1464 - DNA, 424 bp, Homo sapiens
tcttcgtttattatatttgaagaatgtaatgaagtaacataaatgtatttggaaggatgctttttttgctgcaagtaatttaaaatcctgctcaaattatcctactacgcagaactcaagacttggtgtctgcttcgcagtgcttctgattctcttggctctgtcctctgccatcttcatttgctggttttccgttggcttcacaaccccaaacttctcattcatgtgttgccataacatctaaaggaaaagagacatatcttcccagtgtcttctcttaaatgtgagggagcatttttcttagaagccttctgaaatcttttctcatataccattgacttggatcgggtcacagtctcattccagaaccagtctcgttaacaggggattatcaggaattgattggcttcagtttggattcttg

SEQ ID NO: 1465 - DNA, 144 bp, Homo sapiens
tcagccccaggactactgaataatcatcaaatgagatttcataaatatattaaatcgacattgtagcatatttagtgctatgttttgaaacaaaatggagttgatttgatgtaaaataacagagcccactagtattacatatta

SEQ ID NO: 1466 - DNA, 1021 bp, Homo sapiens
aattcatctggaaatgtgcagaataaatcaaaccagagagaagaaatttatcttcctgaggaaattatgagaagaaactgtacattggtgactgagttcattctcctgggactggccaatcaccgggaattacagattttcctcttcacgctgtttctcaccatttacatggtcacggtggcaggaaatcttggcatgattgccctcatccaggccaacgccccggctccacacgcccatgtactttttcctgagcaacttatcctttgtggatctgtgcttctcttccaatgtgactccaaggatgctggagattttcctttcagagaagaaaagcatttcctatcctgcccgtcttgtgcagtgttacctttttatcaccttggtccacgttgagctctacatcctggctgtgatggcctttgaccggtacatggccatctgcaaccctctgctttatggcagcagaatgtccaagagcgtgtgctctttcctcatcacagtgctttatgtgtatggagcactcactggcctgatggagactatgtggacctacaacctagccttctgtggccccagtgaaattaatcacttctactgtgtggacccaccactgattaagctggcttgttctgacacctacaacaaggaggtgtcaatgtttgttgtggctggtttcaacttcacttatcctctccttatcatcctcatttcctatctctacatatttcctgccaccctaaggatctgctctacagaaggcaggcacaaagctttttctacctagtggctcccatctgacagccgttactattttctattcagctcttttcttcatgtatctcagacgtccatcagaagagtccatggagcaggggaaaatggtagctgtattttataccactgtaatccccatgttgaatcccatgatctacagtctgaggaacaaagatgtgaaagaggcattatgcaaagaactgtacaaaagaaaattgttttctaaataaacatagatcggccg

SEQ ID NO: 1467 - DNA, 1095 bp, Homo sapiens
aggcctctgggtagtgggtacctgagtgttttttttttttaattttgtatatatttgtaattgttcataattacatgtttttgaagaaataaaaatatgatcaccactttcattatttttaatacactattgtagttctttttcctggtgattaaaatgcatgggctttctcctttctgcatattattttttttaggtatcctttctacacattttttataaaatcctagaataggaaggagatgtagagaacatttgttcaaatctactgcttgacaaaggcacttctgaattcaagttggtgttccaggtaaaaacccttgctagaattttcctttatgcttaataatctggaagatatggttttggttaactattttgtttcaactaagtcaatgtccatggataatgagttttttttttaatgcagaccataatcagttacacctaacattgatactatgctgaaaacacagttttatctgtaatgacacagtgactgcgaagaatctcagtgttatcatcatagtcttcagttattattttggttatatgtgaaagcaccaattgaaagagagctgattggcaaaatgtcagataacctggagtaaggagaatacaggaagaggtgagaattaccctttattgaggtattgtaggtgtgaaagttgtcagaatcagaatggagtcagtcatgttaaaaaaccaacacacaaacaaaaaaccctaacatatatagctggagaaggctatgaagagagggttctcatgctcgtatgcccaaaaataaaaccaccacaaaagactctgcaaaaaccacaactttgtgcaaaagccaccataaccttacacaaaaaatacttctgcaaggacatctgcccagcaactgcctgtcaacctcagacaggcgccaccttgttattgatttttgtagccaaggataattgcctcaaaacaattctgtaatagtcctcctcatttcttctttaaaaacccttgtctccctttacttcccttaatacgcatataatttactatggcacgtgtattcccattgcaatactcgattcaacaaataaacatcgatcggccaag

SEQ ID NO: 1468 - DNA, 586 bp, Homo sapiens
tgcccatgtaaactgtggatcctttcctcttcactttctgttatgatttgcccaaaaagaagaagtaaaaattgtcatggtgcaacactacagaataggtttagatgaaaaaatgaagtacaaaaagtggtctttgaacgatctgcagatgattgatggaaaagaagcagatactgacaatccattttttgatctgcacttcaagaaagtgtacagtttggaagcatatagctgtgcttctaaatatgcctttgctcgaactgtaaataagctgaatcatgcatatcttaaaaaggacttacagatcgtgaactttgattctacatacattaacgatgattccatttggtcctccaacaataaggattgtttggtccttatgagaatatgcttttacgctttcaatcttgtgtgcttgtccctatgtcccttgccactctgaagctgtgtaccacattccttcatcagtgacctatgaaaatggtttcccaagtaaatattgattgtcataattttgtttttccttcatcagtgattattataatttaaataaaaataaagtaatgctttgtgaaaaaaaaaaaaa

SEQ ID NO: 1469 - DNA, 663 bp, Homo sapiens
aaacccacaaatctattcaccagcaccacacctggctagggacgctccgagagccgggctccttgctggtctcctgaggctgaggttcccagagacatgctcagtacaacctggccgtgttccttcatctcccaagtggatgaatgaagctctcctcacaagcatgcacaacggctccacgccaaagcttcccacagaacacagaacctggctataaggctccatcaaacggcaggtttctctctctctccaactcacccactgaaagtttcagagacacgggagagcagaaccctagaacaatgaggcaatcttcaacatcacaactaacaactcctatttattaagcatttgtatgtgtaaaactgtgccatgagttttccattcattcccttgcagaatctccagcctcatttaagaggcactgagatccatggaagtcaaataaccaagaggtaacaacctcaaagttgcaagctcagatatgctgctaacttccttgtctgacactaggcagccccctcctctgtctgtaaccaaagaaattcataaagttcaggcccaaagacgaactagccatcaactaaatctaaggagtaacctattaagtacttttacagaaaccaacagaaataaattctgcttcaaagaaaaaaaaaaaaa

SEQ ID NO: 1470 - DNA, 579 bp, Homo sapiens
ctggccgatctatatttattttattattttggataatccaacaacttagttctttaactgatatcacattaccatggaccacactgggaagtctccaggatccttgtgatactacaattgaagcagtgtttgttgaataaataccatatgtatttccagcagaactgtgctagaagtgttgggaaaggaaaagaaacataaatacctgtcactcctgtcactcacattgatttcttgtgttctacagattaagggaaagttagacattgcaatttagaaattgagtatttccaatagagaggagggaattgttagggcaataattaataatttgaaggttcagtagtcaacagtttgacttgtagggtcatgttttttttcccctcaaattgatgtggattgtctgtgggcttcatcttctcaccatttcatcccatcagtgatttccccattcttcctcccaagcttcaccataaatttgatgtttgttctggcttcaattttagcagaaatcatgttgttctgatactgggtgttttcaaactgatatcttatccttcttagtgcttcaaaccacat

SEQ ID NO: 1471 - DNA, 885 bp, Homo sapiens
  misc_feature (1)...(885): n = A,T,C or G
tatttccttccaatcccatcccaggnggaggttgcagcagggtaaagtttttggacaatcttgtttactgctgcatccccagtgtcaagaaggctgcctgaacatagaaagtcttcaatatatatttgctgaaataaaagtaaaaattcagtctggtagtgatgcggacagagccatctgtgctgcgctgcaaacccacacagaggtctactggaagggaggagcccgaggcgagtccactgaatgtgggcacttcccagtggacattcagcaagctctcgaggctctgccagggtactctcccaggaaacatcaacaacacctaanagtgtggagtatgttacagatagagctacaggacctcatgttccctgctggtggatgagaagagtgacctgcaacccttctaacctgtttctgtggtatggtttggatttgtgtcctaacccagttctcatgtcaaattgtaatccacnttgttgganaaaggctctggtangagccatggaaaatgtacctgctttcccattgccttctgccntgactatttgagctctgggcaaaaatnaatangctcaacatttataaatagagnccangctcctgctggngggntatttctcaantcctggnttctctnntgactaaagaccantnaactngaaaaatgggncccactantttngaacnnatcggnattcntcnggaaaancactggttacaaaaaacctggattttttnaaacaancnaagctttnaannntacctnantnccngggnacnaantaatggncnnggcncaanttcnttngggtnnnannnccnnncgnnanccnnccnccntnnggnnnanngcnngggggngannnncccgnttnnngnant

SEQ ID NO: 1472 - DNA, 1087 bp, Homo sapiens
tcattttttatttttgaatttttgttgtttctaccgcagtttatcattactattgctaatgtcaaattgctaaatcatgaaagtagaaattatagtttagagttgacttattaaacataatagtactaaagaaaatattaacctaaatatcacagcttaaataatatcataaacatacaagatgaatatgaatatacagaataggctgggacaattgcatcttcagctgtggttatttgtgtaagcctcaatagtgaattttgttggacctccgatccattcacttctggtccccatggcagtttcagtaaaacattgtaaaggcttctgcttcattttcaaataaatcacatggtctctttcgtaaaccagttgtgtttttccagagatattacaatatgttacaaaattagtgggctccattttctcatgttgactggtccttaagtcaacagagatgccagaacttgagaaataaccctccagcaggagcctggactctatagtcatggcagaaggcaatgggaaaggcaggtacatcttccatggttcctaccaaagcctttctccaacaaggtggattacaatttgacatgagaactgggttaggacacaaatccaaaccataccacagaaacaggttagaagggttgcaggtcactcttctcatccaccagcagggaacatgaggtcctgtagctctatctgtaacatactccacactcttaggtgttgttgatgtttcctgggagagtaccctggcagagcctcgagagcttgctgaatgtccactgggaagtgcccacattcagtggactcgcctcgggctcctcccttccagtagacctctgtgtgggtctgcagcgcagcacagatggctctgtccgcatcactacctgtttacaaggccatggctgtgattatggagacaccagactgaatttttacttttatttcagcaaatatatattgaagactttctatgttcaggcagccttcttgacactggggatgcagcagtaaacaagattgtccaaaaactctaccctgctgcaacctccatttgggatgggattggaaggaaata

SEQ ID NO: 1473 - DNA, 230 bp, Homo sapiens
tcgacatttattcatatttgtttatataatactctatttgaaggggataaagtatatcccaaaaatcttccaatcagattgttggctggaaatccagttaatttccttgcaagatgtggaacttgatggcaaataaattttgcaaatcatcacgtaatagatatcttcagaaggttactcaaagttgttataatttttgttctcttatctcatgtcttcctccttgttat

SEQ ID NO: 1474 - DNA, 528 bp, Homo sapiens
tgatgaattataccagtgtgtggcaacatctggccaaatgttagaatcacctgtgggagcttcaaaaataatgcctatgcctgtgccctaatcccagacgaattgaatcaacatctatggaagatgatccctggatatcagcatttctcaaagctctccaacagattttatagagtagcttaatttaagatcccataagggaaggaaacggcaaactcatatcttttagtgcgactttcagaaacagaatgcattgcccaagtagtttgccactggttcctatgcttaaggcaaatcctaggtaacaagcatgtgaaatttacatgcctaactgctctttttgagttttctaacactctaagaagttttaaatgtatctaaatgtttctccgagaatcttaggaattctatcactgccagtacagatagtcaagtcttaggaatgtaactaatttctttcattctctggtcttccaacaatcatgttgatttataaaaaaaaaaaatgcaataaagagagatcggcag

SEQ ID NO: 1475 - DNA, 793 bp, Homo sapiens
ataagcttgtggccaggaatgctgaatgactgaacccttttcagaggccccagctgatgccagtcacagttgaaacaaacgcgaggacctgaggacagcacagacccaagctcgctcccgtgcaccagccttcctggcagtggttctaaagatgcatcttcaatgaattgaagtgagaagccacaaggtcaagaagctccttggccaacagcttgggctgcaagaagaatacaatggaagaaggatggagtctcgctctgtcaccaggctggtgtgcagtagtgcgatcttggctcattgcaacctctgcctcctgggttcaagtgattctcttgcctcagcctcccgagtagctgggactacagggaattcaaggtgatacgtcagaccctccctcactcctggtggaacgtctactctgcgagaatgcagtggagtaaacgtggcacatctcagaaggtcgctgatgaattacgaagtagaatacaagatgggtgctcttgaagcttccggtaaatgctgtgtttgccatgggctgtggccagcactagctccacccccaggaagtattcggctgcccaataacaaaggctttgctggatcacttgtgactatgaggtagtgtggctgctttttaaattgcaaggtagtggccgggcgccatggctcacgcctgtaatcccaacactttgggaggccgaggtgggcagattgcgtgaggtcaggagtttgagaccagcctggccaacatggcaaaaccttgtctctactaaaaataaaactagatcggcag

SEQ ID NO: 1476 - DNA, 885 bp, Homo sapiens
atctcttgctctgagtgaagtcagagaacacggtgttaggattctcaaacatccctgtgaaaagacccacgtggtaactgaggccgccagcaacacatagcaaaaatgtgagacctcctgccaacatccatgagtgtgagtttggaaatcaatcctctggccccagtgaagccttcagataatcacattgttgactgacaccttgaatgcaaccttacagaacatcatgaaccagataagatgcttccaaattccaaaaccacagaaaataaaaacgtttattgctttacaccactaattttggtggtaatttgttagacagcaataaataagtttgaacagctggaaatagctccaatggattgctatgttgattttctaaaactggaagaaatctatgacctacattaaatgaaattgagataccaaagatttcttggtgtaaggtaaacaaaataattcaaaacttggtaagattggactgttggaatgcttatatcaaatcaaaggttttatttgaaatgcattttaaaattatattttatgcagcttatatacttcagatacatttctttcatttttgatatttgtgaacaaagacaatttgttctttttgatctgcagactttagtactgatcaccatcaaaatatatacctactaatgtgattaaataaatgactgtattcagtctacctaacaaatagattcagtactaaaatgattcctgaatgagctgtataacagtagtaagaccaaatgacaaccacaattttgatatttttaaaacaaaaatctcatcatattactttccacttaagatatctctggatcattcattgttctagagatgaatatttttaaaataaaccaggaatgctgccag

SEQ ID NO: 1477 - DNA, 130 bp, Homo sapiens
gaaacttcagagcctgtccttgaacggctgtcagcataaacgacaaaagatcaacatttgccttaagatcacaacggaattatcaacagataaaataaatctctgtgtgcttgtgtgaaaaaaaaaaaaa

SEQ ID NO: 1478 - DNA, 519 bp, Homo sapiens
tgagacttcagttaagcatgattccaaagcttgagatgactcactgactgagaactggaatcatctaaaggctcctgcatttgtgtagattgcagctgactgggaccttagctgggacttctggttggaagtcaacaacactggctgtctgtgtggatgcttggacttcctcagagcatggcgactggattccaagaagatgggtctggctctgtcacccaggctggagtgcagtggcacaatcacagctcactccagccttgaactcctggactcaagtgatccccttgcttcagcctcacaaatagctgggactactggagtacaccacaactcccagataatttttaaaatgatcagctacgtccaaccttcaaacgtccagtaaaattaaaactgagaattcaattcaatttgatgaagtggaagtcttctccattttatcttttaagttatattatagaaataaattgatcaaaaataaactttctttatcaaatattaaaaaaaaaaaaaaaa

SEQ ID NO: 1479 - DNA, 613 bp, Homo sapiens
ggcagtgaaagaaaaaggaaaaagagaaggagggacagaaagtgaaacagagtgaagaggtcagagggactgataaaatacttgctcttggaatccagtcgccatgctctgaggaagtccaagcatccacacagacagccagtgttgttgacttccaaccagaagtcccagctaaggtcccagtcagctgcaatctacacaaatgcaggagcctttagatgattccagttctcagtcagtgagtcatctcaagctttggaatcatgcttaactgaagtctcactgtgggtcagagaaaagcgaagaccactatatgttttgagaattcttgacccacagggtaagtgagcatatttataatcatttttgttttcagccactgagcttatggtggattattacatagtaatggaaaatgaaacacttaaagtgaactcatttatcacttgaaatactgtaatttgttttcattctgtcacccttcctttatttgactacatacagtctgttctggatgaaacaaaggcagtaacttcttaagacctcagcattataacatgtcaactatatgaaaatatgcagaattataaagtgaataaacccctatgcaaaa

SEQ ID NO: 1480 - DNA, 682 bp, Homo sapiens
cctaaccacatcacacccagcatctcacttgagacaaatctgtcgtctgagcatattgaagccttgctgtgactcgactggttgaaggacttgcgaaattgcacggttctgaagagacaacccgaggaacgaggatccagcaagaaatccccccaaacttgatggaattctttctccaccactgctgcaagaggaccagatctccctctgccaacagatggggcggggtaacactggaaatatgtcacaggccaggttcagatgccacaagagtagcctcaagattttgcacataacttcggaagaaaccccagcataatagaaaggtccaacagttgaaactatgcattccaagtagaatctggttggaataaaagggtctgaaccagctttaatcatcaaaggaaaaatatgctgtttataatattgaaataaaaatagggaagatttcaattctttgggataattacccagaagtggaattgctggatcatatggagagccttctaaatattggagatgaccctttatcagatatatgtgtttcaaatattttttcccattccattggttgtcttttcactctgccaattgtttcctttgctatgcataagctttttagtttgatatagtaccatttgtttattttgtttttgttaccagaataaatcaggatcggcag

SEQ ID NO: 1481 - DNA, 703 bp, Homo sapiens
ccgtgcttccaagttatgaaggcacacataacaaggcaatgaatatggagatggagatctggagagctatatgtgtagctaaaagagatcgtgggacacagggatctgcagacaagaagaaaatcctacctctctacatgttctgcatctcaatttagcatctcctattgtctgtgggttttttttgtttttagttaattataattttgacataattaaccttccttaggttcagtgcggaaactttagaaatgtggctaaaatgaaagctaaatttagtcaatttttctagtttaagttcactaaaagccatgatctcagccatattacttaagctctctgtccctatcttccccatgaagatagtaattttatctacattaaatagtggctcctggccgggcgcagtggctcacgcctgtgatcccagcgctttgggaggtcgaggtgggcagatcacctgagatttggagttagagaccagcctgaccagcatggagaaacctcatctatacaaaaaatacaaaattagtcggcatggtggtgcatgcctgtagtccaagctactcaggaggctgaggcagaagaatcgcttgaacccgggaggtggaggttgtggtgagccgagatcgcaccattgcacaccagattgcactctagcctgcataacaagatcaaaactctgtctaaaaaaaaaaaaaaa

SEQ ID NO: 1482 - DNA, 517 bp, Homo sapiens
ctgccgatcgttctttattcatttatttagtttatcacagttacatattgctatgtaagaaccaccctagaattttagtggcttacaacattagtcattttacttgcttgaaattctgcactcttggatgggctcagctgggcggctcttctgctgttcttgcctgtggtcagtcttgtagtgagttatctggtcaggactcagctgggaaacagggatggctgggcttctctctccatgtagagtcaggaccccttgcccttcaagtggcctctctatgtggtctcttcagggtctcagcaaggtcacagggcttcttactggtggctaggatcacaaaagcacaagtggcagggtgtcgcttctgcagcattctggtctagttcagtgaagttaaggtttacagtcatgcataaagtagaaattacgtctattcagaattattcttgattactatttccttggttgactttcagattgttttgtattcttttatgtgatggtcagtcaggagtag

SEQ ID NO: 1483 - DNA, 932 bp, Homo sapiens
  misc_feature (1)...(932): n = A,T,C or G
gtatgctgcaacgactctcttaatttttcacngctacacatgacatatacttccctgctccagtgacttgggacttggtcctgtgatttcctttggttaatggactgtgatacaagaaatattaggcaaggctgcatggtttggattgtctgcttgccctcttgtgatttgccatcaaaagaacatgccttagggagatgctggcccaagaagaacatggtgacacatagagcagatgtgaacccagttctaagcctgaagccaagcccagctgaccagcaacttgaaacagggtctccctggctttcctacactcctacgatcaagaaaaatagatgctgattgttgaaagcattgagtttggagtgttttgtgactttgcagaaataactaattaaaatgtatgtatgtcaagaacaacatttaatactaggtgtcttagaatgtgactactcaatacataaaatacactggagaaggagtatggttaagtatattgaaattaggtctgagtttaaacccttgctatgcaacttactagttatgtcttagacaagttgcctgacccctctaaactcagccttctcatctccagaatgtagataaaaggaagcttatttcatagcgtattatgagggtgaaataagagtgatcttgtaaagggcctggcacagcggttggcacagaataaattgctttactgaaaaaaaacaagacatttatagttgagcattgtaattgtttgtctggttacctccaaagtgttttgaggattaaaaactatttcatttaagttagtttttagttctccattaattatggttacataactaatttacattataaacaatgggtattaaaaaaagaaaaattttattctattttcatcccaaataattatgtcttgaattaataaagaccgatgctggcag

SEQ ID NO: 1484 - DNA, 808 bp, Homo sapiens
  misc_feature (1)...(808): n = A,T,C or G
tcctgttacgaaagtgctttacaaaattttgctcacattacataccacaagaactatgagaagaagcaagcatgaaatcttcccatgtgacattgaatacttcctggcttacttcaaatggactttgagttaaaatgtcttttaaatatagacctacactattgcagaagtttagattttgttctggtgctttttatatttttcagataatttataatcaaattttaaagcaagttaagctttataaatttataaatttatttttcatgctaaaaaccatgctacttaatggtgggttaaaaccatgaaaaataaacaagaagctaaaatgcagggtcagctgaacagtaagaatgcccttgatgagcaacattcaaatattctcctctttgtgtattgtatcagaacccatatactcaaaatggaatatcagcacttagttatcaatacaattttggagaaagggcacttgaaagtcagtatatcctacatgatcacctatttactagctatgatggaaaattcaggaaacaccagattctggctttatcatcaagaagtccactgtttccctcaagatcgctcttgtatttgaaggagaccctcntttctccctgttcatgaaacaaattcagtaaactaaggctcataggaggggcttgtctctccctccttctcttaaattatggcggatgacactgtttaattagttaaaaatgctttaagtttaaaatttacatcacacaagggctatttggtttntcctaagaaataaccataaattttgtttggttttatctaaggatca

SEQ ID NO: 1485 - DNA, 764 bp, Homo sapiens
ggccggggaggggttttccttcccctaaaaaaacaaaaataggtttgtcttaaccccaaccccggggggtcccttttggccttttttcaggaattctttgggaaaaaaccaaatcaatttttccggctgatttctttggggggaaagcaaatttttcttttggggggggggattttttaaaaacaaaaacccttttttaactaaaaaaacagggtttttccccttttttttgaaaaagggggggggaaaacccccccctcctaagggcccccagttaacggtttttgttccaagaacagggaaaaggggggtttctttaaaataacaaaccgtttttggggaacccggggccttttttataaaaaaaacaaaaccgggggttcccggaatttcccatcatgcctggaaaaagggggaccttgggggatttcctgcctttaagggccccttttctccaaattgttttgaaaccaaaggggggattttccttttggggtataggggtcccgacaccccccccacgggggggatttttggattggtgctatataggggtttttttaggggcaacttgaccctccttttggctccttgtgttattttcgcggttcccccccccttaagtactgggtttttaccccagaaaaaactctttaactttttaagcctccctcccttcaaaattgttttaatctctcgaaaaatttttgggcccgaaaaaaataaacttggggagagtggggtctttataaaaaccttctacc

SEQ ID NO: 1486 - DNA, 640 bp, Homo sapiens
cctagctgcactgactctcttatctaccaccgctcacggctgctgcattttgctgggagttcactccagaccctagttgccttggtttttcccatacatggaggtatcaccagtgaagtctgcaaaactgcaaagatggcagccttgtccgacctctggaagctccattctagctgtgttgcttgatacaacaactgtactgggagagctaggatggaaaacatatccattttatggggtatgcctcctttcaccacaagctcaagactcaagaaatttgtacgtatatagcagatctaagataaatgaaaatctggtcgcagttctatttatcaaacaaaacacctatacctaattgtcaagattgtttgctaagtaaaaattaatctgtattgatgtaccagagaattggaataaggtacaaaagactaaagggcaccagaaaagatggattgcttgaactgggattggctttactcacactgcaatgtgtcttttgactgtgtgcatcctaagttgtgagtgactgggacatttggaggttatgccgtgggagtcctgctatgctgttgaccatcaccatgtatggtgttttgttgaatgccgtatatcccttttcataatgctcaataaaacggga

SEQ ID NO: 1487 - DNA, 870 bp, Homo sapiens
tctgatgcttctcctgtcaattggctggaacatgaattctaagaaatcactagatgttcacagcaggtgcaaagctatatgcagaggagatgctgctagatggtggagtcatgcaatagaaggaacctgggtccctgaattataacgtggagcagaaaccccctgcaagcttcagtggcctacaacatgaatgaaaaaatgcaagtcagtgggatgaagaaaactctgctccactcagtcatgcacggacccaagtttcttccaggttatggcactgtcctcctctaagccctagaagtgtttttctttcagccaaatgacggggaaagagagcaggggcggaagtggaggttcttcatgccaggcctggaatttggacatcacttccactcatattccattggtcagaactcagatgcacagagacacagagacttagaaattaagtttagctgtgcccgaatgcagtggggatcacagacactggtgagcactggcaactcctgacacatttgaaaagtattcaaggagtgacaaaatgaccatctctcagggactcgaactgttgctgagactcaaaatgatggcattatgagagatgaaaaagcacttaaggaacaccaagtccaatcagctccctacatgaacttgcccaaggtcacccagataaatgttggcagagctgtaactagaaccatacgttctaactcccatgccattcctttgtccacccaatcacctcctcggttagttgtcctttccaaatttaaaaaaataatgccttttttggtccctgaaaaaaaaaaaaaaaaaaaaaaaaaaaaaaaaaaaaaaaaaaaaaaaaaaaaaaaataaatctcgatgcggcag

SEQ ID NO: 1488 - DNA, 755 bp, Homo sapiens
ttaccgtgagaaaatatcttgaacttctactctgtgctccttcttcatcctgttcatctgttattagctgattttatgatatcaatgtgcacatctatacgaactggccccagtacaagagtctagtcacctaatgtttgaaaaacttaaagttctcatcatttaggtcagttcttgatgcacaatcgatactcaaaagatagatgttgattgattaaataaatgaatgcagggtggagagctgtaagaaactgggttgatgagatctcatcagatgaaggataaataaacgtgtctctcaaagccatctttattcgaagaagtttccttcgcactacaaatctaaagttctttctacgaacatcttgtatgaattgatacctgattaagcgcatctaactacgtatttgtatatgtgtctcattgcctcataaaaatccagaagtctttaaatgtgattcaaaaccaacaaaaaatcaaataaacatttaaataaattagtgagaaaatgtgatgtagcaagtaataaagagtaaaatgtgaactgcctatctaaaacaggataaaactgaaaatgtatttaagaaaataatattttaacagcttttaagggatagaaattttctgctaactagagatacttataaatttatttatttgtactcctatgatccataaaactgaaatctgcattccttaagctaaaaagagacaatagggcattaaaatgctatgactgtgcaaaaaaaaaaaaa

SEQ ID NO: 1489 - DNA, 1306 bp, Homo sapiens
  misc_feature (1)...(1306): n = A,T,C or G
attgactgacaacgatttcctcttattcttttctttgtcaggatgaagaaaagcagatcactctaagaatgacaggtttcctgggtgctgtgaagcatacctaaacagatagctgcaaagaaggatcttttctctatttcaagacatgaacactgccccatccccactcctggtattttgtaccctaaacaaaattgggtatttgcctgatataacctgaaaaaggtggtgcattatactttacatagtgatttatagtttacaggctgcttttacgatggtctcatttagttttccaaatcaagctgtgatatagtgctattattcccctttttaaaaagaggaaatgggggacatgtgagggtaagtgagtggttcaaggtcacacgactagtcagcagcagaaccaggactagaattgcaagcccagtgttcttgagggttgagccccaggaaactctgtccagggctttgccatcatggggatttgcccgaccgcccttaggcagcggagggatggagtgcagagacaactggccttcatcctttgtcccaagccctgccctctgggaagtccaggaccagagagccgcaagggtgacattgtgatccacctcagtagaatggcattaaaatgatcaagcccttgttctgaatgactttcccccagaggtgacgtcttccacgagactgactgtgacattaaaaatggattaggccgggggccgtttcccacccagaagctcaacagaaaactggcaagtgtcaaattttaaattttgcctgccagctcccaagccatttactgacctaagacatgaaggctccaccctggaaacaattcaggactaaatgttgccaactaactcagggagagagagggaaaatataaaatgcctgggcatgccagcagcaaagggctttgggtctttacctgcagttgtgggcaagtagaaaataatccatgcaggattcaagacctgccttctcatcctgaccctgtgccatgattggaatgtgcccccttcaaaattcaggcattgcaaatgtgattgcatcagaagatggggcccgtaagaggtgattaggccatgaagtcttctntcttattgacgggattaaggcgcatgtaaagaggcttcactgcagctttaggttagcttgcccttctgcctccagtcatgtgaagacggcatggatgatgcccaccagaccatctagctggtgcctagatcttgtagttcccagcctctggccctgtcacaaataaatttctgttctttataagttaaaaaaaaaaaaaaaa

SEQ ID NO: 1490 - DNA, 764 bp, Homo sapiens
  misc_feature (1)...(764): n = A,T,C or G
ctagggtaatgcaccaagcgaacaaggtcgagaactgcagttcatgaacgctggaaccagccagttgcttcagtgccagcaggagagaactccactaactcagatctgctgcgttcctccccttgcagaagtgagcactcagattctgcgttgtgccacccagattcccattcagaaatagaggacttgtagccccagctggacatgcgattatcacaaggcctccggctctcaacatccacaggaattacctgagctgacaagaactacctcacacaaagccccaccccttaccttgggtggcccatctaaagactgatcaatgtcagagtaataaggacctgcctcatttgccttgattgcaggccactctagacttccatctcaacatcagagctccatctggggtcaactgaagctaaaattaggactgcatcacagctcaacttctttctctgaccagtcctatttccttctcttttcctccacaggtggtgatcttaagaacactgtccaatcatcctcctccacaccaaaatgtctgcttctgaagaaacttgatgtcagtaacaaagaaatatatttctcttatttttatgtttcagtatataataaagaatcaatttgggggaaaaattgggaaatcattgtttaacccccccgccccacaaagtagacttcaattttaatgcaaagtgaatttcaatagtgaagctattttataacanataagaagatgaaagtttgtaataaaatttataatg

SEQ ID NO: 1491 - DNA, 415 bp, Homo sapiens
tgcacaagcgaacaaggcgagaactgcagttcatgaacgctggaaccagccagttgcttcagtgccagcaggagagaactccactcactcagatctgctgcgttcctccccttgcagaagtgagcactcaggtggtgatcttaagaacactgtccaatcatcctcctccacaccaaaatgtctgcttctgaagaaacttgatgtcagtaacaaagaaatatatttctcttatttttatgtttcagtatataataaagaatcaatttgggggaaaaattgggaaattattgtttaacccccccgccccacaaagtagacttcaattttaatgcaaagtgaatttcaatagtgaagctattttataacaaataagaagatgaaagtatgtaataaaatttataatgggcattgaaaa

SEQ ID NO: 1492 - DNA, 908 bp, Homo sapiens
tgtaggtgcaatctaaggcaaatggaaagaactcacaccatataaactgatgctggtcttcagtccaagccgaaagcaaagaactctttagatagtggagtcacactggaaaaagcacagacccttgagtgtactgcttggaggagagctaccctggagcatttgctccagattctgcatgagcaaaaaataaacttttgctgcataaagtaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaaaaaaaaaaaggccctgagggccccaacgggggaaccttgggggcccttccctttaagggggggtaaataaaaaacccccccaaaaaaaccccgggcccggggggtttcggtggggggaacgggtttaaaccaaccaaaaggggggaaacccggtttcccaaaaaaccggggaaaaccccaaaaaaaaacttgggacaaaaggcccccaaaaggcccaaaaccctaaaaagggccctttggttggctttttccaaaaggcccccccccccgggaaaaaaaaaaaaaaaatgccccccaaagaaaagggggcaaaaccccgaaggaataaaaaaaacccccgcgttccccccggaaagcccccccgggccccccttcgggccaacccctccgcaataaaagaaacccgccccccttttcttcttggaaaaaagggggcccctttcaaaaaaaacacgggggggtttaaaaaccgggggaaggcgtcgcccccaaccgggggggggaacaaaaaccccccttaaaccccaccggggcccaataaggaaaactatgttgggaaaaaaccccaaaaag

SEQ ID NO: 1493 - DNA, 832 bp, Homo sapiens
  misc_feature (1)...(832): n = A,T,C or G
atatagtggggagttcacacttgggaaaaaaagcaccagaacccctttggagttgttacttggctttngngagggannaagcttaccccttgggaagcnattttgncttccaanatttcntgncnnnngnnanccnaaaaaaaaatnaaaannnttttttgggnnnggggtttnaaanggggtcgnagaaaaaannaaaanaaagantggagnnnntntggnngnttntcncnnnnnnngntggggggggnaaaaaaaanaaaangaaaaaaangnggggctcccttttggggggcccnncntnggggtggggagngnnttcttnttnnggggcgccctttttttttnttttttgaggggggggggggggagatattttttgatggtatatcccctcatcactagaggagcacagacnagagggcagtcgagggggagattcggattggggcgcggcagcggccaggggggggtttatttacctccctcccacagagaggggggggggggtttcattctgtttttttctctcctctcaacaaagatgaggggggggggggatgctccccnngnngtanaanatatattttnttntnnaaanagnnngcctncannnnaaagcgnggttnggctnttctcatctnntnnannngtggggngngangtgtggngnnnngaatnggtctcngttnntatgnncngaatagtaatnnnntnccnnccccccnnnnagagntatnncgatntantttnaatgaanananngttntnnttnctctnangnagngngtgnntgggnnngatgnggtcgcntctntntcgatttttntat

SEQ ID NO: 1494 - DNA, 1066 bp, Homo sapiens
agcagaaatgcgtcacactggatcaaagaagcaagacccgacagcatgctgtgcccaggagacacacttggaagacccagggtggtagaaggtacaaagatggacaggttggctgaatctgtgaatgagaaacctgtagatatggagggccaaatgtattaacaagtcagatccagcaatataacacaaggattatgcattatgatcgaggaatatttatctctagaatgcaagattggttcaatattcaaaaatcagtgattttatttttaccatattaacgtaaaggagaaatctatatgatcatctaaacagatgcagaccgaaaatttcaattcgactggtacctggatctacctccgtgtcacgaagggcatggacagaaatgctgcagcttgcctctaacattatgaactaggccaagacatgcttttgatcttgacatatgcaaagattccctagaaaaggtacaaaaagcgttaacccaatattaacccaaactggtaaattggtaagttgttcttcaatcaaaattttaaaagaccatcaaagccacctttaggaaaaggagaagacaagtcacagactgtagaagcgtctgcagtcacacaaaagggtcctcaaaccctttaaggaaaatgtgtattgtgaaaaactatgcatagatgtcaaaaattgtgcaaaaataaactcatactaatttgttataacatgtctgaacaggatctggtgtgaggcactaagaaggataagacatcagtttgggccaggcgcagcggctcaagcctgtaatcccagcactttgggaggccgaggtgggtggattgcctgaagtcaggagtttgagaccagcctgggcaacatgatataaccccgtctctactaaaggtacaaaaattagctgggtgtggtggcgcgtgcctgtagtcctagctactcaggaggctgaggcaggagaagtgcttgaacctgggaggtagaggttgcagtgagccaagattgcaccactgctctccagcctaggcaacaagagtgaaactccatctcagaaaaaaaaaaaaaaaaa

SEQ ID NO: 1495 - DNA, 803 bp, Homo sapiens
tttttttttttttttctttttttttttttttttttttttttttttttttttttttttttttttttttttttttttttttttttttttttttttttttttttttttttttttttttttttggcccaaaaaatttaaatgggggacccccccccccgggtttggggccccaaaaaaccccaaaggggggaccccccccccccccgggaaaaaacacccggggacccccccccccacggggggggggccaaaaaaaaaaaaacttttttaaaaaaccccccggcaaagggggggggcccccccccggggggggcaaccccttaaaaagggggccccccccccggggggccccgcccccaaaaaacccaagggggggggcccccatgcctggcccaaaaaccccgggggggggggcccgggttccaaaaaagggggggaattggcccctttttttccgggcccccttaggggggccgttttccccccccccgggttttttttccccccgggccctttgccaaaaccgggaaaaaaaaaaaaggggccaaaaaaaggggggaaaaaaaaattttgccacaaaaaaatttcggagggggccctcttgggcaaaaaaaaacgggggattcccccccgggtaaattccccaggggcccgaaaaaacacactgtgggcggttagagcgggggctcagggccccaaacccaacccgccagggaaataccccctcttaaaaacccgaaaaaaaaagccccccgttttcccccctttttcaaatttccgcccccgaagaaacgcccccgaaaccc

SEQ ID NO: 1496 - DNA, 831 bp, Homo sapiens
  misc_feature (1)...(831): n = A,T,C or G
aaagaagtggccaaatcacagcctctactgagacaccggcaacccctccctggtgatctgagcctagcactgcgagcctccccctctggcttcctgaggcacaggcaccagctgggaagagctcccttttcaaaggtctgacctcaacgcggtggagccctgccctatctgcctgtggattttaacaacatgctctctttgctttgcccctgaccctgtgaggaagctgcttcctgtatgttctctccgtgggacgtgtatgtctcctttttgtgttttttaggcttccaatacctgcttgactagttccctatattaaattctctgtcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaannnaaaannnnnaaaaaaaaaaannnngggcccnntgggccccaggggggggactttgggggccttttcttttaggggggggaaaataaaaaaccccccccaataaccccggggccccggggtttggggtgggggaggggtttttaatttcctaaaaggggggttaacggggttcccaaaaatcaggggaataccgaagaaaaaaatttttgacaaaaggcccccaaaaggcgccaacacctaaaaagggcccgtttgtgggttttttataaaggccccccccccttgaggggatttaaaaaaattcgcccccaagtaaggggggggaaacccccaggggttttaaaaaaaccagggtttcccccgggaaaactccttgggcctttcttttttccccactttcatttag

SEQ ID NO: 1497 - DNA, 287 bp, Homo sapiens
aggaggcaccatggatgaaccaggaagccggccctcaccagacacaggacctgccggcgccttgatcttgaacttccagccatatatatgtatatcgtctatattcggcaccattcccaccagcaaggcacaagagttctaactgctctgcagcctcaccaacacgtgttattttccacgacctttattatgaccatcctagtggatttgaagttgtatttctttgtaattttgatctccattttcctaatgactaaagatgttgaacatcttcaaaaaaaaaaaaa

SEQ ID NO: 1498 - DNA, 291 bp, Homo sapiens
tttttttttttttgtatatccacatgcttttatttctttcttctttggccagtggattgtattcattataccaattaaaaagagaccatcattctttttttttttaaaaaaggaaaaatgtaataaagagaccaatttttagtcaggtgcagtagtcacatctataatcccaaagacttgggaggttgaggcggaagaatcatttcagcccaggagatcaaggctgcaatgagccatgattgcgccactgcaaaccaggctgggcaacagcgcaagcaaaatcccaaccag

SEQ ID NO: 1499 - DNA, 140 bp, Homo sapiens
ctgctgtcccagaaacaaaggctttcgaagatggcgaggagacacgtcctatttacgtcgtcactgcctagacagacgtggaagtgcgggagcagaataaacatctgtatccggagagtaaaaaaagaaaaaaaaaaaaa

SEQ ID NO: 1500 - DNA, 162 bp, Homo sapiens
cttggttccctgtgaaggagtctttggacgaggaggagtggccgccaggaagttcgcattttgcatgatattttgatgttttaccaggagaagatggtcttgtgtgatttatgtcatcaaaattatgtaaaataaaaagccagaccaggaaaaaaaaaaaaa

SEQ ID NO: 1501 - DNA, 390 bp, Homo sapiens
tttttttttttttttttctttttttttttttttttttttttttttttttttttttttttttttttttttttttttttttttttttttttttttttttttttttttgattttcaaggataaaatagataatttattcaccaattactaattggtccagaaggctattttaaaggctacaaatgaacagcgagatcaatacatacatagggtgaggtctggatgaatcatgagtacgagagcttctgtcccagaggggatacaaccatattccctggcctggaagctcactacacccagtcctctgggttgctggaggcttcatttcacggacatgattgattaaatcattggccactggtgatcaactcgcctttcagtccttcttttctc

SEQ ID NO: 1502 - DNA, 277 bp, Homo sapiens
tttttttttttttttttttttttgatcctttttattacccaatattaagttaatatgagttaaatgaatcatttctgctaactttaccaaactttgagagattctacattttaaaccctatctacaacatattttaataaatactacttaatgaatactgagatttaaatttcaaatggaaataatacacaaattattttaccttgtggtaagtatgtcaagtagcctgacagagtaaaatgagggtctttcttatgtgtccggtattttgctaggt

SEQ ID NO: 1503 - DNA, 855 bp, Homo sapiens
  misc_feature (1)...(855): n = A,T,C or G
caggacagtctggatcacttccagaccatggctgccgcctgagctgttccctctgccttggaggccaagcatggctgttcactgtcagctataacccattgtaggtgctgcttcaatcaatatttgatgaataaaggtgtgaacagagagtaaaaaaaaaaaaaaaaaaaaaaaaaaaaaaaaaaaaaaaaaaaaaaaaattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaantgggcttttttgccctaaagggggaatttttggggccttttttttttagggggggtaaataaaaaaaccccgtaaaaaaaatcctggccctggggttttggggtgggggaagggttttaattttattaaaagggggatatcgggttttccaaaaaattgggggttaacccaaaaaaaaaatttttaaaaaaaggccaaaaaaaggccaaaaccctaaaaagggcccgtttggggggtttttaaaaagggtcccccccccttgaaaagattaaaaaaaattcccccctaaataaaagggggaaaaaccccaaaggatataaaaaaaaccgggggtttcccctgaaaaagtccttgggcccttttttttcaaacccttcctttaagagaaactggtcccttttttctttagaaaaaagggggctttttaaaaaattcacccctaagtttttaaatggggggggggccgtcctctaaaattggggtgtggaaaaaaccctttttaaaacccaaccgggggctttaataggaaaataattttttgaaacaaaacccataaaaa

SEQ ID NO: 1504 - DNA, 232 bp, Homo sapiens
cagcttctcctccctctttctcttcccttctctgtctccatctctcttttctctctcttctttcctgctttccttcttttcttatttcttagttcttaggtattatgatcagttctcattgtactttcctcactgcttcaaagataccacaggaactagaacactaaggtaaaattatttcaatcattcttcaataattgcctcaatttttctgcagtgaaaaaaaaaaaaa

SEQ ID NO: 1505 - DNA, 1283 bp, Homo sapiens
actgccatcaccctcacatcgctgtcctggtgggagatctgccgtcaccctcgcattgctgtcccggtgggagatctgccgtcaccctcccgttgctgtctcagtgggagatctgccatcaccctcccgttgctgtctcagtgggagatctgccgtcaccctcccgttgctgtctcggtgggagatctgccgtcaccctcacattgctgtcctggtgggagatctgccgtcaccctcacattgctgtctcggtgggagaactgccatcaccctcacattgctgtctcggtgggagatctgccgtcatcctcacattgctgtctcggtgggagatctgccgtcaccctcacattgctgtctcggtgggagatctgccgtcatcctcacattgctgtctcggtgggagatctgccgtcatcctcacattgctgtctcggtgggagatctgccatcaccctcacatttgctgtctctgcacatggagcatcaccgctttctctccagctgcttttaagattttctatttattactagttttgagcattttataatggtagtttggtgtgcttttctttgtgtttcttgcacttatatgttattgcgttcttggatctgtggattgctatcttttatcaaatttggaactttgtcagtcaataatttttctaataatttttgtccccttctcaccatttatccattctttcaggaactccacttacacttctattaagccacatgtataatgtattgtcccacagctcactaatgctttgttcatgcttaaacttttttctctgtgtgtttgattttggatagtttctattgatatgtcttcaagtttgctaatctttttttcaataatatctaatctgccttttttcactccagtgaatttttcatcccattgtgttttttcatctctaaaagtttggtttgattgtttttcctatactttctatacctctatttaactttgcacatgcagaataacatgctaataacaattctaatgtctttgtctgctaatcgtaacagccatgtcagctctgagtcagtttcaattgattgatttttctcctttcaagagtcagactttcctgcatctttatatggctgttatttttgttgggtgccacacattgtaaaatttgctttgttggtaacatggtccacacttgaggctagaccttctgaataatctcccccattccatgaatcctgagatgttccagtttggcagataaaaacagcctcaattcctgaaaaaaaaaaaaaaaaaa

SEQ ID NO: 1506 - DNA, 608 bp, Homo sapiens
cctgatgagacacagaagcacagatagcttatgcaacttgcccaaagtcacatagctaaatggtagagctgggatttagctcatacagactgaatccagagatagaactccacactatgcctcactatactgctttgcctcaccattggttgaatgcttgaagaaagaagaaatttggaatctatgtcaagagaaaattgaaaagagcaatatttacagaaagaaagccaagggctgggcacagtggctcacatctataatcccagcactttgtggggtcaaggtgggaggattgcttgagcccaagaggtcagggctccagtgagccatgatggtgccgctgcactccagccaggacaacagagtaagatcctgtcttgaaaaataaaaaaattaaaaaaaaaggaagaaaggaagaaatgcaaatgaacaatatgtttctagatattccatgcatagttaatgtagtacaaatgttgccactgcatgaaatgtagtgacaaaaacctaggttgatttggatacctaacttaaaaggattttgctcctttgctaaaataaataaataataaataaaacaatcaaattgtaaaaaaaaaaaaaaaaaa

SEQ ID NO: 1507 - DNA, 483 bp, Homo sapiens
ctgctgtcttaagcactttggagtacgattacgtccctttgaaatgatggatggtgaagaggcaggcctgtgtgagagatcccccactcatctcccctagggaagaagtgaggaaatcctctttaaattgcccgccgcaaattcagagcttgtgagacttaatttactatatacattttccaataccatttacagttatgaccattagactaactgtagtataaagctttttgtatcctatataatactcctttctttatgtcacatacttaagaggttttattgatttccccctccaaaacatcaaaagcagaatatttttgttcattgctaaaaatgctttcacaatctacaaaataatttagctgaagcacaattgttttgcatgactttaaaatactatgccatggatgaggagtctttaccttgttttggctaaattcaataaacatcaaatgagtaaatccaaaaaaaaaaaaaaaa

SEQ ID NO: 1508 - DNA, 813 bp, Homo sapiens
ttttttttttttttcttctttttttttttttttttttttttttttttttttttttttttttttttttttttttttttttttttttttttttttttttttttttttttttcccagaaacaaaccctttttttaagcagggcaaaagggataaacccccccctcccattttgggggccccctaaaatttaacaaaaaggggaccccccaagggggttaacccgggaaccaggccccccccaagggaaaaagtttttgggaaggggctttcctttttatcaaaaaaagggaagggggaaattttcaaaacccaggggccttaaaaaaaaaatttggggggccaaaaagggaaacaaaaaaaaggccttggggaggttccccaaaaaattaaagacccccctttcccggaagaaaaaggggggggtccccaaaaaacctttttgaaataaaaaaaaaatctttttggctttgcaaccccaaaagtttcccaggtatctcccggaacaaagaaaaaaaaccaaaaacctgcccccctaaggggggccttaataccccccccatggtttttttgtcccccggaactattgctagaccttggaaaaaaaaaaagggcttttaatggtgggaaaaaaaattttgacaaaaaaaacgtttggggagggccttttggcgcaaaaaaaaacgggaaaaccccccggggaatatatccaagggcgctcgaaaaaaactatttgggggttttaaacagggtgccaaagtgtccaataaacaacaccggccctgggataatacgccctttaaaaaacccaaaaaaat

SEQ ID NO: 1509 - DNA, 839 bp, Homo sapiens
  misc_feature (1)...(839): n = A,T,C or G
caggtcctgagttcttgtcctgtgtccaggaagaacatggaaaacttgagggtgagcaaggcagagaggagtttcattaagtgacagaagagctctcaggagaccccagccttgtcctccaggtaaaggatgctcctaaattctagcagcaacctcccaactgccttcttctgcttccacttctgtgccaccaaatgttctctccaaagcacactgactactgaagattcaaccattcccttttctgcatagagagtaaagcccttcacaatcaacttgtcacctgaggtgggccatgctcccagtactaacaccattggcagttccctcttgtgtcaaatctgagctggccctatgatgtgatggtggtgttaatccatttcgcattgctataaaagagtgtctgtaactgggaaaaaaaaaaaaaaaaaaaaaaaaaaaaaaaaaaaaaaaaaaaaaaaaaaaaaaaanaaaaaaaaannnaaaaaaaaaaaaaaananangggaaaaaaaaaaaaaaaaagggccctttgggccacagggggggagcttgggggccgtttccttttggggggggtaaattaagaacccctcctaacaaaccccctgcccctgggttttgggttgggggaagggtttatactaatctaaaggcgggtatccggtttcccccaaaatccgggataaccccagaaaaaaattttgtaccaaaagcgcgccaaaaggccaaaacccctaaaagggcccgttgtgttgcgtttttacaatggcctcccccccttgaaaacattaaataattccccttaatttagaggtggaaaacccgccagtctttaaat

SEQ ID NO: 1510 - DNA, 411 bp, Homo sapiens
ttttttttttttttttttctttttagacggagttttgcactctctcccaggctggagtgcaatggtgcaatctcggctcactgcaatctccgcctcccgggttcatgcgattctcctacctcagcctcctgagtagctgggattacaggcacccgccaccacacctggctaagtttttgtatttttagtagagacggggtttcaccatgctagccaggctggtctctatctcctgaccttgtgatccgcccgcctcggcctcccaaagtgctaggattacaggtgtgagccactgcaccccggcctgaagtgagtttttcttgttgttttctgttcctggatgggatggcagaactggttttgccggatggccagtctaggtggtgtcagccgatccgccagatgcaggct

SEQ ID NO: 1511 - DNA, 778 bp, Homo sapiens
  misc_feature (1)...(778): n = A,T,C or G
tgcgacgtatgcatctcttgccagaaaataatttatcctcatgcccaaacttgtgacttgatttgaaaaccagtaaatcagaattaaaaaaaaaaaaaaaaaaaaaaaaaaaaaaaaaaaaaaaaaaaaaaaaaaaaaaaaaaaaaaaaaaaaaaaaaaaaaaaaggggcctctttgcccccccgggggggcttttgcgcccgttcctttttggggggggtttttttttgtccccccctccttgccccggggccccggcccgttcgctggggggggggggtttttctccccccaggggggggtttccgtttttccctaaacctgggggtgtcccccgcagaaattctttgcccgtagggccttggttgcgccggccccgtttttcggcgctctctctgtcgccggtttgcccgcgccctccgtcgtgnccttgcttgagtccttcgatcttacatgatggtggtgtggtcgggcgggtgtttttttgtggggtttggaggggttgagtttttgttgtcttttgtgtttgtagttgggtggtgggtgggattgtgtggtgttttgttgttattcttgtgttccgggtatttttttcttgtgcgctcctgtgtcttttccaccgtggcttccgtcgtgcccctcgcgcctttgttccccccgcttcttctgtctctttcccgttcgcgcacggcgttcgcacacgttctgtgttccgctctcgcctccttgctcgttttctccgtccgttcctctgtttgtctttgtttccattcgttgt

SEQ ID NO: 1512 - DNA, 219 bp, Homo sapiens
ctggagtacagtggcgtgatctcagctgactgcaacctctgccttccgggttcaagcgattctcctgcctcagcctccgaagtagctgggattacaggacctctttatactcctggaaattactgaggactccaaagaacttttgtttatgtgggttatttatcgatatttgctgtattagaaattaaagcagaatttttaaaatgaaaaaaaaaaaaa

SEQ ID NO: 1513 - DNA, 413 bp, Homo sapiens
caggtatctctattggagatgaacacatgttcaatacacgtggcctgcctgagtcattagcaaagtgtccaacaactctgagataaatcgtcattttatggaatgccacaggaagaagttttctttacaagttctgaagacttgtgatgaatgagtccatagtttcacctttgaaaatgtccctgggagtgtcaaccccatcacttttacttatattacactcacaatcagttcatcttgccaagaaaaataatattatcctcatgcccaaacttgtgacttgatttgaaaaccagtaaatcagaaataaaacttcccatgtgtttttttcctacctgaaaaaaaaaaaaaaaaaaaaaaaaaaaaaaaaaaaaaaaaaaaaaaaaaaaaaaaaagaaaaaaaaaaaaaaaaa

SEQ ID NO: 1514 - DNA, 268 bp, Homo sapiens
agagacaagcgcttgctatgttgtccaggctggcctcaaactcctgcattcaagcaatcctcctacctcagcctctggagtctatatttaagtttctgagtagctgccagaccgatttacaaagcggcattaccattttacattcttcccagcaatgtatgagggttttaatttctccacatcctggttacaatgtattatctactgttgcatcatgaggtttaaaaaaaaaaaagaaaaagagaaaagagaaaaaaaaaaaaaaaaa

SEQ ID NO: 1515 - DNA, 366 bp, Homo sapiens
tttttttttttttttttcatgtaggaaaaaaacacatgggaagttttatttctgatttactggttttcaaatcaagtcacaagtttgggcatgaggataatattatttttcttggcaagatgaactgattgtgagtgtaatataagtaaaagtgatggggttgacactcccagggacattttcaaaggtgaaactatggactcattcatcacaagtcttcagaacttgtaaagaaaacttcttcctgtggcattccataaaatgacgatttatctttctccttttcacttgggaatgaggaaataatcaataatcaatttcccattatttgcttattgggtgctggccaacataaacagcactgtg

SEQ ID NO: 1516 - DNA, 487 bp, Homo sapiens
cagatgacacagtagctgtttatgttggccagcacccaataagcaaataatgggaaattgattattgattatttcctcattcccaagtgaaaaggagaaaggtatctctattggagatgaacacatgttcaatacacgtggcctgcctgagtcattagcaaagtgtccaacaactctgaggcgtatcctcaaatgaagccttgtctctgtgaaattcctgataaatcgtcattttatggaatgccacaggaagaagttttctttacaagttctgaagacttgtgatgaatgagtccatagtttcacctttgaaaatgtccctgggagtgtcaaccccatcacttttacttatattacactcacaatcagttcatcttgccaagaaaaataatattatcctcatgcccaaacttgtgacttgatttgaaaaccagtaaatcagaaataaaacttcccatgtgtttttttcctaagaaaaaaaaaaaaa

SEQ ID NO: 1517 - DNA, 264 bp, Homo sapiens
tgaggccaacgaggccatttttttttttttttttttttaatgatgacaatcttctcaatttatttttgtcttagaaaatatagttatttttaaagtgtgatttttattaccatggaatggagttttatattattttaaatgaattaataaatacattttaaaaattctgctttaatttctaatacagcaaatatcgataaataacccacataaacaaaagttctttggagtcctcagtaatttccgggagtataaagaggtccc

SEQ ID NO: 1518 - DNA, 469 bp, Homo sapiens
  misc_feature (1)...(469): n = A,T,C or G
caggacctctttatactcctggaaattactgaggactccaaagaacttttgtttatgtgggttatttatcgatatttgctgtattagaaattaaagcagaatttttaaaatgtattgattaattcatttaaaataatataaaactccattccatggtaataaaaatcacactttaaaaataactatattttctaagacaaaaataaattgagaagattgtcntcaagcaaaaacaaagaaactagataagaaaaccaaaaaataaaaaaaaaaaactaacaaagagaaaaaaaactacatgaaaaaaaaaaaaaaaaaaaaaaggaaaaaaaaaaagaaaaaagggcccctttggccccaaggggggggccttggggccccttcccttttggggggggtaaataaagaaccccgcccaatgaacccctggccccggggtttgggggggggggaagggttttcacctctc

SEQ ID NO: 1519 - DNA, 385 bp, Homo sapiens
tttttttttttttttttctttttttttttttttttttttttttcaaaaacatcatatttcttttctttattcaaaggacattgaaaattgcaaatattgtagacactacacacccagaaattggaaacagataaaattgactggcatattgatgcaagccaggcaggactggaaattttcttcctctttgtaggcacagaagcatatacacaagtgtagattttgccagagcttctgatttatccattcctgatttttattccattattcttagatgtgcacgagatgagcccttgttgcctgccactgctctggctttctgcctgggtgctctcctgctgcaggggagggaggtagagtcaagcaggatggtgatctcctggag

SEQ ID NO: 1520 - DNA, 1280 bp, Homo sapiens
tttttttttttttttttctttgacagtaaatgtttttaatatttttgctccatttacaatgtttggtttttactaaaatgtgactgtatatcaaagaatctcacagctggcaaggggtttaacaacagatcagactaatgctttcaatttacaaagctgatgcaacctgtgaagtgacttggccaaggtcaccagttagtgaaaaggcttagattaagatgcagagcatctgactctttcctggatagatgcaaggatgacatacctggattcaaatggatcctgcttctccagaggtctcactcttttcttcgtcactgccaatttagtcaagtccacatactttgtctctccattgctatatgtgaactcaagaacactattccattccccttgcactctgcataccacagtgttggtgatgttgtgctttacttcagctgtaacccgatgcagtttgccaccataaaatggcttggtatgaaaagtgatgctggctgaatatccagtttttgcacagttgacactgactttgccacccagttctacccaaggaacagtcaaaattgacccgtgcctttgcacagggtatgagaaaatgtgttctcttctccatgctccacagaactaaggataccttctccaaccattgtcacgcctattgacatgcctaagaacttgctcttagtccagacatgcgcatttacacacatcttcctctctgtacattctgcataaatccctgaaatggaggatgatgagaaacctgctcagcaacaaatctggactgtgtaacagtctgatcccacctgggtcaaagactcccccgataaaggagcatgatttgtgactccccgggtggaagaactgctaaaaacactggatgctacctcgctttttggcatcttccaggaacagtgaaatgtttctccaatgataggattgtatggttttttagcaatggctcccttacggccttcatgaaatgaggtaaggtagtactcaacaaagcgaatcattctgtcctcagctgtggctccattagtgatggctataaataggtctggatgagacataaagtctgcatacatttccagcaaggaacgcttctctaggataaatgtaggaagcaccactcttgttaaatccatgcccagcttaagctgtgacaagagatgtaggatgacactacgttgttcttctacagctcccaggtcatcctctttgtggccacatgtatcctctatctcatcatctgcatttatttcttcaggctccag

SEQ ID NO: 1521 - DNA, 107 bp, Homo sapiens
ttttttttttttttttttggatttctgatgctactatctttattgtatgcagagaagtttctgttcaagcttctgcagtagtgtgccaaggacgttttctttattgt

SEQ ID NO: 1522 - DNA, 128 bp, Homo sapiens
ttttttttttttttttgccagggcacgtggttatttttattcgtgttcagttccgacttgttaacaccgtaatcctttccttatgtcgctgccttcaccaccctgagagcacaggctagattgaggct

SEQ ID NO: 1523 - DNA, 320 bp, Homo sapiens
ttttttttttttttttaaatacgtaattagttaaagtatttattagtaccattcaaaccataataagagtacatcagattagatgcttgggagagtggcggttttttgttttgtttttaatacttctgggttcatggtacctaatcataatttacttaaaaaggatatttgaggcagggatagtttcaaaagcagaaattatttttgtttaaaaatcacagtattttttttgtgtgtggtaactgctttgtgtccattacttgtatcccgacttctcttgctggaatgcccagaatgtctttcttaaagtcccaaatgac

SEQ ID NO: 1524 - DNA, 187 bp, Homo sapiens
gcctatctggccgtttaaacagatgtgtataagagacagtcttaaggtttgagagatctagcatattgttaattgaagctagatttcaattacactgagaaacttatctatttaaaaataaaaactctcctaaaaaaaaaatccacattctttttaacaacgtggcaaatttgcaaaaaaaaaaaaa

SEQ ID NO: 1525 - DNA, 349 bp, Homo sapiens
gtcttgctctgctgtcatccaggctggagagcgatggcatgatcacagctcactgcggccttgaccacctcgggctcagtgcctgctccctctcctgcttcctccatgatgtatttcctgaagcctccccaggagccaagccagcttcatgcttcctgtacagcctacagaacataaccctggaacagacatgctgaagataatagcataaagaaaaagaaggatcctgaatcccagaacctctacttgaacaaagaaacccatgagagctgcccagctagcaacatccacgttggaccaagcattagtgataaataaagttttatttgctaaaccaaaaaaaaaaaaa

SEQ ID NO: 1526 - DNA, 242 bp, Homo sapiens
tttttttttttttttgaagaataaactgaaaaatctgtcatcatattaaagacagacatggaaaaccttatggaaataaatgatttgctttctaatttttaaaacacaaggtgaattatactatagaagcactaataaataatgaaggctaggtatttaacatttgctttttaaaagactggaaacaagaaatatgaagcagcactgcacacaaatatttacttcatattcaaaattataaa

SEQ ID NO: 1527 - DNA, 203 bp, Homo sapiens
tttttttttttttgcaaatactcacagcaactttattcattaaagtcccgaactggaaatattccaaatgccatcaatgggtaaacagataaatgaataatggtatatttatataatggattactactctgaattgcggggaatgctttctgagatataaagctgacaatcagacatctgagtgtgactggaaaatagcagtc

SEQ ID NO: 1528 - DNA, 371 bp, Homo sapiens
gcctatctggccgtttaaacagatgtgtataagagacaggttgatgtatgagcccatctctccttcttgtcctcccctctaccttcagtaattgggtttataatagaaacactaactcaacgttaactaaagtgatactgtcaagtgatatgataagacgcctgggtcatgttttatgataatggattctctttgggcttcctttccaagatcatgagatggtccctcaccccttaaagggcaaagagaaagtgtgggagccacagcagaaggaaatttgtggcaagttatgtctccattgtaacttcatccccggcatagtaaaacaaacaaacacccaaacaatcttttgttaaaaaaaaaaaaaaaaa

SEQ ID NO: 1529 - DNA, 161 bp, Homo sapiens
ttttttttttttttttttggttttgaaaactattttggattttgttatattttaaaacataatttgatgtctaaatccacaaaacttaaaagccaaggttattagagccactggatgcaactccccatcgatggagctgaaaccttccagccggagacgtg

SEQ ID NO: 1530 - DNA, 370 bp, Homo sapiens
ctgaatgaagcagaaagatgttctgagatttttcaagcccaggtctgaagaggactggtagagtctactttctcctctttgaagccacgttccatgtaagaagcctgactaccctaagaccaccatgttgtgaggaagcccaaagccaaccatgaggtgtaagaggtcacatggaggagcattgaggcaggcacaagacacttaagtacaaccttcttggacctccccatgcagtccagctaccacataaatgcagccacacaagtgacgccagcagacaccacattgaagagtctcccagctgagcctagtcaacctacagaattgtgaaaaataaaaaatcattgttgttttcaaaaaaaaaaaaaaa

SEQ ID NO: 1531 - DNA, 359 bp, Homo sapiens
tttttttttttttttttaatcattaatattcatcatttattgttaatgtgagtataactctttaatatgaattatcattattatcggtattgattttaagaattatatgatcagttattaatattgacaattatcagtatcaattaataattgagattattaattgtggtaagtaacattgcgccattccaccccttcctcggcagctcgtttacgacccaaaacggggatccaaatgcccctgagagagcagcggcatactgggagagaggaggatgctcacgtggtggagaggcgtgtttttgtgtaaaagcgcttcacctctgccgaccttctcaaccgggaaaacaatacgccgt

SEQ ID NO: 1532 - DNA, 460 bp, Homo sapiens
catgggttgagtagaggcaaaaggactgtacagacggtagccatttgctgatattccctgaatgacgaattgtggaatgaattagagctgctgcacattctgaagatttcaaaagtagctgtgcttcagttaagtgcttattcaattttcagatgaagtcatcaaattaattttaaaactcacaaaataaatatgtgctttaaaatatatgttttttcctaagaaagtaaaaattatctgtttaggttgtgagaatatttaatagtgtcaaaaataaaagagagagaaaaggcttcaacttttagttaaatacccaacagcaaactatctaatcaatagggtatttctaggcattttcctggtgaattgactacagttctacatatgcaaaccccatggctttaatttgtctttaattaataaattctttgacaatttggtctcttgaaaaaaaaaaaaa

SEQ ID NO: 1533 - DNA, 172 bp, Homo sapiens
tttttttttttttctttgtcggtgcttctttattctcatttctgaacgatttggtttgagttgttgttgccgtgtttttctaaaatggaaatatgcagcggtcgtgggttcagccaggatttccgagtttgctcgtgttgactgggccttgccgggtgctggaggggaaggg

SEQ ID NO: 1534 - DNA, 346 bp, Homo sapiens
tttttttttttttgtaggtacacgttagatgtcttttttatttttatcattacaacagactttatgactgcaataaaaatgtgagtagattcttcaaagataaacataccatcgtggctgcccagaatccacttatttatgtgaggtgctctgtagtgctgctcaatgaaggcaagaagcctgaacttggtaattgagaatgaatgtcaagtagtgtcaagacgcctcaattcatcaggctgataactccttctgtgattgcatttccatttttacagctgcttcagtggccaagtttgccagtcttgtttgggaaagtatatatattacagaactcttggcactg

SEQ ID NO: 1535 - DNA, 202 bp, Homo sapiens
tctaggctgctccagaatggacccgtgtaaaggaaacgcaccgctgcacactgctggctcttggcctagtagtcccagccactatctgcaactctcaacatctcagcacatggcttcattgttcttgcacctcaaagccttctctggagaaggacacagatttctggagaaataaataaacgggatcccaaaaaaaaaaaaa

SEQ ID NO: 1536 - DNA, 192 bp, Homo sapiens
ctgactggacaaggcatgcagcctgtgaccacagaagtcaatcatctcatcctctgctggttgctgagaaacaccccctgagcaaatgctgagcctattgctgggtccagggccggggacgctgcgaggagagctgactaataaaccttccccagcctctaacagggggaccttacatcaaaaaaaaaaaaa

SEQ ID NO: 1537 - DNA, 284 bp, Homo sapiens
cctggtaacatcgaaaaagtgtttgttgacaacttgcagcatagagacagagaagacacacgggcatatgctttggactacaaaatccctaaagtgtccttccaaatgttaaatgaggattctataaaagaagcaacaatgttgattatttaattatagtattgaaagaagtgctatagtgagtcaacttggctcacaatacaaggcacttgaagactagagcatgctcttgggttcttaataaactgtgatctgtttgtacctccaggtgaaaaaaaaaaaaa

SEQ ID NO: 1538 - DNA, 612 bp, Homo sapiens
ctgattcacggccatatggagatgttcatcctgagccacctggatttccagcaaggaaaacaaaaccaacaaacaaaacaggacatgacaatgaagatatcaaagaactgttatttacttttgctacaagaagtacagagaggattcatgattcttgaactatattttccaaaataagtgacagtcattcactttcttgacaaatatctatggagtactaacaataggccggacactatgatcgtcttttacaatatattctccctaaagaagattccaagtgaaaatatattgagagtgctcatcatacttgaaacattcataataggcgcgtcggccacttaagggctccaagaaatcttaaagaaacttgtttaatccaacagtgaccagatacatttaattatgtcattttcttttcctttcctttccttttttttttttttttttgacagagtttctctcttactctcaggctggagtgaagcggcgcaatctcaggtaattgcaacccgggaggcagaagttgcggtgagctgagatcgcgccactgcactccacgcctgccagcctggcgacagagcaagactctgtctcaaaaaaaaaaaaaaa

SEQ ID NO: 1539 - DNA, 555 bp, Homo sapiens
  misc_feature (1)...(555): n = A,T,C or G
tttttttttttttttttcagaggacaatgagtatactttattcatctttagagagccacagcccagcacagtgactcacacagtaggcattgttaagtgtttgttgaatgaacgaacatacaaaaagtggttgaaaaagggcacgacccagaatgctaccccagaattcttcatgggggtccatccctatgtgtccattttggggaagcatggccgccttgctcggaagaggtgggtcaaaccccggcggagaacggtagtggcctcagcaggaagctgaggcagtgcgtgacagacatcagcagggaggtctcaggcagaatgtccccaccctggatggctgttgtgaccctctcctgacagccctgcttgcgggctgcttagcccacctgagggggctgggacaatcttcatagttctccctgctgcaagaaacaggttcctcctgaggaagcagcaggtgcatgggcggagtccaggtgtcttcctcctctctcaaaatgtggtagtacgggcagtgtctcagcaggaacngcatgagataattgtctatga

SEQ ID NO: 1540 - DNA, 448 bp, Homo sapiens
gaccaataggcgtggagtgtgattgtgtggagaacagtgctggcactgggcatgtgcggcacagagcaggtgctcagtaaacatcagcaggaggcatggtgaagcgaaggacacaaaaaccctcaccgtgcatcccctgcagactgaccagaaactctctgtgatccgtggtctctctcctatcaggaaggaactcagcgaggactgggtggtttggaagcctggaagacagcccttgctggaacccagcccggctggcagctggcctcatctcagacgtcccgcctcagacccggagaactaggtgtctgctgctgaagtcccagccctgctattccatcatggcagcctcagctaagacagcaatgatctaatattcatccacgttctaatttccccaggattccaaattatatcttttagatagaattaaaaaaaaaaaaaaaaa

SEQ ID NO: 1541 - DNA, 861 bp, Homo sapiens
  misc_feature (1)...(861): n = A,T,C or G
ttttttttttttttttttagcatacctgccggatatttttatttgtattaatattaattgcatctccaactccgagcatatccatcattaaaaacattttgagattatagaatgcctgtgataacaactgaaacatctgcacgatgtgaatagttagtttcttttcagaggaaatgaaatagacacgctgaatgaaaaggagagtgatataaattaaaaaacataccatgaatttaattaattacgcccatcattgtggataaagttactgaataataaataacataatcttctggtatcccactcaaataatttcattcctttttaatacttcttgtaatttcggtaactgacatacagcatcagcaatcgcactgatattcgtggcattatcctgaaaccattcatgcccaggcccccatgtgcgcatagtgccaaagataacagtccaccagcgttagttggtcaccaaacgcataaggttcagcagggagctgcgaattcaacccaattttaaggcgatttttcgatattcaattaacatttcttctttaactgttcaggtgcgtcaggagccccntctctcagggtaatcggcgaaagtgaatgttgaatagacattagcaaccagccagaccatagccggtgaaacagttgacgttcggcccgcccaaccggtgcgccaaggtccggcgacaattcaaaaccatcaatgccatcgccgtgtctccggcataatcttgccttttccaatgcccgtggtagaacctgaccacacggttaagggtttcaatacttggggaagctcttggggtaaaaccatgcattaaaaattgcgccttattgaggctttactcggcc

SEQ ID NO: 1542 - DNA, 300 bp, Homo sapiens
tttttttttttttttttgacatgtaggaaaaccgttttacttcgattatttcacatcaagttcgcaacttgcaaaattaagtggaggataggcagttttcttaataaactaatacagaaaacaacattggcttaatttcagagtaatctttttaaatacattatttttatagttaactggaaccacttttccaatttgtatttattcagaggaaaaatttttaaaagtcaccttggactgaagaccagcatcagtttatatggtgtgagttctttccatttgccttagattgcacctaca

SEQ ID NO: 1543 - DNA, 377 bp, Homo sapiens
aggcacagatgtgatcacggtggtccttggagggagccaggagaatctgaataagagaagaacacatgaagatggaagcagagcctctaaagaagaagcagttgtttgtatgtacaccattcacaccgtgggaggctggtcttcagtggattttgtcttggcacctgaagcaggctgcacttggaagctcacgtctgtaatcccagcaatttgggaggctgaagaagaaggattacttgagcccaggaggttgaggctgcagtgacccatgatggtgacactacactttagcctgagtgaccgagcaagacccagtctcaaaaagaaacaaaaatacatatgatagacttaaataataaatatggatgcgtcctgac

SEQ ID NO: 1544 - DNA, 303 bp, Homo sapiens
tttttttttttttgagtttcaaacaacagacatttattatttcatattttctctggggtcagtaacctgagaattgctcagctagttggttttggctcacttgttcatgaggctacaatcaaggagtgagctgggttgtggtcataggagatttgattgctgtagaatgtcttgcaagtccacacatttggctgcttgcaggaggcttccatctttcttcacatgagccacctcatgggactgctcatagttatggctttctcattgcactccagcctgggcaacaagagcgaaactctgtct

SEQ ID NO: 1545 - DNA, 279 bp, Homo sapiens
actcagccactgctctggaagactgaccgtgctttaacaacctcaccaaggctgccagctcttctgacttactccaaaacgaagaggaggtgccccagcaacattccttgagtttgagaatcttcatttctaaaatgttgagttctgcaccccgcaccctgacttcagttataactccggggtcacaattctttgccacttccacaacctctgagaacctctggtgccattcctgaaagcctttcattctttttcaattaaaaaatatataattttaaa

SEQ ID NO: 1546 - DNA, 330 bp, Homo sapiens
cccagaggctgaggagaatgcaatggttttgggaacccacatgaagcacttcttccctatgcccacctcaggaggctgctgctcacaccctggccactctggtttaagatggttcaaagggcctcaggcttatagctggaaaaaacttgctttgagtcccagataagactttcaattttgtatttgtgaattgatgctggaacaagagcttctctttgccttctgccatgagtagaaaccttctgagctcctcaccagaagtagatgctggcaccatgcttcttgtacaatctgcagaactgcgagccaaataaaccccgatgctggccg

SEQ ID NO: 1547 - DNA, 198 bp, Homo sapiens
gctctttatttttctcttctcctctttcttcttctcctcctccactatacctaaatctgctaagaggctggcggaacttgtaagaacgccatttgtagttctaacaaaatgctgggtaattgtctggggctaggtcactgaagagccatctggaaggtcagcttcactggatatctcccaggaactggtcttcacaca

SEQ ID NO: 1548 - DNA, 222 bp, Homo sapiens
catgttgcccaggctggtcctgaactcctgggctcaagtcttcctcctgccttggccttccaaagtgctgggattacagggcgtaaccaccacattcaggcgccggccatctagttattattcatccttataactggaggggggggaaaatatatttgggcccattttacagaatagaaaccccaaacttctgaaatgataaacaatcaccttccatcatgc

SEQ ID NO: 1549 - DNA, 227 bp, Homo sapiens
ccctcctgcccccatcctgtgcctatgaagaccccagactcatttggtagaggggaagatggccagacttcagtgagatggctggacttcagggaagagatggctggactatggaagagacaacctgactatgggggaaaatgaccagcccgtacagtctcctctgcagcttgcctctccactgagagccattttcattgcttaataaaattatctgcccttcaaaa

SEQ ID NO: 1550 - DNA, 172 bp, Homo sapiens
agagttctcccagtctcctggatcacactggtctgaaagctgtttggtagacaaccttcgagtctttctgccttcatactgatatattgtccatgagatcttgtcctgtgaagtctttcctggcacatagtaagtgctcaataattgttgcataaaggtgaataaaccaaga

SEQ ID NO: 1551 - DNA, 411 bp, Homo sapiens
tttttttttttttccgtgtccagcgctttatttattgaacaggaaatccattctataaagacacagagagcctgcagtgcagacacaggaggtacttttgttctgctcttctttttatcctctctcccagtgtgtttttcgccttcatgcttccacagactttggcatacatcccaatgttgattctgtttcctcaatcatcatgtctacttgcactcatgttggaagcattgatcaaggaatgaaattgtgctttacaagatcagtcttatttcaccaatagcagaaatttcagaggaagttccatattccaagactccactggcattatcagagaccttcaatgaagaaagatctttcctggcttctgatactgccaagttcttaacatacccgaagttgtcccagaac

SEQ ID NO: 1552 - DNA, 183 bp, Homo sapiens
tggatctcccctgtacagtgagctgtcaccagaaactaacaaggaggatgtgactcccagcaatctgagctacagtgaatagtgcgtgacctaccagtcttgacatgccaacttggactatcatttctagaatggttgaaaaataaattttaatgtagaaagaaaaaacccgatcggccggag

SEQ ID NO: 1553 - DNA, 470 bp, Homo sapiens
acttctttctttaccagcggggactcccctgtactatgacctagattgtatatatcatctttctgtttgattagtgtccactgtcagtcttttatcgtagtgggcattgtaaaataaataaaaaaatactaaatcatggttgcacattacaaaacatgaactgagaataaagaacaatacatctacacactggacatttcattaagtgctaaattataaggtacagtcataagtgttgaccacattgggagaagaatataggcaattcctagcagatcctgggaggcgcacctcttcttagagttggggggagagacatgctttaattaggcgtgtgtatccagctcacctagcaaacaatgagaacctctagggattgcttatctttgattcccaacacctttctgggatgggagacataaaagataatcaataaagtcagatgctgccccgagtccgcgtacgacgcg

SEQ ID NO: 1554 - DNA, 171 bp, Homo sapiens
gcgcgatcagggtttatttggggttgggcttctggtgaggcctcaggaagcttacagtcatggcagaaggcaaggcggtccaagcaagtggatttcacaaatctactcttctctttcagcagctgttcttaataatctccagacattttctgcactccttcagtgttttgt

SEQ ID NO: 1555 - DNA, 167 bp, Homo sapiens
  misc_feature (1)...(167): n = A,T,C or G
cctatcgttatttattttgacttttctagagaaagcaaaactgtagaagacagcagatcagtgactgccaggggctaaagacggaggcaagggttgatncaaccaggcaggaggttgntttntgggctgatggaaatgttcttatgctggattgtggtaatggttca

SEQ ID NO: 1556 - DNA, 424 bp, Homo sapiens
acattcagtgatgcctgctgttagccacgcattgttgcagacactgagggtacaaaggtgttttaaaaattgcaggagagatgacctaaatgcagtaactaaattatatccatcagatcatggaggccacaaaaggggcaatggccaattctataggagcagttaaaaaagaagagtgaattctctagaatcaagaggacccaagagacattatttcagcaggaaaccaaagagataagataattgacctggaagaagaggattataggagtcagatggacgagtcttcctccttctgaattcttagcggcaaaatctcagaacattcataatctccagtaaagaaagctgcaactagagaaatctagtgtgtctggtgcggctgagaagctcaagatcaagcccccatacgagtgggagagat

SEQ ID NO: 1557 - DNA, 379 bp, Homo sapiens
agtctcctgttgcctaggctggtgtgcagtggcaccatctcggctcactgcaacctttgcctcccaggatgaaggctgggcaagggccacagttgcacagatacccaaatctggaaggcagggggagatctccccacagaagagaaggcaatgtgatggcagaagctgcaattggtgtgatgagcgttgaagacggaggaagggagcgcacaccaaggaatgcaggaggcctctagaagctgaaaaagtcaaagaaacagattccccctcagagtgtctggaaggaaccagcccgacccacacctcgactctggcccactgagaccaatttcagacttctgacctccagatatttaagataataatccagatcggccga

SEQ ID NO: 1558 - DNA, 334 bp, Homo sapiens
atggtcttgatctcccagcctcaagcaatcctccctgcttcactttccaaagtgctggagttacaggttgtggaaagtaccagttggggggatggaggcaaattgcatactctctttggagtcacatatgtcttgaatacaaatgatggagttggtataaatcaggattcattaacccagatggacagagaaggtaggaacataacccaattgaataaaatgggctgaatataaattaatagggagaggaatggaatttaggaatgagagagtatgtaactactgtacaataattcaggggtggggggatttgaaaataaataaggggtggtgc

SEQ ID NO: 1559 - DNA, 812 bp, Homo sapiens
aatgccgctgaagaatgctacaagagaaagcaatctatctgccagcatcccaggaacctgttctgtgccagataccctcgcgagcaaatattgatatattaaccgcagctcagacactaatctgacctatccttcaagactcagctcgatgctacctgttccaagaagatttcactattccctttgctttggggatcctttctccctcaaaatagaatagaaatagaattaggtctaccccgacatgacccccaaatcatggaactatacacaaagacatactgactacgacatcaccccacaaataaacaaaaacaaaaggaaacttaaagcaaatccactgcaacaaagctgattttaggatcttaattctgcctctttccttgccacctccccatctttgaaaaggttttgtccaggcctgagacctcagagactgtaagatttttttttgttgtttgttttttttttttgttttttgataaagtcaggtcaggctgggtgtggtggctcatgcctgtaatcccagtactttgggaggccaaggtgggcagatcacgagttcaggagatcgagaccatcctggctaacacggtgaaaccctgtgtctactaaaaatacaaaaaattagccaggcgtggggggcgggtgcctgtagtcccagctactctggaggctgaggcagggtaatggcttgaacccggaaggcggagctttgcataagccgagatcgcgccattgccctcagcctgggggggcagaggagactttgtctaaaaaaagaaaaaaaaaagttacatctagcccaagcg

SEQ ID NO: 1560 - DNA, 286 bp, Homo sapiens
aactgtctgctaggacttttaaatttagaacatcgggtctgaacaaacaatgaaacatgacctttcagaaaagctgattaaaatgttttttacttgaagggaagcaagccataaatgctaaggaagtgagtgatttatgatgtaaatttttaattgaaaactaataataaacaggaagtccagggatgctgcaacagtgtggctacaagcaacccaagtaattcttcacagtgtaatgtaagaatttaacttaatcacgggtccaaataaatgacgatcggcctga

SEQ ID NO: 1561 - DNA, 171 bp, Homo sapiens
ggccgatcactttttattacattttatttgccaagtcaaatggctaggcctaccttcaagaaggtgaatcccactacatggctgagaagaaaacaagtgataatcaaagcagtctttttgaaattttgagtaaaatacgctacttctccaaatgttagttcttttgacaca

SEQ ID NO: 1562 - DNA, 904 bp, Homo sapiens
cgggtgacaggatattacgtgggtacaggtcaaattaatattatgtatgatcggagagtggcggctatatcatggacaatgagtacgcggggtgaatatgacgtagcggataaagagaaatataacggtttaaaaaaggcgcaagggagttgtgggaagacttggttaaaaaaaagaagagaaaaggggtgaaaacaacacaaaaaggggttgtttgccgagcccgctatgaaattgcgggttcgcatagcctaaagggcataagagcgtattcaggtaaaatagagggaagaagggtttgtagcaaaaaattacagcataaggtcgagggatttttagataaccgcggtcgaggaaaatgaaaaggtcccttgtggagaattgttcatgtgaccatcttgatgattgatgcagataaccacgcgatcagcagcaccgggggataagtattgatcttcatgattgctgaaaggaacagatgagctttcacaaagccccttgagagtttggacttaaaaaaaatatctttgacaaatttgaaggctttgatatttttatctggatccactctgcctctaaacattacaaaaggacgattgtctttttccatgttaagtatcctggatttatgacagtctaagatcaatgaagtaaaatagcagaaatcgaaataatattctaatggaagaaatacaaacccctccatgaaatttaaaaacagttgtgagacaaaaagcacttgtttaacgagtcacaatgataccgacaatacagacaaaagacgtttggtgcaaaccctgaattgggaaagaactcgggtggccttatcactgattctattcacttttatactaaattaataataaccctacatcatcgcagagttcttgtaatcctaataaaa

SEQ ID NO: 1563 - DNA, 265 bp, Homo sapiens
cataatatttatcattaaaattcttgctacaaactgggaaagcctatatgtaaagaagggcaaaaagcggggggattaaatatttcagtttcaaaagggtgaggggtctaggcacttaaacatttatccacttattaaaaatatttcttcaagacttaccatatgccacccaatgttttagagactacagatatagccgtaaacaggatgaatgagatgtctgcctttctgaaatttatatcttagggactataataaacacaga

SEQ ID NO: 1564 - DNA, 461 bp, Homo sapiens
gatgtcaagacttggagtaggtgacagttggccttgggcttcggtggccaacccatgactacaaaagcccgagaagccagcagcttccccggctcctccaccaagtggcctctgggtgatggggaagcttgtcctctgctttgtcacacacaaaactctaaaagtcagcatcccaacgcattggcctggagagcccgtccaggaggatttatgtggaatctggcttttttgatagcatcgacgttccttcccgtgccttctgagtctgtttctcttaatttgactgtggtctctgctcttcgctggactcagggagatgtcacaaattttgcaccagaatctcacaaatcacaaagaacttactcatgtaacgaaacaccacctgtttcccagtaactatggaaataaaaaaaaaattaataataaaaaatttaaaaaataaaagacgatgctggcctgaa

SEQ ID NO: 1565 - DNA, 316 bp, Homo sapiens
attatctgtatgcacatttcatccggttctcagatatcgtcacttgttcaccacagtagaagactcagaaatacccatggcaacacactggagatcctcactgcctcaagggcagagctggtttgaacacggcctttccattgcttcactgcccgccattcaccctcaaggtccattctgtgccaaggcattgcatgttctcaaggcaatgaccctggagaatgaatagccatgtgtggcagtataagtgcttggaaggtgacttagcccatttgaacaataaaactgtcttttaaacaggtcaaaaaaaaaaaaa

SEQ ID NO: 1566 - DNA, 133 bp, Homo sapiens
atacaagattctcttcctatttttgctgatagttactgagaaggaagatttccctgctatcagaaaacctcagaaccctaatctagggggtggcttcctgtagtattgcaaaatgaaagtcaataaagcatga

SEQ ID NO: 1567 - DNA, 199 bp, Homo sapiens
atctatctttattacaaaaggagttattccttaaaattttaccagtccttctatttttgtttctgaggtacatgtttttttcatttgagttctttctttaattcattttcgttgttggctttattgttttgcttttccccaaaggtggctcatggttgcctgtattccttgagttcttgcttgcttgagaatgtctatt

SEQ ID NO: 1568 - DNA, 439 bp, Homo sapiens
ttccaggtaaagggatggaatatggctcgcacccctagaagaaccatatgcccctcaaatcacagtctccatcagcctctgaggatcaccactgtcctgacctacatgagaatcattttctcgcttctcatcatatttttatgatgaaattaagggattcagtgaagccagagacagatcatccctctagtagcacatcaggcagctcacagcagctccagccatggctgtttgtcattatcctggctttgtgagcctttgtccagctctcaatctgtgccgacatctcctctgccaaaccaatttgaattaatttgtcaagcaaaattttgtgagataatatatcagctgcattactgaactaagatctatgacttctactgtgatcctttcatcttctaattgagccattctataaataaaagcagagtgcccgaaa

SEQ ID NO: 1569 - DNA, 154 bp, Homo sapiens
caacagaaaatgggctaagacatggagcaaggggcaaaacgactcttgaagatgctgagcaacttctggacagggggtctttcaagggggggcttatgtgaagaatttctccaggattcatcattccatctggatctgtataaataaagctaga

SEQ ID NO: 1570 - DNA, 692 bp, Homo sapiens
agtcttgctgtgccacccagggtggaagtgtggtggctcaatcacaggctcattgcagcctttaccgccccaggctcaagtgatcgtcttgcctcagcctcctgagaagccggcctccagacaggaacaattgagcatacggaatggaattcaattgaatgagcctaatttccaggaaaagttttctgaagattctctgagatgatgctgaagccaccccgcttcccacaccattttggagcctttattatgacacagagaaaccagttgcctttgttctcaattcccacatgacactgaatccagctgcctcttggaagtgaagctcagttgttccaatacatgacgcagccactgcttggcttcacaatgcgtcttgtcatactgaacccaattaagtcaccaccaaacgaaaacttgttccctccctctttaaacgtcttgggttatttgatgaatgttcttcagtttcccaacaatggaaaattgattcttaggctgtgaagttcctctctcttcttttaccttctgttttccacagattttaagcttaagagagcagaattaaagtttcaaatcattgcttcccttagctttttgtcttgaatgacttttatatatctttgcttagaaaatattaaattgctgactttttatcaacaacaaaagataataaaaggcgatcggccgaa

SEQ ID NO: 1571 - DNA, 359 bp, Homo sapiens
acggagtctcactctgtcgcccaggctggagtgcagtggcgcaatctcggctcactgcaacaaaaaaaaagcagtatcacctaggacactgttacaaaggaaaagtcatggacaccacctcagacaccctgaatcagagagtgtctcagagtaggatccaggagtcagcattttaagaaggcttccagatgatgccgatgtaggccaaagcttgaaaagcactatactagaagacttatttaaaaccagaagaagttctttaaaatgatattaaaatgtataattcttgaacacattgcagagatctatagttattttcattttaagttttcaaaagtcaaatatacaataaacggtga

SEQ ID NO: 1572 - DNA, 211 bp, Homo sapiens
ttgctgaacctgattctggaaggtacaacaatttcggccatcttcctaatcaatactgtgagatgggaccaaattaattgtgtggtacatgaagcacagcccaggaaaagctgatgagacctagacaccattatatattttgcctgacttattaacttactctgtgtcaaaattgagtccgtttttgataaaaataaagtctgatcggccg

SEQ ID NO: 1573 - DNA, 927 bp, Homo sapiens
ctagcccacccgaataaccgagccataatgtttaattaatgatatgaagaagtggtagcggcggagaaacagtaataaatatagataccagataactgcgacgctatgcgaatgagctcgagttcaatcgcaatatacacgcgacagctcgactgtcaccccatggtatctacaccaggcacggctatgggccaaaaaaagatactaaagaaccggctcccaccaaaggaaagtaatcattaagactagaggccaaaaaggcgtatccacgtgaagtcacccgcagacagtgattttgaaccacgatttcgcgctaacactcaagtcatttctaattaacccagcggaagcactttgaaggttccaattacgaccggcaatcatatatgatggaggggtcgactatcgattccaaagaccttacagtatggcccgggtatcaatcagtaaagcttcaacaggtagaaaacccaacagccgtatttgttaggatccaaacgtctaggtttgatatgaaacatcctggcctggggcgggagacaaatctgccaagaaaagggcactggtccttcctccatagaaaaagatgggctgctgtcgcccctgctgggatgtctctcttttggaagggccctccccaccacccagtgccctcagcatgcccagcttccccctccccttcctataacacatcctgcgccaaccacactgctgggtgcaaactctgcaggtgtggtgaaggcccggctctgcatccccaccacctgcgttttgtttctgcacctttggaagggtaccatctgcctcgctgagctgctgagatgacagctataggagcgcttttaaaggactaatgcatctcatcaatatctggtgattatgttgctgtttttataatgtgtttactcatctcctgaacaataaaca

SEQ ID NO: 1574 - DNA, 281 bp, Homo sapiens
ggatcccagccctacattgggaggctcacaagcaggcggattacctaaggacaggagtatcgataccagcctgtgcaacatggtgaatccccagtactctactgaaaatcatatattaaccgggagtaaaggcacatgttgtgcatcccatatactaaggaggctgaggcaggacaactcgcgtgaacctcgggaggcattggttgtactgagctaatatattgccacggctctgcatcccggtccttataacaaaactcttttaaataaaaaaaaaaaaa

SEQ ID NO: 1575 - DNA, 429 bp, Homo sapiens
  misc_feature (1)...(429): n = A,T,C or G
atttccagtccctagggactctggaggtgcaagagacaaaccacaacagccaggtgcgccacctcaagtctgttttcaccccaatcacatctttgctggctgacctcaccttggagaacttcaggccactcacattaatggcactgaaaggcattgggaagacaatgaagaaaaagcagagacattccataacctcatagagcttacagtgtcatgggaagccaagtagcaagatgttatattctgtatgtgatgaccacaattgctgcagccatctcaggatcatgaaggcaatcagcccaagaggacaagataacatgtntagtggcacagcacaaagacagaaggtacacaggccttgcaagacgtcattaagcctgtaaatnaatctaccctatacaatgcctntggcttatttttatgtgaaat

SEQ ID NO: 1576 - DNA, 221 bp, Homo sapiens
tttttttttttttttttatttttttcatgtgcttggcttgattattttaagctaatttatataccttcattcgttccgtaacagccaaaagtgaaacttttttttcctgtttcttttgtcatcaaggcacaaagaataacagctttcaaaatagtctttggttttgtcctttaaatggtagaaggtcatcattttgttttcgcttttgtatttctatttct

SEQ ID NO: 1577 - DNA, 390 bp, Homo sapiens
attttatttttatttttcgtagagatggagcttcacatggttgcccaggctgctgtagaacttctggcctcaaaagatcttcctgcctcagtctcccaaagtgctaggattaaaggtgtgagccactgcacttggccaataaaagttttgaagatgtgaataggaaattcaccaggagcttcctgttcacctccttgcttcaagtttatggaagtcttgacttatccttgtccttgtcaccaacaagccttgtagccgcagcctctgctcagggggaaagtgttcccaccctcttcaccagtgaagctgctgagataacagggcagctggctccttcccatggaaagatgaactatgattcctcatttccccaataaatttacgattttg

SEQ ID NO: 1578 - DNA, 130 bp, Homo sapiens
tttttttttttttttaaatacttacaaaataattttaatgaaggtctcattagcaagaaaaatgcagagatatggatgataacaatctcagagactactgcagaaatgtgagtggcccaagtcaaagctg

SEQ ID NO: 1579 - DNA, 352 bp, Homo sapiens
attacattagttctttatagccaaggtctccagcttggaggtggggtggggaggggaatgaaaggttttcgtatttgatgaataaatgccttgtagtcccctttggtttttctttaaaaaactccaaacatgtagcaaatattctctcggtcctgcacgtggcaccccctcctcactcctacatttgcaacctgtcttcacatctcttccttccaagaagaattagcaagggccagggctgcaaagtgcacaacatcagtaattgactttggtgccaatgcaggctgcagctgtgtctgtaaacaatacagttcaggatttgtcacagatggtgccagccaacgagaacgtg

SEQ ID NO: 1580 - DNA, 349 bp, Homo sapiens
attcataattgttttataaatttgggagctccagtgctaggtgcatatatatttagaattgtgaacttttcctatgggactagtccttttaccattataaaatgttcctctttgtcttttttaacttctgttgctttaaagtttcttttgtctgatataagaatagctcctcttgctctcttttggtgtccatttgcatggaatatctttttccacccctttaccttaagtttatgtgagtccttctgtgttaggtgagtctcctgcatacaggagaaacttggttggtaatttcttatccattctgccattctgtatcttttaagtggaccatttaggccatttacat

SEQ ID NO: 1581 - DNA, 328 bp, Homo sapiens
tttttttttttttttaaatccgagatgtaattttatttttgaaaaaactaaaccaaaccatttcccagctctgagcaatgaaaaggcctagaagttatggccaaccctgtagtcaagagcacctgtagcacccagattatggttttgcaatataattttccactaagaggaaaggaggctccttagagaaatggcatattccaggtctgaggcagcaaatacacagattgagtctgaacatcttgtcataccaaaaaataagggcattaccattccactggcacctcctcaacaggacacaggaaccaactcgatgggactcccactg

SEQ ID NO: 1582 - DNA, 291 bp, Homo sapiens
tttttttttttttttttggtggttaagactgtaccttttatgttgtatatattttgccacaatttaacaacaatgtaaagtatggtgaagttttttcgtgtttcaaaatactgagtagtggaaagcttttgtgttttctccgtggcagcctccttcttcattcacatgtttattcattcattcttctggtcataaagactgtcctgagctcctgtcatgcggcagatactacaacagatgtggggtccagaaataaacgcagtgcagagtctgatcttcccagtctagagt

SEQ ID NO: 1583 - DNA, 1112 bp, Homo sapiens
cctagaatttccgtatttggagactgaaagcaacgatgagggataatttaagtggtctgagcagactgttttttctccagagactactttatcaaaaagagacttgcataacataagccttctaacaggaagtacatttgtttgctcattcattcaaccaatatgtatcaaaaccgtaacatgtgcacaggcaaaaggatttctgccctgcgtggagtctagtaggggaaaagagttcagttaaaaggattatgatgtcaacttttatgctgttaagtttcatactcctgaagttgggtagtaaactgcaccttgaagctaggcggacagtgcgtggcctacaggctttttgctcttcatcactgctctatacgatacgactgtctggactcttcagtctgaggccaacattgcagatttgctgttgacataaaccaacatgtttgcaaaaggaaaaacctctgactgtcagactgtgggtgtggccatattacagtcaaggctatcagtcacaagaaggataatataaaggaatgggttaccacagacatattacttactgcttgaactagaacttggaagtttccccagatggtaggtcagcaatattctcttcacagtgataatgaaatgtccttttgctactagaggttatgcacttcctctgaaactgttaagtgattcttactcctctttttaagaaatactctttaaaaatcataaccattgcaaaaattcagatgaaagtcaaaagtaaaaatctcctataatcttatcccctaggcatatattaatatttctatgtgaatctaactatacttacttctcagcatacacatttagcaaacatggaatcatactattcagtttataactgctttttgatctttgcaatagatgtggacattcttcaataaaatacaatgcagatttcaatttattaatgtagatgtacactctattttactgagtgcatagtattccactgcatgttggtgaattaccctactggttgacatttaggttgttttgcaatatatatacactgcaaatatggatatgtataagaaataaaacatcttgtataaagataaaaaaaaaaaaaaaaaaaa

SEQ ID NO: 1584 - DNA, 494 bp, Homo sapiens
tttttttttttttttttaatatagcaatttccttttattaaacacctactgtaaaccaagcacaatgtcaaatcacctatgtagtttatttcattttattctcagaacagtcatattagataggtaccttttattaatcctgctttatagatgaggaaactgagaaaggtcaaggtcatacagctagtcagccacaggagttgagatttgaagccaggtttgcttgggtcaagagcggagactgttctcatacaacactcttccttagggaccctctgttctcagccccctgaacagtgaggttcagagaagggagtgatttgtccaaggtcagctcctagcagggcctcttttccaggattccaggacagggttctttctaataggttaccccagtatgattaagaatatattatgttgaggccctgggatgcagtctagtgacagagcccatgggttcagtatttccatcctttgggctccagttttcccat

SEQ ID NO: 1585 - DNA, 429 bp, Homo sapiens
ttttttttttttttttgttttcattttctttattattttctgtactttccaaaatgtgtatgtatttttgtcatagtcagaacaaaaatactatgtgtaaaaatacagtccttcctggaagcaggagaatgggcatcattctttctagtctcgtggttcacatagagcctccatgggtcttcatttcagattgcacaaattccaggcagatccaaaaattctctcccaagcagcctcagtttatctcatcagagctgaacattctacagttttgacctctgtcatgatcccccagggaaaaggtattcattggttcttctgtcccattctggaggctggctggtgtataaatatttgggctggcactagagcctcttactcttgggtgtgtgcagtatttgtcattttgttttgctctaactgttcctc

SEQ ID NO: 1586 - DNA, 412 bp, Homo sapiens
tttttttttttttttttgttttcattttctttattattttctgtactttccaaaatgtgtatgtatttttgtcatagtcagaacaaaaatactatgtgtaaaaatacagtccttcctggaagcaggagaatgggcatcattctttctagtctcgtggttcacatagagcctccatggtcttcatttcagattgcacaaattccaggcagatccaaaaattctctcccaagcagcctcagtttatctcatcagagctgaacattctacagttttgaccttctcaacagctctgttgcaacccagcccccagatccccagaacttcaagcatttcttctacccatctcctccagaggagagactgcagccggagatcaccttgataggttatcagataatggacatcatcctag

SEQ ID NO: 1587 - DNA, 724 bp, Homo sapiens
ccttggagtcactcgcgatccgccttagagtgcctcacactgcgcaccacccgcggggtctgtcccacagactttggctgatggatgaaatgagtactcaaagacacagagggaggcattgcagagagacccctttcaaagcacacaggaagtggctgaagtcaataaagaaacagaagaacaatttgaatgaagatggatcaaaaagaagacagacatttctaaaaagccatctttaaatataccattttacaagctccctagcaaatatcttgagacaaaattggatgactacacatttagcatattatcatgatgctttgaaaatatgtatgtgtacatatatatgtaatatttatacacaaaatgtataacataatatttcatatgataataaatataaatgtaaatataaatttgacttaagaagggagtatatgttgatagcgttgaagtaagcttagatgatcaccttaaatgttgttactgtctttgttgccatagaataaacacttaaagagaaataacaactttgttttcagtttggagcatatttttggccctgggattattgattagagagattaatatgtattttccttatttcatctgtaaaatttaagttatttttaaacagttattttatttacacataatgtcaggctggcacctggaacaataaatgttgagttttattgtaaacttgaaaaaaaaaaaaaaaaaa

SEQ ID NO: 1588 - DNA, 278 bp, Homo sapiens
atccttataggagagaaaagaaaaaaaagaagacacacagacataggggagaagaccatgtgaagacagaggcacagatgggaaagctatgtctccaagccaaggaacactaagaattgctggcagccatcaaaatctaggagagagatatggaacgaagtctccctcttgtcttcaagaaaaatacaaccctgttgacaccttgactttggacttctggcctccagaactttgagggaataaaattctattattttaaaccaccaaaaaaaaaaaaa

SEQ ID NO: 1589 - DNA, 362 bp, Homo sapiens
cttaggaaactggggagggaatcatgttccagcagtgaagaacaaaggcagttttttggggatttacatacgccatctcctacaaagttaaaaaattttcttttcctgaaagactacaatcaagatacaaacatgtacaatgggtgaagtggattaacaagtttgtgtcatgttaattatatatttcaataaagataattttggaactagttttatggatgtaaatataaattacaagttaactaaattatattgaggatgcaaataactttggaaataattataggtgtaatcagccatttgaaaataaaatgaatacaattaaacatgaatgacaaaacatgatggcaaaaaaaaaaaaa

SEQ ID NO: 1590 - DNA, 162 bp, Homo sapiens
aagaagaaactctcctccacatgaaaacggaaaaagcaattatgagtcaactaaaattatccaaaagatcattttacgtaaagtagttgctgaatgtacacgaaatgtttagaaattaaattaaaaaaaaaaaagatgccaggcaaaaaaaaaaaaaaaaaa

SEQ ID NO: 1591 - DNA, 278 bp, Homo sapiens
aactctgcatcaaatcgctttccgtgaatttgtttccatgcagtggtgtggaagagcaattataaaattaattcagagcaggaatgttttatatcctgaatgaagaagaaaggggagattggaggtgctaccttaatgtgtgcctgaatccatcattcctgaacatgctgctgttttatttcattctgatgtggtgtttctcccagctcctaagctccttttggcatatatctttttgcagaactggaaaaaaatttgaaatgagaaaaaaaaaaaaa

SEQ ID NO: 1592 - DNA, 330 bp, Homo sapiens
gaagcccagacgcacttcgaaatccttcccagtcctacaaacgctgccagaagccacaatcaactgacaagcattggcagacaaggtgatgcgtgtgactcttccatagcatcctgacagtggccagctcggggctcatgagcctgaaggacgctctgccttcaagatgtctgacatgagacagtccctcaaagatatgctagccctgacagtgagcagttcctccttgattctcttcccagattaattttttgtttaattggtaattaatgttcattccttaataccaagtcacaattaaaaattgctcaagtcacaaaaaaaaaaaaa

SEQ ID NO: 1593 - DNA, 965 bp, Homo sapiens
cgtaggacacacagatccatttgaatcattcattttgaaatataatgtactgtataattctgtataaaatatctatcagaggtttcagaagagaaagagccaaaagaccaaaacttcttcaccaacccgtttgatcatatttctttcttctgcctgcaagttttataaaaagaaaatgaggctgaagtactaggagtgagctgaggcctagaagaaaagcaacactggtgtgcagaagaaaagtgatcatgcttcttcaccctactacagacttctgtatgagaagcagcctatgctgagggaaatgagaagcttgaatttttaatgaagtctggaaatgcgactatacatcagacttttttctatatcacaaataagcaaacaaatgcacatttttccattatttgtataataaaaactcatggtaaaataagtaaaatgactaaatatatggtagaaattgaggttaataactaaatatatggtagaaattgaggtttatcagagtattggagctcaaaattaaacaatctcttttactccacggtatttttatatgtgaatattatcttaaaaagattgtatttttgtcaataaagatgttttggaaagttttacaccagaaatcttgagaaacatgaaaacatgcctgtattctctttatgctgcaaggagaatcaagacgaaaaactgaattatactgccagctattttaactataattcgagcaaaattctgtgtttatattaactacttaacaataaattccctcagctaaaccaagtaccctatttataaactgctacaacagtatatcattttactttgagacacatattacaactataataaaataattatgaagttacatttaatatctccctcccttgtggctctataaggctcattttcaaatatcattaaaaaataaaaaatgtatgtctttcaatgaaaaaaaaaaaaaa

SEQ ID NO: 1594 - DNA, 307 bp, Homo sapiens
ccctaggctggactgctggccccctaatgaacattaccacgccactgcggaccagttcctgaggtgcacattaactccatgtgacagttccggagcctgcagccttgagaccccttctccattccaggcgcctgtgcttccatcatcttcctatggcaggatctgtatttataattcatgcttttcctttggtttcctttccaggcctctctgggctggtgcttaaacaaaatctctacccacatcaagctcgtgttagtccttcctcaattaataattaatagtaatgataataaaaaaaaaaaaa

SEQ ID NO: 1595 - DNA, 659 bp, Homo sapiens
tttttttttttttttttgcagttactctctatatttagtagatagattctttattatgtttattgcaagctattttaccaatatggatttaaaactattattaggaaaataggaggaatgtcgcatttatttaaagggtctcattgaatctttccaatcacatctcttctcctcttttaccaataaaaaagacttgcttatgcctatgtcataggagtataacagctattgatatttattttgtaccttaacattttctcatggctttcccatcatattttgttctcactctgtaatgtaaatagaacagtattctttgtttaaaacaattttttaacttgagatttgagaagaatagaggaattcaagtggcagatcagtctttaaattgaagtcttacagctcaaagcccagtctcttttctaacggaatatggagagggaattccagaaagtaacgcagttcctgttcaattcgcctgtgccccagcattggtcatgtgtagcccttggcacatttttgagacttgatcaaaaaaattttgtttaagcaatcaccatctccacaatctgtacatctgttttccaattctttatttttcctgtatttgctccttccttcgttcttcctgtcttcactgcgcaccaaaccccgtcact

SEQ ID NO: 1596 - DNA, 607 bp, Homo sapiens
taggagggaaatttggacatggaccacatagggaagacagccatgtggagacagaggcagaggtggacctgctgccgcaaaaccacagggcgccaagtactgtgggccactgagaaaactaaaggagaggaaggattcttccctggagctttggagagggtgcggccctactttcacctggatttcagacttcagacttccagaaccatgaaggaataagctctctttgtttcaaaaccactcagtcaaggcactttgttacaacagcctaggaaactaatacaggaattggtattagtaaaatcattattgttggctcatatgaccatactcatagaacttttaagataatatgtaaataagcaactaaaacaaaaagtcagaaagctttatggtgccagatcaatatacaaataaatatcattattttccaataaaaacaattatataatgtaacaataataaagtaataatacaaagaaacttccctataatagctacccaaaaattctaaatgtagttataacctagttttttaaatataatatgttcagtaaattttatataaactaaatataaattttaagttaaaaaaaaaaaaaaaaaa

SEQ ID NO: 1597 - DNA, 788 bp, Homo sapiens
tgaacagggggaagtgaaaaagggaggtgtcaacagggacacgctggcttaaggaaactgaggacaatcatgttgttgaataaaacagaagagaaaagtaaattcagaagtgttaggtgacttacctgagactacccaactaccagatgacaaatttctatctggcctttcaactgactccagagtgaagcttcttggattaggatgcactgccccctaccatcctcttatcatcactgtgtgagaattaaaacaagaaggcagagcatccacccttatggaagcagcacatctggccactcacctgtttccgttaactgagagaatgactgcaaaagctcagtgagcatggacttgggggttaagaataacagtgagtaggtgaattcacacacatggaatccacaaataacgagaatcaagcatatgtccatcttgatttgaccaaaaaaaatggatgtttaatttttaaaaatgtatatgaccatgactaccactcatttttaagtaactatttactgatttattatatgagtcagactctatgctaaattttacagatatgggatgaaggaatggcttttcctctcaggagctcttgattgagtagagagaaagtcatacaagaagtaaccatgcaatgtcataagtacatgcttcagttagggtaatattagctataaaagacttaaaactcaactcaaattaattttaaccatactggaatgtattgctttatatcattaaacatatcttgaaaaagtttactttgaaaaaaaaaaaaaaaa

SEQ ID NO: 1598 - DNA, 1052 bp, Homo sapiens
cgtcatctaggtgaataaacattattccctatacctatagagtggaataccacccagcatcctctcacatacaaagaaagaacaaattgctgatagacacagatgtccatcaatctcaaaagtcgtcgtgaaacctctggaagaattgagctggtcgactatgcaaacagttgtcaagagcctataaaatatgcagcataaaatttttcctttgtagtcaaacctgattattcctcttagatactgggaacagaatttcacagtcgtcagagaatataccttttgtattttcgtattaaatatgtactcctattacttaacaattgtagtttaactcgttttttaggtaaaattctaatttttctcttctgttaaaaatttccagttccaacacgaagataataaagaatattaattttatccttattaacttgaaggaagtaatatttatttttgtatttctgtacttaagtatatcacaaatacagttttctgtagttggagaattaatataaagtaacatagtattcaataagaagggatttttctttattaaaaagaggtctgaattataaactaaatatctgtgtaactttgaacaatttatttaactttttgaagatatttgaaacttatttctaaaatgagaaaaatacctatcatgaggagcttttgtaaatactaaatgagatataacatgtaaagcagttaacaaaattctaggcatggtatgggtatttaaataaatggaaagtattcttaagttttatagtaatagttttacaaattttatatgtaattctgatgattaatggttattttaatatcttttctactgtatatgctagggagtattttggagtatcaaatttaaatattagtaaagcatgaaaatttgatttagtaataagcagacaaagcagaaaaatgcactaaatcttatttcttatgcaaattgggacaataaaatatgggagcaagaaataaggctgaagtatgtatatgagcagaataaaataaattactgcaaaatgtaaaaaaaaaaaaaaaaa

SEQ ID NO: 1599 - DNA, 1037 bp, Homo sapiens
ttggtggatatattaaatccataccagcccctgctcctatcaaatgtttactggatgtcttaatggataatctttgggttgagagaaggaatattgacctctggcagacatgaagaccatgacatcattgagaaagaccaccagctgcccaagacaaacttctaaacagtctacatttaagcttatgttgctttttccatgaaccccaaagtacatcttcaaactcatcataggtggctgaattctagcatctattacgaagatctaatacaaggatcactggtccagtcaatagtgactggggaggttagggtgaagacacaaagcatgaaggtccaggtgcaagtttatgctcatgactactctggcaaactgattcttggaacaatatcatttagacattcatgaactagctatacaaaagcaatacaaagcgacaattcttatttcatggtattaaaaaaagttgttttttctattgaacttcccatgaatttttatctaaaataacatgttgtcgtagattccttgtttactttatccctgatactatttctggcttatttggaatttcccaaatctgcctttagatcacaatttatactccacagctcaaccccttgagctatctggatctacccatataaactagaaacctaattctaagttttttgatgatgacacaattctaatatgtgatatcatatcataagccctactaagatagcctaaattattttatagttgctgagaaacgaaggtactaagtttaaattctgtaagtctatgaacagctatttttctggaccagtacctaattttgtcgaacataaaaaaagttgtctggtttctttcaagacaatttagattttctaatttctgtgagaactacagccaaaacttccaaaatgagagattctttgaattcagctgtccattaaagtgttgtccaatgcctgcttttgctgtcaatttgttatacttaaacactgtgtgaagaattaaattagaataagcgtaaaaaaaaaaaaaaaaaa

SEQ ID NO: 1600 - DNA, 372 bp, Homo sapiens
gaaagaatggttaaatgagtgtttcaaaaactctgatagaaacaagaatttattttatgattaaatttcagtccattatgattttcctttctcacataattacttttttctttttagacttataagctagcaattacagatttaactacagctatcagcatggacaaaaatagttatacagcattttataacagagcattatgttacaccaagataagggaacttcaaatggtaagatgaccattttagtaaacaatgtgtttaaagtgtttaataaataacatgcatttaatagcttgtggatttcaatcaataaatatttaataaacaatatgttaaagcatttgtaaactcaaaaaaaaaaaaaaaaaa

SEQ ID NO: 1601 - DNA, 755 bp, Homo sapiens
cttgttgactgtgggtaatgaaagttgcagaaagcaaaaccgcggatcagaggggacaatgctgctttttggaactctgttaggagaccaacataaaccgaagaaactacgaactaatacatcatgaaatacttcttctatttgggaggtggagaaaccatccccttctccaccaaaatgacacttaagaaagagaccccagggagggtagcagtggaatgagggtagaaaataactgatgaaggtcagtttcagccttcctgcctccaaccttctcacagactccagtgcagaagaggatgtattcagcttcctaaagtctgtgtgtaccactaacaggttaggaaatgagttaaatgccagattcttaaatgttgcatgtgggaggatctgaaacagagacttcagtcactttgcctctgccttaaacacccacacaacagaaatggatcacggcattggctgagcaagagagaagagcagagaagcaagaatactagaagttactctgttttttatacaggtcgtgccttcctgatctgaaagtctgaaatgctccaaaattcagaactatttgagctctgacatgactgcacaagtggaaaattccacacataaatacttaatacaaactttgtttcatgcacaaaagtatgtaaaatattggataaaattaccttcagattatgtgtataaggtgtatataaaatataaatggattttgtgtttaaaaaaaaacaaaaaaaaaaaaaaaa

SEQ ID NO: 1602 - DNA, 730 bp, Homo sapiens
ttttttttttttttttaaaataaagacacgaatatttattcaactctagacaacgtttgatgccataatgggtttaaaataactctgggagcctgggaatctagtctctagattggaaaccactgaactgggtattttattattaaaaacaataatcattattattttttccattgtaataacatgtaaaaaaacatatttcccatatgctcagtggagaaaatttggaaataaggaaagtagcaagaagaagtggggggaaagaggcacccataattctattacccagagtcaaaaacatcttttaacactttttctgtgcattaaaaacaaaaaaagaaaattatacctccatcatttctggtgtgacctgcattgtgacagcacaatgttggccagttatggtgcagaaaacagtgctacccctgggagcctggagtgtggtgggagatagctccaatagtggcaggtgctgtgcaggaagaggctcgtgtgaaagtactggagggctgccatggggcacggtgatggggacatggggccatgccgtctgcacaagggccaagtggaagagcagatttttcacggtaaatgtaggcgaacccctttttttttttctgggtgcctaacctattattggagaagtgctcatatacattcttttccatctgtgccttgggcaggatgacatcattgatgatgttgacagctttcttgctgcagcagaaac

SEQ ID NO: 1603 - DNA, 613 bp, Homo sapiens
ggaactcagaaagaagactctagaagaggagccccaaaccttttggagaaaagaaaattggaataactactccaaagatctttgcctcaagaaaaaaaaaagaagaagaagaaaaggaaagtgaagactccctccttcattcctgcaatggggaccaaaaaattaggaccactgttcattaatcagatttttctacttttaaaaatgataattatggttacaatgactccagatccttttattttcttttcgtcattgcttaaatctgatttttgcaacattttacaggctttcatgaaaattatgagctatgcttaaattgctttagtggtatcatttcatagataccaaatgaataggattatagtaaacaaagaattaggtcttaacttaaaaattattttaaaaataactttgttcaattccctaaagtaacaaatggaacagaactgaaaagcaataatattacagttttaaattggtaggatcttcattttaacttaaaccatgtttgcatataagcaaccatctggataaaatgtttaaaattcaagaaaaaaaaaaaagaaaaaaatggcctcgtggacctcagcggtggagctctgcggtcaag

SEQ ID NO: 1604 - DNA, 884 bp, Homo sapiens
agctacctttcttcctatgaaaccaacctcctctactcagtccctcggaatacacatttcattttatagactgaggtgttgccttattctagaatcacaagtaaaagccaattagatctttaaactaaatttgttgaaattttgcccgttgacagaacttatttgtgctcacactcagtttattgttttaacttttgtgggtacatggtgtatatatttatggggcgcatgaaatgtttttatacaggcatgcagtgcataaaaatcacatcatggagaatggggtatccatcccctcaagcatttatcctttttgttactaacaatccaattgtactctttttgttatttttaaatgtacaattgttattattgattatggccaccctgttgtgctatcaaatactaggtctcatttattctttctaactactttttgtacccagtaaccatccccatctcccctccactttcccactacccttcccagcctctgaatttattgtattttgttaaacagcaataattaattaaattaatttattataatagaaaattttttttttgtaattataaaacaacaaagaataattgacacgaaggctagaatgctaaactacaggttaaaatgatgaaggtggggtaattatatcaatagggttttataattaagaatggaggtttatattttgttaagggctccaaagtcacaagtaagctcaatggatacaaaataatattcatacaacctcaaaagctgtactgaattggacttttatttgggaagacaaacatgtatatgtaggggcaatacatataattaattaattaatataattaatacatacaattaatttcaaaattgcaaaaaaaaaaaaaaaaaa

SEQ ID NO: 1605 - DNA, 293 bp, Homo sapiens
ttcaaacaaaagtgaagcatattaaagtccatcccgccatccttccaaagagcaaagaaagtccatggaaattcatcaacatccaggatgctcaggagcttccaggttcaacagatgcgtgagatccatagcagaaacattgctgtcctcttcagattcaaagtgcaaaggacctaggaagtcctggacacatgtttgagactggagctataaaaagtagtatgacacaaatgagtactctttaaacaattttgatcatgaaccctgtcaataaaaattgtgagtgcctgcaa

SEQ ID NO: 1606 - DNA, 379 bp, Homo sapiens
cctaggtgttactgtgaagactttgttgttgcaggttcattctgccgccatatacgtaacattctaagaattataattcgcatcatctcagcctatgtgccagaggggtgcatgacccagaagtgaccatattcaattattccagcaacaatgacaggaatatgaccctagtacaggcaaatataagtcaattataaaatgatttttgtgctaatgatggagaaaatttctttttccagtggaattacaatttggtgcagcacaccagcatggcacatgtatgcatatgtaacaaacctgcacgttgtgcacatgtaccctaaaacttaaagtataataataataaaagaaaagaaaataaaatataaaaaaaaaaaaa

SEQ ID NO: 1607 - DNA, 812 bp, Homo sapiens
tgacatacccagaggccagctcactcttctccctttccagagagcttccattttatttgggtgtctaccctgacctcacatgactcaggattaaattctgaatcatccaagccagtcatcgaaattccagttcccttgccagctcttggttttaggaagagacgaatgactcaatcctggtgaataaaatgagagaggaatttatctgaggttttctaggaagggcttccctgctgattaaacatacacacaccctcttgagcatcattgtatctgcctatgataactgaaaccgtgacagcctccttgggacctcaaggggaactggccaggggtaaggagaggatgcagtgcacacagatggaaaagcctgtgattccgaagacatcattgagctactgaagaaagcaaccctggattcctcctgcctcagaagatcttattatgggacataattttccttaattgtttaatcaattttgcaatggatttcctattacttgcaggactcaaatggatttttattagttctatatacacaaatcttagtaatctttttcatgaaatatctagagactatctatgtgaatggtgagcatttcttataataaaactgactataccatgcacatttatgctaggaaaattgcaagtcaaaataaagaaaatgtaatttatttgttatctacttagattttcctttcaggagagatgaatatgtggattcacctggttgcaaaattttgtcaagatgggtcagttttacttttcaacataaaagtccaaggatgtttacaaaaaaaaaaaaaaaa

SEQ ID NO: 1608 - DNA, 448 bp, Homo sapiens
ctaggtgtacaatgtgttctgttctgccgtgggagacagtaagctgcccatcactggagacgccagctggaattttcactgattgctctgaaggatggttggcctggataatctctaagtttcctgacctgagatgcgaaggggaaactgcttgtagcagacaggtgtcagctttgcagtccgccagacctgagttcaagtctcaatttccccgcatacctggttttcttctctgcaaagaagagagaggaaaataatatcaactttgcaggactcccgtgaggaatccatgacacagcacctggagctacgatgactctcttattattcccccctcttcatttcaagtcagttgtgtgctcagggtatggactccacactggaaccaaccctgcatttaaaaataaacagccacttagcttcatttgatacatgaaaaaaaaaaaaa

SEQ ID NO: 1609 - DNA, 215 bp, Homo sapiens
cagattccaaaaactcactctgaccttggagaccagaatcctacctgctggagcaaattgcatctcgagttttgaaaatcagcacccttattaagcagagaatgactgaaagatcattgaggatcacatatcaaaggcactttatttgaaattttcaaagaatcaacagaaaatatttttatctactttaaatgaatgacagaaaagaacacaga

SEQ ID NO: 1610 - DNA, 357 bp, Homo sapiens
caaaggatttaacgtaagttgtggagcattaatcagtaaaaggcaaacatatgacaatgcataaacaaataattcaaaataattagcatttattccctgaatgtgtggctgccgtagcaaataaggaaattcaaaatatcatgcttaatttgcgattgtgtttttccctttaattgcatctgccacccgctgttaatttgaaacaattaaaccctaaaggcagtattcaaaagtaagaagactgcagatttcacctttgggcaaaaaaattatacagcagcttcaccgaacttaaaaaagagtgaaacattcttttccagaagtggtagagtgttttctgtttgcacagcatgccct

SEQ ID NO: 1611 - DNA, 359 bp, Homo sapiens
ttttttttttttttttttttttttaattgaaaatatttatttaaaatttgcagatcggagttttggaaaggttacatttattaaattattgttggactatgaggaacacattgttgcttggaataatatttaattatgatgatgatgatgatgataataaatgacaataataaacaactatcatttattgagcacataccatataccaggcccagtaccaagcagttcacatatattatacatctaatacccagagcaactctataaggcagctctatatgttgcttccatttgaaagatgaataaactgaggtacagagatgtgaagtaacatgctgatggacacccagatatgatct

SEQ ID NO: 1612 - DNA, 774 bp, Homo sapiens
tttacagaaacttagaaaagagagaaaatgcaatgatcaattctgaagtctatagaggaggaatgattggaaatactatattgacaaaagaggaacagatccattttctgaagaatatgcttagctcccacgtgcaacttgtagggatctaagattattgcaaatgaagtagatgttttacataaaattatgccatatatgtcctcagaattaataaaacccagagccttgaaaaaaatgaggttattaaaataggttgtaaaactttagtgattaaaatagcataataatgacataagaatagacagagcaatactcttcatttaaaaaacctgtaaatatgttaattatgcaacacaaggagttaggtacttattgacatgaaaacctaaagttgtgtccatgtactgtgcatgtacagtgtaactccgtttcagtaagtgcgtgtgcatgtgtttgtgagtgtaggcatgcatgtgagcacatacgtgtgtgattatagagagaactctggaagaaagtctacgtggctgtccacagtggtcatctcatggcagcagagtctcacatgtgatattttttaacctcgcattttgctttttgcttctctctattggttgaatttttgaaccattacatatttttagcaaacaggctgaatctatttccaatggaagaaaaaacaaaggtcaacaaaatatttcatgcaacgtctctcatcagctcccaggcttcacgttttgcacatggctgttgctcttgctctgtgcatct

SEQ ID NO: 1613 - DNA, 631 bp, Homo sapiens
  misc_feature (1)...(631): n = A,T,C or G
caggagaatactcattcattatggcaaccaaagaaaggggggctggccgcatccttgattatttattattttattttatttttttgagacagggtctcactttgtcacccaggctgaagtgcagtggtgtgatctcagctcaccgcagcctcagcctcctgggttcaagccatcctcccgcctcagccccccaggtagctgggactacaggtgcacactaccgcacccagctaatttttttgtttgttggtttgtttgtagagacagggtttcaccgtgttgctcaggctggtcttgaactcctgagctcaagcgatctgagcgatctgcctgccttggccccccaaagtactgagcttacagacatgagccaccaaggcaggcccataaagttttctatcttgcttttttttttacataatagaaaacatttaaaaaattaatcacaaaattcatggtcacattcctacaaagttaacgaaatatctgggttggcttatgtaggtggtcagccagaatttctggcaatgtccagatctcaccagggcctggctccagtttgaagcccgcgggtggcatttatctccccccctatcaagtggaagtgactctgggctcngnggtgacagga

SEQ ID NO: 1614 - DNA, 306 bp, Homo sapiens
agggcgtctggctttgctgtttacagattctttctccatttcaagatgatagaaatattcaacttcaaatttcttcaagcacttgcataaattattaagcatttgactttattgtagagacagagtttcaccgtgttagccaggatggtcttgatctcctgacctcgtgatcggcccgcctctgcctcctaaagtgctgggattacaggtgtgagccaccacgccaggccaattagttgtaactctttagtaaaatcaactaatggtttgtctatatgttatacataaattataaataaattccga

SEQ ID NO: 1615 - DNA, 260 bp, Homo sapiens
caggtgaagaatggaccagagaataagggtatgtttccaagagccaagaaagagctaggaagctaaatactaaaccaactgatatttgcattcaggaatggtgtgatgagaacccaagcattttaattgaaagagtaaaaccaaaaaagctcaaggacaaatcataccaaacaaaaggaaaagaacgatcattttaaaatttttatcatttgtacttcattagtccttgtgcttattatttattaataaataaagaccga

SEQ ID NO: 1616 - DNA, 192 bp, Homo sapiens
gtgtctgatcaataacacagaagcaactgaagaaacaatatgtggatgcttcaaagatgagtgaaaacatttcttccaatacccaccattctcaattacaattgatgatactactctggagtacttttgcacctgttgaaatgttatgttgaataataaatgatatctgctatgaagccaaaaaaaaaaaaa

SEQ ID NO: 1617 - DNA, 773 bp, Homo sapiens
tctgctgagcatagagtatgggatacggctactgaggataaactggaataccttttccatgaacgtctcccaatatctgaattattcttctctaaagaagcggctgaatataagtatgaaaattctgatgaggaggcccaagaagctggaggcaagaaggagagagaagaggatgaaaatgaagaactggaagaaggacttgaaaaggatctggactcagcagagcacagccccttcaaaaaatccagcttggaggcagagaaataaatagatggagaaagaagaaattaatttcctcttcatggatgttctagttttcagtagctcacacaactgggtttgctaaagctcattacacaaaaatgatatcaactgatatctgactttactcttacattctacatatatattcgacagcatttgcccatgctaaaaaacgaaagcttgtttgaaacgaacaagttttcttttttttgccctccctggtttcaatgcagcaaatttaccgtagctcccgtttcccgagggttgcccagtgaccccccatatctccgcatctgctcttccactgtcctttgcccctattttgccctcttttcttatccccccccccccttccccccttcccttctttttgccctcccccctccccctccccttcccctttcccttcacccccttttcccccacgtgccctgttttttccctccccgcgcttttccccccatctccaccccttttactccgttttctccacccccctccccgtcccc

SEQ ID NO: 1618 - DNA, 472 bp, Homo sapiens
  misc_feature (1)...(472): n = A,T,C or G
tttttttttttttttttgagctcaatgatgggtaagatttatttaagtacagagggaatttggcatttcaggtataggaaatagttcccaagaggtgagacatataggtatctatggatatagaaagttataggttgggcgcagtggctcagcctgaaatcccancactttgggaggccaangcnggtggatgactttttgctgggagtttgagattagcctggccaacatgatgaaaccccatctttgccaaaaatatacaaattagccggacatggnggcaagcgcctgtaatcccagctacttgaaaggctgaggcanaagaatcgcttgaacctgggaggcagaggttgtagtgagctgagatcatgccattgcactccagcctgggcgacagagtgagactccgtattcatctgttgtcttttctgtttcagcaccgaccaacaacttaagccacagcctgggatcc

SEQ ID NO: 1619 - DNA, 775 bp, Homo sapiens
  misc_feature (1)...(775): n = A,T,C or G
tcatcttgtaaacagatctctcggatcaataagcatgaatgtcgaagactacatcactatctatgacacaatccaaaatgagaggacgtatgaggttccagaccagccagaagaaaatgaaagtccccattatgatgatgtccatgagtacttaaggccagaaaatgatttatataccactcagctgaatacccatgagttttttgttgtgtttgtctataccattaagggtgaagagaccagcttggcctctgtccagtcagaagacagaggctaccttctgcctgatgagatatactctgaactccaggaggcttatccaggtgagccccaggaggacaggggcatctcaatggaagggttttattcattaacccaggaccagtatcttttgtacatgaaaactccaggagaatgggagtgtgatgaaggaagatctgccttctccttcaagcttcatcattcagcacagtaaggccttctctaccaccaagtattcctgctattctgatgctgaaggtttggaagaaaaggagggagctcacatgaaccctgagatttacctctttgtgaaggtaaggnctgnctctgacaggcataccctgancatgcagatntnatggctggtgnantatttagcctctgaatgaccagggattgattnntantgcccaggttcttggatctnnttncatatttatgaattagtgggactannnttnnncnttnntngttgancnnnnttntatnnncannnntaangaannnggangac

SEQ ID NO: 1620 - DNA, 842 bp, Homo sapiens
tttttttttttttttttttatatacattatctttaatccacatcacaaccccaaatagtaagtattattactttccaatcactttgactacaatgactgctttacaaatgactgtactcaggctgagaaacatggaatagcctgagcaatattacacagctcataagtggggaacacagaattctaacttatctctgttttttgccatttccggtgccttttaataatataatactgccttttgataccaggtaaattgaagaaatgaaaactgaagtaaaagagtcattaaaatcccaagaaaagattaaaaaataaacacattcctttgtcactggtaaactgagttttttttcccctactttgtataggttgcaaagaaagaacatccaattggaaaaaaaaaaaaaagaaagaaagaaaaagcaatcaggttttattcaatggccagagaatggagaaggggtagctcttgctctaaaggcatattccccgcccccagagtgttgggaggcaggggaatcttaaagttaaatgcgggccaagagagatgtaagcatgcagggggggatttccagacacacaggtggcagtcccaaacataattcttcatttaccgaatgtttacaaatgggataagattttttttagaagaggagatttcagcattatattatttgtcatgatctaagggaactaggggtcattgttccagttgcaccaatccaggagggcttatttttttgggtttgggagggggcacaacttttgaggcctggtttttcaacactggcctttgttagagcgaagaaaaaactgggaagaaattaaatgttaatagg

SEQ ID NO: 1621 - DNA, 174 bp, Homo sapiens
taagcctacacactgctgctgccacaatgtagtacccagacttacttgctcttgaagatgtgtgttccactgctgacatcctgctcctctggctgaatcccttctgcaatggtagtcacagatgctctgtcaaaagtggaattgtaaaactactataaatggatattaagtgga

SEQ ID NO: 1622 - DNA, 248 bp, Homo sapiens
atcaagataatcaacaaatggcactcgaagaaaagaaaatgttattttttgagctgaagaaaaaagttgagacttccgataagatggcatcagaatcacccattttaccatcttggcatcatttctttggcacagaaaagttgattccttcctatcatgaagctaacatagcttgtttgccttttgaaaatttatgctgctattaaacgtcaaaaactgtgtcaaaaaattttttctcgttggcctca

SEQ ID NO: 1623 - DNA, 757 bp, Homo sapiens
gctttgctggaattttcttatacccatgggtatggaatttttctccaagagtatgcctgtcaaaacgacaataaaagctttatgatagagagagatacttcctctgtgctcctttgctgttgatttcctccccaattctcaggattttgtagcatggattgattgatgacttttcaaatgctgtggcctgaagagaaagaatattgtcttcaaattttattcccttgttgttgaacactacacatgaggatgccacttgttcccatgtaaccattagccaaagctgcagtaagaaacttaagagactctccagatctttatttatagaggattgctcagtagcaacgctcagaattccaacatggatggaactctgagccttgaagacaagtagccttgtgttcaaggctcagaaattctccgtgggtgattttaattgaaagagttctcgctatctttcaaaaagccatttgaattgccagctcttactgaaaaaaaatttattgatagctcaagtccatggacaatcagtattgtctgtatatattatgctatggttaaaggcatcttgaaaaatgcaatcatgtctaacacagagagaaatgtattatttcctttgctttttttcttgcatgttgacaaattatagtcatatatatttatgggatacaaaatggtgttaccatttttgaacaaaatgtggaacgattaaattaagctaataaacatatctatcacctcaaaaaaaaaaaaaaaa

SEQ ID NO: 1624 - DNA, 537 bp, Homo sapiens
catgctggccactcttgagaatcacttctctagaatgagaaagtcttctccccactttaaaacatctccagccacttcttctgcagctgctttgtgtttttcactaatttagcttaaaaaattatttacttaacttaaagttcatattagttggctttgtacttgtgatacttttccatagcacgcttgtttaaagtgagcatgactgcttatgaaaaccctattatcagatgtcaatgggaatgtcttcagtttcaactttactgcataagaactacaaaacagaaagcaacgatacaatctgaaataatcctcttgggatcatgtacaattatagaaaaatactgtttgcatgtttaatgtatgatatttcagggtactggaaacagttttattggagcaatcaattatattatcaattagtataattcagatttatagaatttttccctccaatgtacttaatacaccagttaaaatttagaattattgcttaaaacattaaaaaattatactatagaacaaaaaaaaaaaaaa

SEQ ID NO: 1625 - DNA, 1255 bp, Homo sapiens
  misc_feature (1)...(1255): n = A,T,C or G
cctgacttataagctagcaattacagtattaactacagctatcagcatggacaaaaatagttatacagcattttataacagagcattatgttgcaccaagataagggaacttcaaatggcattaacagattatggaattgtgctgcttcttgatgctacagaaactgtaaaactaaataccttccttaatcgtggactcatctacgtagaactaggccagtatggctttgcactagaggattttaaacaagctgcactgataagccggactaacgggagcctttgtcacgccactgccatgtgccatcacagaattaatgagtttgaagaagctgtcaatttctttacttgggctcttaaaattaacccatgttttctggatgcttatgttggacggggaaattcttacatggaatacggtcatgatgaagccaccaagcaagcacagaaagactttctgaaagcactgcatattaatccagcatacataaaagccagatttagttttggctataatttgcaggcccaaggaaaattccagaaagcttggaaccactttaccattgccatagatactgatccaaagaactacctagcctatgaaggaagagctgnggcnctgtcttcacatggggaataatcatgctgaattgctggatatgaatgctgacatgaaggccataaccatgttacatgatagtatgatcaacatgaatgaacagtgtttttgattaggtcgcgcgttcgatattgtactgttcgatttgtgatgatatttttgtattatttgttgattgcaccagcaagtacatgtcatagatggctaagaaatacgcagaattctgacacatgagaggtatatgatagaggtaagacgcaaaaaataaaatttaacaaaagataatatggttgtttttttgaatttttataatgcaagttatctttttgatctcaaaatttgtgtgaatgttatgttaagtatatatttgatagaaatagattagatacgccgtgtgatagcgtgagaagtattctacttctgtatataaaaacttcttattaacttcccgaagatggggtgtagctgatcctaaaaacagccatacctaacgacaagtttgatatcgtcatggatacgctattgtctgatattatcttaaagtatttaatggtatcaattatagattatttgtgtttcggtcgaactaatatgtattgtgagagattatgtaaagtacaaataactgaagcgttg

SEQ ID NO: 1626 - DNA, 1086 bp, Homo sapiens
tttttttttttttttttaggaagacactattttaatgtgttgattaatcagacaggtgtttaaaagcatttgttagagtcaattcacagaaaatctcttttacatgcaggttacagccaaagaaagaaataatagccaacacatttacgatttcaattgcaaaaattgtcatatttttgaacttgtgtgggtatttgaaaatattagctcctactaggtccagttaaagcttttaattctataaggtttcagactaccagctgaccactgctcagcatcccctggactccaagggtttcatctaagacatctaaggagaatgtctacccgcacatcgcactaatgcccatgactgcactgcttgaaccatgaggttattgaacagaaagcaaatccttttctgaagagcctccaagatgtggatatttcagttaatttcagctccctgccagctcagaagaatgatgctgtgctgtgtgctgttcccatgaatactacacgcagggcactgctcagtgactcagccttccagggagccagtcagggttttgaagctgcatcgtccctttcatccttgaagttctttgggatttcatcaatggcatggagggatatttttaaaacaatggagatttttcaggactggcaaaagggctcccctcgtcacagtgccaaaaccatcacaaacataagttatgttaaaaaaatcctaaactaaaaatatctggtacttagggaactaaaagacatctcatgtttgctatcatttccatcagagctcaggtcaatggacagagatcaataccaaaacaaacatgcatacttagagcataaattcagataaatgcaagaaaattaacatgtagatagaagtaccatcatgcctaaaacaaaaactcagtccaatggttgtttcagtgaactgactagccttcatagagaaaagtttattcttttcaaactgaagttaaaagatattcggtgcttcattcgaaattttctatttcatgatttttgaagtagtgatttagaactctttaggactatagtaaatcattttacttctaaaatgtggtaactcaaggc

SEQ ID NO: 1627 - DNA, 1319 bp, Homo sapiens
cttgttttgtgaaacccttgaagttcgctgtagaactgtagatcttcacagagcacaagtagaaaaccactaaagaagaggaatctagatctcaacagaagatgactcttatgtaaccagacagaaaaggcagaaagcaggctatgattaaaaaaagaaaatgtgaatatgaaagcagagagtgagagtgaagaaggcacaaacagaaggacattgggaacaagcagccgtttttcatcatcataacagactcaggctggctgatctgactatgaactgttttgataagatgaatgaccagaactcccaatactacttgagtagaatcttctcctgtcactacaagaagaggctgtgaagacactgtttgaactcagaccatcaccaaagaacagtatgattattgactttcaatgagtttcttacaattttatacctaattactatgctgtacaataatgattatgtagaccattaaatgtttcattaacattttatgtcttttatttgattagtacaccaaattctactcatgtgtgctctgtgtgcatagttccttaaacatacaacaaggttttctgcccacagagcttgatcttcccttgtttggagataaaattgaataatatgtagtctgtttttttaatctcctttttatagccttatgttggagtgtagagtatgaactaccagaaaaaaagttaccagaaattccacattagaatgtaataaatactaatctaagtattttaagaaaatgaatattctgggtatttgaatagatggattgagtcttttggcaactcagctccagaacttaccagcatgtagcatgagtaggaatgttctcattctgagttacacagttcagttaaatttagggtgtgttagctggcagcatgcattaatagtggtgacaacaaatagaaggatgtctttctaaacaacataaggtaacctgggcttgagaactttataatactttattcattctctttaacaaatataaaagatacagctctatattatagataaaaacatttcatgtacttgataagatgtagattttgggtaattgacttgtgattataaatttaaatccagggcccaatatccatttgtttactagaaccacatcaatcactgccaaatataagttgttttaagatgatgagttaaaattgagattaaataatttgcatcgttaaattaagtttaatgaaaattgtatttgaaccctcagcttttaaaacctagttctgcttagcctttgaattttgtaaataaatttgacataatgaaaaaaaaaaaaaaaaaaa

SEQ ID NO: 1628 - DNA, 1120 bp, Homo sapiens
cctggtgacaacactgacttgtccttatctggagaggctctggcttgctcagcctgctgttgagtttgcaatgagagtgtaaagtcaagacagctacagatgctaacaggacatggacaccttttcagataactgacttcatctgtctgcctgtttatgtggagagctgattatcagccatgtgcaaatactggggaaccgatctgatctctgtgatgttttacactacaggcgtgtcagagccatctttctatccaacattcactcagcgaggcaggaaatataattaagctttcatgcatattcccatggtaccctgcacagtcaatcattgaaaaaaagtcagtgccacaagagcttgtttgtttgaagacatcacctaagaacttaagagctctgagaggcaggagaagggatgtaagccatgtgaggcatgggtaggagtggtgggttccttaggggcgtgaaaactgggctcaaggtgattgtgggcaattattttgcaatgcacataaagtatatttagtccaataagcacaatccagagagtttttcatgggaaaatttcactccaacattgcagtgcctaaaagaatgaaaattacttgaaaatggtcagtattgctagagtataataattgcttgttaggccaaatctattgtgcggaggactttacagaaaatatttatagacacttttaatacaaagaaatgttataggaccaagaattataatatctaatttgaattccagctttgtcaattattgtgtaaacttgagcaaattactgaaccactaaaacatcaatttcttcatccataaaataggtatggtaagatataatcatactattgttctgtggctcaaactaaacaatgtaatatatttaaagtaactcatagactacctagacctcaataaaaagtgattggttttattaatctttttgttgttattcacgaaacactagttcaaatacatatagtgaatgcatttagaaagctatacatactagactctctttttgatagttacagtgcatgtacgaattttaaaggctctgaaatggtctaagttaacaacaataacaaaatagcaataggaaaaaaaaaaaaaaaa

SEQ ID NO: 1629 - DNA, 533 bp, Homo sapiens
atcgatcagttacttgttaatgccctaaggaaatgaacaaaagaggggtgcgttttgatgactgactacataggatgctggttgagagaaacaggccctagatgtaccgtaaaccaccaagaaaaacaaagcaaacctgccaaggctaaccacacatgaaatggtgaaaaacagaaagatggactggctgctgtttcaataaatagcaggtagatgaaggacctaatggacttgtagctctaccagagagaatggacaacaggatatgtgcagctttaagaagaccagcgtcgcattctgttgcccaggctggagtgcagtggcatgatcttggttcattgcaacctccacctcctgggttcaagagattctcctgcctcagccttccgagtagctgggattacaggacactccttacaaggttatgaaagaagagagagacatactattgtaaccctaattccctcataaataaataaacttttaaaataaaacgatggcctcgttggcctcagcggtggagctctcggccg

SEQ ID NO: 1630 - DNA, 225 bp, Homo sapiens
atctgggagcgaaggactggtcgtacctcaatgcactgctcgccctggcagaaatgacggccttctgctcctggcacaaagctcttaagtctcagaatgaaagaaaaaaaaactttctagatacaaaaactacttctcagtaacttgcaaatgtcagtgtctttaaggaaaaccagcaataaactcttaaattacatttaatgtaaacaatgaaaaaaaaaaaaa

SEQ ID NO: 1631 - DNA, 354 bp, Homo sapiens
tggatcacagtccaatggtacagaagggagactagcaatagtcccatgcaagtcagtggagaaaggatggattattttcataaatgctcgctggaaataaatttgaatggaaaaaatgaaactggatcacgcacaccatgcacaaaaattaattatggctcagttaaagactgtacgtgataacatgcccagctataaaacacagagtacaatgcagaaagatcaatatatgactttggaatggaaagatttcttaaataagatgcaaaaactgttaattatatagaaaagaatgatcaatttgaccccattaaaattaggaatttctgtgcctgggaaaaaaaaaaaaaaaaa

SEQ ID NO: 1632 - DNA, 133 bp, Homo sapiens
tagatgctcaaccttttctgatgctgactggaaattaacctcgttaggaaagactgatgcatacagaggaggacattacatttcctttaatcgttgtaaaaaataagacatataataaactttcatgagacaa

SEQ ID NO: 1633 - DNA, 1000 bp, Homo sapiens
agatgggaaaactggagcccaaaggatggaaatactgaacccatgggctctgtcactagactgcatcccagggcctcaacataatatattcttagtgaaaaagcagaatgatggccaggcgagttctctggctaggaagaagcccagctggtatacaccatttttctgcacttcccctgggcagccagatgactaggattcaaggaccagcctaccactttctaagctgtttgccttggacaaatgacttattgcctctgaacttcactttactcacctgtaaaatgaggagactccagaagaatgagaagattccatgagatgactctagcagatccatttcagaaaatactctgcgtgtgaagttattacaaggaacttggcaggcacactccccttcacctatggggcttttcttttttcttccatgagagcttctacccagatatgcagatagaagaaatgtattggtcccaaagacaacaatgtctgtgaagcaggattcaaagagatgaagggaggggagaacaagcctttcaaattatagcaagtgggtggtcttcaactgcttttacttctttttaaaattccagatcatactggggtaacctattagaaagaaccctgtcctggaatcctggaaaagaggccctgctaggagctgaccttggacaaatcactcccttctctgaacctcactgttcagggggctgagaacagagggtccctaaggaagagtgttgtatgagaacagtctccgctcttgacccaagcaaacctggcttcaaatctcaactcctgtggctgactagctgtatgaccttgacctttctcagtttcctcatctataaagcaggattaataaaaggtacctatctaatatgactgttctgagaataaaatgaaataaactacataggtgatttgacattgtgcttggtttacagtaggtgtttaataaaaggaaattgctatattaaaaaaaaaaaaaaaaaaaaaa

SEQ ID NO: 1634 - DNA, 937 bp, Homo sapiens
cctgatgctctctgcacttggctggatgagagatgagcaatgctctggaagtgctgaagccctgggctcttggagctgcctgcctgaggctgagctgtgtgggaggagaagaagaacagcaacagcctggggagacaaacacacaaacaaacctacaaacaagggatgtgtttgttactgaaagagaaagggcccattcagctctaggccctagatgctcaatgcttcctccaggcctggagcccaggcagctgtcacatttatctatccccaaagccacctgtgacccctggctgctgcacgggaggtccctgggcctgcaagggtgggggtggtgaccctttccctcatggctcatgggttggctcctcaggccctgtcccatggcctgggtggggtctccttctccttcctcttcctccactcggtagctctattcttatccttcacctctgaagtcccagggacaaacagtggggccctctggatgaagagagggcttgaaatgctgatggctggaatggagagaattattcaaaccatcctggggtgagaaagaggagaaggcaaagtaacattttttgagcacctactatgtgcttgacacactgctgagccatttcatctaatacttccagccaaaaggagtggcggctcagagctcgagcagctggctctgactgacagtgcattccctttccaggaaaagatccaccccatggggctgtgatgttaagaaacaggacagggaagcataaaggctacagtgagtgagggagtagctgacacacagtagtgttcaatagatactgtgcccccatcctgagtccctatgcattttgtagaagacttgtttaatggaaaggaaaaaaccatgctataactgatccatttattttattcaataaatatttactgagcaaaaaaaaaaaaaaaa

SEQ ID NO: 1635 - DNA, 185 bp, Homo sapiens
ccactttgaagatatgaatacaaattggagaggaaggtgaagatgagaagcaacaccataaggaaaatgtgtatctttgtaaaagctaattgtgatgataattactttctgctttggaagcacatggataatgttggctcttacaatggaatttgttcaaagaaataaaatagattgggctattc

SEQ ID NO: 1636 - DNA, 1740 bp, Homo sapiens
  misc_feature (1)...(1740): n = A,T,C or G
atgaagtacagcatataaattctggcaagttcttgaaatttggaaataacatgaaaccatgaagattttcctaatgtggtgaaaagaacacttcagccaaaataagatcacatttggcagtcactttacagaagaaaagagctcttgaaaaaggtctgcaacgcactttctatgaaacaggagagctgctggaagccaagaaatgaaaagagaatggggaaatccagacagatttatgtatatattaagggtttatcttggaggttgaaatcacaattcaagaggaaattcttcatgggacattctaaaggaaagtaatgataactaatgtacccaccagaacctcttctcacgtaaaaattgccgctgtccccagcaaattccgtcaatcattttacaaatgctagcttattaaagatataccaaaaagtaggtaactagggctaaatctgagaccatgatgtttcagagttttagatttattattgtgaatacacaggagaaaacaaatttaaattttgtaatcacatttgaaaagtcagagcatcactttgagggtggcattgagatttatggccagaagtcaagttcagctttaagtttaatgccattcagcctgtatctgtgtccctgcagctagggtagctagctaggttcctgtttcttcttggacaaccatctctatcatagtcatttatttctatttttaaatatagcttggtacatgggtttatcttaaaagtacaacacatactcagtttccaactatttcaagatgaagttcataactaaatcacagtaaggtgtacttttcctagaatattttgcattgcccaaagcctttccctttaacatagtacaatgaagcctaggatgtgagcttttatctagtagctgatttgcataatgtaagtatgcacacatacatatatgtaaatgcacatatgtgtgttttctgaaatgtggatatctgttacaactgggttcttatgagaatgattgttgtaaagggactaaatgttctttagattgcattggtagttgcataaaatagacataggggctgattcgtgagaaaataagcttgtgtatataataatggatgacatccattctttgtcattgtctatgtaacattctctgcctaccctatttttaactcccttcaacccattttccaatatggcgtagcttgaaattctcactctaaaaaaaatccattcactagcatgganaatatatcagcatataaatttcaaatatagtgaaaatatgaataatatctttgaagtaagtttactagttgaatagctatgttaaaagtaattgtgtaaaacagatactagatttgcattctaaaactcatagagtaacaatgttttcttacataaagtttttggtataataggttttacttgaagaggacgaatttaggaaagtctcattttacagtaggtttctaaaaggactttaggcttattttacatagccattgatttttacagatcattagactgaccacatattattttaatctagctgcatttagttaaattggttatttgtaatgtttgtgacttttgctaacttaaattgcttgtttattagcatacgacctgcataaaaataattgttattgaagaatatcactaccagaaattgcaaatattatcactatgatttaaaaattaagtataaaaccaccatggaatactatgcagccataaaaaaaaaaaaaaa

SEQ ID NO: 1637 - DNA, 389 bp, Homo sapiens
ttttttttttttttttttaaaataaaaagtgtttattatctcacacaatttctgagggtcaatgaatataggagtagctcggctggctggtcctggcttagggactttcttgaggttgcagttaatctggcctccagggctgcagtcatctgaagtgttgattagggatagaagatctgcttccaagatggctcaatccaatgacttttggcaagggcctcagttcctgctgcctcttatcaggagcctcatttccttaccacacaggcttcatacagctgttcgatatggtagctggcttccccaatcatcagctttttcttgactggaacgttatacatgcctaatgtgatcacagcacgacttagtagatgaggcactcattatct

SEQ ID NO: 1638 - DNA, 610 bp, Homo sapiens
cctaggacattccagacactgtgctgctggcctttccttcaagttgcagagtctgcaagtgacgtgaaaccaacaagtgttcatccattctccctaacaaataggctatttggtataagagacaaaaattgtgaagtgaaattacctttctgttacaagtttctaaggacaattaattttaggtggttggcaaatacaatgtgaaaagaagtggattgttaagtagctatgtgagttcagcttttttccccctcctaatgaggcacttaaaatcttaccttttaagtatattgcttgattattgtgaattatgtttgcagtgtgacaaatatttttaaaaaacaaaggattttcatggagggaaatcaaatcaggaataaatgtatgggtgtgaaatcctttcattgctacaataataggataatttatgtaatacctcaagcatccaaatcttttaatagcttttttgaaatataaaacactgaaaaaaatcagttatgcctgttcccgcccttactgagtgtttatttgaaaaacttcttgttccgttaatgttctcttgaaaaataaaagcagccttgtctggaatgaaaagaaaaaaaaaaaaaaa

SEQ ID NO: 1639 - DNA, 795 bp, Homo sapiens
agatcttataaatacaccagggattcagtctaggttctgatgctcacttcaccatcattgagatgaagaatattgccagatgtggaacctgcagatgcagggggctgacttaagagacgaggatccacagacgctgacatccatgagacacaagcaagaaaaaacattcaaagataagagtttcatgacagtagaagtcttaatctgtgaacttgggaaaaactgttcacattaaggatgctgtcttctctttgggagaaatttccctggttagctttacctcgagggtaccaatgggtgcacagttccaaaagtgtggaaggacccttctcagttgcaagaccacgaaccgaaagcccaaggtcctgaagttttgttatagtgtggatggcaagcatagtctttctccaatattctcggaagatccaagccataagaagctttttacctggcgaaaatacactatagcataataatctgcttttataacatcagccctcttccatgggaaagcttttagacaagcagaaaacatgcattgaaaataacaattgaatgaaatccctttacaaaatgtttaaatgtcccaccaggtgaccaaatgtacctgaagctttgtttttccaggaatatgggatcaagcattggttataaactatttttgtaagttgtaagtcactacaccaaagtattcaatttggatcattatatcttttccataatgagtcatggaatgcagaacttttaataataaaagctttaaggactcaggaaggacaaaaaaaaaaaaaaaaa

SEQ ID NO: 1640 - DNA, 445 bp, Homo sapiens
tgttgtgcgcgtgaggctggtgggtagcggaaggagccgccttgccgcatctagaattactggggtgcgtgggtggataatacatagaatgagttagtaacttcggtgacaactctatctcacaggacgtttacctcttaaaagtgtattttggcctggtgtggtggttcacctttgggagactgaggcaggagggttgctttaggccaagagtttgagacaagcctgggcaatatggtgagacaccatttctaccacaaaaagaaaaaaacatttagccaggcatggtgacacacacttgtagtcccagttacttaaaaggctgagttggccgggcgcagtggcccaataggtgcctatcagaaacgcaagagtcttctctgtctcgacaagcccagtttctattggtctccttaaacctgtcttgtaaccttgctaccttaag

SEQ ID NO: 1641 - DNA, 538 bp, Homo sapiens
ctactgagaaacgtgtgatcccagagcaagcgctaccattgttatgaagtaaatactggttatggtaaagataaaaataatcaagttaaaaccaggaaaaaagtatcagaatgctttctacatgaacaggaagactaaccaacgttgaatggcagccagtcttatctccgtccttatcaccaccttaccatgtcatcctggcgaagatgccatcacaggagtcagggttgaagtccaggtttaaggtgcatctagatgggttcccaggacgcctgaagtagcctcaagaggcccaaaagaaaaagctcctctggcacagtctcctaatggtgacaaaggagtccctctcatctgcttggcagccttacaatcagagcgttcttacatctaacctaattatttcccactgaaattcaaacctaattcatttattttttattctctataaaaatgaaaaacatcactgtggcaagtaacttgctcaatttctcacagaaaataaagaaaaggtagctggaatcaaaaaaaaaaaaaaaaa

SEQ ID NO: 1642 - DNA, 821 bp, Homo sapiens
  misc_feature (1)...(821): n = A,T,C or G
tttttttttttttttttggattaactacttgtacgccttagaatagaaatatatagaagaaacttacctaaatatttctcaaaggccttatgttcaattatcttttattttagcatcatgattccattaagtgttcttatcaattacctagattgttttctgtattctttatactgacatgcccaccacacgcccacgtttttaagcaaagctaccttcattgtattatctgtattcttccttagaatggtcttctttcgaaattacttagtacttgatagtatctttttctgaaaatttccaggcttcaaaaatgctcttccctatgatgttctagaacactttaaatctcagtatttcagtatttaaaactctagatttccttgatgaacaaaattgaacacttgtatttggggctaacttgtggccaaactacacttcgccaattctctgatttcctggcatctgctaacattaccactgtcattactggctttttgctggtggtgtacacctaaaatttctgatattaaatttttaagagtcagtaaaccccctggattaaaaccaaaggggactgatnttaatgggccttttggtgggcagagaacttaacaaaagttcatgtttgtttaatagaaaattagacttccaatttttttgattaaatccctctgtgaataacaacaatttttgggaagggtgccctcaaagaagtgtttggatatttaattcccaaattgtacaagttctactgttaaaagctctttggccctatgaagacccccaaaataggaatcttaaaggggatacaaaaagtt

SEQ ID NO: 1643 - DNA, 572 bp, Homo sapiens
aagaggacagaggaaggaagtggtgctaatgatactaattcaacccttgtgcctgggcaagagctttcccagaagccaccaaaaaagatttgtgttcctgtaccaagatatctatcacaggacaggtctccattgcaagaaaatctgacagaataagaaacaatctcaggataatgcagtgctagcccactaacaagggatggattcgaaaattaatccctggtctacatataccaaagtcaaaactcttctcataacacatgaccacccccatgaggagatggattgctacacaccagggaaacaaacacagtgccctcaatggaataacagcttaataaatatttgctgaataaaagaataaagaagtttcctaaaaatataatccctacatgaacattgttttatattttgtttcttgttggtgatatttttccacctttagttatatctctatatggctgtggaacatagaaatgtattcaataattggaaatcacactttctcatacatgggaaattttaggcaatatgctaaataaacaattttaacataatcaaaaaaaaaaaaa

SEQ ID NO: 1644 - DNA, 370 bp, Homo sapiens
catctgcctcctgtgtcccctccttccctgttgtacggctaacaccagatcccagtctcttcagtggcactcaactttttcaagtcacaagatggaagcgctttggaagaggagtaaaggacctggactctgattccatgccaccgcaaactcgggcaggcacttcaaagcagagagtctcattttccacttctgaaaaacacatggtctagatgagctctaagtcctttgcactcaataatttcacagtcttttttattattaatattattttcaattgaaaaatcataattgtatatttatggggtacaatgtgatgttttgatatatgtattcaataaggaattattaaatcaagataattaacata

SEQ ID NO: 1645 - DNA, 774 bp, Homo sapiens
tttttttttttttttgttgtgagtcctaaatatattatcgttcaaataatggatggtacgtggtaacttccacaaagaaaaattctagaattattttaacagtaagcaaattgcatttcatctttaagtaatatggtcaaataaaaaaggtacagggaaaaaagtgtctatatattgccctgaaatcctcttggcttctttaaaaaacatttgacactgcaggaaaatgctaattaaaggaagacaaaagttgaatttggattctagtgcctcataggactctaatttctgtgaatattgatacaacatgtttttaaaacactttagtaataaagctgtgttctgctggaagtggcagaaaggcaaattgcaggcaggcactgaaaatagaaaactaccgaagataatcacaggtttgttattggaaagggtgccttaaccttaactctgggccaacgggctcaaccatggctcttacactaaggacaactccccttgatttccagcgaggaccactcccgaggccaagttggaggaagatcttcaaggggaacatggggccttctccctcttgttggaatgttcttgaccaaaatgagggtgatgtataaaaaaatgacccaagcccttgttctgtccccttaaaaagtaggttacttaccgctgcgtttgctgctctcgagcgcaggcaaacctgtgcaactacccagccctaattttcggaaaccaggcgtacacttcaactgtgcgggagcccattgagaaaaaaacgta

SEQ ID NO: 1646 - DNA, 453 bp, Homo sapiens
cctaggatttcactctgtcacccagcctacagtgcaatagcatgatcacagctcactgcagcctcaacctcccaggctcaagtgatcctcccaactcagcctcctgtctctgggactacaagcatgcaccgccatgcctggctaattttttaagtttttgtagacatggagtctcactgtgttgtccaggctggtctcaaactcctggatctcaagtgatcctccctctttggccccccaaagtgctgggattacaggcataaatcatggtggctgatctgcattaaatttttagatgaatgcatttaaaatgctgcctttgtttcctctatctttccagcaacaggacgatcacttaggtgtccatcttgttcagtactcaaaatttgttttcattttttcttatttgatttacaataaaaatattttgtggtatcagtaaaaaaaaaaaaa

SEQ ID NO: 1647 - DNA, 136 bp, Homo sapiens
ctcaggaggatggtccttgtgtgcgactttttatattactttgtccgaaaattcagcatgccagtggaaactaatcaacttgtcactgggtacatggaaagataaataaaaaatctgaataccaaaaaaaaaaaaa

SEQ ID NO: 1648 - DNA, 831 bp, Homo sapiens
  misc_feature (1)...(831): n = A,T,C or G
ttttttttttttttttttatcaaatatcactaaattctcctgcctctgtgggtttatcctttagtctatacatttgaccaaaagtgcaacacatcaaggctgaacaagctctgctggttgcctgattccaaaaaaaggaatcaaggatgtattgcacttttgttacccacagattatgagtcttgaaaactttcttttttctcatcaaatgtttaacaaggatgtcgttttaggatcttatcatgggaagtggtctggaaatgtgatctttattcttctcaatctctgcttccacaaacacaaaaccactttggccgattcaaattaaggtttgactgacttcaccaagaaacctggaaaaaaacctatgatgccagaatgctaagatttcccttaaaccattctgtgtattcgcaactcaatggtgtgcatttagtaacaacagcaggctcagcctgttcagtcattaataaatgactgggtgggaaaaagtccatgggcttagtacctaccaagaaaaaatgaagtcgaggggaccttgattcatcaatgagagtggagtgaacttatattaaatctctagcacttacttacaggataaatgtgagaagcccattggaggggttaatcaaaataatttggagaatatttatggcagttcgggaatcgatagtggcactaagaccaggttggcggagggcttatgggcaaanaaatcacgggtttaccacgtgggttttccaaaggggtcacaaaaacattttgggcttttcaccattgctaatgaccttaaacaacggcactggatatacgcctttaaaaactgaaaaa

SEQ ID NO: 1649 - DNA, 885 bp, Homo sapiens
cctgggaggtctggatgctgactttgacagccaagtacagaaagcttgaaaagatcgccttaattctatcagagcatgcattttgtggatactcatccttggaactcaaattcgcacacacggagagactcccgcacagagaagaaatgagcaccctaactgacagccagcgtggaccatccatcagcaatgtgactgagggagtgagccttcagatgactcttccagcacccagtctcccagttttcctgctaaggcttcagacatcatgcagtagagagaaaaagccattcgtgctctgccctgtataatttcggaccgagactataagtggttgtcttagaccacatgttttagggtaatttactatgcagccatagtgactggaacatacttccaagtaaatctagcagaaaatacaataatatttttgtttattttctactcatatgtaagagatgagccttttctctcataaagaaatagtttctataatgttatggtagaggaaaggggcaagataatccaaacacactgaagggagctctaagtacagggaagaacatatacatattatagccacaggtttttttttttttttttcttcaaactcatctattattttgagtatgataatactatgtctgtgtatgacagaaaaatttaaactttgtcatcctctgggagaatgttcaggtaaattgaaggtatttcggaaattcagactaacaaatgcgtggctaattataggcatacatttcaagggaaagattttcaggtaaatacaaatttgttttattttattttattaaattatcccttgattattaacaatttgttgtttgtgtaaataaaaatagttactgtaaaaaaaaaaaaaaaaaa

SEQ ID NO: 1650 - DNA, 700 bp, Homo sapiens
caggtctgagtggatgtgcacactatgcttcatgtatggaagaaatatctccctctgcccatctccaactcaagagttccttgaatcaagagaagcatgacttggcttaatgaagatagtcagttactaaacatacttagattactctatgtatacagacagccatatatgtcatttttcctgcacttttgggtaaacattttgttaagaaacatttaaaacatgtataaaggtagagataataattactcactcccctcccacctacctgtcattcaacttctacagctgtgaacatatgatccaaatgagtttatctataactctcacatctccatcccccaggttatttagaataaaacttggatttacatatgatttaatttataactatgtcagtgcacatttctaaaataggactttttttaaaaagtatttttaattgacaagattgtatataattatcatgtgcaatatgctgttttgaaaaaaaaaaatacttcaatcaattatcacaacttcacatcattaaatatctcattagtttgtaaagttacctcattgtcacataaatattttaaagagcttgtatgaaaccatatccaaattaactttgtatattgcaatgagttaatgtttattaaatctcatttaatttataaaaaaaaaaaaaaaaaaaaaagaaaaaaaaaaaaaaaaa

SEQ ID NO: 1651 - DNA, 346 bp, Homo sapiens
catggacactttgaagaatcctctcaacttatggatactaatccatcagctgcaaatagccacacaaatgttcaccacatgcatatacaggactatgaagctttgtacgatatggagttgtattagggactcaggcctgggagaacagccactgcccagacacgttcagcgacagataaaacagtataacattttgcaaaggcaaattcctcctcttctgctgtagaaaaacttggtttcttctacatacacactgagtccttctgctcataatgctggtcctaaacaccttaatccaaaagcagccaataaaaagtttttaaaagtccaaaaaaaaaaaaaaaaa

SEQ ID NO: 1652 - DNA, 400 bp, Homo sapiens
aattcaggcaccagctaatgcagtacatctgtgagcagtcgcttgctcctcacagcaggaccatgggattgatgccgtcattaccatcctccccatgttatagatgaggatattgaagagaggtgacatctaaatgcaagctggtatcctggattagatcccagaacagaaaaaggacattggtggaaaaactggagacatctggataaagtctggagtggagttaatagcagtgtaccaatgttaatttcttagttttgatgaatgcactaggtaatgtcagatgctaacattaggtgacactgggcaaacagtatatgggaactcttgctgcaactcttttgtagatctaaaattctctcaaaataaaatgtttaaaaataaaaaaaaaaaaaaaaaa

SEQ ID NO: 1653 - DNA, 354 bp, Homo sapiens
agtgtagaaaaaagaaacattttctttctattacatcaagattcatgtttcaatctttggttacagactgatggaatatgaaataagaaaaatggaataaggaggagaaaaatgtttaagagaatgaatgacaattttttctatgatattttaatttttctttttaaagcaatgtgaaaatacttaaaggaagatataaatttttaaaggatgttacaattttgtgtgcttcttattttaatatgttgattttcggatgttacaattttgtgtgcttcttattttaatatgttgattttcaattgctaccacatgtaataaatgtttcctgtatttcaaacaaaaaaaaaaaaa

SEQ ID NO: 1654 - DNA, 360 bp, Homo sapiens
aaacaaaaagttggcccaggaaaatgcaattgggaagctgaagaagattatagtatttctggcagtcaagatttggaaagttacctactaagaagctacaatatgctcaagatactactatatcagaataatttttacctaattaagagaatgaaaattttatttactcaaccaaatagtgagttaatatataggaaatatatgctctgtatcaaacagaatagaaaacaatggcattgagatgtataccagtgctctcataatgactgacctgtcatgtgtaattgtgtgttattttctatatacactccatctgaatgagcaataaaactagcttgaggaagaaaaaaaaaaaaaaaa

SEQ ID NO: 1655 - DNA, 427 bp, Homo sapiens
acccagaaaggaaacccaaatgtatccactttacgcattcaaagccttgactttctgagctaatctttcataaatggctcttaagggagggtctccttccttccttgggtctcacccagaggttgcccctttgcaatccacattgatgaaggacatcttccctgctggaggacacgttcctgcaggagattctttgaagagcaaacaccaccctccagccttgaaatgctggcgcggcttcactgtgtctctaaatcaagctttgtccacccagacaggaagactccaccctgttgtgacaggcacaatgtggaatttgtgcttcagtgagcttcagatgattttcaaccccacaccttggatgtgtttttgaaacaatgtgggatataaataaataaaacatattaaccaaaaaaaaaaaaaaaaa

SEQ ID NO: 1656 - DNA, 185 bp, Homo sapiens
atatggtgcataattggagatggagcatgatggggagaagtatgaaccagagacttttggaagaagtctgaattctgtgtgttttatatacatttctcatgaagtaaaggagacgatatcttcctcaccagcaggaaaaatgaggtgatcaaaagaccccagagcatggtacaaaaaaaaaaaaa

SEQ ID NO: 1657 - DNA, 436 bp, Homo sapiens
cctaggctggagtgcagtggcacaatcacgggacctcctggattcaagcaatactctcatctcagcctcctgaatagctgggaccatagcagcacaagccctgtaagaatgtgagagcgctcaaggatgttggctactgggaataaacatttgtgactacaacccacaaaacaatctgcacatggctaatcaagagaagactgcattttcctatttttgtttatatcataccagtagaacattgtacattaaatctataatgatgataaactgcccattgggattttcttcattcttgtaatcacccttaggactcaaaaaaatcccgtgagtttgcacttttcaaattctgttgtgggaaatgctgcaattaggtgctattgaaccaatctttgaaaattaaaaatgctgtagaaaaataaaaaaaaaaaaaaaa

SEQ ID NO: 1658 - DNA, 847 bp, Homo sapiens
cctagaatgttctccagatatgcttctcattggaaacggtgatagaaatttgaaattgctctgagttcataatgaagaatgaccaacatctattattcatcaaatgaaattctccactaaacaaaatcctgacctttgtgaaagtgcttctttgactttttaactaatgcaataaccacatgacctttggtgctcaaaaacccttgagtggctctctacaacttctgcagattcttaagagttgggtacatgaaatagctatttctaggtaaagtcaaccaggccagtgtgaaaataaggtttgataaattatttcttccagtattagagtttaaatatgaatttctaggatcttcctgattttcaccattgtagcaaatttatatgcttgtgttaatttgtgagaattttaatctgtacattatcaatatgtaattaaattctacttggttgaattaaatctgttagataatttgggacagacatcaaatttgaatggcatttttactaagttgatagttgttttactgacatggctggcattggatacaaacaaaatctccctagtgactgtaagataatttttaatacattgtacttcattttgtgtcaagccaaatcttatttaactagctattgcatatctagtgacaacagcaggcatcatttgaattcaaaatccaacattgtcccacacatgaaatactttatcctttacctttaacataactgtagactttggatcaaaacaaaacgtgcatatatgtaaaaatattacaaatttttttgtaatgacttttttaagtaactgaataaatcacatagagccaaaaaaaaaaaaaaaaaa

SEQ ID NO: 1659 - DNA, 515 bp, Homo sapiens
tttttttttttttttcttttatgcttttattttcttggacacattaaaatggagagactttaaataagatttggagagcctcttgaaataccacaatataacgacatatatttattgtttgacctatttccccctataatctgactcacttttaaattcttaacgcttcttaagtgacctttagtcactgtcagattgccttttaaaggagtttactgtatgataggaaagaaagtattaaaaatgaactagagcaatttggctacatactacgactcagatgagagatcctagacttcagggtcaatcagaattaatttcttttctaaaatggtatgaatttaatgccacctattgagaagtaagacgtatgtgtggaaaagaggactgtgatgaaagtaaaacataatctagggccagacatggtggctcagacctgtaatcacagcagtttgggaggtcaagttgggaggatcaatagaacccaggaaattgagaccagcctgggcaacatg

SEQ ID NO: 1660 - DNA, 438 bp, Homo sapiens
cctgtgtcctgtccatggctgcattcattggccccatctcccactgatgttctctgaagccatgaggaagcagtgggactgcaaacatcccagcgctgtttttagtaatctaatgtttgcctgtactcatttcatctttatctcacctgagctttcgagataataattttatctcagagagagattgaagtccattctctacaaactttgaaacaaaattatattgttaggtttaagaaatatgatatacaataaagaggaagatgatagaattgttttggaggattttgcctaggctactctgttattaatgtggctgatatattaaatcgataagaactgataacaaaagtaatgttcataaaataaacttggctaagcataaaaaatgtaaaagaaattaataaagcaattctgtagaagaaaaaaaaaaaaaaa

SEQ ID NO: 1661 - DNA, 724 bp, Homo sapiens
atgcgcccagaacatgtttctaaagacacctcgcgcaagacgatctaaattgcaccccccggggcgccggctataatgaacggaatgaccatgttcaccagctcatgccagcgcattcagcaaatccgccaaatccacggcttacaggttaacaagtcggaaaaggccgccagaaactctcaaaaccctcacattgctccatgaaataccgctttctctatgtgcccctttcctgacaggctgctaagccaggaacaggaatcttcgatgcatctttttcaaggggcccaattttaatttttgcccataagatccttgcttaacaccaatataaaagtaaatgtacaagtttttttatctgtaaaaccctaagactgcattaagaatatcaaaggtacggtgttcaacgcaaatagagggaaatatatggtcctctgtcgctgggatatcaatcatcccccatctatggtaatgattgagatcaaatctacaagtggaagaattcgcttcttattaagtcctcctcattaaaagtgattccagtaaaaaacaaagttggggaagcagattataacgccgatttttcaattctctttaacacagttattatctgtaatctattcctaagtcctatatgacaggcagataatctatattattcttacccgtttataagaatacttaaaagattaaaaaagttttaatagaaaaaaaaaaaaaaaaa

SEQ ID NO: 1662 - DNA, 332 bp, Homo sapiens
aaatcacaccatgcagatgttatcaagatatgaagtgccttataaatatcctgagtatcaggaaggatcccgccctccttggagctgagccctggagcctcacggaagtcttgcgatgggacaggtgctgctgaagggcatccgcaggctgatagcaaagaccccatccggatgccatctcttacaatctaccatagtgattatgaagatgatccctggttatttttcttataagaaatcacctcaagccagccagttgattagaaatattgacaggtattcacagaataaatttaatttgaattcctaaaaaaaaaaaaaaaaaaaaaaaa

SEQ ID NO: 1663 - DNA, 657 bp, Homo sapiens
ctaggtttgcatctgaacaaagtagatgaagttctctagataaattctatgatcttctccagagctacattatttattttctgccaatttttacttctgaaattagagttttcttttgatcaaataggtacgcagaaaataagaaagaaaagccttcaaatcaaggttacacatggagtgttgctaaagtctggcattatcttaataaaatgcaagtaatatctataaatactctaagacaaaggcaaaggacatgtacctgaagaacatttctgagatgctatatttagaagcacttcggtccactttggggaagccatttttgattgaattgcttttgaagatacaactctgcgaagaaaaactaaaaaatcccctagatggagttcggctgcatgttgtttcctaagagcagctacagcgaagagacaagtttacgttacaaccaagagccaacaagaaatagtcttatatcacataatttaccttgaaactgcagtaagcacaaatctaatgcaaaatcttaggctgtcagctactgaattctgaaaacttaaagaacagaatggggaaaggtcagaaaacaaagcctaaacttgaaacgccttttacatctctgtacaataaaaatgaatatgctagaaaaaaaaaaaaaaa

SEQ ID NO: 1664 - DNA, 816 bp, Homo sapiens
tttttttttttttgtgagtccataatgtaactctgttgtaattgctagggatacattttttgggaaatgcaaaaaaataaataaataaagtctcttgtcatagaacttacattctagtggcaaacacataaataaataaacaaatacaatttttaaaaggtgagtttagagaaaaagattattgctatgaagctaaaagacactgtgggataatagagacttactaggtcaggcaagggacaggaaatacttcagatagggtaaacacaaggcagaattccctgacatgttggcatttaaagaaaaattttcttgactagaaaagccagccagggcaaagtaaggtatgcaggcccagacagaaacaaagttgtttttcttttcttctttcttcttcttctccatacccttctcctccttctttcttcctttcttctctccttccttcctaaaaggagaaagaaatacttgggtggggaagaggttagtatagtgtagaagacatcttcagagataactaggcataaaccataacaaagtcataaagagtttaaaatttattccactaagaaaagccagtggattgcactttaaatttattattatgattatcattacttttgttgttgttaatctggggagaattgacaataagtaacaagaatggatgcagagagagcagttaagaggctattgcattaatcctgattaaaaatgatggtagcagggactgtggcaatgacaggagagacagagaagggattggatttgcatacgtttcttgtggtagagtgagatgtgcgaatggcttggatg

SEQ ID NO: 1665 - DNA, 441 bp, Homo sapiens
caggtgtggtatcagcgttatcggtgtgcctggatccaagcagccgtttcatatcctggacatgataatttgttgaagaatacgaacatgagtgaactcaggccgatgagatgcaagaagatattttctgggagtgaagctttttcactttttctgtttaacagaccatttctcttttttctgtgcttcttatggagccacaggcagagccacacaaaaaaagcagatctgaaatacagattcttggtgattttatttgaatcctggatcaagccaagcctgaagcctgaatctcaatttactttacaattggaccagattaatcttcctaagacattattttgttgctaaaatgctccgaagtgaccacacaatgaagtccaaatcatgtagtcttatgttaaaatgatttcattacctggtaaaaaaaaaaaaaaaaaa

SEQ ID NO: 1666 - DNA, 957 bp, Homo sapiens
tttttttttttttttttttttgagagaaattgcaccttctttatttaataggtttatggtgaatgaatgtatataccagataaaatatgattttataaaaatgcttatactattagtatcgattggaaaattttgaatgacttataagggaatctttgtatttaccttaaagtgaaaaattcaacaattaagatattttgatattcaataatccttaagtcaccagaggagcttattaaaaactttgtatttgacattttcatttaattttaatctgaagggaagtggtacaattgagccataaactaaaagtaaactaacatacgtgagctaactttcatagcttttttttttctgtagatctatttaatcactaatatttattttggtcatccttttgattatctaattattgaatttgacttttaaatgtgtaaaccctttacttaacaaatgaatactcatttgatattaccatttttaaagtaacctaaaaaattttaaagatatgaatttaaagaatgatgttttttagggattattgtaatgacagaaccagaaatagctttttaattctttccaagcatataccgacctcacaatcctttcagatatgtagaatgatttcaaccataaaataatctgtgcatgtgcagaatcatcagatggcatacaggtggcaagttcgacttccaaaggtgatttgtttaaaataataaaaggccaggtgtggtggttcacatctgtaatcctagcactttgggaggctgagtcgggcagactgcttggcctcaggagttcaagaccagcctcaggaacttggtgaagctccaactctcatcggcttgtgcatattggtatcctctctgcccagggaagtcaccacccaacatcttaaagtagtaccgtgctcatggtatatttgattcctgatgtgtaaaatgcttgtttctccta

SEQ ID NO: 1667 - DNA, 409 bp, Homo sapiens
atgccatttggagtagctactttgaggacaagagacaaaaagcctgaggagaaagtcaccatgaaggaaacagaaagattaaacagcatgcgtgatctttgattcagagtccccatctcaccctggactgccttcctttggaattcccttgtggaaaaaaaaattaaactcttatttggttaaataattgtgacatctgagctgagtcttgaatgaagaaaagctgtccatgtaaagatctgggagcagaaggatccaggcagaggaaatggaaagtacaaggggctggatgagagaacaagcttggcttgttcgcaaaacagagagacccgtgtcttcatcatggagcacctcttctcctctctccttacctgctgggaacattgcccaagattctgtaggtaagaat

SEQ ID NO: 1668 - DNA, 558 bp, Homo sapiens
catgtgttgggactttgatgggaaaaaggtgaagcaaaatgtggtaaacaggaatgaaaagccagaatgaataaaggaagccttcattgttctgaggcatacacctttggatctctgagccatcatgtaagaagttcagctaccctgaagccaccatgttggatttgccacttagagacagagatatttgaggaaccccaactgttctgggctccagctgtttgagtctttccagtccaggactttgaaaatgtcaacctactccctcctgacctgtatggtttccattgagaataccaaatgaattggagctcctttaggttatttgctaattttctcttgctgcttttaggatcttctctttatcgttgtcctttgagagtttgattatatcttttgaggtagtcttatttggatcataccaaaaatcagtagcatttctatatgccaacagtgaataatctgaaaaaaaaaaataaaagggtaatcccatttataataaccatgaataaaactaaataccttggaaataaacttaaccaaaaaaaaaaaaaaaaa

SEQ ID NO: 1669 - DNA, 725 bp, Homo sapiens
ccctcgtgtatcactgaaacaaccaactgaaaaccattgagaggctcatggtgaaagaagacagacagtgtaatttccctggaaactcaattttgattcagacgtccacagcatctcatttctgcctttaaaaaatttcaagagtgacattttggcatgactggactcacaggtggagaagtgttgtcttttccctgcattgagatagcattgcatggagatccttgtactcctcgaacagaggctgcagatggacacaggatctgctcagggagataagatcacctgctaattctgctttctccatcagagtctgaatgatcagtgatggggaccagagctaggttaggtctctggaaacagccctctgtctgagtccgggagatggatgatatgggtaatgacttgctgctttatcttctctccatctccttacagcagctccaactactgacttttattgtgtggcagctaattgtaggattctatttctgtaaagagaaggcaagagaggaatgcagtgtccaccatccctgcagccctttggcgccttccccctcccattaccttgaagtagagggaaaggggacgacagaagaacccttagaagtaagactttttctgtctctgaagccacggacctttgaaatatttttttgaaaagaaggcctcccttggatgataccttctgactgttagtgaataaaggaggatgccggcccgca

SEQ ID NO: 1670 - DNA, 547 bp, Homo sapiens
  misc_feature (1)...(547): n = A,T,C or G
gatccaactgaatctttgtgaatgccatggtgaatttaactctgctgacatgacctctgtgaataaggcagaagccagaatggcatcatacactgggagtggaggatcttctcaaggacttaaaaggcagagatccattcaacctctggatagaaggcattctcagcaaaggactctagctcagttctgtttgaccaaaacctgaagcacaaatgtgatgtttgtgggtgcagcagccctnatggagacctgagagttggagcatgttgtctgaaattcaacatccatcagcagatggcataggaggtccctccaagggcgattaattttgccatacctcaattggctgtttgtccagcatcatcccagcagaggagggtcttctcaaaatcatgcacactctttcttgatttcttttaaaatcaagaccctaacccttgtctttgtgggacaggaaaatcataaagaagttcacacttgcaagattagagcactgaactaaagccagtggttacccacctcaggcttcttgatttattagaaaaat

SEQ ID NO: 1671 - DNA, 607 bp, Homo sapiens
  misc_feature (1)...(607): n = A,T,C or G
attactatttcacatatttggggggtttctgcaaatacacttataaaccatgggaagccaccaatcactgtacttcaacatcgcttttgggccctagcacaatgctgagccactaacaggagatgagcatatatttgtaaatcgacatgaagctccgtaaataccaggtgcttaaggaacagtgatggtgactatggctgaatttcagaaagaatgcattcattcaagttgctcaaatattttgtctcaagtgctcaagtttcaaccccaaacctagcacagggggaggaggagagacttanggaattcttgggagagttgagttnaatgccctgtggtcaggtcacactagtcctcagctccattcttcagtctttgtatccaggtggtgctatttgtcctgcttactgacttggttgacagaaaagtatgtaaaagtgcttgtaaagtgctcttctaatatacagaccaaggacccgaatagccgcatccttcaccatatttatgctatgttcttcctccagtcatctctgaaggttgattgtgtccaaaaattcctccataaatacagcacccacagctgcttaattttgatgcatttggccat

SEQ ID NO: 1672 - DNA, 256 bp, Homo sapiens
ccctggatccttaggagtaattccttgccactgagatattttagttacgaattaattctctaacttcaaaccacgctgaactgcaggagctcaccatgtagcagtaatccctttgtaagaacaaggaagccatgcacctccagctgtgatagaaataggattggagaagagttcctctgccagctcaccttttcattgttagcatgccatttattataataaattactttaagaggcaaaaaaaaaaaaaaaaaaa

SEQ ID NO: 1673 - DNA, 650 bp, Homo sapiens
ctcagttgccagagatgaataaacgtgtaaagcaacaactcttgcactctgaagtcaccttacaacaatgtcttttacgatgagtcttgagaatgagaccaccgaatctaaatgtaggcattgcccataacatttgtttctagaaatgttgtacatggcctgctcttatgtatttatttttaaaagaaatattttttctgctgataaaaatttaagcgatgatacagaagtgtgcagagtacaaaactgaaatctcttgtttatttccatctcttttgtgagaagcctgttaatatcctttgaaattcttctgcaagctttgtcgtatcatattataaagagcactttataagttcagtattttttacagtttctcattcatcttttttgtttgtttgcctgtggggtcgattaagacttgcttttagagaaaaacaaggagacgaaaacagagtgtgggtcacattctttacacagagttcactctcatttttaaagaagaattgattctattttttagctgatcagcataaagtgctttattaagcataaacttgtaccatgtactttatcttatttatttaagatggatgaatctgttttatgcatatattaaaaagttatcaaaaaagcaaaaaaaaaaaaaaaaa

SEQ ID NO: 1674 - DNA, 368 bp, Homo sapiens
catgttgccagagatgaataaacgtgtaaagcaacaactcttgcactctgaagtcaccttacaacaatgtcttttacgatgagtcttgagaatgagaccaccgaatctaaatgtaggcattgcccataacatttgtttctagaaatgttgtacatggcctgctcttatgtatttatttttaaaagaaatattttttctgctgataaaaatttaagcgacgatacagaagtgtgcagagtacaaaactgaaatctcttgtttatttccatctcttttgtgagaagcctgttaatatcctttgaaattcttctgcaagctttgtcatatcatattataaagagcactttataagttcaaaaaaaaaaaaa

SEQ ID NO: 1675 - DNA, 777 bp, Homo sapiens
ctagtgctggatgcttcctgccctcgacattggactccaagttcctcagcttttggatgcttggacctacaccagcggttaacaaggggctctcaggcctttgtccatagactgaaggctgcactgtcagcttccctacttttgaggctttcactctgtcacccaggctggagtgcagtggcacaatcacggctcactgcagcctcgacatcccgggatcaagcgatcctccaacttcagcctcccaaagtctgggattgcagttttaatcaatggttggttgaatctgtggatgtgaaacctgtggatatgaagggctgactgtacacccaccaacccatcatgaaaatcaaaataatggacatattgatcactccccaaagtctcctcattttcctttgtgattcacccttctgtttctcccaccctttaccaaaccctaccaacagcttctctctccccgcaggtaacctctggtgggtttaagccatgataaattagtttgccttttccaagttttatgtaaatgtggccttacaatataaattctttttttctcagacttctttcactcagcataataattttgaaatttgtccactttgttatgagtatcaattattcatccttttttattgccgagttgtattttcttttatggctataccaatatctctttatacgtttagctgttaatggatatttgggttgtatgtagtttttgctttttaaaaataaaaagactatgaacatctatgtgcaaaaaaaaaaaaaaaa

SEQ ID NO: 1676 - DNA, 793 bp, Homo sapiens
aattgctcctgctgttaggatctgacctggctgagtgataatctaagaccaataaatgcaacttcagtaaaagagaagaacatgaacttgaagtcaacctattctccaagagcaatgaggcatgtgaccttcagagaaacatatacttcttgagatttcctggaagatacagaataactcagcatcaccatccttatgctctttctggaggagttttattttatggcaggtgcctcatagaaaggcatttatgttacaagttagcataattctgaagaaacacaatcctttttatagtaaaaatatggaacttggattgattaataaagagagccatctacagaataagaagctcacagtgcaactccaaaatgaatccatttttataatatcttctctgccagctaatttagaatatactatgtgcaaaaacaaaaatactacccttaaaataaaacaggcctcaaggaatatctgttttagggttgattaaattcccaaatactgaaatttcttaagcttctacttgaagggactaacaaaaaatgtcaatgttgtttctcctctgcagaaatactagatattgccttagatcttcactaacagaaatattagagattgccttagatatcactaacagaaatattagatattgcctattagatatcactaacaatgcatatagtatcttaacgggtacgtgacaaatggggcttggagaaaagagggaagtatgtttatgtgatctataaaataaagtgaaaaattttaaccacaaaaaaaaaaaaaaaaa

SEQ ID NO: 1677 - DNA, 184 bp, Homo sapiens
ataaataaaataattcaactacaacagacttaacgcaaaaacttcaggtgatctatatccttggacttctacagttctatagaagctgaataacttcatttttcaagctgaaagattatgtttgatctcatcaacctatttcttaccaactataaaatatttataaaattcaaaaaaaaaaaaa

SEQ ID NO: 1678 - DNA, 148 bp, Homo sapiens
cctaggtgacttatatccttggaacttctacagttctatagaagctgaataacttcatttttcaagctgaaagattatgttttatctcatcaacctatttcttaccaactataaaatatttataaaattccactgaaaaaaaaaaaaa

SEQ ID NO: 1679 - DNA, 265 bp, Homo sapiens
cttatatccttggaacttctacagttctatagaagctgaataacttcatttttcaagctgaaagattatgttttatctcatcaacctatttcttaccaactataaaatatttataaaattccactgatgaatttgttgctctagcttgtaagataaaccatatgaactaagtgatataagtaaataagtaaacaagccacatgataaacagataattggtagattaaacaattcaaatactctttgaaaaaaaaaaaaaaaaaaa

SEQ ID NO: 1680 - DNA, 426 bp, Homo sapiens
ttttttttttttttttagaaagtcgattatatttattgccctcattacatatatagaataatgagctcaactaaataatttttacaggtaaggtttgttttaaaatcttttcactttactcagcaagtaattaaataaaaattatttcatttttaaaacttaaatatcatattactttcttgctgtaacaagttaacacaaactgggtgcttagaagaaaagaaagttgttgtctcacagttctggaggccagaagtctgaaatgaagacatcagtaagtccatgctttctctgaagattctggggaaggatctgttccaggcttctcttagcttctggtagttcctttgcttgtggcagcataactccactctttacatggtattctcccctgtgtgcttgtctgtgtctgcatccaaattttcc

SEQ ID NO: 1681 - DNA, 1240 bp, Homo sapiens
atagacagggtctcactctgttgcctggctacaatacagtgttgcaaacattgctcactgcagcctcaacctccagggcttaggcaatggcttctacctcagcctctcctatggctgggactgcagaaccaccatgctctgaaaaatccaaataaactggagaaagagccatatgagaagagcaaagtcatgctgtccagtctcagcagacccccaggctacagccagcaacaagtgccagccatgtcatccagatgtcttgaatgtttcagcctcaatccttcaagtgaacacagttccagaaaacagtacatgaagaagaaagactatgcagctgttctaagtcaatctaaaagtaataccataaagtgacacttcggttttcagccactaagttttgagtcatttggtatgcagcaaaaacagataatagaaatacatacaattttctaaatattcttctatttttctccatagaatatttttatagtcatgttaaataatgcagggagcatgcaatacttaagcaattgttaaataatatgttttaatataaattaagacatgaagttgaaaagagtacaagcaagtttcaatcccaagccaagaacataaaaacttcatcatgtcttatttcaggagtctattgttacatggtatgaatagagctaggaagaaattcatgaactaaaaatttataatctttggcaaaatattaacactaaaattactaaaaactattcaacaatttccctatgggaccggcgcaggaattgaaccaagtaaaccctcaaatacccagttaaaatgggaacctggagtatttaaattatgtcgttggactatttctaaaaagatactaatagcaatcatttatcaagcatttatatgaattactgcaggagctccatgcacactccttaagaaaaaatgaagatttaccaaatatgcaatattgtattgtacagtgtaaccctgtactattgtctttctctctactgaacgatctaaaattgttatgatgtgtacacattttacatttataacattcattgacatttagtctaattaattattagttcagcatgcatagtctgtttgtattagtcatgtccatatttgcaaatcaaaacacagaattaacttctcgaaggctacataggagatgggattctttacttgggggatgagggaaaaatattctatatttatcatatgctttgaaaaaaaaaaaaaaaaa

SEQ ID NO: 1682 - DNA, 198 bp, Homo sapiens
tttttttttttttttcagcttatattttgacttttaattcctctggcaaccaaagaacaaacaagcaaaccaagaaagtataaggagtgactttatgaagataaatcagaatgacctgtatgttgaatccttgagaatacatctcttgtggtttcattatacttagattagtgtgtcgtctgtggtgatactcttcct

SEQ ID NO: 1683 - DNA, 369 bp, Homo sapiens
caggcccacttgaagaacaaagaccaaatgacaaagaatggccaagagaagggaagggctgccaccagaagacaagtgacttcaaagaatttctgggagataaaaatctgacagcagtacagtggaacatgtagcagggcacagaaagacaaccctagaatatgcttggaaaaggaaaaactcaactgtccatagaaaataactctgtgttgcgtgtgtggaatgtcccagtgtaaagaccgacgttcctctggcctctatgaggctaagccaggcactcatcacccctttactgggagctctcagctttcttcttagggctccactcttgaagacatgaacaaaataaaaaaatcacacaaatgaaaa

SEQ ID NO: 1684 - DNA, 857 bp, Homo sapiens
ggaaaacgtcaatagattctcaaaagaagtgtgaatccagaaaaatcaagatcccaggaaaaaaaagactcaaaaaaggaattgataaagttaaacattcatgctcctcggacttcatatcggatgctcatttaaaagtaaactcttggaagcaacgttgggagaagagtgatacagagtaaaaaattattttaaaaacacgactccatattttaatggttttgaacttcatgttattacctgtgtaatcacacacacacacacacacacacacacattttaaaaccccatctgcctaggtttatcaataataaataccaactattttattacacacatgacaggatattttgtggccctttccccatgatggcaagatccactgaatggtaatgctagagtgattaatgtatccacatagtagcatataatttttatagagaataatactttatatggcattcattgaaatgacacaatttattttgtctgtctaaacggaacacgtatatgtctatccgtagtttcctcattagaataactaataaaatgccacatatcgttggttggctaagtaaaatatatatgaatggtattttggaaattaaaatctctatataaggctcaagcagaaaacgaagatttttttatcgttacttagaatgtatatgactgtagggtatccagggagacattgttacttattcatcacgacattcgcaccacaggagagtgggttttccacacactaatgtaaggtcccaatgaaattttaaagctgatattgagtttataaaaagtggacacaattttaatttatagggatgggaagtaccaagacatcatttcgacaagtg

SEQ ID NO: 1685 - DNA, 746 bp, Homo sapiens
ttttttttttttttttgattgacacagactaaaatatataatttattttaatgaggaagactacattatgatgtcccaagaaaatctgggtaatacagctataaaagaatgcaagaaagtcatttataaaggttaggatgatagttacttaaggagttgagaatcaggccaggctattattgaagccacatacttgcaaagagcttctgggttgactggcaagttctgtttctttatttgggtggtacaataactcattaagacatatatttattttgtgcatttctgtgtctgcattttattttggaataaaaacatttttaaaagaactggaagtagtagcaggcaaaagggaggaggtccaattactatttccctgaaaatcccaaataaatgattacacatttttcctaggcgttaactatactgtagtcactttaaacaacaaaccagccaaaaccaacagtatctggaaatttttgaaataatatatcctcatctttctatgaaatgccttgtttccagtattcaagatattctcattcagctaacttgaaaggagtagtgcgattttagattatgtaaaaacctttttcttgaagatgtccaatttatgaaatagtctcatgaatatcaaaggacagcaaggcgtggtggtgtgttcctatagtcccagctactgaggagattgaggcaggaggattgcctgagtccaggagtacaaggcaaatttcagaacatctcag

SEQ ID NO: 1686 - DNA, 828 bp, Homo sapiens
ttttttttttttttttttctttatacaactatactttattctttctctgcagattcacttatttcacataaagatggttttgacgcagtttgtataaccttcaattcaagatttataaatttcaattcaagactaaataaatcaagttgactaaactaggttccctcagtttaaattctaatacttatattggccaagttgggttaagtttacaccccgattccatcaatggtgcccatagtgcgaagagtcacaaattaataatgggacagccaagaacctgccctgccagccagcaaggacagttaagtggcattatgaggaaagtgaacagctcaaaacgtgtcttctgtatattgtcttacttaatgaactaaaggtgaaaacatctaaaatagaactacctaaagcagcccttccctttttccattcctattttctaagttctacatgttgtgtgaaatgcttttatggatgagttgaaccctttccaaaagagatgttcaagcccttgctaaaggctttaatctagatttcttaaggattttgtgaaaggtaattcccaaaaattggcatttttgggaaagataacacttcttaaattatgaaggtgtcagaattggcagaaattaatcttaaggtcaatccctacttttgcaggaaaggtttggttccgtttctacttgtattacagacttgttcttttcttcccggttaaaagggataatactttgcatcattgaagggatggcatcctcatcgctagcctcctaaggaacgattccgagtcgccttatctctgtgcccagtgcctgggtgccgggtgcg

SEQ ID NO: 1687 - DNA, 212 bp, Homo sapiens
tttttttttttttttttttctagattattttatgcagaccctttcattcctttaccatgttatacctttagaaagatttagtgtttgtgaattctctctttcatactttaaaaaagaaaacagggataaattgcatcctcttgtaatggtttgtatgttggactaaaggcaggagtgtacactgaaacttcttccatgagatgttgatttct

SEQ ID NO: 1688 - DNA, 189 bp, Homo sapiens
tctttagggaaatacttgtttttattgcacacagcatttgataaatatcaacattagccaggaacttataggtgtgagaaagaaggcagctaaatacaagtttttttggttgaaaatcacacccattcactaatcctcaggtggacttgttctcaggaagaataatttacattgtcaaacactcacaag

SEQ ID NO: 1689 - DNA, 810 bp, Homo sapiens
tttttttttttttttttatcctttcttcaatatatttctcaaaaatttcaatacagattttacatggctaggaaggagaaagaatgagtgaaaatagcctgctctttcaaacagtcaaatcaattcaacaaaatattcacagagacatcaccatagcagaccaaatgacagatcctggggctatgcagagtaggcttctttggcttcatggtgcctatgtccaatggggagtccaaatattaaacatgaagtgatgtcttcattcattagtgctgctataacaaaataccacagcctgggtaatttataaagaaaagaaatgtattttctcgcagttctggaggctggtaagtccaagatcaaagtactggctggtgacggagggcccagtccctctgcttccaggatggtacttcggtgatgcaacctccagaggggagcaaagctatatcatcacatgggcggttggcagaaggacaagctaacccaatgctttgcaaagcttcttttataagggccttaatcccattcaggagggaggagtccttgtggcctaatctcctgttaaagttcccacctgtttatcctattacattggcctttaattctgaacatctggaatgttggaggggacatattcaaatcctggcaagtgataatgttatgagagagagatgggaataactcagggttctctgaaagcaggggatgggtactgtatccagagagtaattaagatagactcatccctcaggcttccactgaaaggttgcttggtgaaggctttgaagatgtatgaagacgagtgag

SEQ ID NO: 1690 - DNA, 742 bp, Homo sapiens
ccatctcccatttcagccgctcgaatggcacttttctgatgacatttcaagaggtctttccgaataaacggcgtaacaaagagatcaagcctgccgggaagccagagcaaattttttttttttttcatgaaatgaatagttctaatcatgtcctttctgcctactccgtataaccttccagcctccacccccacacaaatcctaaggcagcaaacaaaacattgagacccactccttcacacctttttaccaagaaggtttacaatcagttaggtctccaagcaggggcattgttcccctgcactcaaagagcctgggtccccatcctctgccagctcattgctgtgagagataagcagacctcctaaggctcagttatgatcttgttttcagtcatacctccaggatctatagcaatgccaacaacagcttgaaaaatggacctgttttcaaagaagagctagctgttgctgtgactgatgactagggaacctctggttattcaggttttcagaaagggtcagctcttcacttccagctagtcttttcagtaccttgaaaatgttaagaagcagttattttagcatcaattacacttctttaaactgctaggataattgcaagcaaaagtcaatgatctcataggtataccactttcatattgtgaatgagccagtttgaaaaatcttaaatcaaggcatttcaaacattaaagttattttaattcaaaaaaaaaaaaaaa

SEQ ID NO: 1691 - DNA, 276 bp, Homo sapiens
  misc_feature (1)...(276): n = A,T,C or G
ttttttttttttttttttttttaatgtacacattatatttaatattttaaaaatctgagtccaaatgataattatttattgaatgttgagtanaaagtttaataatgncagtttagggtcttgcacttcctcttaataatattaattacatcgatataataatgtcttattcatcatctgtgttcttagatagtccatgagtttacttcaacctatttagcctttttccttgatgctcagcacagacaatagtatgcattataaagagncactcca

SEQ ID NO: 1692 - DNA, 111 bp, Homo sapiens
gcattaaaggcatggcagggcagcctgtatattctgtatgtatctccttattcatgaaagaaaactcaataagttcactgggaaataaacacggttactcaaaaaaaaaaa

SEQ ID NO: 1693 - DNA, 381 bp, Homo sapiens
aggatttcacgggaaaggaccacaaactcggctccttttaaatttcgttgaagaatgtcagcaaattacaattgttcaaaatcaaaatttcataaacttggctgcagaatatttatgatgcaaaaacaatcgcaaaaggctttgctgcaaagctttattgacacagccttcctgtccccacatcttgcttcctctcaggaaagtgggacgtgttggatgatttcccagcttctatttggagaggaagtctacaggtttttcaccatcaagccaatctgcactcactgaagaacacctgcaaccaagggctgtgcctattctcttttgtgcgtttgcagctatcaaaataaatgagttatgaggatgggaaaaaaaaaaaaa

SEQ ID NO: 1694 - DNA, 154 bp, Homo sapiens
  misc_feature (1)...(154): n = A,T,C or G
tgcctcaaagatggcaaggaatttatcaanatgtgatgtgggaaatggaaaaatattgaaaaagattaatggnccaaagaccnaaaccaccacaatgacatnagntgacagcatnnanaaanccttgnatanaccacctgaagattttttntga

SEQ ID NO: 1695 - DNA, 634 bp, Homo sapiens
ctttttttttttctttttaagaaacataatatttcttttatttgggtgtctagatatcatcccgtattatgaaaaccaatatggaaggttgggtagcaatcccaacagatgaaagtatcctttctaatatcatgttagacttcattaccccataggaaagtggggcttcatcaggtttcaaaagtgcaatccaaagaagacctgcttctatcccatataattcttgttctggtaggagacaagtctgtggtctcaattagtcagtccttccatctgtgcactggattccatttccattcattttttcagggaaattggttcttcaagtatacccaagatgcttgattttcttcttccttcatgatcttcctttcaaagtctcctttggtggctcctcctctaccagacatgtaaacatcctagtgctcctctagtatactcttcagctagagaatctcatcaactctcagaactttaattacaaccatctgtgtcatccgattctctgacactggaatataaatctcaagatattgtgattttgtttccattactgatgactgtatacagtggacagctcctggttcttcccaaacatggatagaaaggtaaaaagaggaaatgatacaactag

SEQ ID NO: 1696 - DNA, 814 bp, Homo sapiens
ttttttttttttttttttgcttttgaagttttactgattcaactggtgatgacaaaatgagccacttttatatttggacagttgattacttacagatggaaagaaaaagtgtttaagtcaaaggtgccggcatccctcagtccttgtcccatacaccaaaagggtgacaagaaaacagaaaaggtcccataaatatcttcttctgagaagtgtctgttcatatcctttgcccactttttgatgggattgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctacgtcctgaatcataatgcctaggttttcttctagggtttttatggttttaggtctaacgtttaagtctttatccatcttgaattattcttggataaggtagaagggaaggatccaatttcagctttttcataatggccagccagttttccagcacctttataaatagggaatctttcccattgcttgttttctcaaggttgtcaaaaaaagatagatgtagatatgcggggtaattttgagggcttagttcgttcaatagacctaatccctggtttggaaccaagcccatgctggtttgggtactggagcccttgtcaataatctggact

SEQ ID NO: 1697 - DNA, 161 bp, Homo sapiens
accatgaagttcccatcttgcttcctgctgagctggctgtgtttccctttgctgtcccattgctttccatttcccttccagatctccattcagtaatggcttttcctggcccaaccctaagtcaagccctttatggagaaattcagctgacattattgact

SEQ ID NO: 1698 - DNA, 290 bp, Homo sapiens
tagacaggctctcactttgtcgtctaggatggagtatagtagcatgatgggatcagggctcactgcagcctcaacttcgccaagctcagtgctgccaaatgttatccttttgtctgaagctaatggatgtgcctccacttcgtctactctcagcagctgtgaccatcatctaaatgaatataagaattgaattaacgtgcagtgagtgcccacagtgtcctgaactatattaaaaatgatgattgatggctctgtggaaaaaaaaaaaaaaaaacaaaaaaaaaaaaaaa

SEQ ID NO: 1699 - DNA, 181 bp, Homo sapiens
tttttttttttttggaaaccttaaaagataatttatgtataccaggaatctttattcagcaaaagcttattcctagaaatgaaacgttatagacctaaattttcttcatccagacttaggtaaaagggtgagatttgaaaatcttcattccatttttaaggtgtgagtcttccaggcagct

SEQ ID NO: 1700 - DNA, 127 bp, Homo sapiens
cttatctccctttgtgtttcttggagattaacctgatgttactctgagaaggctctgtatgttgtcaagttttgaactctactgaacggaaccaaaaataaaagtctaagaccaaaaaaaaaaaaaa

SEQ ID NO: 1701 - DNA, 730 bp, Homo sapiens
ttttttttttttttttttgacattaacaacatttatttcaaatcttttgaatacatatccagaagtgggattgctggattatatggtagttctatttttaattttttttgaggagccccatatagtgtcccatagtggctgcaccattttgcacccctgccaacagtgtgtaagggtcccaatttctccacgtcctcaccagcacttgttgcctttttttttttttttttttgtaaaggccatcctgataggtgtgaggtgatatttcattgtgattttgatttacattttcctgatgactagtgacattcagccattagtcttgagttcgatgatcttttttcatatgctgatttgacataggcatgtcttctttggagaaatgtctattcaagtccttagcccgtttttaaattagactattgttctttttttccctgtcgagttgtaggagtttcttatatattttagagattaaccctttaccagataaatggtttgcacatatttccccccattccataggtggcctttttactccattgattgtttcctttgctgagcaggtttttagtttgatataatctcagttgtttatttttgtctttcgctgcccgtgcttctgaagtcattgccaaaatcaatgtcttgaagcttctccccttgtttccctttaagagttttacagcttcagatctggggatttattcaaaagacttgaaactggggt

SEQ ID NO: 1702 - DNA, 795 bp, Homo sapiens
ttttttttttttttttttttggagacaaaactattttattttagcatgcagtagaagttccttctgcgtattttccatttcatcttacagaatattttaaaagacatgttcccaacagttcagatttaacaaaattaacaattttttttttgcttttatcaagggcactattaagtgaaactgaccttttccccctccagtaagtacatgttggtaaagaatatgaggaccactagcatagtttggtgccactatcttgagatgtactgaggggcagcagttttattcgctattgctttgtgatatcaatagaagtgttaacatggtgggaggcggaagcagaacccccaaattatgtcttagtaatattataaaattaattttttatctcatggactccctgaaagggtcttccagattcccaacagtccacaggtcatcctttgagagctgctgacttgcagcatgttgttctcctaggagcttaagccttcatcatctcagtcaaggaaccctgaggaggttgggagctgcaaacatcacaatttttcattgaaataaggcttgaacaaagagtattggaattgtttaatctaccatttatctgtttatcatgggggcttgtttacttatttacttatatcacttaagtcatatggtttatcttacaagcctaaacaacaaattcatcagtggaatcttataaatttttttaagtagataaaaataggttgtgaaaaaaaacaatatcttttactgtgaaaatgaagttttacacttcttagactggaaaag

SEQ ID NO: 1703 - DNA, 455 bp, Homo sapiens
ttttttttttttttttttaaaagtagtttacttttattcaattaacactaatcaagcacatacattatgcagatgttgtgccacatgctaggaaccactaagatgaataattatggtttctgcctttgggagttcacagtccaagcgggtaacagacagttaagtgactagtggcagcataaagtgcaaagaggtgcatactgtaccctgtgaacataggccatagatggaggaaccagcaggcagctctgtgtggctggaggtcacagagctcagtggcaggttgtttcagaacatgggctgtaatggtgggctgcagacttcattcatgggtagggacacagcgagtcagggaacttcgaaaggaccagagtaggcaacagccatcaggaatcagtagcagccgggatatcagcagctcatcccctccaggtaccacagaaatctttgagatt

SEQ ID NO: 1704 - DNA, 485 bp, Homo sapiens
tgctcttttatggtgaaagtctatgtggagttcaacatcatagaagtttcctctgagctatctcttcaattaaaatttcataccagcaaaccacagggattacttttgcttgcagctgggacaaatgactattgtataatagaacttaaatcgggaaccttatgtgtatgattttaaatcttgaaaatacatataagcatataattactggagagaaaaccagttgagagagaaagagaacaaaacagctacatgtattgattgctgttatttcattagaataaaatgatgtgccatttgtataggttgggatctccttcggttttactagcatggcttaaatattccaactttaaaatttcctgagtttagtatgtaatctataagcatgggaagagttttcatgtacaaatttctctcttctttttcttttgtgaaaggtccgattttctcaataaaacattatgaaatgaaaaaaaaaaaaa

SEQ ID NO: 1705 - DNA, 809 bp, Homo sapiens
tccgctatacgctgagtcatttacaacttggactcctgtgttcacctgtgccctcttcactctttacaaatttacttggatgacgacttccacttcatataggcgtaggtcagaaactgtgattgatatcctgtgatctaaccagctcctagatgaggccagtgctgctgttcctctgatcacactccgaatggcaaagccccagataacttggacccaggtgctggccaataatgagtaatttagcaacatatgcctcaaaaaccatgcactacataagagacaataagttacttcgtgacaagtactatggaaggaaaaagtcatcagttttgatatgcccattaaaagagctggagctgaggaggaagctggtttccaggcagaattctggacttcgtggatgagcttcactgaaacatcagagtacagcaggaaaaggaaattaggatcagctcttgtccagttcaagctgactccactgagcctccaatggcctgtatgaatgcccaatgagtgcccttttgacatcagaaggccaaaaactccaccctcagattgtgccaacgacaccatcttgcgaacgtggatcctatgaaaagccatgaagcttaactgcactcgcacagatcagcaattacctcacttttccttaccaccaattaactttttccatgcattggactgccttgctcctttatcccacaaatatccctaatgccccaacttcaaggaggagaatttgaggggtgttatcccacctcctcacttggctgcctcatgaataaaatcttttctccactgcaaaa

SEQ ID NO: 1706 - DNA, 528 bp, Homo sapiens
cctagagcatgccaacaatgaatgatgtctcagcgtgaacaatattctcaggaggaattcagggctggacttgtcaggagtgttgcaggcaaagctttcattgagagagaaatgaagccaaagctccattgcctaagtaaattaattgatttacgatatgagaaagaaaagaaagggaaaattctgttaataccgactatttaactccatctggaagagatggttcgaggcagcaagtgtttgagagtttccatcataggtgttcttctcgttcttatctctacccagagtgattagtgttaactgctctggggtatgcaactggtttctccctgctcaggccatcacgtatgtttacaatttttgttgctgaaacatcaaactctgttccttagcaggccccctggactaacttcttagtgatatctgtagcacttctgtagaaatagcaaattgaatctagagttaatttttgaaatgatatgaaaataaaaagtacaccttggagaaatctaaaaaaaaaaaaaa

SEQ ID NO: 1707 - DNA, 634 bp, Homo sapiens
catattgatacagatttgtttggttttaattttttatttattccttttactggtttcgaagtgatgatccttttattattcttttagcgcttaccttcaaattttaaatggacattattgaggcttgtcaacgtctacaaaagtgtactggaattttgattgggattatgttgaatcactggatcaatttttggagaactgacaactcaacaatattgagtgtgtaggtttatatatgtgatatagctctccatgtatttagatttttagtttccctccacaatcttttatagttttaattaaacaaattgcacacatattttaaaaaatgtatccctaggtattttatttttgatgctattgtaaatgctattgggctttttaaaaaatcgtttcaattttctgttgtttttgttaaatataaaaatgcaaataatttgtgttcatagaccttatatctggaaacgttgctaaatgtatttttttattccattagctcttttgcttattccttactattttctttgtgggcagtcatgtcatctacaaataaacagttttactccttttcaacctaaaaaaaaaaaaaaaaatgtcctcgttggcaacatgcggtggagcagttccgctcagg

SEQ ID NO: 1708 - DNA, 291 bp, Homo sapiens
tttttttttttttttgtctgtggtgaacttttattagactcacaatgcttttataattaaaaaattaatcgtcaaccttattgtattaggagatgtcacacagaattctggattttcagcctttctgcaaaattctgactgtcttgctatgccaggtcagcgatctcagatggtgacagttggctgaagcagagtggcacttgtactcctgtagagctcacatgtgtgtccattcatccaagtcctctcctggccagcttctggtcctcatgtgactgactggcctgtggg

SEQ ID NO: 1709 - DNA, 367 bp, Homo sapiens
acatgggcccttacaagacaccaaatctgctggcactttgatgttggacttctcagcctccagaactgtgagaggtaaaagaagaatgtgaactttaaaagaaattcagtgggggaatcctggcatttttattccaaaagctagatgccagatgcctgaagaacgaccgacagagattgttattggtcatcactggtcatggcttaaatgtgcaaaaaatgtaatatcatgagggaaagaggagcaggtgagaaactgaaaacactagaagagcatttcatggttataggaagatgtgatttatggatataaagttcctgaaaataaatgtttattacctggattcaaaaaaaaaaaaaaaaaaaaa

SEQ ID NO: 1710 - DNA, 293 bp, Homo sapiens
aggatatagcttcagagtcaagaaaaaaattttgcagaaggaatgaatgcctttaagggcattgtgaccagctgctgacgcccagaagtctggtggttcaagatgtaatctgagacgaagaaagacttttccccgaggttccctgaaattccccctcccttacttcctggtctcataaaaactccccactacttctttttgttagggtggatttgagagatcttgacctcttgccttctcgctttggccaaatggaataaatcttcctctgtctccaaaaaaaaaaaaaaaaa

SEQ ID NO: 1711 - DNA, 327 bp, Homo sapiens
atcattcgctctgggggagtcagccaccatgccaagaagaacacccaggatccctacagaaagacccatgtggtaaggaactgagccccgacctgccaacaggctgcatcaacttgccattcatgtatgtgagctgtgttggaagcaaattgcctggctccagtcagatcttcctatgactgtagtcctggccaacattttgactgaatttcctgagtcaccttgagcgagaaccatccagctaagctgctcccaaattcttgacctacagaaactacaagagataataaatgcttatgtcattttagccaaaaaaaaaaaaaaaaa

SEQ ID NO: 1712 - DNA, 785 bp, Homo sapiens
  misc_feature (1)...(785): n = A,T,C or G
ttttttttttttttttttttgttcattcgttaatttcttcagtaataggcatccactgactatatatgccagacactgccaggcattggttgagtcagacatgatccttggcctcaaaatatttacagcctagtacagtgagatagatagagaaaaataactgtaatacgaagctatgtgtgctctttgaagataaaggaatgtggaaatttagagaggacaactatttagctgatagtggggagggatttcgcagagtaggacacaagtagaattgtgcgagacagacggactagcacttttcagacaagaacctgtatgtgctaaggcagagtgtgaaagaaagcattgtgatacaggccaggaggctgagcaaagcatacagtaaaagtaggtgatgggtccaggcctggtggctcatacccgtaatcccagcactttgagatgctgaggtaggaggatttcttgaggccaggatttcaaaactagcctaggcgtcataatgagactttgtctctacaaaacagttttttttaattaaaattttttaatttaaaatttttaaaattaaaaagtaggtgatgggctggggtggcaggtgaaataaactcagcatagactatgaaaggccttgaatgctgagattaaaaatgggattttattctgttggcaatggngagactctggaagcttatagacagaagatggcatgttttgatctggtttttgaaagagatgctggcaaccatggaaggagggattgaactggaagtgtgggaggagaa

SEQ ID NO: 1713 - DNA, 795 bp, Homo sapiens
tttttttttttttttttttaaacagtgaatggagtttattggcttacaaacgagaaaatccaaggatagactggtctttagtcaaagtgcgagtggatctctgttcccatgttttgggggatttctttgtgtctccatcgattgcctggcctctttagcttcaaaatgctttccttgtggtcatataattgctgtcagcttcttttccatacccagtgcgagaaacatgagcactgtcctccactgttgaacagatgtcctggttttgctctcactggaccctctggagaggtccagattgaattaatctatggccatagcaatgcctggtattggtttaggactgaggtagatggaacaatgatgaaacaatcctaatgacaaaaaagtgtaatcagaaagcagggaatacccttggatctgaggatgaagcaaatcccacccaaactttctagttactacattatggagtggagaatagtagaggagaatgctggttggtaaggcaaccccagtaaccactgcagagttccacagaagtcagtcggactccatgccttcataaaattatcggtggtagaaagaattaaagacaacttagtctcaccttcatatgttactaatgatgaaacctaaaggtccaaaagtttagaaggttcgcccaagagaaagtagcagatcctggaagtgggctccaccttactgaccctagtgccaacagctttctactagatgtcactcatgtatttattcattcaatatgccgtgagcattgctgtctccagcctgcctctg

SEQ ID NO: 1714 - DNA, 806 bp, Homo sapiens
tttttttttttttttttcagagaacacctttttttttgttttttgggtcattttagtatccttaatagtagcaggtttttcatcgactgagtctcagttttgatatttatacatttgcttcataggagaaatttgatatttgcttcacgggagaaactctcgaaacctttatgcccagattcagagtctgggcaattcaccttttgggtgaatcctcaatgtatgaagatatctagggtcccagaagtaaagcagcatcagcacatagctcctttgggtctcagggaagctggcattttccagtacagcctttgacactttgcttcaagctgaagatcttatgtttagtcactggttgtcttctcaaaaaagcactattttatccagaacatgtcagaaccaagtcagtttctgtattttcttttttttttttctttttgagacagactcttgctgtgtcgcccaggctggagtgcagtggcgccatctcggctcactgcaagctctgcctcctaggttcacgccattctccttttcgtaacttttatcaaacacttaaattttttgtcaacacaaaaccacacatagttctgcttaccccacctgctggtacaagaaagaggggctgaaggttaaaacgtagggattggccagtgagataccacagcagcagcagccgataattgattcacttgggcaaactgctccttccaagccctgggccagggctgaggatccagaagggctaggacaggatcccagtttctgggactcatgcctaacagccatgctggagaacctctctc

SEQ ID NO: 1715 - DNA, 439 bp, Homo sapiens
ttttttttttttttttttctttttttttttttttttttgatttctcagcggggtttaatataatcagtgtgagatcatccagcaaacatctactcacagcaaaagcaacaacaataatagctcccaattaagagcacttcctaaatgcaggccctgtgctataggctttacccacttggacctgtcgaattcacttagcaaccctgagctgagtgttactatgatgaacttggctccgggaaggttgtgtggtgacccgaggtctctgagctccttatttgggtctggcacaaggctaggggctggaaatgcagatcctagccccatggcacttgcacagagatgagttagtcttcttcttctttgtgttgttcacccagcaagccatgtgatgctggtttaatagctggatcaccttcagcacatgagttccacacct

SEQ ID NO: 1716 - DNA, 450 bp, Homo sapiens
tttttttttttttttttgctctaacatcttttaatcattgtaaagagacagtcagataaagttattgtaagagaattgcaaatgtctaattatatttctattaacctacatttttagaaaaagagggcatacttattgacaaagaagttataaaaaccatttggtctcaaaacacacaatggcattgttttcaaacctttatgagaagcatagctgttttgtttaaaaaaaaaaaaaaagaaaacattttattaggtttttctccctgagtcttccttctcctgtccctgacagcccccaccccataacagcatacagctctaagatgccacttcatttatttagattccattttagtggattagtcatttacctaatggagctggcctctcttgttcagaaagcaaacatattgaaaggtaaatacaactgaacagatcaagttcagtt

SEQ ID NO: 1717 - DNA, 338 bp, Homo sapiens
ttttttttttttttttgtgagaagcagaaaatcacatgtttggtttattctctaggtgatgagaaaagccatcctccaccccacaagctttactgatgcagataagaattaggaaaatgcatcattgcttgctactcagcaatccaatctttatcaaatgaaagaatttggcataggagctcaatttttggattgactactgtgccagataaatctgcagaaaagaactttctcccaagttttgctgtgaggaagaaaggatgtttgtcctcagttgtagattcaagtgaaaagtatcttcatgtggctcctggcatttttcatctccttcgagggct

SEQ ID NO: 1718 - DNA, 276 bp, Homo sapiens
tttttttttttttttttttttttcaaataaatacatatttgctttatttcacaatgcaaactcaactatctcagaatagcaataccaagattatcactagcaatacgatttttcaaaatggtttgtaattgatgatcttactgatgctcagattgtcatacgttagctaatcagaatgtcctcaaattggctcttgagttcttttgacctttcttatgtgagcttcaccactaacagtagaggaggtggaattttctctttatagaatttttccgt

SEQ ID NO: 1719 - DNA, 224 bp, Homo sapiens
ttttttttttttttttcttgtttttagagtaatttattttaattcaagtttaataaactcaagatgggaatatgactcaagaacaatgaaatgtgtttttctaagcaagcatattagattataatacaaagaaaacatgtgaataaaaccacaaagaatacagtttttaattagaatattttatgggcccagttctccttttagggtttatagaattatgtgcc

SEQ ID NO: 1720 - DNA, 237 bp, Homo sapiens
tgaggccaacgaggccatttttttttttttttttgattgttttccacaggcttttattttttctgttgttccctgggggaatccactacatccagctgtccagattgatgtcatcaatatagcagagcatcatgaggccctttttgtggaatgatgatggatatggctcaacttcaacaaaactctagagggcatagctgactccctgaagcatgcgcagaaggatatatgtgcctg

SEQ ID NO: 1721 - DNA, 524 bp, Homo sapiens
  misc_feature (1)...(524): n = A,T,C or G
tgaggccaacgaggccatttttttttttttttttttgaaagaaagcatgtttattagagcaacagtgtacataaaatggctgctctgtagacacaacagggctatcccataggcagagtagcacagaagagcatctgtggattgctggctagctctgcttataccgactcttatttacatgctaaataagggacaggttaaggttattcatgaacaaggggtggagggttcctggaatcacacaaggtaactcctggatcattgccacagcatttgtaaactgtcaaggatctgatgggagcatcttaggcaaatgcaaataagcagtgagggtaactggagatcgctttcattgccatcttggttctagcacattttatttgccacatcccgtcttgatcagcagcagggagactgaggctcagaaaacaagtccagctgatctcctacctcaatcccagggatgcattaggtcatctgctgtttttgtcatgataaactgtggatccngggttcccccaaag

SEQ ID NO: 1722 - DNA, 797 bp, Homo sapiens
ttttttttttttttttttatacataaagggagtttattagagagaattggcttacacaattggctcacacaattacaaggcaaagtcccatcataagtcatctgcaagccggagaaatagagaagccagtagtgtggctcagtccaagtccaaaagcctcaaaaccagggaagctgacaatgcaagcatcagtctgaggctgaaggcccgagagcttctgggagtctgctggtgcaaatcctacagttcaaaaggccaaggaacctggagtctgatgtcgaagaccaggaagagaggaagccaagtgtccagcatggcaagggaagagtgagagtgggaagactcagcagcaagctgcttatctcccttcttctacctgctttgttccagccttgctggcagccagttggatggtgcccaccaattggtgggtctttcttcctagaacactgactcaaaagccaatctcacctggcagtaccctcgcagacacacccaggaacaacgcttcttcagccacctgggcatccctcaatccagtcaagttgacacctaatgttaaccatcacagtggtctattattactgactatctttatcattgtgttagtttgggaaatactagctgtaataacaaataacccaaatatttcagtgctatataacaacaattcattgtgggctgtcctggttggcagatggctttcttccatgttgtgattcagtggtgaggctctttttatttggtagctctgccaccccttagggcctcagtgtcttctttatctgtggatcctt

SEQ ID NO: 1723 - DNA, 157 bp, Homo sapiens
cattaaacctgactgtgatataatgtaaatggctacatcgcaagataaaagcaacctagattcctgaattactgcttgggaaagaacctttaaatcaggaatgcccacgttggactttatgtgaatgagcaataaattacatcttgctaagctattc

SEQ ID NO: 1724 - DNA, 796 bp, Homo sapiens
gacctagtagagaaacactactgaaatattacgaggcatgatacagtaaaaggcctggccacaaatccaaggactgacggaggtatagagagtaataatcttggcttgcaccagttctttcaagagccctaaaactggactataaaaccatggaagacactgatgtgaagagacagatggctacaataatagcgtcattattctatagctttgagtgaagtggatacagcatatgttccataaacttaaaagaaaaagaaaagctcacctctattcataatgaaaaagaaacattgtaacagcagagactctgggtgccatagaaagaaaatatgtcatgtcagatatgcatatctaagtgaacatattttatctcttaaaacttaaagggagaacagctgtagctattattatttttcaacaagtgattagtttgatatactgatactatatttgaatttgccaataacttaatcagaaaatagaatgtgcagttttaataaggatattgtttaaatcaggcccatctgcactgtgtctcctaggcctcctctccaaaaacagtcctggatcagaaaagtgaataatttcaaacaattataatgattacaaaggaactgttaccacctgctgctgactcttggcagccatcagtcaatgaaggatttaattagaatatttatcaacaatggccaaaatgccttttgatttgttcctgatttctccaagctggaagagtaaactctttgcaaacttcaattaaaagacattggaaattcaaaaaaaaaaaaaaaaa

SEQ ID NO: 1725 - DNA, 523 bp, Homo sapiens
cggatttggccagtatgtctttgctcaagcatccaaacatctgacctcagtgacagtgttcaagcagttggaatctgagcaaactgccatccatcttatctgatttctcaaacaagtccacctcttgcccaaggagcatcaccagtagaagctgaagagggatttgtgctgtgtgctgtgaagtgtcatctgagcttatcatcatgtccagaactcaacgaacaatgtcaagtaacaatgatgatagaagaatcagactcttggtttttaaagacctatgggaaacgtcatttgaatacaccaagcccagtacccatttgcttccaaagaagtgttgtcagagttactttttgaagagtatcctcctaaaggttctaagatatttcaaacttagagtctaagatcaaaatgaagaaaatgggacaaacagcacagtttcttttaaataagctgctactttaatactttaaatctagatcctgaattataacacagtagtaaaatcatggcctcgttggcctca

SEQ ID NO: 1726 - DNA, 308 bp, Homo sapiens
atcccagtgacattttactgcaacaaaaccaaactgtatgaagttaagccctgtctccaggaggcatgaaaccacctccacttctcgtgatgctggcttcttctcaaaacaatctcaaagacagctccccggatattttgaaaattcagcttctgtttttctgagaaaaatatattaataacttctgaattctctgacattgaataaattgaacaagagtgttagctttcatctactgggaaatattcaaagctaagtctactaaattgaataaaacttttaataaaaagctggcctcgttggcctca

SEQ ID NO: 1727 - DNA, 314 bp, Homo sapiens
cttgatgatgaagaagtatctactcttggaattacttcgtacaaaaaaagaaggtggagaactgtcagagaaatcaaaacaaagacctgattgaaaaaatatgagaaattaagtggccataaatcactatgttcaaatggtcttcatctaaaacttctgaaagagttaaagaaggatgtagctaagctaccaccaaaaatgtatcaacaccttccatcaaagaggagggtgatgaatgcccatcaatctttaagaacagttcagtgttacttgtaaggttaggttttaataaaaacatggcctcgttggcctca

SEQ ID NO: 1728 - DNA, 241 bp, Homo sapiens
attatgtgtccggcgtccccagatcgacacggagatggactggcttgcgggggaccccacgtcctcttccccaacacgaggagcctcgggatccattttcactgctgcaggcacaggggcctcctcagctcctcctcgtctgctgttcctgtttcgtcctcttcctgcctcgtgcttcgttgatgttctgcaaattatttagatgtgtaaatgaaataaatggatggcctcgttggcctca

SEQ ID NO: 1729 - DNA, 138 bp, Homo sapiens
atggtgaggatgcaaagagaaagtggctgcctgcaaaccaggaggagagccctcaccaggaaccaatctagctgacactttgaacttggacttcaaacctccagtattgtaagaaataaatatgttttcaaagtcaaa

SEQ ID NO: 1730 - DNA, 229 bp, Homo sapiens
atgaaaattccaaagattcatcatctatgaagaagaaaatgaagagaaagaagatgaggagggaaatgggaagaagaagaaaagaaaaactggaattaaaaagtgagactattaagattgtaatgtacaacattaatacgcaaaaatctattgtttttgtatatatcatccagcaattaataattggaatttaaaataaaaacgtgggctcgtggcctcgttggcctca

SEQ ID NO: 1731 - DNA, 220 bp, Homo sapiens
tagaaaattccaaagattcatcatcatgaagaagaaaatgaagagaaagaagatgaggagggaaatgggaagaagaagaaaagaaaaactggaattaaaaagtgagactattaagattgtaacgtacaacattaatacacaaaaatctattgtttttgtatatatcatccagcaattaataattggaatttaaaataaaaaagtggcctcgttggcctca

SEQ ID NO: 1732 - DNA, 849 bp, Homo sapiens
atgcttacaacagaacacatgcctctgccagtccccacatgggatcccagatgagaaacctctcaaggagaataacaaaatgcagttggaatcaaagtgtatgaagcctcccagacacacccagcaggagtcaccaggaagcagctgggaagaggctgacagcccaccagcaatgagaccacaggagctgctgctcccgggagggagtctgctgtcatcctccacttgctagagttctccctcctctctgcttgttacacactgcttccctgctctagagcttgctccagagatgacttcaacagaacagagtggctcttccttacttgaaacacagatccattgtacctgtggctttggctctggattgtctttctacttagaggagaacaagggtgtgactgagccacatgatggaaagtaaaggtacaaccaaaaattgtggcgtttcctcttgtttatgacattaaatttccctcagcctctaccctcatgctgcctgcttctctaaggctgctcccagggaacaagttaataatctcaaatacagtaattcttgcccctttcagaggtaagagtttaacaggggacaaaggacgaattttccattcatgggctttcaaccatcagtaaaatgttgattatttttcagcactctagatattatactctgagcggctcttgtaaaaagtaatgcaagctggggttctacttgcatgagcccttactgtattcacctgcaggcgagaggttatgctgatggaacttggcccatgatttgggaatgtgttgatttacaagttattatataaattataatgcaatgtgctactaatcattaaaccccat

SEQ ID NO: 1733 - DNA, 1065 bp, Homo sapiens
ggtgccaagtatccaggaaccatgtctattttcttctctacaagttctactcagtacctaattcagtgactaatacagagcaggaatttgacagatgcctgttgaatgaatgacaataggggattttggacagttggattaatttttccatttaagatgagcatactgaagcccagagacattaagtaactaggctcattagtagtgacagtgatgttgccaccaaactgtaaagccaggatttggactcaggcaagtgaccccacagttgtgttcttgagtgctccaccgcagcatcactgcaggaagtggactagattctcatgggccttcaggatgatgaagaattctggacgatttacagtggaaaatcaggattactgtggtttttgcctgctcctccctgttcttccttctttgttgtttagacaaattctaaacgacagaccttcagctctcaaatgctagaaccttgacgaagatttatagcctattctctttagagtgccacttttccttcctttcttaactgtactatgaatggctcttatctactattggtcttttattctttccacagtttactccaatctcctagaataaatcatacatagttggagctggtttggagaacagcattaaattctttaatgatgcttgtagtccgactcagcatttccttattatgatatgtcttactgacaaggactcttgataccacctcataactctgcctcgtggctagcgtgagtctgcgcgctccttaggaggtagtatgactcctataccgctggtcgcgttgttggtatgtttgtcctaagcgaattgctccacacgggatcgtgaatactgacaatgcttaagcgcacctcagcgtcgcgtttttatccacctgcgcccaaatccgcgctaggcgaccagataaaacaatcctgatccaggttcgccctgcatcactaccctcctcaagatgttaccactattctcttgcacacgggaaatcttccctccattcaataacccccatactcccgtttccgcgcgtacccccccttattttgtccc

SEQ ID NO: 1734 - DNA, 627 bp, Homo sapiens
catttcctgcttcggccatgtgaggcggctgctcccctttcgccttccgccatgattggaagtttcctgaggcctctccggaagcagatgctgctatgtttcctgaacagctccagaaatgtgaaaagatcgaggcttgaagagtggagggcctgggctcctccagttagacacggcacagccaggcctacaggagcccctggtcctggcatgcgagctctgccgccccgccacctgccctgtggatgcactctgcagggcggcagcaagccagagtgagaggcagctcccagctggagggaagaaccagtacctcaactctctgttctcagggcaccaccctacacccagctcacctgaaagtataaacaactgttttgttgaataaacatacgcaggtacaggccggctccgaaaacaagcaatgcgagaaagaaacaccgtaactaaggtgagtgcaaaagattaccagggcccaaaagaaagacccattaacaccagctaggcaggtctgcaaaggcggtcgccctgtgagcagtacttaaatgttactttaaacttttcagccacattggattttttaatgtgttaatcgtttataataaagatctggccctcgttggctca

SEQ ID NO: 1735 - DNA, 211 bp, Homo sapiens
ctgaaatgctgctattatgacacatctctttctggaaaagcaccatcaggaaccacacgcattcccagcctggtttttgtacgggatgtgctttccacgtatgcttctcacagtgagcgtgaagttatggtgactggcctgtgactctgcttggtggttggtgctgccaacctagggattaaacaataaagagatggcctcgttggcctca

SEQ ID NO: 1736 - DNA, 260 bp, Homo sapiens
ctgatggagtctcgccctattgcccaggatggagtgccctggtgccatctctactcactgcaacctctgcctccctggttcaagcaattctaatgcctcagcctccctgggactacagctattctctgaaatgaataactctgcatttgaaagaggtttttgagagaagctgggcactaaaacagattaagatgaaccgaagacacagaaaaccattatgttcacagaataaacagttttagtcatttaatgttgtaaaa

SEQ ID NO: 1737 - DNA, 514 bp, Homo sapiens
caggtcccacgtgtttcaatggacatttgtctccatcatagccacatcacaccacagatttgatttttcagttcatttggtcaaatgccactcaaaacaagaaatgctaaaggagaagaagagtccagttcaagatctgcatttcatttctgatgttggcccaacaactttttccttccagtttctcggaagcctgcctccgtagttctcttttcccccagttcgcccaagaatttaaagtgagaattcagaatattctttccccttttcccctactaatgattcaacaggtagtatgaattttccatattctgtttaatgctaggcatcagattttcagagtttctagcctcatttcctctgaaaccattatttttgctgtgtagtatctctgtctaaggttgtattttaaaagattcccaagtcctttgtactatgacaagcatggaatataactttactattgacaaagaacaaagagagatcagaaataaaaacactgggaactgtaaaa

SEQ ID NO: 1738 - DNA, 171 bp, Homo sapiens
cccgggttatgaatgtatgcaactaactgcaatagactgaacaggacctgcaccttcatcacttaaagaaatcacagattcttcctatcatatcattattatcatggatttgttgctatctcattttgtatgcattaataaacatatttataaaccacaaaaaaaaaaaaa

SEQ ID NO: 1739 - DNA, 810 bp, Homo sapiens
aaagcaggcaaacatggcgattttcgcgggcttatagcgcggtatcaacttatcggttgcgcggtagctaacgtcgcggttgtaaccttgaggggtgttttactcgattgcggactatcaagggtgattacgggggtttcttgcgctaaggcttttaaggagtgtttgttgaacacctctggttcccgccatttcgagactgtgtggtgccgcgaggtttgtggtggggctcgggggagatagacctgagtgtggtatatatcctcgcttggggggcgagaaggggggggggagtcccttgttatgtcatggttggtgttgataggggtctataaacttggcatttgttcgtgcggttggaggtggacttcattgaaattcgagtggggggggggaagctctcacaggggggggggcgttttttgggcccgcaagtgccacttctaaaaggaggtggggttttaccccgcccttttggaaagggaggaaaacggcttatgtaaaaacttctttttttctttagagaaaacccccttctttaatagtggtcccaaaaagggggttggggggtttttttttggggtccagtcccgggggggttccctcgcccccctcagcttggggtgaaaagttttttggaagtggagggggcccttttgctttaatttggggggttggtaggttgagaaatttcccttgtcctccttcaaaaaaatggtttgggggcggggtccaaaaaaaaaaaaaaaaaaaaaaaaaaaaaccacaacccaaaaaaaaaaaaaaaaaaaaaaaaaaaaaaaaaaaaaa

SEQ ID NO: 1740 - DNA, 270 bp, Homo sapiens
ttccaggccctgggcgaggccacctggctctgtcctgcacaacttcaaggaacgtgcaaagaggcagcctgtgtataacatgacgaaggatggacaaattaactgatcttcaaatccctttgaactgagattaaatcattctgacaatggatactccagtatttatctgtatcttcttcacatttgctttttaaaatgtcatttttttaacatatattgttttaataactgttctggattaaatttggtttagaaataaaaaaaaaaaaa

SEQ ID NO: 1741 - DNA, 581 bp, Homo sapiens
ctgaagacacagtgaagaaagacagtctcctcaataaatgatgtataactggacatccatatgcagaagaaataaaattagaccttctctcacaccatgtacaaaaatcaactaaaaatgagcaaaacctgaaaccacaaactcatagacaacatggaaaaacttcctgtcattgattcagaaatgatttatttgaatttaataccaaaagcacaggaaaaaaaactatgtgcaaattacaaacgacctgataaaagggaaaaaacctggatagactttttttcagaaaacccactcatgaaaaacagagcctaaaaaggttcccaacattactaattttcagagaaattcaaatctaaagcacgatgaaatattgcctcaaaccacttaaaatgactattatcagcaagacaaaatatgacaagtgttcacaagaatgttgggaaaggaaatcatgatatggtgtggtaggacttgttactcaataaattgaaaaataaagttatcgtacgatctggtgatcccacttcttgttatatattgaaatgaaataacattattatgttaaacacaaaacaaat

SEQ ID NO: 1742 - DNA, 664 bp, Homo sapiens
attctaaatgcaaatgaaggagtcactcatcaaaggcttctatggctaaacttcatgactctatactaatcaggaatctaaccaagaaactcacagctgctcttgagaagatgccctgctaaaccactaagacaaaaatcactttttatgacctcacccagtatttgatagaaagagattagcagcttgcctgtaatctactctcttcatttactgggagattctctgcaaagagaagtgacccaatcaaatttccttgccaaatacattgttggtatgttgtggtggacgtatctgcatatagaatgctttagcaagataaccctggtctcttgagaattgcttatggtgaagaaacccgaaatccatcgattcatggagtatgactttataagaaatatcatgtaacctgtaactgttacagtatacaacgaaattttgtgaataaacagcttacttatgtgcaagtaatggctgcgtacatttcttacagtcattgattgttaaatcttgaccggaatcagtcctaatgtgagaagaaaggacctagaaagcttctgggtaaatgattacttatatatatttataatcttaatgaattgcatgggcacttgaggttattggtaaagtttaatataaaataaattttctaaaaaaaaaaaaa

SEQ ID NO: 1743 - DNA, 535 bp, Homo sapiens
cgtccaattagaacatatccatgaggtatgccaagggaccacctataaaaatatggaaatctggcccagatcagatgctatctatacttatgttaagcatcttcagagacaccatggatgatcttcattctgaatcccaggaagaattctggaaagcaatcacctacctcttgatattttctccgtcagatattacctaaaggtttttatttttaatttactctcatctagacacagttctttttggggttgagaaaagtttattttcagaactaaaaattagctttttgccccagcaaaaagatgagatgatattttcaaggaaatgtctccctacaaatttgacagtttttttttttttaattgcttagtgaatactgaattcactgctaaaaataagggcatgccttttggtagtttatgaagagcatgaaacaaagtttgatgttttttggactgttaagccactgttacatttataagacacccaatacataaataaaaaaaaatatttcaagtctgaaaaaaaaaaaaa

SEQ ID NO: 1744 - DNA, 219 bp, Homo sapiens
atgatgtcatgttggagcattgcatactgctcttctcccttctgcctttacatacaagatgcctgttgctgagaacacttgttcccacttctctagcaggcaaggatctgggcaggacaacaaccacaggtcatgatgcagcaagaaggccctcaccagatgccacccctccagaaccatgagccaaataaatgtctgttctttataaaaaaaaaaaaa

SEQ ID NO: 1745 - DNA, 261 bp, Homo sapiens
cctgatgtcatgttggagcattgtagactgctcttctcccttctgcctttacatacaagatgcctgttgctgagaacacttgttcccacttctctagcaggcaaggatctgggcaggacaacaaccacaggcatgtgctttctcatcatgtgatgtcatccgccaggtcatgatgcagcaagaaggccctcaccagatgccacccctccagaaccatgagccaaataaatgtctgttctttataaatgaaaaaaaaaaaaa

SEQ ID NO: 1746 - DNA, 743 bp, Homo sapiens
ggtccagggtctccacagttgaccgtcctggaggagaagaggttaactgctctaagagatgtggctgaccctatcctacaggcttgtctgaaaacctttccggtgtattgaggaccttataaatcccaaagtatccttggaacttcttttgcagtttcctgaattgagcaagtttggatttctatgagaattgacatgcaattacaaatggatgaatttataaggaaaatgcaaagataaagaaggaaagctacctgcatagtatatatttatctacactgcatgttagtataatctgtgaatatttctgtatgtgacccaatacttaccataaaattagagaagcaaatgaacaaattaatgattgtattaatgctaaaatatataatttttctattttgtcatttaaacaataaaacagctcattctgatttatttatcaataataagtacctgtgtgtatagcttattattaccagtggagaggtggcttataataaaattatagcaatttataaagctatagttaactatgtagaaaagaatggtttaagctcaataaaaatccagtttaattactgcctcagcattgtaatagcaagcaacaaatgcactctagtgggtgcatatagcaatttaaaaagctattcaatctatataaaaccagggttttttggttggcttggttttaaaatttaccaagtattattaaaacacattagaaacttttaaaaaaaaaaaaa

SEQ ID NO: 1747 - DNA, 397 bp, Homo sapiens
gtgtgactgtgttttgaaacgaaagaggaatgaagtgctcatttaccaaaagcagcagagttaatggaaaatagaatagagctaaaagctgagagcagagtctacagaaaaaaaggctgaaaaactgacatcacagggcgaagcgatgaaacgatgttaatggacacaacaaaaacagaagcttgaaatgtgcatgtgtggctggacttgaccttctgtttctcctactaccatgagaacatgacctaggtagcctcctggtcccagaagagagacacatgggggagaacccaaactctggagtttaatccaggctgagttcagcctagaaaccccaactgacatattcaggtacacaggaaagaaataaatgcatgttgctgtaaaaaaaaaaaaa

SEQ ID NO: 1748 - DNA, 487 bp, Homo sapiens
attattggcaattgtctacatgtacggctctcatggtttccatctggaaagcaggtcacaggtccccactctgagcctgagttcagggagcccatttccaccctcactgctgaaggctttaggatgcaaacaggcttactgtggagagaacagtttctagcagctgaggactattcagagcaataaaacacataaggggaaaaaagagatcctatgagtacattcagacctggaaatcatcacgaattaacagtcatttaaaaagagaatattaacagaaggaaagaattctatactgcaattcagatgacctggatttgagatccacactttgacttcaagctgtgtgattttagaacacccaactctctgccaacttcacagggttgttggggcaaccaacatatgagaaagcacttggtaaatggaaaagcattgaaaaatgtaggttaataaaaatctactgttaccattaaaaaaaaaaaaa

SEQ ID NO: 1749 - DNA, 1140 bp, Homo sapiens
atggtgtatttctactggatttgccgggatgcaagagcttttgagtggtttgctgatctcttactctccctggaaacacggatgagtgagcaggggaaaactcactttctgagttatcatatatttcttaccggctgggatgaaaatcaggctcttcacatagctttacactgggacgaaaatactgacgtgattacaggcttaaagcagaagaccttctatgggaggcccaactggaacaatgagttcaagcagattgcctacaatcaccccagcagcagtattggcgtgttcttctgtggacctaaagctctctcgaggacacttcaaaagatgtgccacttgtattcatcagctgaccccagaggtgttcatttctattacaacaaggagagcttctagactttggaggtcaagtccaggcattgtgttttcaatcaagttattgattccaaagaactccaccaggaattcctgtgacggcctgttgatatgagctcccagttgggaactggtgaataataattaactattgtgaacggtacactataccatacttccttagcttataaataacatgtcatatacaacagaacaaaaacatttactgaaattaaaatatattatgtttctcaaaggcttcttaactttgtggactgtcattctgccataaaagagaattaaattgatctgacatgatatgttttgacaaaggcagcctcttaagctctctaagtatttctaaattataaattgatcacttctttttctttatcctcagattttatgttgacctgatgatttctatgatgatattgattttataagttaggaatattccattcatgtctaaaaaaattatttctactatctctgcattagaatttctcagtaacttgaggtattgcttgatgcatataactcaaactctactaatttgaatagaaccagtctttctgtgtaatcatttccccatttaagtttaattcaggctttgcaaccagaaatttctatagttaaatctaatctttactttagcaggatattaaatatattaaaattttttctcttggtcatgtttaattattacttttctttctctgtctacttgaaaataaaagtactttttgatcatcacaa

SEQ ID NO: 1750 - DNA, 358 bp, Homo sapiens
cttcaggttgcatggtccagttctttaaaagaattattggcttcttcttgggtgacccattggatatagaaattggtctttgagtttaaaagagattatgaatctgtgcttgtcctcaactatcggggcaaaattatgtttcctgaatacacctggaaagaaaagaagaaatgtttctcaggcaatgataccaggagataatagactattaaattatcattcatagaaggggatttagcaaacatgtgaactcatcctctccttacacacttggggctgaaagactgtatacctgtctactgtgaaaaaaaaagaagaaaaaataaataatctcaatcttttcacaaaaaaaaaaaaa

SEQ ID NO: 1751 - DNA, 495 bp, Homo sapiens
agttgtattcacatatgtggatgctacctgtctgctagtcattgacatattctgctcctgacatccaaccatcaagatggtcatggctctgtgatccaggatcacctgaagcagatcatcctttctctgacatattatcagaagcacccctgctcagactgaatgggaatactgataaacacgaaaacatgctcaacttctctaataatcaaagaaatacatattaaaatgagatgccactgtttcttctatcactgggactgaaatggaaagtattcatcatatcctttgctggtgagaaagccggacgaagaaagatcagagagagcgccacccccattccccacagcgttccagctctggccctgctctgtggctgcccctcaagcctgaaaatcacctcatattcttacaataaatcccttctcctctcttgcttccatttttctttacttatttgcaagtaaagagcgttaactaataaaaaaaaaaaaa

SEQ ID NO: 1752 - DNA, 698 bp, Homo sapiens
atgctatgcaggaagacaaaggttagaggaaaatgaaacacattattattgctgggagcaaacagaagacacactatgaagaagagatggagtttgagcatcctggcaaatccagactgaagttaaatgacatccaccaaacaactccaggctgtgaagaaacagacagctctcctcccacttctcatcttccttttctaggccattaaactgtgcactgaaaaagatgaagatacctccccaggctttggaattatcaaaataactttggaattcttgatattgattaatatcaatactattcctattctattcaggtcaactaagacaatgttttcaaattttagattatgattcattagttgataacaaaatcaatttaattggctttaaaagagacataaaatagaaaagaaaatataaaagcatgcatcacatgcagtaaggacgagtctatgtatgtaaacattttgtttcaaatatatatgtgtgttagtttataagatgtacatattgcgatagtttaatgtttcttattgtgagttatagtcaacaaagtgttcaaaaattatttaattaaaattgaaagctccccaaaggtgcagggttttgccttgtgcaaccattggtcatccagcacctaaaacacatacataataaatattagctgaataaatatatggcctggggaaagtcaa

SEQ ID NO: 1753 - DNA, 851 bp, Homo sapiens
accgccaaacctctgctgaacgactcagatccacatcaacagaaacagctctggtaacacattcaaaggggtaactgaagaatatttaatgaaggaattgtatgtaagaacatgagcagagtaaaggaaaaccaacaaaagaaagaaatactccctggtccccacccataggcatgaaagaataaataaatgggactatgcaaactcacaagcttctgcatagcaaaggaagcaattaacagagtgaaaagacaacctacagaacaggagaaaatatttgcaagctagtcatctgacaggggattaatatccagaatatacaaagaactcaaacatctctacagcaaaaaacaaacaaacaaacaaacaaaaaagtaaaacacccaaacaatccaatttaaaaatggccaaatgatctgaactgatatttctcaaaagaagacatacatcaggccaaaaaatgcatttaaaaatgttcagtatcactcatcatcagggaactgcaaatcaacacaacaatgtggtatcatcttaccccatttaggatggcaattatcaaaaataaaataaaataaccacaggggcttgtgccttagtcccagctactcaggaggctgaagctggaggattgctggagctcaggggctcaaggctgcagggagccatgatcatgctactggcagacccacactgggtgacagagcaagattctgcgtctaacaatacaggtgagaaagacggaccataacaaaggctgatgacgaggatgtggagaaaatgaaactcttgcgcactattgcgggaatatgaggtgcgacccgcactatggacgacaccgcgacggccgctcg

SEQ ID NO: 1754 - DNA, 683 bp, Homo sapiens
agaaaatgattcttgaaacatcacctaggttcccatggccaggaggccctctaaaagacagcgttttcatgcctttaagttgtggacagatggctcagtgacaggcgatgggtattcatacgtgcaggactgcatctcattacactctaacaagaagatcgtaatggaaacaatcaaaaccaagcctggctaatcacatgcaacagacactgattttttttttttttttttaactaagggcaaggacattttcatgcaatctgagaaatctgatgatggatgttattttcattatcttttatttcttttgttttttgaaaagctaagtaaaccaatataatttaaaaactaatttccaattacattacagttatttttattattgttttcccaccatattattttggagcaaccatctctttttcttgattactattttattatctttctagaagtcctttaaaatgtcttttgtaaaccactttcttccctttaagatgtgtgcaatcaataaagaagaatctttcagcacaacctcccagtatcctcatcaacaaaggaaatttgaatatgtagcaaatacacaagtctctactttagtttataatgaaaagtacatgatacccgccagacttttcctataagtacattaaagaaaaccagcaatctcaaaaaaaaaaaaa

SEQ ID NO: 1755 - DNA, 331 bp, Homo sapiens
cattgtctaagagccattacaaaaaatgagagaagaaagttgtcagttctgttctgacaggcctctgctactgaacagtgggattcttcttcacatcaaatccacaggcgcagaagacttgcatatcctgggcaacggatctgcaaattaattttctttctttgctggaatctgtttccttgcatccactcatgggcagtcacctagaggcttccccaccaccggcccagacacatctccttcattcttatgttgctttagaaatgtgcacggatgctttctttttaataaaaaaaatataaacttagtctataacagaaaaaaaaaaaaa

SEQ ID NO: 1756 - DNA, 779 bp, Homo sapiens
catgttctaaggcacattacaaaaaatgagagaagaaagttgtcagttctgttctgacaggcctctgctactgaacagtgggattcttcttcacatcaaatccacaggcgcagaagacttgcatatcctggggtaccaaatcttcagaatcttgacttaagaaagtcagaattggaaacagagctgctacaatggcaatgacgagctgctcagctcctgaaacaaattttctttgtcctacagcaacggatctgcaaattaattttctttctttgctggaatctgttaccttgcatccactcatgggcagtcacctagaggcttccccaccaccggcccagacacatctccttcattcttatgttgctttagaaatgtgcacggatgctttctttttaataaaaaaaatataaacttagtctataacagatatgcacttgtaatgaaagttttattaaatggaaatataagtgagagaatttcagtgaaaaaatgtttaattttgtcttaggcttctgacatttggagatatttcattttattcagttggaaatgtatacccagcaaagacaggttattatttctagttaacttgtatttggtaattgggtaactaacaccagatagtcttggataattagtttaaataactgcataataaacctaatcatcaaatgggaagagtacgcatttctaaaattcattcattcactccttggttgtttctttattcaatggtagtttattaagcaccacgaagcactatgctcaacgggtca

SEQ ID NO: 1757 - DNA, 243 bp, Homo sapiens
ctacttggcactgaccccagctcggcaacccagatgagagctaattttggggaaatgacttcgcctcttggagtctcagtgagaaaacaccaagaacccctcaaggagcagctgcaggtgaagcgacgacatgcacagcatgcatcagaccgcgctggacagaggcgcttgttcctgtttctacctctccccacttcagaggattccttcaataaaaatcaatttccaaacaaggaagatgaa

SEQ ID NO: 1758 - DNA, 767 bp, Homo sapiens
gcatcttacaaggatcggtccttggaacaactgttagcaaacattgcttgagatgatttgcatctcttctctgattggctgacaaacgcaagtagctgcagtgacagacttctcattgtgacagatgggccacagttatttccattttagtctgttttgtttagaatttatgttgacaaaaagaaaaaaaaagaaaaaggaaagaaaagatttcctggaaacggggaggtgtttgttgtgtttcacaagatgcctgaaaggcacaagatttctttcaacttcaatcgtcggaggataacactgcctggggggccgcagagccgcagtctggcaccgtgcaatgcaaatcagcctggagactgacaaagaagagacagaaaattgatattccactagttttgaaaaagcccaaagtaatatttacaaataagatttttgatgataccaagaggaagatagtttttttaataaaacagaaaaccataaattctcctaccagcaaacaaatgcagttctcacaatgtgactattttcagcagtcttttttggtgaatgcgcccactgctcatttgtgaaggaaacacatatggacccattaactcgtgatatgggatttctgggttaaattgggattggcaatgggaaaatcatttccaggttcagtggtttaatttctggttgacaagactaagtttattcaaagcataaatgaggaagagggggagctatggaagaccaagcatataggtagcaaagtgccttcgcca

SEQ ID NO: 1759 - DNA, 748 bp, Homo sapiens
ctgaaaagctactttccaagaagaataagaaaatggaagtacaaatttccaacagcatacattttctctgctctctccttggctttgaaagaggatgcgtgaaacagaatttcaggctgtaattaatgcagctcttcataagataagaggtccttttatctacagaaaaattgctgcactaattcccaacaagaagtgcaatgctccggttaatgctctttctacaagaagaattcaccttttctaccctctacatatttacagacaaatttgaatattttgttatgggaaactgaagatgggtaaacatacaatgataatagtactttatagggctaaatctaaaagccttaaagattaatattacgtttggataaatgctgaataagtttacataaagaactttcaaataacattgacgctacaggcatgtacttgtaagcacagaccttaattgggcacaacttagatccagcactctttgagggggagaataaacaaattgggaaatgcatcctcatttgatacagtgaggaaaaagagctatggttccttgctctgctttaaagtactgtccaaagaaagatgaagccccgctatttcattttgatttaaatatttccttgtagaatgcactttccaatttggaaacaatactctctatatgtatgtttcatgtatgtgcttggaataatggtaatgtgttgggactgtgttccacttaaatgcatggcattgtatactaaaa

SEQ ID NO: 1760 - DNA, 905 bp, Homo sapiens
ctagtattagaggcatttgatggataagtagtgtgccaaggtgattagtgacaacaacaacaaaagcaacttatttttgagcctgtgaaaggccctcttctagacactttatacaacagctgtatccttattgatagccctgcaagaaaagctattttccaagaagagaaagaaaatggaagtacaaatttccaacagcacacattttctctgctctctccttggctctgaaagaggatgcgtgaaacagaatttcaggctgtaattaatgcagctcttcataagataagaggttcttttatctacagaaaaattgctgcactaattcccaacaagaagtgcaatgctccggttaatgctctttctacaagaagaattctccttttctaccctctacatatttacagacaaatttgaatattttgttatgggaaactgaagatgggtaaacatacaatgataatagtactttatagggctaaatctaaaagccttaaagattaatattatgtttggataaatgctgaataagtttacataaagaattttcaaataacattgacgctacaggcatgtacttgtaagcacagaccttaattgggcacaacttagatccagcactctttgagggggagaataaacaaattgggaaatgcatcctcatttgatacagtgaggaaaaggagctatggttccttgctctgctttaaagtactgtccaaagaaggatgaagccccgcctatttcattttgatttacatatttccttgcagaaatgcacattccaatttggaaacaatactttctatatggatggttaaatgtatgtgcctggaataattgggaatgggttggcacctgtgtccacttaaatgcctggcatttgtatactaaaaaaaaaaaaa

SEQ ID NO: 1761 - DNA, 456 bp, Homo sapiens
cattgggtgaagaactagagagaaaatcattgtgaagaattgcaaaatggaaaagaaaagtcaccttcaactctctcctctgtgaagaaactatcaactttccccatcatctcctatagatgccacataacttgagctccatatgcttcacgaggagcagggtgcaacccatccagagaagatggattcctttggtcttttctaccaacatgctcatgaccacaagaatcaaaatcaccacagctccttgagtaactctctgacttttgccatatctatctcgtgtattattataatcatggcgggtgcttccaccataagacatccgaagccctcgtgcaggtggtgcaccatgagaggtccctgcagggttgataaaataatatgttcgactacatttaaacatttttactgctatcactaaagcatgaattagttaaagtaaaaaaaaaaaaa

SEQ ID NO: 1762 - DNA, 838 bp, Homo sapiens
ctggcacatctggataaaggcagaaacaaagtaacaagggaggaagtcccagtaatcacaagaaaccaatcttttttctcccaaacacatattttggggctgacatcatagccacatggcacaaactacagatggaaaagtatctgaactcaaatccggaaacttaacctttatcagatgaagacaagaaagacttcagcaggcaaactcacacctgttgggctgaggagctagaaatcaacaaccaaataccaacattactgctctggaaataacttctgttagaacaataaagtaagatgagggcaaatgactgagcttcccttgatgcttttccctgatgctattttattctgcagaaaatatccaacatacgatgacacctgaaaagaatgagtcctagcatctctgtgtttccacaccagcagctcactctgactctggctgccttctaggtctagccactgccttaaagtactagcccaccacctggtgtcaccagcccaacaccagctcagtctcctgacaccagcccttccctaaaaaatgctgcaggaccccccctcagcaatgcatggagagccgatcctctcaggcgttgatctatgggaaactgggacaggctccagaattataaacagaaggggtggtgtgtcttcctggatctcgtcatctgattgctatttaaaatggcttgactgtgttagtcagacctacgagttcatccaacaacaagcgggcacagtgaccagccggcctcagcccaggggcagaaagcaaacactccctcggttgggatttcagccttatgcagaccaaatagaggcccaagtattgg

SEQ ID NO: 1763 - DNA, 489 bp, Homo sapiens
tttttttttttttcacgaagcacgcagtagacactgctagggtttttattatagtacctctttcacacatgatgatttttgttggtgtttttgttaatgacagaaaaggaaaaaaaaataatagattctgggacagttccaaggaaagctatttgttactacaattttaatcattcagtttctcaattaatgttgtaattcctgaggctcacttctggaacttcctcccaaagcagacagctcctctgaaaacagatactctccttctctcggttttgggtggatttctgtagtttgcatgactctcttctgtatcaacaaatcagttgtacagaatccagggtcaccacaggtaagtaggctataattaaattttaaatttgattgaagaatgttgaattcattaatgaattgaggatctcccaggatcatttccttcttctattaattctgtttctttgaggttaagcctcaaactaaaaacaaaat

SEQ ID NO: 1764 - DNA, 653 bp, Homo sapiens
gactgtacgacctcaatgcactgctcaccctggcagaaatgacggccttctgctcctggcacaaagctcttaagtctcagaatgaaagaaaaaaaagctttctagatacaaaaactacttctcagtaacttgcaaatgagacttgctattcttttctcagctttgtgatgttgaagaagctacatggaaaggaattcagagcaacctccagccatcagccagtgagaaaccaagcccttcaattcaacatcccttcaagaagagaattctgtcaccaaccaagttagtttggaaacagattattccccagccaagcgctaagatgagacaccagccctggctgacaccttgactacctcctgtgagagaccctgaaacagaagacccatctaggctatgccgattcctgacccatggaaacccatgccataataaaaataatcaacagacctgcttaagaactctctgaccactctcagaaaagttagtcagtgggatccctctccattcctcccaggacctaaacaaaaaagaaaaagggcaagaggaagaagagaaacatcagaagaaaagactacatataaacccttataaacctattcaaaataaatttttgtgattggccaaattccttctctctaaaaaaaaaaaaa

SEQ ID NO: 1765 - DNA, 567 bp, Homo sapiens
aacacattggaagctgatacaatggacggctcatcacttataattcctggactctggactggatgcagaaacttaatgagactctggattgtctcctgggagagagggtgaaggttcaagtcaataaaatatgagaggcagtgctgtgtgcaacttctgcatcatctctttcactaaaaagcggctttccctggactctgttcttccccttcccaaggtcaggagagtggacaagtaggtgcatctgtccaaaccattcaaacaaggacaaactatattggatggcaaagcaaaaaagtgaaatattgtgtccacagaagagcttgactgtagatgaaactctttttgtttttcctgtgaacccagtagagctggaagatgtggtccaattctacctgacatacaaaataattcaaacgaaagaaactggcccacaaatatttgagaaaagaaatatttttctgtatacattagagtgacacttaattgatttaacaatctaaccccatcattcagtgcttaccacaataaaagtttatttattgctcacaaaaaaaaaaaaaaaaa

SEQ ID NO: 1766 - DNA, 296 bp, Homo sapiens
ctagaggggccaagaactactttatgaagaggaagatgaggatactgacagagtaaaatcatggagaaaatggaagaactgaatgcagacatgagaagttaaatcacagaagaaaagttaagcaggaacttgagagagggatgaactgtgacaagttgtaagaaggaagaccaggactcaccaggaaaataataaattgtccttgattgtacaaaagaatgtgttaatggaattttcctaataaatgtgagagaatgtcagcataaatattgattttaaaaacaaaaaaaaaaaaa

SEQ ID NO: 1767 - DNA, 486 bp, Homo sapiens
ttttttttttttttttttttgaaagaaagcatgtttattagagcaacagtgtacataaaatggctgctctgtagacaaaacagggctatcccataggcagagtagcacagaagagcatctgtggattgctggctagctctgcttataccgactcttatttacatgctaaataagggacaggttaaggttattcatgaacaaggggtggagggttcctggaatcacacaaggtaactcctggatcattgccacagcatttgtaaactgtcaaggctctgatgggagcatcttaggcaaatgcaaataagcagtgagggtaactggagatcgctttcattgccatcttggttctagcacattttctttgccacatcccgtcttgatcagcagcagggagactgaggctcagaaaacaagtccagctgatctcctacctcaatcccagggatgcattaggccttctgctgtttttgtgataatcactgt

SEQ ID NO: 1768 - DNA, 514 bp, Homo sapiens
ttttttttttttttttagcattgccttttgattctttattaaaatttcagtctctcatttcatattacccatgtgctatggtttgaatgcctttcctttctgaaactcttttcaaacttaatttccaatgcaacagtattgaattgagacctttaagaagtaactgggtcacaagaaattaattgatgaatggattagtagattaatcaattatcatgggagtaagttatcacaagagtggatttgttatagaagcaagtcgggcttttcagtgccttctctcaccctgtgatgccttccaccttgttgagacacaacactagaagccaaccagatgcagctgcccaatattggacttcctggccatgatatgaaatacaggtcctttatttataaattacaagacttaggtattcagctatagcaacagaaaaccaaataaagcaacatttattcttttatattcacttttttccatgaatgatcttagcaaattgcttataattatttttaa

SEQ ID NO: 1769 - DNA, 267 bp, Homo sapiens
tgaggccaacgaggccatttttttttttttttttttatgagttgaattctcttttatttaaacataaatgccacacaggcagaagaaagtcagaataaaaattccatggggtgttttaagtatgtccaaaatgggatgacacttggtcatttgtttagtccttctcaccctgttggaggcatccaagaagggaagaaagtagccagctggttgccttctttctctttgctcctgtctgacgctcgggcaaggagtgcagcctcctgt

SEQ ID NO: 1770 - DNA, 640 bp, Homo sapiens
tttttttttttttttttttctttcccgctaggtttctgtgatggtgagaataatggacatggggaaggtatgaactgattttacctacctatattggagtgggatgctgattagtggacataacctttcaatacctttactaataaatattcatgttttcaggactcccccaaatgctgacaactgctgattggcttacttttcagagagcctctagaaaattaaggctagccatgttcagggccaggagaaaggaaatatgtggttgcattacaaaggttcctttttatctaggtccccacagtcacaaggttgagcaaggaaccaaaaattgtaatcacatgaaaatatgaatgaattggcctggcacagtggctcatgcctgtaatcccagcactttgggaggctgaggtaggtggatcacttgaagtcaggagttcgagaccagcctgaccaacatggtgaaaccccgtctctactaaaaatacaaaaattagccgggcatggtggcacgtgcctgtggtcccagatactctggaggctgaggcaggagaatcgcttgaacacgggaggcggaggttacagtgagttgagattgtgccactgcactccagtctggcgaccgagcgagactccgtct

SEQ ID NO: 1771 - DNA, 116 bp, Homo sapiens
tttttttttttttttttcagctatagcaacagaaaaccaaataaagcaacatttattcttttatattcacttttttccatgaatgatcttagcaaattgcttataattatttttaa

SEQ ID NO: 1772 - DNA, 159 bp, Homo sapiens
tttttttttttttttttgaaatacaggtcctttatttataaattacaagacttaggttttcagctttagcaccagaaaaccaaataaagcaacatttattcttttatattcacttttttccatgaatgatcttagcaaattgcttataattatttttaa

SEQ ID NO: 1773 - DNA, 875 bp, Homo sapiens
tgcttgccaactactaaatgaaaatgatacatgtgaattcaaaacctccaacctctacccgatctctactagatgtggatatacgtgtaacgtggaattccttatgagaaggcaagaatggagggtgctgcaaacctatacagattcaccgccaatgtctccggaactcggatctcttccacaggggactggctccagaacccctgaggataccaaaagctgcagattctcaagtccctgatataaaatgtgttgtgggaatgggagttgaccttgttctccagcaacctttaaggtcattgttggcagttttggcttatgtcaccctcacagtagctactggtacatgaagctgcataatattttcaggtaaaaatcactagtcccattgttcaggtagtctgtagaaaaggcaggaagtggaatactggaagatgttaattcaaggttgtcttaaagtcacattgtggagaattttcagtgcatgttacagaatgtgtaatttactggggatggggaaaactacaaatattcagcaggaattaaatagcaatatctgttattaggaaaatagttgttataggtcatatgtagttcaatattcataatctttcttctctgagaaatctgaggtaattataggtaattattgcctctataatttcatagttttttaccttggaatgttcgtattttttctattttactggtattaaaatccattataaacagtagtacattcatttacatatcatttctctgaatagaatgcaatgtacacagaggtattgactacattttatgtttccatgtatctgcttttttgcctaactggttaggcataatgcaacataataaacccgtgatcgcaaagc

SEQ ID NO: 1774 - DNA, 464 bp, Homo sapiens
atggtgctgtaatggaaatcctttatttgtgactcttgtggccttgtgtgagagttttttcctaagatggactacagagaaccagagagagttttaaatgtcttattaccagaacttaaagacctttaagcagatggccccagcagttcttccacaggattgagtaaggaagatagagaaaaaggtcagcatgtaaaaaaatgatggtacttgacagtccagctgccacaatgctttcaaaaaactggatttctactggattcttcaagattacaaagttacagccttaacaaacaggttgtggacaaggaagacaaagagtgcatgaactgcctggtgatgaaagccatggtgcagtggcggcggcgactgcaacaagacccaggcaggaaaggcgcgtgtggtgttgggaccagcagacgggcagcctctgaggccattttctatttttgaataaaactcga

SEQ ID NO: 1775 - DNA, 1098 bp, Homo sapiens
caaatactgtctcttggacctagagaaaaaagatggattaaagggacacatttacgcattattaaaagatgggtccacatgaaaccatcattgggatgacattcaataaggaagaaaaaagaataatgatacaatcctaaggaatatcaatattcatgaagttgggaagagaaatcaggtaacacaaagaaagtgcaaatcagaggagcagatggacaaagtaaagacaagcatcaagaaagccatggatgaagagttttaagagggaagtgccctttggaaagttctggaggctgggaggtccaagattaaagcaacagaaaatctgatgtctggtgaaaacgccctctctgcttccaagatggcgccttgttgctgtgtcctcacagggcagaaaagatggaagagcaaaagggaccaatgctctgtgaagcctcttttatatgggcatgaatctcattcacgaaggttcaagcgattctcccaccttagcctcccgagtagctgggattacagacatctgccaccatgcctggctcattttttcttgtgtttttagtagaggcagggtttcaccatgttggccaggctggtcttgaactcctggcctcaagcgatccacttgccttgaccccccagagtgctgggattacaggcacaagccaccacacctggccagtatttattgaacaattagcatgcaccaggcactgtgcatagtgctagccactgggagcccagagtttggaagaggttgattaatccactggtagagtcatctgttccatcttaagttacacccattagaggttgttataaatccatctgtgtagtaaactgagatttctggagactaaacgacttcatggatctgtaactctattaaacaatatagtttcactccttagttaggattattctaaatcatgcactaggaccacattttgaatacctttttgtgaacagaaattttatttgcttgttggtttcatgacttgagtcatactagtcaccttctgtcatcttggcttgtggtaccatattgagtcagaattttagtattcattaaaaaaattcaaataaaaagcgatcggcaag

SEQ ID NO: 1776 - DNA, 313 bp, Homo sapiens
ttctggagactggaaaatccaaaaccacggcaccagcatctggtgaagatcttttcatggcaagagagaaaacacatgcatgtcagctcaaatctctttctcttttaataatgttgctagtcccatcatggaggccccagccttatgaccttatctaatgctaattacatccaaaaggctccacctccaatcaacatatgaatttggaaattaggtttccaatacgtgaaatttgggaaatgtatttaaaccacaaacagccagtttaaaagattttgcattgaataataaaagtgaaccaacaaatgtaaaa

SEQ ID NO: 1777 - DNA, 425 bp, Homo sapiens
cctttagaactggactggaattgtactttcctgggtctccagcttgcagatggcagattgtggaacttctcagcctgcataatcgtcatgattggcatccttctaagaaaaaacagagagacacaggcacacaacaggacactgtcatgtgatgatggaagcagagactgaagtgctgcagctgcaagccaaagaacgccagagattgccggctaacccccagaaggaagaggcaaggaatgttctcccctaacgactgcagtaggggcacggccctgccaacactttgttttttggcttctagtctccagaactttgtgacaatcaatttttgttgttctgagacactcagtttgtggcaatttgttgcagcactgttaggacactagtgtacactccttcataataaaccacgatgctgcaag

SEQ ID NO: 1778 - DNA, 223 bp, Homo sapiens
atggactggccttggccctccctctgaaggcacaaagcttagcacagacatggagacaggaggactctgccgggtgaagcagcaagccagcagatcacgtagactcggttctgcagctgcttggggtctttctggaaatccaccaagcaagcctcaaagacaaagacaaggctcgacccacagcccagtgctcctttctttaaaaaaataaaataaaatcaga

SEQ ID NO: 1779 - DNA, 152 bp, Homo sapiens
catggacagaacttccagcaggaccttgaatgttaacgcattacagatgccagaacctctgtctacctaaggccctcagtgactttgtgaagcagagtctcacctccaggctggaaacatcctggactattacatgaacaagaaataaacca

SEQ ID NO: 1780 - DNA, 1174 bp, Homo sapiens
acaacaaaatgtctaaatcacctttccaaggcttcaacaatgaatgtattttccaaatcaatgttggagtacatggtcagaaaagatgtcttttggacttgtgaaattacttatataaaaattcttaccaagatggaagcataaaaaacacatttatttatatgtttactaaatcttcttttattgaaaacaataagacaacctgaaagcaagtctatcagagaaaatctgggacttatgtcttcactgacaaaataataaatgagacaaagtgatagaagacctttgtcatgacacctgtttgctaccagagccccaggccatcgtcatccactgatgtctccacattaattctgcagaggtcctggacagtcttctctgccctgtctaatggtcagttaattctccttgtaagcacatcatggctgaccaggtgctggaccgcgcaaagaaaggtgtcagagctttcagcttaagccttgattgggtggtgagtaggtctcctgcagctaatcagtggctttagaaaccctggagtccttcagaaaccctaaagttcttccttctgatttttctggtagaccaaaggaaaaggccaacaacaaacaatttctaaataagaaatttccaccttagctaaaagcaaaaggcctttgatactctataagattgatcaactcacttcagttgaaataatggttttctgaagtcaaggcatgaacagcctttccccactggatgggatgctcagattaccagccctggaatgaaacaaaaggagaagactgtctcaccccacacttctcaaccattggccattctgagatgacacctgcagagccacagccccacctgcccgagcacccacgggtgccttggtcatcctgcaccatggagctgcttgtctctcctctgtgtaatctaatcttctatgagtccagatattacatgtttaaatttcttttccttttgtttttagtttacacataataattgtacatatttatggaatactgactgatattttcatacatgtatctacattgtgtaatgatcaaatcagggtaattagcatatccatcacctcaaatattgatcgcttctttgtcttgggaacactcaaaatcgtctctcgtagctctttcaaaaaatacaataaattagtatcgcaaag

SEQ ID NO: 1781 - DNA, 1138 bp, Homo sapiens
  misc_feature (1)...(1138): n = A,T,C or G
gcctctggcagtgcagcttatctcctggtccagggaagacagtggtcatcctagcagcacatcattgttcagctgaccctcgcatgtgggccttctcaagatgccctatataacataaagatgattactgaggataagcagcttgtaaaaccccacctcatccccacttctgacgtgtctttctggcagtagtgaatccggtgaacaactcatatcaaacatttttctgcaaacaggtcagctgaaatgccagaatctaaacaaaggcaacaaagaaggcagggttggatggccagtgccggtgtcacatgctcacactcgagaattcgcaaagcaaccatcattcatggctacagggaggcagtgaaagactacaatacaggctgttgtagaaaaacatgatgccaagcccaagaaaactgagttatggctgtcgtgggagtcttacatctcagctcttcagcacatgtctnacccaaggctgccttgtgtgatggttcgggtcctgttctaagatgagaaaacaccacaggaattctcagagtgggctgcttagagaggcctcaattaccctatttgagatccaaagcttccctggggaaaacttttacttaggtggctcccatggggaaagtgggtcacattcacctcctgctcagaaaaccccgccacacagctttacagcccccttcttacagtcttcctcaacaacctgtggtgtgctggagatggctcacacagaggcttggcttgtgagagctgactgttaaatttcaaaaatggtgacagccagctggcttcacattagtagccatggtgggagcattcacaccgaacactaccaatcagctcccctcccaccactcacagctccacaacccccggccccccagcaattgttaaacatttactagtacgccaaggaccaacgactctcaagctgaagtatcaggctccattttcctcataagtctttgtgttctctggccctttcctcaagatctttctgttcttctcctggatgttctcacgtaatggatgccacccagggcccctaacaatgttgttccccacaaactggggttctcctcttatgagtgcttcgatcctttctgggaaaataaagctagatcgcgag

SEQ ID NO: 1782 - DNA, 604 bp, Homo sapiens
aagaatggacagaggaaggagagatgaaaggagaaactggaaatttggggaaatctgtgtttaaatacagactgaagggagaagaccacatagcaaacttctagaattgatactgtctgtatggttacatctaaagcataacaaggggcagttgttttccagaattacctcaaaggaaagcacaacagtcagacgtgaaatggaaacagaaaaatcttctgaagcagaatagtaacgctgtgaatttaaaagtaatggagggaagatacttgattctgcaatttctacactgttagcattatctaaatctctctctccgttgaatgctaagcatccataagaaaccatgccatctgctactcagagtgttttcctaagatgcttccaggtactcatctttcctcaaaccctgttgttttgtgaagacacatcaacttcccatcatgtatagagcgatttcgttagacctcacatttacttgtgtcaaaacaatggcatcgacccattcagcagcaatttggaagtgttttaataatttgttgctttattttacagtatttattttgtgtcatcatttaaaatcaaataaaggaggatcgcaaag

SEQ ID NO: 1783 - DNA, 778 bp, Homo sapiens
  misc_feature (1)...(778): n = A,T,C or G
ctgccgatctttttttatttgagacagacctgatggctttgatatagtttaaaaaaaaaaagtctagtttcactaaacttagagtgaagatattccttcaaatttgtatcattttgcttgatactaaagattattaccacttgttattttcttaattggaacaaaaaataattacccaccatcagtcctgccttatccagtaatatctgaaagactaaaattttcctatgtgtttcttcccctttcttttttaacacatatataacttcagctcctttggaatgtcatatttgtactcattccactattctggaatcatttttgtttctgtcaacttgaatttctccaaggacccagtcccacttgtggcatcaaaatttgaatcgttctttactacagattgacaaatattaaaaatagaaaaaacattaaaatccaattcaacgtaatatgcttcaatcatctaaaacctagtcctttttagctcagagtattttattgctgaattgtgtttagctntgctgaccataacttttttttttttgaaacagaatcttgctctgtcgctcaagctggagtgcagtggtgtgatctcagctcactgtaagttctgctgcccaagttgaagcgattcttccacctcagcatcctgagcagctgggactacaggtacacaccactgcacctggctaatctttatatttttagtagaagtgggatatcaccatgttggccaggctggtcttgaactcctgacttcaagtgatctgcctgtcta

SEQ ID NO: 1784 - DNA, 704 bp, Homo sapiens
tcagggaatgcatgtggaggtttggtacatggcgatattgcttgttgctgaggctcagtgtaagaataatcctgtcaccaaggtaaaggaaacaagaataaagacccttgtatatggagtataaaagaagaaatgaataatgcagctgactgaagagggggactcagtaactgaagagctgggaaagcggattgaaaggattgaagacttaggtgtttgcctcaagaccctgggagttctttatccagttctcttatttttgttttgttttgtttctcatttgatgggaagaaaagatttgagagaagggtaactccaggaagctgttttaacaacctcagaactagaatactttgccacagagttataagatacttcttttttgcttttacttttgtttttgttttttgacatttgtttctgtttcaaaaatgttcaattaaaatatgtggcaaagacattctgttcacacaccccatccattgcaatgacagttcccagcttcaaacctgcaaaccgacttttttttggaaaccagtttgtctcctaatagcatttggttgcttttatctccttacttttgatttaaaaaaatgtttttctccttctatgtgaaatttcatttcaaaaagaagactgatggcaggcattgaatctggaagctcttccacccagagtgacaaaaataaaaacgtatcgcgaag

SEQ ID NO: 1785 - DNA, 951 bp, Homo sapiens
atgtgagtgtacatctggatggactggacagaactgtagtgaagaaataaatgaatgcgactctgatccatgcatgagtggaggtctttgtcatgaatctaccatccctggacaatttgtatgtctgtgcccacccctttatactggacaattttgccaccaacgctataacctttgtgacctacttcataacccttgcagaaacaactcaacatgcttagctttggtagacgcaaatcagcattgtatttgtagagaagaatttgaaggtaaaaactgtgaaattgatgtgaaagactgcctcttcctttcctgccaggattatggtgactgtgaagatatggtcaacaatttcaggtgtatttgcagacctgggttttctggatctctgtgagaaattgaaattaatgaatgttcctctgaaccttgcaaaaataatggaacatgtgtggatctgacaaacagatttttttgtaattgtgaacctgagtaccatgggcccttctgtgaacttgatgtaaataaatgtaaaatctcaccttgtctagatgaagaaagttgtgtctacaggactgatggatacaactgcctctgtgcccctggttatacagcagggataaaataatactagacacatggaaattatattggcaagcaaaaatggaaaggaactagaagtatttccagagaataagtaatcaaaagaaacagtatgatacccaacagaaacctgtatcttgaaatagactgtcagatataaaaaaaaattgaaggtctacatcatgcattctcaaaaggtttctgggatcttactatttttatgtattagacacaggtacataaaacatgtatctttggctgtaaaatttgatgatgaagagtgattagaaaaaaatatttaaaaagctttgtgcaggggcaataaagaaaaaataaagtgtactcgcaaag

SEQ ID NO: 1786 - DNA, 803 bp, Homo sapiens
ctctagaactgagatggctcctcgcctcccgaaaaacattgcggctgactctaatgaaattcactatcacccacaggcagcagccagacacacctactttattttcaaaattaaattggttggtgacagacagataaggaacaaatggcagggaaggtggagataataataggttcaaaaaatctccgtaaggaatgaacatttggatccaacaagattacaaaccaataatgagtcttcaatggtatgtcttgcttttcggtgtgaaggaaacaagaccgctgtaacaatggagcttttccaaaagctgcgataagatcttccttccgtgtctggaactgcactattaagcgctgcactcttaatcagctcaaagaggaagccaaggcttccttcccaggtcaactggcttccatggactgcaaaactaccttttacaaagcgctctggatgctgttagcctaggaaccactttctgtttcattccccttggcattagactaaacaaagcactgtgtttccattttaatatgtggtcccttaaaagacattcttctctacatcataaggataaagcagcataggttgtgcttattcagcctgttccatcactatcacgattatttacattaaattaaaaatatagttcacaaggcaaccagtgtgggttggcttgagaggggcaggagttgtctttgatgaacgaaataattttagataaagttaccctggtatatccctgcttagtgacaataagaacattttattcgatccaattcaaataaacccgatgatgctgtaag

SEQ ID NO: 1787 - DNA, 1137 bp, Homo sapiens
tattagaactcttttcgttgcaagcgacagaaatccaactcaaacttgctgaaaccagaaaaccttttagaaacagaagtatacagcgacttgattcaatatcagacaagcttgcaacccagctagctgtagagatgcaaataataccatcaggacttggattctctctctccatctctctaaggtgcatctctctctgatttcacttggagaaagtctccttccacataggagctccagaattacatcttcacagtgccaagccctgggaaaaacaaaattattcttacttggttgcccaagcacaagtcccagggtcagctgtatttgattctgttggcttgaattatgtcatgtggccattcctgagccaatcaccatgaccctgagcttattactctctgattggcctgaccttagtcacttgcctaccatagcgcttggactacagtgaactctacaataaagaacagcgacagagtgagctgaatggacaacaaacaggagctggatggacaacagaaactgcctactgtgaactaggaccatggaggagttgccaatcaaagcagaaataagggagaaatgccctgactgctctctcttagtcctccaatctcccaatattgcctctcattggctagtccagaaggcagctgtcaagaagtctggaaaatgtcattttcagtacaaaagagaggaatgtatctgacaccaaggaggcaaatgaatgacaccctccttgtagcaagaaagaaagattgagagtgctttcccatggaaaattaacagcttcatcttgatccttttctttgctatagtagaagaatttgaagcctttctgctactgaggaaacggaggctcagttttccagattttggccataggtcctagaggctactgagacagccaggtgggagggggtccccagagaaactccagccagcttgtgcactgtgatggagcctcaggaagttcacagtttgcagcaggaaggagcctggctgctcctcttcctgtgtggaacctgggattagaacagctggcaggaagtgctttagcagggactctggcctagtgagagtccttgtttccccctttcttccttttcactcaataaagcccgatgcggcaag

SEQ ID NO: 1788 - DNA, 1332 bp, Homo sapiens
  misc_feature (1)...(1332): n = A,T,C or G
ctatttcatgggagtatcacttgacctctctgttgattggttgtgtgactgaccttttgcactcagaaaaagagttaatttctgtcaaagtgctgtaaagatgaacaacttagagaaaactgagagcaagatggccaactagaagcctctactgatcatcctccctgcaggaacagcaagttgaacaactatccacaaaaaagcaccttcataggaaccaaaaatcagagctttgatgcatctcccctgaatttagaaaataggatgcatgttccctccgggatagggtctatgtatagcatggcaacttatacagttgtatttagtacggatggagatggaattctaaccaagagaacatgaagacgtgaactatattgaagtccctatgcaaatcttcataatgcccaggggactctatctcaacttcaagatgcaaacctttacaagcatgcagctgttccagacatcaataatgcatgcacagttcataatcataccagtgtatgtaacctgtcgtgcaagccacattttncaaggcatgtatccccagaggacagacaaagctatgcacagagaacctgctgttgcttaagnatttccactttctataaatggacaatnaatattaatactgatcttgaaaataanctgngaaccagaggngatnaccttanaagcagattgnngatgaatgaggagatgtactggaaggttctcaaagcctacctttcttacttggcttttgtgaaaaattgcaaatctttccctggtgagatccataccatgacttgctaatacatggtcgagagcacttttgtacttaattggtgcagaaatacaagtaaaggcagagctgtgttcacttcctccttcatttcctctctattccttttctgtgatgtcacatactgatacagcatctacacatagccatgtgtctaacaaacatatctgctcaaggcttagtcaatctatgaccttcctccttcctcatgcataccttaagcattgatttaaggtcaagcacatttacaggttccccagcatgcccttttccatcttttgctcctctatcctttctcattgtccttggtcagacttgcttgaactatgtttctcagaaaggcagatacgcttacccatggctctagcaaaaattcctttttcatttttccatgggtgctgcagatgttttaaactttggtaaaaataagtgtatctagcaccctgttgcccaaaacatctcagatgggctaatggagttttattatggaggaaaaaaccaaagtcacatataaagtacacgtacaaataaaagctgatcggcag

SEQ ID NO: 1789 - DNA, 266 bp, Homo sapiens
attgaagaaggaacctgaatttttttaaaacaaaaggaagcagtaattgtggtagagaagaaaggataactaacctttactgagagcctgctgtaatagctacacaatactatttatcacatatttatttcatctcatcctctcaatagttctgcagaaaaggtagtatttcccatttcataatgaggaaactcacaatattagtgggacctggatccaaagtcctaatatttatacgatttgtgcatttccaaaataaaaacaga

SEQ ID NO: 1790 - DNA, 938 bp, Homo sapiens
aggtacaagctaaagagcatgcttctggatctggatcctgggaaacaaggatacatgacgcacagaaagattaaaggaaaaagagaagagaatgtaaagacaaaagagggatacaagatgaagagttttctctctacaggatctgaataactttcttcagtagggtgtttctttatctacttaaccttccgagaaatcaagtccaagatcacacaataagtggcaaaatccaaagttgaaccaagtgtttttcccccaaccccagcagcttccatttgaagagggaaatcatttgagagactatgatacacgatgaagagaagcagggaatctgcagaggctgtttatacgctctattgaatagaggtcaccctcatcattgctgattcaagacatggaagctgaagctgtaatcagattggggctcagaagaatcccacagttccagaagtcattttaagaacacttagaaaacccttggaattcctcttcagggagtttttagacctgccaagcctgctttggaaaccaaaacgtgcttcttgcatctttttatctcaggaaaaaggtacttcctatgccaattcaagaccatggacctgaatcttagggtaatcatcccttcaagaaaagtgaagtgggccagacgaggtggctcacacctgtaatcccagcactatgggaagccgttcacttgaggtcaggagtgcaagaccagcctggccaacacggtgaaaccccatctctactaaaaatacaaaaagtagccaaatgtgatggtgcatgcctgtaatcccaactactcaggctgaagaagaagaatcgcttaaacccaggaggtgaaggttgcagtgagccaagatgacaccactgcactccagcctgggtgacagagcaagactctgtcaaaaaaaaagaaataaagaaagatcggcaag

SEQ ID NO: 1791 - DNA, 851 bp, Homo sapiens
agttattcatgttatttaggggggggggggaaactaaaaagctgactagcctgtctttccttctactgcacactgagctcctgaaggcactggggcttgctcccatttgtaccctggagcacacagtaggtgcttactaagtgactgtggagcagaacttctaatatttttgaaacacagatttggaaacatcttcccagaaaacagactacaacaaatcatttccctggtatgaaggaatgaaggtcagtattgctaaactgatactatcactactaactacaattactaacactatagatactcattacagcatttcagcaaagtgctgttggagacaaatattgctttagaagtagtttttgaaaaaaatagatttacattttactataatagttctagagatataggcaaccaaaagtttctctctctatatatatatatgtagtgagtatgtgcgtgtgtatacatatttatgaatataaaacagttatattacttaattgtgtaagaacatggatttttgaattcagagagctacaacttctactgcacttaccgtgtgaatttgggaaagcccactcaaccccctaaagcttccggcctctgctctataaaatgataatagccatcgccccttatcggatatgccggctctcatattaaatacataaacaatctacggactcacctgacgatcctttagaggtaaaaacaaagatgttgtcttccatttgaactcgatcgtttaatcaaatctataagcataacccattgggatcttcgggcctaaatttttacctcccctaagaacccgatccttatatcctgatgcacatccgcaacaggct

SEQ ID NO: 1792 - DNA, 940 bp, Homo sapiens
cctactgcctaaatgtccaacctgtgaccaggcctcccttccacaagaagcttgttgatactggcagacaccctgtggctcttgcctgacctgtgtgcagtttattcctaccaggatggccgatctctaggagagtcttgacggagaaagaagctgggttcagatgcagctggagagcctggggtgagaacatgagcagtctataatcagaaaatccctttgggataaattgacaaaaatataaaccactccacaaaggagaaattgtaaatgaaaatgacatgagaaggaagaagatcacttcagagagcctgcagctcagaacagtgggaacatcaaaggttccccatgtgtcatttcatctgatcttcatggttgaaggggtatatctgagatctgagatgataggcgactccattcaaagcaaaagaaaacaaaacaaacaaaaatacgtttattggataaacagctgccaccacctgcttcctgtcatggggtcagttgaaggaaagaaacacaaacttctactatgttcagcctttgtcttacttcttctgaaagctcctaggtagtaggcattttgcatgatggacattgctcttggcagaactcactcttgcctcattttgcaacagcatctgtagctgagagcccagagaagaaaaaattcatgaaactttttgttttctgagagatataacagaggaaaacagacgtaaaaattgattctacaaaggttgcctaccagaaggggattcctagagcatagattatctttccttgttgtgagaaatttccatttgaatgctgaaggcggaagctcattctgatataaaacttaaaatgttagtacaagaagcccactcacgttgacatatattattccctatcatttgtgttactactttaacattaattaaaataaacctgtatcggcaag

SEQ ID NO: 1793 - DNA, 838 bp, Homo sapiens
atttgtgctagactttggagatatgaagatgattgaatcaaggtctttatctttaactgagatgttcataataatatcacagaaaagaagacatataaagatcgtatacaaataaatacaatacaatgtggtaaaaggtgactgagcattgaaagaactttactcataaatgggttgtcaacactagcatggagtgtcttaggcagcagtaagttcaccattcttgggtatttaaaaagaagatggatgaacatctgaaaggaatcccgtaatgaggttttggcattgctcaacagattaacttttaacactcttccatctttgatcttttttacattccaacttcaacgtaaaactttcttgaagccaagaagtattaattttaaaatggaaaaaacaccatatttatttgtgttacttatttatatcacatgaatatactttcagatatgtggatattcaatactgtctacagtttgtaacatagtaaagaggtgtcatttttaataagtcaaatgttttgcttaaaagtatatgtaattttttctatgaaatgttggtaaaatgttgatctcacaatagatttaatattttaatgtcagagtttcaaatgaatttgatttttaagaaatatattttcacctttactgtaatatagttattttcttcttttatgtaattagaagtagaactatccaagaacatttaaaattaaattagggagtttttcaacttgactgttaaatattactgctacctctccactgtacttagacctgcaccttgtgttaagaaaaacgttttaacaaattaaaaaaataaagacagtatcggcaag

SEQ ID NO: 1794 - DNA, 468 bp, Homo sapiens
tctatgtttattaagaaagatattttaaaggatgcaaataaacagtctgatgaagagataggtagggtgaggtctggaggggtccggcacaggagcttctgtctccatggagatgggctgtgccatcctcctggcacgtggatgaggtcttcttcaccctcctgtcagcctccacgtgttcacctctctggaagctctccaaactctgtcctggccaggcatggtggctcatgcatgtaatcccagcactttgagaggctcaggcagatggatcgtttgagcccaggagttcaagaccagcctgggcaacatggtgaaacccccatctctacaaaaaaatacaaaaattattcgggcgtggtggtatgcacctgcagtcccagctgctcaggaggctgaggcaggggcatcactttagcctaggaggtggaggtagcggtggataattaagagagccgctgcagctag

SEQ ID NO: 1795 - DNA, 1073 bp, Homo sapiens
  misc_feature (1)...(1073): n = A,T,C or G
ctatctggaaatttttcttaggagaaacatctctcctgaagaaacccaatcaaagaagcaattcttcaccctcattgatgtgcctcaaagcaacttcctctgactcctcaagaccccagtgaggatctcagtttaattctcatcttagtgtggactttaaatcattttcacatcataacatgtcaactgtttaccctctttaatctcagtcttggagctagaaacataaacatccttcaaggaggcagctttgtttgtccagaccctgtcccctggaaaagttatgatcagcaggaaatgaaaacaaccagcatagcttttgttttcattgatattggtgacattttgcaaatggaacacctaaagccaaaccaaaccccgggcctcattctgaccaaaatccgaatcaaggaacttcatgcagaacattaaaaactcaattgtctccagctacagctgaatgaaaagctcagattaaaactggcaacgatttacttcctacaaacatgctttgtttctggctaacttgtcagctcataaaaaacgcctctgtacaagcagctgtctcattcaagacgctgaatcctttcatggtcgtcaatacaaatgtgttacacagaacccaggccaggacccttgctctaaaaccctggcccagagtgtgggcctctctgcttccctgctatgcctttcctctaatttgatgacttgcattttcaatacatggttatagaaaatgccatgctcttcatggaatcccctcatcatgctgcttcccagaagcctgtttatggaaaaagccggccccagaggcaaaacagaggaggtctctgaaaaaaccaattcttaatcctagctcttgctcttagcaggttttggccaatttaatgtctttatatctttaaatgtttccttagtgagctgagcaacttgcagtgaccacgctgagctagcttgctagggagaaatcaaatcaaaattatggcaaaccattttacaaatataaagcagctaatgaataatgtaatgtctgttccaactgagncaggtaaataaattgcgtttcgcacagg

SEQ ID NO: 1796 - DNA, 693 bp, Homo sapiens
  misc_feature (1)...(693): n = A,T,C or G
tccaatacatttaagaaaatatatctcgatgaagaatacccgcaaactctgagcagatctgcagaaagagaggactgagaatacacagagggaggatgaagatgctgggctgaacggggaggaatctgggaaccctgcatggggctgccaagcaccaaggcttgtttgcagcccccagtggctcctggtgaagggatgagctgaataggggaggagtggcccactctcatcagagacctctggaatcctggctgaaggggaccccacgatcccactgacatctgagctggcagggaaagctgcttggagaagtggcagggacaggactccagcctgtgaggagcctaaaagatttggtgtgggaatagcagcagtggagcacaggcagtgatgcccatcccaaggtgtgtcacactcctctaggtgtctttggcctttgttgactgtcataccaagtcagagcagggctttcttgctcatgggacagggtcaatctgatcttcaccccccatatcttgctggccttttcttgggtcccttccctggccctacctgtttgcagtgcagccttgggatcctcagccagggngctttcccaaatctgcccctttancttnttacctgnnaactccccttttcaaataactttancngaacgggccccccttgcnttcncttcccnananccttccc

SEQ ID NO: 1797 - DNA, 773 bp, Homo sapiens
ggtctttgagctttgagattctttcctcagattggttaattctgctgtaaatgcttccatttgtaattcttatagtgagttttcaatctctgttaggttactttgcttctttcttaaaatagctattttgagtttcatctcttgtatcattttactggattctctagattcctttgagtggtttcaactttctgctgaattttaatgatcttcgttgccatccagattctgaattttaagtatgtaatttcagccatttcacctggctaagaagcattcctggggagctagtgtagctttctggagataagaagacatcctggcttttgagttgccagagttcttgcactggttctttattatgtgtgtaggctgattttcctttcatatctgaaccccacgtccttttcacgggactaccggattatatatccatagccgcctccgcgcttttccctttaactgaaggagattattgctcttctaaccacgtgccagccgcccgcgctctccacaagccagccagaactttctggtccaagccggcggctttggatcaagcccggaaactctagctcccttcagacctatgcgttctgccttctccgcgccgccatatgaaattgctcacgcagctcttcaagctccctcgcgacccgcaactacctatcccccccctctctatccctacgctcacgcaccctctcccgcacccgaccaccaacatcttctagtatttgataatgctgccgctctctttagatgccatgtag

SEQ ID NO: 1798 - DNA, 1026 bp, Homo sapiens
actggcagaagttagaaagatggataaggccaagtgttggtggagatgttcccacatacaggaattttaccattgctgatggagtcactgtgtcattactgcagcctttttggaaagcatctgtcactacttagccaattaagaaaatgcatattctataacccagcaattacacctctgggcatgcttgcaatatttctccaccaaatatgatgatggttccaggttttctatagataccatttatccagaagcatttggcctgagaagaaccacaccctctccatcgttttcataagaattgcctaccatctacagatgaacccacccaagcaaagccagcgtgctctgcataggaagcctgagatgatggagtccacatgctgtttatttagtcatcatagctttatgacttgaaaatgttgacagagacatgcatctaccagtcaccatggcagggattcaatagcccactgtgccacagagggcatgccttggatgtagagagtgaagactttccacaacttgtgaatgagccctctgtgagtttagccaaaacattcatgtcaaagaaatggaaatgtgatataaaacccatctcatgccaagctaatgagggctggctaaccaacatattctgaacaggggggttaaaggtaaaaggacgacatgaggtttataggcgtggatcaaaattaattttacttatatgactcttaataaaaggaaacttatatatataaatgttagttttatgtagatgtttgggattattatatagaaatttatatcacatgacttgagcggcgcatgacatatgatttcatgatagaattctattttatataattagtctttagaacgacaggtaaagaaaacaagatgattccaatagcataaacacattgtacgcaatagcagatttatcctatcaccggtctcttatactctcttgtcattatgaatatcccccatgttaatatagatttcacatttaaaggttgagaattgaggcaagtaagatat

SEQ ID NO: 1799 - DNA, 1040 bp, Homo sapiens
aaacacaagaaataagaagaccattttgagaagaacagagagtagccttaagaaaatccctgtcgcaagcactctgggatttggactcaaatgctaattatacaacgttggtggaccagccttaaaaccaacaatgatttgtaacattgattctttgggaaagggcattcgggatcccacatcaccatctaacaaatgaatttttgtaagaaaacccattgagacaagatcatgttctgttgctcaggctggagtgcagtaacacaatcatagctcactataacctcaaactactgggatcaggagatcccccaacctcagcctcccgagtagcttggactacaggtgtgcactggctaatttttaatgtttaaaaatttgttgtagcaatagtgtcttggtatgttatccaggatagtcttgaactcctggcctctaggggtccatctgcctcggctttccaaagctttcggattacagatgtgagccaccgcgactgggcttattatcctttttaaataaacatttttgatggtgaaaatacatggaacatatgaccaaattcaataattacaatgtatataatgttactgaaggatggatataacagaaagttaagacttgaggtctgatataagacagcctgcctgagtccaagaccaaactcttcctcagatgggctgtgagacagtgatcaagatactgacctcttttaaaatctctgctttttcatctgtaaaatgtaaattaaaaataccttgtgctatatggttgttgggacaattaatatgctaaaagagcacatgagaatacacactgatattgccttaaattaataacttgcattttaggttgtttttggtattatagtaatatttgatagtttttcctaaaacaaaaaaattaacatatttttatttgtggctgaagaagtaattttagctcttgactccaagatggtgataataggatattctgcactatgtttttttacctttagcagctcaatttttaaaaaacaataaaacagtatcgcaaag

SEQ ID NO: 1800 - DNA, 801 bp, Homo sapiens
ctagattaataggatttaaaaaatgtgttatatatacacaatggaatactatccagccttaaaaaggaaatcctgtcctatggaacaacatgaaagaacctggaggacattatgctaagtgaaataaaccaggcacagatggacaaatactgcatgatgtctctcatacactgagtgtaaaaaaggttgttcgtttcacatattgactgaatcaacaaagaaatgaagatagaccaacatggaattatgcacatgttggagaccatgcaaactgagaaagaagaattaaatcagtcaaacacttcatgcttagtgtaaaatacttgtgctttcatttctgattgacaaactgtcttatatatattaacatattcaatttactaaccagcaagtcttatggccatgactgcagccttttcctgttaagttgttgacaatgtatattctaacccataatgttgatattacatcttaaaactccagaggacaaatgtataactctaactttccggtttgtacagaaccttacaaataagggctgattcaagaatcaaggtgtactctcaattctagtgaaagccactgtagtcatgattcccgcattttaacctacaaccaaaataaaacacggcctcttttggcctcacgggggatctcctatgcctattcccttttaaaagggctattccatgcccctccgtaacctaccccctcaaatcaccacttcttttcggcaagtggtataatcactcaaacgcgctatccccccttccctatacctgcgcacccctcctaagacct

SEQ ID NO: 1801 - DNA, 312 bp, Homo sapiens
catgatgtctgctttcccaacagagaggagagttgatgaaaaagtgcaaaaggtggcaccaccctcttttctgtacagactcctcccaaaggacttctgcttgaccacgctggccaaaactgtgttatatggccacaggttgcttcagaggatactaagacttcaaatttataattttaaaatagatgacaattaaatgatataatatatataaaaagcttaccatagtgcctaaaactcatactgacaaaaagtaaatgtctgtcacctgagtgagtacacagaatatatttacatagaaataaaagcaga

SEQ ID NO: 1802 - DNA, 438 bp, Homo sapiens
tctgtttttatttgattgggattaagtattccaacacttgggcatgggtttgtgaggggagcagaggaggggtggagagacagggggtgagcgaggctgagaagtcggcccctgtgtgaatggcctggcttgtagggagcctacagtggtgggtgtaatggtatgcgaagtgaccttgaatataggcgctgtgggtagccccagcttttttgtaaaagaagcatttgcagtggaggtttgggtttcaggcttcccagtcatcaatcatctcagcccattcttctctttgacagctcagtacaaggcctgacatttgacacccaagaccctgggacttatgcacagacacaagctgaggccctgcatttgagtgtcatccatgttattttctagctggatgacctgttttactttaacttcttagaaccttattttcca

SEQ ID NO: 1803 - DNA, 570 bp, Homo sapiens
ctagctgcagtggctctcttaaacttctttctttctccacctaagaatgaaaaaacttctttctccacctaagaatgaaaaagctgcaataaaagaaatgggcactgaatccatttaaatatgaaactaagaccgtacaattgtaagaattatgatttctgaagacaatgtaaatatcacaaactgttgacaacataaacataatataaaaatattggaaggtagtgaagagtgagaagggagaaactatggaaacctacatatgtagcttgtaaatgggagggaatcaataccatctagaattgaaacggtttactttacccaaaatatttatagaatttttttatctataaacagctgcaaggaaatattttttaaattaaaaagaaagagaaaagtaaactatgcctcaatattaaaattttaaccagaaaactctcaacttcttggaaaacaaaaaccaaccaaacaaaaaactccattagacaaataagttaaaagagaggaacatttgcctcaaaaatttagaaaagaacaccaaagttataaaacagcaaatataaagataga

SEQ ID NO: 1804 - DNA, 554 bp, Homo sapiens
  misc_feature (1)...(554): n = A,T,C or G
tctgggtttattgggaagaaagataacatatgtattgggtgtatttcatacacgttatctcacttgattcttattgcaaccctttgagatagacattgttattaccccattttacagatgagaaagctagagtttagagagtttaagccactcatagatccagacaatgacagtatgatgaagctgacattcacaccccaatgcctgtgctctatcttgagactccatcttgattttccgtctgcagggtctatgctaagcagtgcaggtgaggtaagagggttagcaggtgcctgggtgtgaaccttgtcatcaaacccagcagtctattagagctgctgagacagtgagagaataactgtaatacaaaatagaaagcaggagtatcttaatgtagtgataccaatcttcaggattctggcaactttgagtctcaaacatctctgtgatgggacatggcaggatggcttccacactggcttgtaaccccattcccatgtgttctaggctgccttttcttccatcnacnnnantcnnaggnnncnngnnggaat

SEQ ID NO: 1805 - DNA, 1073 bp, Homo sapiens
atgttcagatgggtccagagtttcttccttctggtgggttcgtggtctcactgacttcaggaatgaagctgcagacccttgtggtgagtgttacagttcttaaaggtggtgccgacccaaagagtgagcagcagcaagatttattgtgaagagtgaaagaacagagcttccacagtgtggaaggggacccagtgaaccataatcaagacctgacaaggcaagtgccattactgaggagataccaaattcctggaaagggaaggcacagcagttcaaaacaggagcatataggaaaacagccaccagttagagatggggtttcaccgtgttggccagggtggtctcaatcttctgacctcgtgatccacctgcctcggcctcccaaagtgctgggattacaggcgtgagccatggcactcagccgggagaaacgtttttcttggaaagctaggatgctgtggcctgtgaagaaaacaaagataacacctgatgtcttctacattgtccagaaaaaatgaaggatgcaacaactgtagctgagatctccagcgtaggcagcactgaagagaagatatcaacacaattttggaagatggaaatagatgagagaaatggatgatgtagcagtgcagaataatttgtaatttaaatacttcgagagacattcagaagagaagggagccaattctcccttcagaggccggaaaaattttagcaatcagaggctagactctgaggtttccctgtaatataagctagagaaatgtgcaagattcaaacctaggttaaaattatgtgcataaaaatgctttgtattatctggtttgtagtacaggtatttcaattttggcttatacattttcctactcccacggtacagaagccatatactttagatattcttcattgtgtagacataacattgactgattaaatgaaacatttaaaatggcatagttgaaacatgttcatttcttgttcctcgtgagactgtactaataaaaaaaatgcatgaaaaaggaagtatgcgtcagtccttccttccctatttctcaaccatgttgtctggtcga

SEQ ID NO: 1806 - DNA, 1131 bp, Homo sapiens
  misc_feature (1)...(1131): n = A,T,C or G
agattttccttgtgaaaaccttggtggtgaagggcaggagaatatgctacccccagaattcgactttggcataaggattatcttgagctgaagggaattgagaagaagcacaaacaagaaaagctgtctgccctctccctatttgcctaaaatcaggaaataaatatacaaagatgtacctctttacctctctaccaggaatgacaaagtttgatcagtggagatgactttagacccttatcagcctggagatggcacaagagaaatctatacagcaaactttaccaactgttctacctactattggtttcccatataattgcttttccacaatatgccacatctagacactcaaagtccttttcctttttcttgtcacttctctgaaattgtattgtactttgttgaagatgctatataagctgaagttctaagccatctttttgagagttactctttcctttagttctctctcatgtatatatnaaatatacatgttanagaacttgtttgttcttctcttganaatctgtcttttgttgcaggaggnccagctaaggactctgaacaggaaagganaaattgttttctcctctcctacagtggattttgtctttttagtgcagaaagttacattaaagatggcaacaacagtcactcaagatggtttctatccacagataatttcattgattggagcaaagtttttccaaggatcattgttatgagctgaactatgttcccctcaaatttatacgtggaaatcctaacccctagtacttcaaaatgtgactatatttggagacaagcttttcaaagagagaattaaggcaaagtaaggtcatcagaatggactctaatctcacataactggtgtccttataagaagaggagattaagacacagatatacatagaagaagaccatgtaaagacatgggaagaagatagtcatttacaagccaagaggaagagccttcagaaggaaccctgtcaacacctctgtcttagacttgtagtctccagaactgtgaggaaataaatttctgttgcttaagccacccagtttgtagtacttaggtatggcagccctcgctagcaagcttacatcaaaataaacactgatcggcca

SEQ ID NO: 1807 - DNA, 264 bp, Homo sapiens
tccggttttattttatctttttctattttcttttcgatgaaatgaagcctcagatgagtgtccgactgtgataagctcttccgtgccattttcaaactctcttgtcctgtctttcactctttaggcaacatgttctcttctttgttttcaaactacactctcaataaatgtggtttatctgtaccgtggaatattatgcagccatgaaaaggaatcgagctctgatatgtgattcagcccagataagcatcgttccatttcact

SEQ ID NO: 1808 - DNA, 1119 bp, Homo sapiens
  misc_feature (1)...(1119): n = A,T,C or G
ggctgcattacgttcacatagaagaaacaaaaaatgtcagcaagtattgggatctgcagatttattttaaagactggatattcttgaatgttgtgctaggagagaggcacattacttggaagcagtgtgatcctttttgggacatgtcaaaaaaatgccatcttgaaagtacagcctgggcccttactggacaacaagcctgctagcaccctaatttcagcttccagtctccagaacagtaatgaggaaaaactgatatggttacaaagttttaatgttcaggaaagattggccttgttcttaagataattatgacggctgcgatggtgtgtgtggagtggctgctgtaaggatgctggcttcagtgtgggaggtgcagccggtgctgcgtgcttcagagacggtgggagccaggaacagatcattttgtgaaagggaaatacatcttgggatctcaaactcattaagccagagggaaaagtcaagctgggaactgggtcacacaaatctgcattcgccttttcgttcctaaataagatggctacaagatgaaaggatatacacctccctcatgttttacagatgagaaaattctagtgggctccaagatcttaactgtaaaggttttctgttaaaatttaccatgacaatgtaaattgatgccttatcttcacaggtgcataggacagaactcaaagtcatctctctgcccacctgccacaaatgcatatntgactgtaccccttgccctattatctatcttatgnttacgcaaaaatgcagatggacagagccaggctaaggcataaatgactattggcccctacccacctgttacatgcgaaatgggggattggtgagtatgcgaccatggggcctttgacatggggagctctcaaaatcatctggcagagaaaggcctaaacttgtctgccaggtgtggacttaacttaagcacatatacttgctgagatgattgaaatttagcaaggcactgtgttccgattgccgattacagcattgcttatttataaacttatattatatcatttatgcttgatactcttcgcccgacaatatcactgaaacttacttttgggcatcttttgtgtgcttaga

SEQ ID NO: 1809 - DNA, 801 bp, Homo sapiens
agatgaagaagatgaaaaagtatttgagaagagttgctttagtcctggctaagaagtgatgatctatttatagctttgtctttttccatgttctgtaagacttgaaagcgatattcctggaagtggtgacttcatatcaaagtcaatttctttatacgaatcctggctcatgagaatcaagtcctgtgtgactgggcactcactcagcacagaggttcagcaatgatacctgaacagaatacattctagcttcttaacacaatgtaaacttatacctgcttctgcttcagaagaccctgaagtttatagaaagctaaaagaaaacttaaggtgctcatttaattcattgcagattaaagtaggcattatgatttcaatggaacaaaagagttatcttcaaaacatgtcacaactgcctgggaaagctcataataagaagctactaatgagaacctgctaataagcagctcaaaaatacctcaaaataactcaaccatgagcttctccatcccccagtccaacctgcacacatcaaagagaaaaaatatggaagaaaattgcatattgatcattacctgaatttttgttgtggggaacttttgttgggcacagtttgagaagcttaatacatatgaaaaaaggaaaatacttaaatggaacaaaataaaaatggattttcctcttactaccagaagagatgtgagaggttttgagatctggagcttctccagccactgtgcaataataagaagagagcctgtttgagaatgaatccatttgaaatgaacaccgatgcggcca

SEQ ID NO: 1810 - DNA, 820 bp, Homo sapiens
  misc_feature (1)...(820): n = A,T,C or G
ctggccagatactgtttttatttttctagtgttgtaatgaattatcacaaatttagtagcatacaataacacaaatttattatcttataggttttgagtccagaaatctgaaatgaatctcactgggtaaaagcaaggtgtctgcagggctgcattcttctaggggctctaataatctattttcttgcccttttcagcttttagagactctctaccttccttgcctcgtagccccttcttccattttcaaagctaacagcacagcatcttcaaatttctctttgattgactcttcaacctcattcttccacttttataagaacactggtgactacaatgagccagcctggataatctaggaaatctttccatcttggagtcatctgattagcaatcttaatccatctgcatccttaatcagtgaaacaattttttgggggtatcagttcttggaattttgcctctaatacatatctataaatgtctatcnccttttaccactagggatagcaaatttcaacatgcagttntaaattgggtagttcacaaacactaatgttatccagtaatttatgtcttctctctcccatatttatgtcttctctctcccattagttggttatatgtctggctgtaatacaannnnccagtatagatgtccatattgtaagattactgatagccttgtcttgtttacagagtgaagcattgatcagattcagcctntaggtccatagggtgactcatatcagtaaatccatttgctgacaaagttnttaacaaggtacntanncnctttagaagtcaagggaaaagtgag

SEQ ID NO: 1811 - DNA, 628 bp, Homo sapiens
tttggtgccggcttctttcccagctcctggaaaatttcctttctttagtttgagctcaactatataacagagtttcgctcttgttgtccaggctggggtgcaacggtgctatctcagctcaccgcaacctctgcctccccggttcaaacaattctcctgcctcagcctcctcagtagctgggattataggcatgtgccaccacgtccggctgattttgtatttttcagtagagatggggtttctccatgtttgtcaggctggtctcgaactcccgacctcaggtgatccacccgcctcagcttcccaaactgctgggattacatatatcaaagaatatttgtcacgtcatgctttcaaaaagtatttatgtttttaattttttctatattttcatctttttaaatttatgctttctcaggttgaataaaaaaagtatttagacgtgatattccaggtgcctctatcatgggacatcactgattataagtaaaatacaatgaacatttatttgaaggctgtgtatattttgtttggttttatacacagcatgtaaatcatgattgcatgtgtttaatattttggcaggaaaactgcatatagaggaaagcaataaaaactgatcggcca

SEQ ID NO: 1812 - DNA, 1269 bp, Homo sapiens
ttgtcatgtcatgaggacactcaagcaatcctatgaagaagtccaagcagtcagggacaaagaccacttgccaacaggaagcactatcctacaagaacttgagtgaaacacctcgggagtgcatcctccagcctcagtcaagtctcaggtgtctgtacttctggctgacatcttgactacagcctcataagagattctggtctgaacgaattcactaggccactcctggattcttgatgctcaaagactgaatgagattataaatgtttattactttgagattataaatgtttattacttcaagttgctaaatttcaggggtaatttgttgttatgcaacaaaaataatacaatattattagagttatagtttaaaaagttaataagataatacattttatttaaatgtatttatttaaaactatagtcattaattttagtctgaataatttggatgcatagacatttttgaattattgattgagctttaagagtggtcatgttgtatttatttaaaattttaccgtggtgtttgagctccaaaccaaaagtttattgcagaaatctcaagtgaatttatttactttattcttacggaggatctaacactggacttgtaagtcaggaaacccttacgttgatccagttctgcctgtaatcagctgttacacctttaggaaaagagctcctttgaccctgggttgatttccttatttattttggaagaatttgactatgctcctataatttgagttgtaacaattaaaataaactattgaaaactcagggtttattttcaattaagaaaattaaatgtgagtctatcatgaaatccataaaacaagctaaaaagaaaaaaaaatccaatatttgttttttatcaaattctgcatacaaagaatagactaatttctctaatttattatttcactttgtaaccatgttaataaatggcatctatttaatataaaaatgagcctatgttaaatgaagctgtcttttatatatgtatgtatatatgtgtgtatatacatgtatatatgtatgtaaaacatatatgtgcatttgctcaatttccaaaataatgaatcaattcagccaaactataagttattttaacttactgcttgattatcataaaaagaaaagatgaatttactgtctgccttcttttttgtaactgttttgttatacttttaaaatcctagttagcacaatatatgtcactcataacttatgtcattaataaaaataaaaagggatcggcag

SEQ ID NO: 1813 - DNA, 872 bp, Homo sapiens
accagcatcaagagaagatgaaaaggcaaaacgaagtcctgtttgaatattgtgactgtttttaaagacagataaaagggaacaatccggcccaagatggaaataagtctgggaagctgcgaagagtgtgatttccgatcgcaccacccaccggcctcccgcttcaaagttctcctgcccagtgtgaacctcacttctggctttttctacaaaagtggccatgagcgcccaatgcacagaatgaattcggctacaaagaggcctttgagagctcccgaggaagtgccccactgggaaaccaggtggatggcaaacgttcccttttcattacaaatgagttcagggacagggccaccctgatgggactctcaactccatccgaaagctaagccccaccagcccactcatttgaaaaccaaacaggtttccttctgcctccccattccctgttcacaaacacgtttacaagtgcttgataggtgaccttatttacttagtaacctgtggattcatttatcttgaaattagtaggtaatgaagtggaaaacctcaacagccctcccactaattaacatgataataagattgttttgctacagaggtacaattagcatgtatgagccaaaggggaagaaagatcaataaaatgtctgaagggtactactcccaggtctccagagaagaacaaagaagggaaactacagattttaagacccatccgtgtaaacacatccaactctgagaccggaccctactgaaatgatttgatgcctgctggagaaggaggtgtggagataactgaaaggaattaattataaagtacacattttggtgcagtcgatggcctttgaaaataaaaagggatcggcagg

SEQ ID NO: 1814 - DNA, 707 bp, Homo sapiens
atctttgatgctaaaagcagaatggactgagagatgccttggacataagtgatttcacatctgtaactatatcctgcaaacatttgtagacacatcttgggaaagaagcactcatgcttgcatctgtttccaacatctgtgcatttaagtcagcaacaaaagtcaccaggcatttgagctttccctgctataatgtttctgatttaccttgacagcgtaaataaccattggacttaaagaagaagcgttcaccgttttggaaaatcataccgatggctattcatggtgtctgggtgtgcaaatcgaaatgcctgtatcagtctatattggtaacatcacattcctggcgactctacctacagacatcaacaattcgtcacagaagaattccatcctgggaaagcagactttaaatgaaaagtgtttttctgagtcttcagatttctatactgcactttgaaagactggataaaatggacaatgaaaaggttcaccatctctaagcaggacatgaaacatagatgccagaaagtagatttccccccatcatgcctcgtatcgagttcattcaagatgtaattggaaaaagtacaactatttcagaacagacacgagtgcttgtcttgggaaggggttgttttataatgttatagacttttttccattgacactcctcatctatatctaataaagttagatcggcaagg

SEQ ID NO: 1815 - DNA, 564 bp, Homo sapiens
  misc_feature (1)...(564): n = A,T,C or G
cttntnncactntatanacttcntttntatntnaatcttacntatnnttatatatntatatntntnnttctnntnttattntncntnnntgttactttacnttntccttnactgnncgtncaatgtctattcaggtgacnaaaacagaaattgtttcaatgtgggtttgacaattactttntatgtttgngaacatttcttaggagagggttaacatacggaggatgaagagatcctttagttcaagaagtgggatttctttccactgttcctggaggcacgatgtggatcctgggaggctggggtaggaggatgacttgagcctgggaggcagaggttgnagtaagcaataatagtgccacggnactccancctgggtgatggaggcagaacctggtntcttccctcattnggtnattatatcgntgtcagtatctcctaatcggacagacttgttgttatnagcactgtttctttgcagattgtctgctgctttcccagattttgnttaacaatcccttctgaaagcttnaaacatgnnttctgagggggatttttnttntt

SEQ ID NO: 1816 - DNA, 799 bp, Homo sapiens
ctggccagatcaatgtttattcaggtgacaaaaacagaaattgtttcaatgtgggtttgacaattactttatatgtttgtgaacatttcttaggagagggttaacatacggaggatgaagagatcctttagttcaagaagtgggatttctttccactgttcctggaggcacgatgtggatcctggaagccagggaaggagccattttggttttcttcttgttaagtcttaccaaacatttttcaattaatcagtctatttaaaaatgtacatttgtttttcacctcttgttggtgggcttgtttaattaaatcttgtacttctcttagatacttcttacctgggcttagtggtgcgggcctatagtcacaaattacctgggaggctggggtaggaggatgacttgagcctgggaggcagaggttgcagtaagcaataatagtgccacggcactccagcctgggtgatggaggcagatcctggtttcttccctcatttggttattatatcgttgtcagtatctcctaatcggacagacttgtagttataggcactgtttctttgcagttgtctgctgctttcccagtttttgtttaacaatccttctgtaagctcagacatgtcttctgaggtgatttttcttcttctataaagattccaagatgcatagtttgggttaggtcttacattttcaacttggggccctcttttcttgagaaattggagctatcctaggtagtcacagaggcagttcatggatgggtgggttcaatccctattccaagggtgcatttatgtcc

SEQ ID NO: 1817 - DNA, 498 bp, Homo sapiens
ctggcgcattctttgtttatttacctataatgtcatcctaacatgtgtttaattttttgccttatttgcaacacatagggacagttctctttatggaaatatatctaccaaaacaagccagcgtgtagcatttcaaaacaggtcttttcagtgagaagttttcagtaagagaattttcattttccttccttgcaagttatgtagcccatctttcaggaaacagtactgatcttgatgcgccttgattcgtcattagacctatttgtccccatgagaataaaatgcgttattatgccacagtgttaggaagttacatttgaggattttcctgagagtctctcataacatgaggccagatgttccctgttaactttttttgttatcttatatgttctgattttattactgaagagttattctccgcaatttgtataatagaagagattattagagacttctttttcctttgcttctccaacagtctccatctatcctcaa

SEQ ID NO: 1818 - DNA, 270 bp, Homo sapiens
cacctctccagattgacaaagtctcctgacaattactgatcagtcacatctacaaatgtttgtagcattctgaggtgtgacttatctacatcttgggaaatacatttctgcaattaattaattactgattaatggagcaactacagaaaatattcaaatcgaagaaaggaaggtggacaagggaaaggatggaaagatgagtatgacccagtcctgtactgaagatgaacagactggacgtcgaaacataaataaaatacgatgcggcag

SEQ ID NO: 1819 - DNA, 821 bp, Homo sapiens
attcctccatgtgaaaatgccccccacataatataccatgagtctcagagaggcacaagagatagggatattgcaaagaggctgcaatatccttcacgacaggatctcaactccaaatggaaaaaaagtgttctgcaacctccacaatgtaaaatgaaagttaatgtatgggaaataaagcctcctgattttagctacaaactgtatacatctttgagaattccagaaagatcatcaaaaccaattaaggaagaaaaaaggaggaaaaaaatcagttttccagaaacaatgcttcacttgcccagcataaggaatcatcctaaggaggttacagctcctaaatttataactacatttccacatctggatttacaaaaagcaaagttaatgtttgtgaagagtggacaatatccaaggggtgtatatgtcaatcccaaaccacatgactttcgacagtaccaacctggtttaccaaactttgagacaacttatgaaaaggacccctttggattaaaatttaaatcacaacacttaagtacagtacatgggtaccagttaccgaaagatgataaacagaagactagtacagaaagatttatcacccacaagcattgtgaatgcacctgggattcaaaactaattttgacgaaagccccatggcctgttagatctgcttcatatacagtgagtttgactttctctatagctgttggaaaatgtctccagcactgttgtcgacaattgctttagtgcaggagttttttatttgttgtagtgtaaaatatatttctgtcattaaaaataaagccctgatcggcgag

SEQ ID NO: 1820 - DNA, 658 bp, Homo sapiens
tatcaaaagtcagaagctgttggactcagacgtggagtacaagtgaaccacataagaggaaaatatcgggctacgttgaaagaggcatctccaactacacagaaatgaggacatgtcttgcaggtgcaaaaagtcctcttgccttcgtaaagctatttttctaaagacatttttcatcattttccctggaggggatatgagagctgtccactaagaatctgcagcctcttttaggggtcttccacggattcactgtgaccaaggaaacaagctgttacctagcaacacggcccttcaggaggtattgttaccaatctcttagggctcatcaaaggaattcctgtgctcctggagcagctttaacagggatcattgtttctagggagttgtctaaactgtgatataactgaacctcaactacagaaacataaatgttagcagaggggataaatgtccatagcatccctggaaggttcgctgtcttcgggttccattattttttgaattgtttgcactggcttgggtttcttgaagttatacttgtgcaatatatcccccagtatttggtttcttgcttctcttctgtagaaaaagaagcaaaatggaagatatccaattcttgcttgaagtttgctcaaataaatacctgatctggcag

SEQ ID NO: 1821 - DNA, 916 bp, Homo sapiens
  misc_feature (1)...(916): n = A,T,C or G
agacagggtctttctatgtttcctgggcttgtctcggtctcctagcctcaagtgattctcctgcttcggcctcccaaagtgctggcattgcagatgtgagccactggcacctagcccagacataatacttttataaatgtaaatctcagaagacgagtctataaaaggagtttcatcaggctcaaatcaaggtgtgcacaggatggtgttgcttctggggtatctgggggaagaattccttccacgccctttctaggttacaacggctgcttgtcttccttgttcacagtccctattcagaaattccatcactgtgatttctgtttcagtcatcacctctctttctctcatgcccctgcctctttttgtcaattataacttgtgattactttgggctcattctgataattctggatgctatagtttgaatgggtactgcaaactaaatgtttttttnacaattttcaatgcaacaatgttgggaagtggtatgtttaatggcatcataaagagggtttgcaggacacggttcttctcttccactcttctgccaggtgaggacgtagtgttcctcgcctctggaggatgcggcattcaaggcatcattttggaagcagagactgaaacctaagctgccagcaccttgaccttggacttttcagcttccagaactgtgagaaacaaatttctactctttataaatgacccagtctgtggtactataatacaacagcacaaatggactaagacacagggtaatctccccaacttgagaaacttaacctattcacaccagcaggtgtcttttgccatataatatattcacagtttccagaagttaagatttggataccttctagtggtctgctatacatggaggatgcctatgatcaaaaataaaaagcttatctgcaag

SEQ ID NO: 1822 - DNA, 707 bp, Homo sapiens
tatcatgaagaacttgctacatctacttcaagggaataaaattataccagaatagatttatggaaaatgaaaacaggaactggcaaagtcaatgctatttcacaactatttgctaaaagagtttgcaacactcggatttagttgctttttttatgtgttttttttcttttctttttttttttgttctgcttcagatgaatggttagtctgaaattaaaacattttgaatttgctagaatgctacgtgcccaacccagaggaggaggagaactctaaaaaaattcaagtattcgaaagctgcatcttgcatgaggcctgccctgctcccatttctcctgaattgggaagctgatttctctgcaacattcaaccagcttgcattgcctctttagagaacagaaagaacaatatctccttttaaagagaagccacccctgctatcgtatacgggctaacctctgcttgttaatctatgaacaaacgctggtgaacctctgggcaagctgaaacatctctgaacttcagtatcctcacttctttgacatttcagtgtcaaagagttttaaactctgcagagcccagtgaatgtgagtaattgttacaactgtcaacacaattataatggagaatataacttaatgtacaggcacaactctaaatgcacctcccatgtttaaataaaatattttcaaaaaagtaaacggcga

SEQ ID NO: 1823 - DNA, 952 bp, Homo sapiens
aagtgggacagctggatgaccatgacattggacctccagtagtgctcgtgaagcgatgcatcttggaaaggaggatctgcctgcgttcctgacatcacccttgggatttctcctctgctctccaggcctctggctctccctgctggttctgtgctgggtcacctgccactgctcagcctgcatgccctgcagaagttggctggagccagctggtggtgacttgccagagactctggttaaataggaattttgcaagctggttgttaaaccattggtagcttgaaatcagccttggtgggagtatttataacccagaaattggcaaatactacaaatcaagtcttgcctccagcagcttaccagtagtccacagcttacctgctcctcttagtaccaatgaaaacacctacatcacctcgttttaatagcgacaaacttgagaatttttgatacaaatatttactaggaaaaaaagaaaagaaatagcttcacttctcctccttcaaaagctttggaacagaagtcctttatcaagtacagatttctactcttaatgttaaccagaggtttgttcaaaacaggcaagttgtcccagcttttgggggcagttcaattcctttccctaagcccatgcttagctgagatatttacccccaaatttccttttaaaattccctcattttccccatcccagcacctccagcttcctgaaggcagctgtctcctgacaccatccctagtgtaaggcatcagtctcttctttggttctttttgactcgagaagccattccaggccaggtgcggtggttcacacctgtaatcccagcactttgggaggccgaggcaggccgatcacttgagcccaggagttcgagaccaacctggccaacatggtgaaaccccatctctactaaaaatagaaaaattaaaaaataaatcgctgatctggcag

SEQ ID NO: 1824 - DNA, 884 bp, Homo sapiens
cgttcggttataggggctatgccacccgggttaagtcccccaaattgtttttctcacaccatgccggttaaacaaagagtggaaatctacgctatttctgcgccaatagggccgattacaggtttaaatgcttaccgcagtcagggcttgtaaccccaccagtacggaatttaaagctccaggtattttcattattaaccgccgtctaaggggtttaagaagggcgctttctgaatcagccggtcctcaattttaattgggaaggttagcttaaggaataaccacctgccagaattgttcagtaatcatgtcactagggccaagaatggtttcttatcagatacttaatacatccagccatataaggctacacccaggtatactgttccactaacagtccttacccagaggcctctgtgacgttaaatagagcagcacgccgccatattcaaagccggctgtgttaacagactcctatatcgctgtcacttgtgataagcacctagtatctgctggtgaagtctctgcgtacatcacagactcttgatggacagatggatgtctcagactcaggacaggatactctttttgtccacgtctctccctggactggttaaattgactctttgtctgtccccttttacttaatgttgaatgctactttgtatgttgtgatatgtttagtgtatgacattcacgaattgagtaagtatgctatttatctatgagtttgcaatgttggccgacttgtggagtggcttgagcctgtgcctgtgattactgagtgagcaggacgcgcactaaggaggattgctcccttggtaactccatggaccttgtacgctttcatgatttcaataggattaataaagcctgatcggcag

SEQ ID NO: 1825 - DNA, 466 bp, Homo sapiens
aggctgggaagttcaaggtcaagaggccttcttactgcatcatcccatggcagaaggtggaagagcaagagagcttgagagactatatctgcagtgcctcaaaaatcacctgactcctagcaggcagctacatacacttactgcacggatgaagggataaatacaggaatggatagatggagaactgtcctggtttcccaggtcctctgctcttcatgctgtttctaggggctgcagggaggaacaaagcaatcaccaaagcgcacacttgctcatgagaaaaagcacactttgaaaaatgaagtgttccctgtcattagctttcagtcaagcttcccatcaggaaacttttgcatcagatgtgattggaccttgaggggggacgcctgccatgcaggtcctggccctcctgtgagctggaacagatggttccttcacacacatctaaataaagagggatcgcgca

SEQ ID NO: 1826 - DNA, 698 bp, Homo sapiens
atgcttgactcgccgggaagcttataacttctaccctggagggcttactctttcgggacaaccgcttgaattataccactagaacgacggggactggctctcctatgatataagcctataactaacctgtcggaaaggctatggcgcataatgggtactcaaatttatccgacccattcattatttaattgaagacgggaactagactcccaaaacactcctgatataaataatgccatcctggcgctgagcaattactaaacatatgaactggagccctggggggatatgatgttcactacgcacaagagaggcttcattattgagggcgtagccatcatcccttgcatgtgtatagaaccaattgatggcactcatcgagctgggattgtttcagaaaatttaaacgatggcactaaaccaatccttaacggttcttgggttgcccatcctggttactaggggaaagaataaagccctgttaatgggcgcccattatctcccgaaaaaaaaaataaacgcgaagcgggcggggccttcaatggggggaggtttgagtcgaagaatttcttaaattcccgggggggggaattaaaaaggtgttccccaactaaaggggtgggtgtttaaaaaaaacggggcgcccgttcctttaggagggtattttaaacccgccacaaccgttggctgggggtagg

SEQ ID NO: 1827 - DNA, 1387 bp, Homo sapiens
cttggcgatctctttttattatagttcctttctttttaaaatatatatcctttatcacattcaaatattttccttcaatccaggattaagggtgataaagtttctggaagtgaatgttgcagaatcaagctggaaaaagaatgtcatcttagttaatatttggggcagagtgaattataagaaaatactactgtctttgaactttatacggaagcttgtgtgtggagaggatgaaaatatgtaattccaaattatgcctgtttggcataaggattattctgagctgaagacaattgagagaaagaagttctctgctctgctcctatttgtctaccagcaaagcacaaattcccattgtgatggtgtcccttctccttcccctgaccagaaaaaggagaaaaaccgttcttaccactgagattagtctgtgtaaacaaaccttactaaataactcctatataccatttagttgtcctcatggattttccttcccatgggttatcaccctttggaggcctaaaaccatgttaaagaaaatttagtccttttctacactcaccaccctttgttaaagatataactcctcaagtctaattggttcttcaagctttcacttcttttcttttgatctacattggctatggaatttaaaataaaaggtctatgactcttctcctgttaatctgtattttgccagtttaattcccaagtcccagttactaaacctaagaaattagaggggaaacaaaagctctcctgggagcggtgtttgtaatattcttaatatagcagattcaaatataatacctatagaaacctctttcactattgtaatttgaggactgagggtaaggggcaattgttgcatgattcaggccaaatcttcaagaggtaaccacagaacaccacaattttgccatttattggaaattctagtctcttggttgtctgcactttcctttcttagctttattttctatatactatttttttgttaatctgagcaacaaacattttttatttccccaaccctgtaattttaagaaaactctttctaacaaaagcctcattaagataggatgcctccaaacatctacacatcatatttttctttcggtaaaaatgtgttgtgatgtgaacaggacttgaattttattgccaagtaaagctggctgtgaatccaggatccatcatgaatctgttgagtgactttggacaaattttccaatgcttttccaatttgatcgtggaagctaggaaggccaatgatctgctgtctgaaagctgggggctcaggaaagatggtgatatagttctagtctaagcagggagtcagtggtataagtccagttcaaacctgaaggcccaagaacaaggagcaggaagt

SEQ ID NO: 1828 - DNA, 851 bp, Homo sapiens
ctgccgatcgtcctttattttttgtaaacaaaagtttgtcaatttgcttgattccattatagtattacaatacatggcacaatattgatatacaaagtaatatggttccacatcttcattttacccagttactcagccagttcctttctccctctagatggtcagaagtactgcctagatcccagatgttaactaccatctttattaaacccaattatccctcaatatactttaacaatcatgcagaaatatataaactggtcctaaaaaataattagtttttgtacaaattcacacccctagaaacagagaaaaaccaactgctggggaaagctgaagggacaactcttccataacccagatctaactccacacctctccccatccgacttcagatatctttcatgatcttaagtcttggtaagaaccaacattcagagggagagatacgagaaactggaattttgatttaaatttgggtaagaaaaggaaatgagaacacagctgttcacagtctacaaaactcacttcagtgaggaatattaatacaggggacagtgtcttctgaccttctaggaccttctactgagagcttatagagataactcaggggtctccggaaactgtggaaagttatattcactgagagttttagcaataaagcagacttcatgatagtaacacagatcttcagataactggtcccagaattctccttcattagagtataatccactgttgcgatccagaaccattcagcaaaactctcagggcatcctgggcatacctgtagcgggtggtaatttagaagagcactggcagcttagtttcagaactggggggcaagaaca

SEQ ID NO: 1829 - DNA, 473 bp, Homo sapiens
ctgccgatctaggtttatttattaggcagtttattcacatacatttcataattaaaaaaattttaaagtgtatatgcacagataaacatacatttggacatatattcaaatacacacacacagagggagagaaagagagactgcaaattagagaggaagataagagcaccacaggtagggcatacttgcaggtgcacacttaattgcagattttctgaattatgttctttattctatcaaatcattcaggcaaacatttctttagtcctcctggtttcagtgacattagaatgcatcttaagagcttgtaggagatttgccctgtccccactggtctttgggataattactttggatgattttccttaatccttctccttggtgattctgtagggtgcctcagtatgcctctttgctgacattcttcctgattcttgtaattgcttcctgctctgtgctcctttgtcagagac

SEQ ID NO: 1830 - DNA, 1133 bp, Homo sapiens
aaacttctggaagatatgaagaattgtgatcacatggcagggcaagccaagcagtgccaaccatccatagtctgtttcaggttgggagggagctatctgtgaagtgggcaaatcaaaagacccaaatgatggggccagagagaagctggccagtgcctccaccaaagtggggctgtcatagcaaactggaagaagatacactggcatcttagtccacttgtgttgttgtaaaggaatgtctgaagctgggcaatttatacagaaaagaggtttatttggcttcaggttctgcaggctgtgcaagaagcatggcgccggcacctgcatctggtgattcaggctgattctggggttcaggctgcttccgctcatggtggaaggtgaagggaagctgacatgtgcaaagagcacatggtgagaatggaagcaaggggtgggagtggtgccaggctcttctacaaaatcagttctcatggaactaacagagcgagaactcactccttgcctcaaggactgcaccaagatgctcatgagggatcctcacccatgacccaaccaggacgttcatgagggatcctcacccatcacccaaacacctcccattgtacctcacctccaacataggcgatgaaatttcaacacgaggtttgaaggggacaaatgtccaagctttatcagtgggttgttgatatgtttaggtgcaattcagtaagtcttcatcgtgctgtgcactgcagggagtggacagtctccgcgtggtgcccatcccttctgacagtgcagctcctgatctactgcaacacctgggagaaggcggctcttcacctttaactgaagtgcttggagatccagatatgaaaatgaatcctgttaagacataagcctcactaagtaaaggactgacatctctaatcaaatcaaataagatgatgtaaagtccatgcagtaggttgcttgcattgttaacatagggatatttttgctcttcctataagcataaagcaatgatttcaaatcttgttgctatatgtaagatgtttactctttgttttaaagttagtttttctctaaatagaaaaataatccacaatcctactaaattatcaagaagcaaataaaccccgatgcggcca

SEQ ID NO: 1831 - DNA, 396 bp, Homo sapiens
gaaagccaggaagatgggtgaattgttgtttaaaacatctcagaatatatacatgagcagaatgagcagaacagaagttaaagatagagcttcttccagcgcagaaatggcagttgcatcatacctgtttagcatcatggcttccagctaactacccatccattcactggaagatatttttgaagccttgctgtgtcattagagcagagcctcgttctgaactcctggtccagcaggccctgctgcagaggctgctgcagctcatggcacacttggacagcggcagcactctcttctctgaggcctctctcttcaacgttttgtaagactgtatttgcatgtttatttttatgtaaatgctgaaacatctggtctagtttaaaaaataaaacacga

SEQ ID NO: 1832 - DNA, 708 bp, Homo sapiens
cacgcagcatttgacagattgggcagaactgccacgaaagagtctgacacagatggtgtaattagagaatgcgaagtgcgagtgtgaaatttatctttgatcagcacctccttgccagattgtcatctatgttaatatgatgatggcttcttggagatggatagaaggaaacagcagccttgaagaggaaacagagactgttcactccacagagaagatattctatttacttctaaaatccaatcaatttcaacaggccaaaatgaaattgtacttacttaatttatatgaaaaacaagcctaacctgattcgcacactttattaagcctataatcaatatggtaaaatctgagctttagttggaaggggagacatgttaattttttatggagtaataaataaaaaaatacaatctataactgtaggagctgttgaagacaatgtgcatgtctctttatcaaggctctatgaaaaatgcatagacgaaaatcactatactccatagcattaaaactctagacactgccagcaaagttttattctttacttttcctccactctttttctttcaaaataatacctaggatttttactcagttcaaagtacaccagccttattttccttgatgtgttcaattttgtgctttttctctgtatttcacaactttgaaatttttaaaaaattaataaaacacggatgcgtcaag

SEQ ID NO: 1833 - DNA, 1143 bp, Homo sapiens
ggggaatattcaatttgacacccagacaactttcaagagctcagttgctattccatcctcttcctgctgtgatttcagcatctaaaattcctccttatcctgtgaagtgaagctgggactttgtcataagaggaagaaagggcaagggaagggtctgtgagggtgaagagtgctggaaaataactctttccctggccccaccttcctcagcactactgatctttcaggagaattctaatacttttggcatataagcatcatctgactcttggataatctcaggcatttctgaatagcatgttacctgctaggatgagccgttgctacactaatatactgtctttgaaccaaatttccccatgttgtcagcattgtacattcctcagctgcaaggatcttctactaattcagagaatcattggtgggagtttgctttattacttagttatgcactagcaaagagacctagttaaaaacaaatggaggagtataccatggtattacagggaatacctctcgaatacccagtatatttatgtgacatgcagtttccttggtaactcaaagaatccggagcaggaggcaccgtgaacctgttcccacagagatagaggacagtggttgtaggagtttatagtttcttctccacattgctgaaatacatagaaagattgctcccaggctacttttatacctatgcaatagagagaaaatcactagaagataactcttctgacagcatgattctacattcaaatattcagaaggatgagttgtatgatttacattaatattcactagtcagagacttgctagattcttcttttgggttctgccagattagatacatgtggacattttgaagattctctaagagagcaaccaaaatgtttcatttagaaaatcacgttctctatggagaagctattggaatagggattctttaacctacggaaaaaaattggaaagtttctcaatgtctgaaaacagattttgttgtttctagttatgtgattggattgaaatgtcatacacattgaagtgttcatggtacttaggatcacacacacacacacacacacatatatatatgtctcccctttggtggggaaggggtattgataataaagacagatgcgcaag

SEQ ID NO: 1834 - DNA, 501 bp, Homo sapiens
acaagtccatcaactatcagagaagttaaataactcttccaagggtagacaccttctagaagaatatccagaatgcaaaatcaatcttcctgaacccacatcgtgttacactcttgaaacctgcaagtcaagtgtctgctagacccacagcactccagcagctggaaccatggttctcaaccctgatgctatgcttagatcaagctggtgccaggatcccacgcaggactcgtctccagagacagcattttaccatctgtagttttgaaagtgccacaagtgatcctaatgtgatttaagatctcaaattctcagtgatccccagtgattggaaactgctgagctctatattccacaaggctccaggagagagtctgtgtgcaacactcccaagtaattgagacctcatctgaccttatccaccaggcggagagaaaacttttagacatagccttaaaagccacaccataaattaccttaaaataaaacactaaaactcga

SEQ ID NO: 1835 - DNA, 409 bp, Homo sapiens
gcttcatggagagagtttgtcgcttttttgaccttttgccttctgccacataaggacacggaattcctctccagaagtagcagttaagaggccttcttggaagcagagaccaactgcttagaaacagagacctcaccagacaacaaacctgccagcacctgtgccttgatctcaaactttgcagccccagaacggtaagaaataaaattctgctctttaaaaattacccagtctcaggtattttgttttctgcagcatatgcaaaatgctaaggcatctagtaaattgtctaaagtaaactgttattaaaataattttctctgtttctgtgtgaaatgatttccttatcttgctgtaagaaagaatatcatagaaatgctacacatatggaataaagaacgatcggcag

SEQ ID NO: 1836 - DNA, 599 bp, Homo sapiens
attcacaggcggaaaagacttgccttgtctcagatgagacgttggactgtggacttttgagttaatgctgaaatgagagtttccttgcataagctctctttttgcctgctgccacccgtgtaagatgtgacttgcttctccttgccttccaccatgattgtgaggcctccccagccatatggaattaccctcattctagagaagatcctgccccataccctggaggaaggaatgctgcacagaaaggagtgaagaatctgaacagtttggcctttgctgagtttaaatcataccctttttgtccagtcacattgtgacatggttgtccgtgatgcaatcatgcctatccaatgaagtctccatataaggcctgagaggacgggattcaggggcttccagagagctaaacatggggagacctacagggagatgaacaagaactcatccatatgtaagaagggtggtgcactctacctccatggaggcagaaactgctacactcaagacccttccagacctcaccataagtatctctggctctttatttgtagtctataaaatatcctttacaatacacaaataaaccccgtatgcgcaag

SEQ ID NO: 1837 - DNA, 320 bp, Homo sapiens
agattcgttgtgggggttcctgaagatgctcgcttttggaaagctccttgggaaagcaaatccttctgagtgcggcccgatgttcttgcaccacatcacgtgttacctttttgtcaatctccaaagggctactgcaagaccaaatgaatgaatgtctaaaaacatttatgacaggtctacacctggtccactcagaatctctgtaatgaggaggaagatgttggaacagaaaacacttggtgatcttggtgttagagctgagcaaagtgccctatttgccagagaaaagatgcatttaaaaaaaacaaaataaataaaga

SEQ ID NO: 1838 - DNA, 1204 bp, Homo sapiens
catgggtggaaaagattgtgatggatgccagaagatgtgaaagagggaggaagttaaagaaggaaaaaagaagaaagggtgactttgggaacagaaatgaactgaaatcaagaaacagaagggccaaggaaagaagtccatttgaatgtatcaacatgcaggtttattaattattccctgaataatcaacaactaaaccattctgcattgcttggctattgaatatgatcaaacctatatttatcatttggaactgaagttcaatgtcttatacaagctttgtttgctcatgactattccgtcaccatttatagaaagtatagtttttcaaaagtgtgaagaatccaccagctttctgatctttgtgactcctcttaaagaaataaataacaaccagacacaggacccctcctatctggatgggatcaagttaaatgtcatccgtgggtcagaggagacaacctaggaaaccaccacccaacagtttcctttattttccatgactgaacactagaaaattcccaaatccttccactacaaagagaaaagagttgtaaatcaacagaacggaagagaaacaaaaaggcatttcctctatctttaacaaagggaacttagagttatcaagagaaggaacacgactttctacttagctccataattttcattctaatggttattaaaaagaagtccatccttggtaccatggaaggataaatttatattttaaaggtccctcttttctggtggtggccaccaaaggggaccaagaaagccttttattaatagaattctcttatttggaaacattggaaaaaggatgccacctcccggaaatacccttgcccatcagtaaagaaatccggtccacagggaataaaaatggaatggagagctctccaatgctgccctatggggagaaataaaaggggtctccacatgtggacttcataaaaactttgatataaaagaaatctattatcaaaagtacacggtaaccccagcaagtgttctgtttaatctttgcacagaggatttagggcctgcaaagtgcaagaggcatgatgcattggccattttagtattcatgtctcctgtactgctttctaataagttaagatcaaacgggagactgcgtgcaggagtgagagatgcaagaaaagcagtactgagaaataaagatgaataaaagtcgatcggccag

SEQ ID NO: 1839 - DNA, 937 bp, Homo sapiens
aaatttattaacattggcagacacctttgtggttcttatctgacctatgtccagtttatacctgtctgaccattcctctggtttgaggagactgcccttgtgttctccttggcatccgggagaaaattcaacctatggtagcccctggttctccaggcctatatctggatggaccacattgaggaactgggaggagacatagagctagaaactgtgtcatgggggaccaagtcccgcttctagtataaaaaagttaaacttatattctaaataaatgccaaggcaacataaaattctaagaatttgctataacacttcacagtcaaaatatgtctacttgtttatatcaatgagcttcatactcacagcattatttattcactttattgaccatcacaatatgtcagttgattccaatatgacttttaaatttcactatagtaaaatttatttaagtagacaggtttctttggccaggaacatcttagaatgagcagttatgaatttccaatgctactgaatcaaaatttaaatgaaatttttaacttcaaaatttaaaagactaaataacagcgataagctacatgctacacttttattatgagaaaagcttggattccttttgggaagagtttcccagagcctttacatctttttctaagctgttaagtgtgttactgtttttgtccaaacctaaatgcaaaagaaaaaataaggcttgaagtcacaggtaatgaagaagcataaagtcaattaataaatgaaaaggttatgattgacagggccagggccatatcacagcagtattcaaatatttaagtcatttcatccttttaagccaaaaattaaaaaaaaattctgagactgagaaaaataatactgaggctgaaaaaataagtgctaaataaaaacatgttaataaacgccgatcggcaag

SEQ ID NO: 1840 - DNA, 751 bp, Homo sapiens
attatcagggatcttctgaatctgagtatcttcgatcttttctgcactaaggatgcagaggtttgaaagtacttttgcaagccaggaggagaaatgagaaacagaccttgtatttgcacagccaggtgatacttcctatggattgccgtttcgactcccttggatacagggctcaagagtttgctgctgctcaacctcctctttccatttttggtaacccctgctatatcataagatttcatctgcgagaaaaggaggaattcttctacagctcccctgctcaactttcaggagattttgacccatgtgctgctacggaaagattgaagaagacaaagtacatttaaaggaaaccaagccctcagctctcacatgggcctgacatggaggagatagatcaatgaagtgggagaaaagcagcaatggtgaggtgggagacgacaccagcacttgatattctatctccagaaaagtggatattcaagatttgtaccttaggcaccatctgctcatcctgatttcttttaatcaccaatgccaatgtagaaagagagatgtaactctacacctctttgcttgagcttagggtcattttcacaactccagagttctgagaaaactctacctaatggggaaaaagtgtttatgtttttactcagttgtttcgttacataagttgattatgtttgaaaatagaatgtgatgcgccaagcccctctttcccgcgtggccgacgctcagtatataattg

SEQ ID NO: 1841 - DNA, 915 bp, Homo sapiens
  misc_feature (1)...(915): n = A,T,C or G
ctggccgatctttgtttatttgcttattcgtttgctttttttgtccactcggtacctaggaaacgaacggccatttcttgcaaaattctgtgaggttggaacttctttattctactccacagatgacacctagagaataccatctacttccgagtccagattatcagctgattaagataatcaagcacggtagtttccttaaaaagatctcagggctatacaataatactctatttatagtttcctagagcttcgtggtaagtgcatgattgagactggtgattcttaaccaggggcaattttatccttcaggagacattccgtgacatctggagacattttttattttcatgaagggggagggggattgctactggcatctattaggtagaggccagggttgttgctaaacattttccaatgcacaggacagactgtccggccctctgcctcccaacacaaaattttgggtcccacatgtcaacagtgctgaggttgagaatcctgttccagagcctctacattccagacagggcangtccaaagccaggggataggggaaaaaagccacaagagaaggatgtgatagggagtcctgcttatgtttaaagagtagcatgtacgagtttgttatgaatcaagcaagtttaacaatacatgctattatcgtggggagcaattaaatatgtccattgcaggcagacatagagccaccgtaaagttttaatggaagttcataatttggacatctcatacggatcctgtggtcaaacaggaactctggggcaatgtctaggaacagttattccacggcatatatgcaaggaagcaaattgattcctcagataagctgatttcccttcaaagaaattaatcccagatgaagcaggttgtcaaaaatttaaggtaagctat

SEQ ID NO: 1842 - DNA, 1001 bp, Homo sapiens
gaacttatatttgtcagctttgcaagtggggctcagtttcggggaaggggtgagagagaagaaaggaagaaactgatgaagagaatgaaagaggaaaagacctgcctgacacctggatcttagaaacaaacctttcctaacaacagacctccaagcataaagagagtattttcaaacaactcaaaaaatcagtctaaatcaacgatattcaaaaggacaaagaaaaaaataataggggattatgttcttttctcatctgtcttatgttctgaagttattcatttgacaccttctgctcttgtacgatggcaggcctgtattcccaaagatgcccattccagccatctattgctgtgtaacaaatgacgacaatgtatgatggtttaaaatcacaactattttatttcatctctcaatattgggggtcagagttcaggcttggtgaagcgattcatctgcttcatatgggcttgaacagtggtcttcagagtggtacttctgctggtgagttggctggttcaaggggtctaagtgaagtttagaggcttcactcacatgtctgcactttggcagggatggcttcaaagatggggtccactgggactggcgactggagcccacacctggcctctccactcagacttctgacagtaagcaaggcagaatcacatgactttttatggcctagcttcagaagtcacaaagcatcattttggtcataccccattggtcaaaacagtcacaagcctgcctagactgaagaggcaggggatggacgctagcttttaatggagggagtgtcaaagaagtcatacttccatggctccgaagttgggctccaatgtggaatgtgtttacctttttccttctgaatgggccccatgagcagccataactgtgaagacagatacaaaggcagggaccatggcgccttcatttcctaaggtccatggtaattttctgcaaaccaatacttctcctcaataaacatggatcggcca

SEQ ID NO: 1843 - DNA, 953 bp, Homo sapiens
ctcctgacacgttgctgtatgccacaattctatactacaacacattgtctgccaacagctttaggatcctgagaactaatctgcctgccattccattgaaatgttcttattccagagactggagttcaccatgagcctgatgacagcattactatacagaagactgcagagagttgatatagatttatcatttttataagaaatagatgtacacgatcatgggcagttctgtgtttcagctgctttgggactttttaaaactagaagagagacaaaaccataatggatcacaagaattctggactacagggaatgaaatctgcacctaaaccacagttcttgttgtagtgtcaacaattcacactttagctagaataagtttttcccttcaggaattttatctcctgcccttacccttagtgagtttttgcctccagtaaacttgttttcagtggaagcttctgggtcttagtgttctccctaccccagttaccctccaaatcttaggttctttagctctaatctactgcctcctgcagatgtaggactatgtaaggctgagttggctttttgtgggtataagtatttaaggatacaggttacagacacaatacattgttcctgatttccttagactgggagagacatgatctttattttctggttatctcagtttggatgggattcatcaagactcctttgtactgattttaaagctcagtactagggcctttatttctctgactaccatgtattggcccagagattgtggtccccctagccatgacgtcttaagtgttgagaaaagtaaggaatgggaaatgatagaaagcaggacatcagaatcatctgacgaactttttccaagtaacatctccatctgccacactcatgcccggaactgtctgtcaaaacaaaggtaattaaataaacaataaacaacgttcggccag

SEQ ID NO: 1844 - DNA, 187 bp, Homo sapiens
agagaatcttggaggctcccagcaaaccggacaaggccaaacaggacacgctgatgatgtcaatgactgaagaaaaacccttttctacccaggtgcggtgactcacacctgtatcccagcactatgggaggccaagtcaagagaatcgcttgagcctaggagttcaaggccagcctgggcaacaagc

SEQ ID NO: 1845 - DNA, 279 bp, Homo sapiens
agcaatgcctggagcacagcagccattttgctaccatgaggactaaagtcacatgccaaggatggtagagtggagaggtagaaggaacctgggccagtgatggcatggtggagctgccacaccagccctgaactgccagctgtgggtagacaacagctactgtgttgtcgccactgtggcatggcttcctgctccctgcatccagatgtggccccatgtgacacagccataagtaaaaaaacagaggcacacattaaaattcctctcaataaaccggga

SEQ ID NO: 1846 - DNA, 422 bp, Homo sapiens
cctgctgagacactctcttaattctccaccgctacagcccatctggacatatatatgcaggtcacagggcatacgatggtttaacttgggctcagaggcctgacaagaagatcggaaggtctttcttcttaattcacaaaatatttcaaccaagggcagtctgagctcaagtctactcatacaaatgctgacatcatcaaacctctttcttaatgatggacagataagaaatctttacacagaggggttaaacactttactgaagcctgcatataagtaaggcaagggcagaatccagggcttccaacattccagtggtgtgctatgctgctagtctgggggttataaagaacggaatctgtggtctgtgataatgcatctggaaaacagttaaaaacacttgtaatttacataaaacccga

SEQ ID NO: 1847 - DNA, 442 bp, Homo sapiens
ttttgtctgttcacagtacagttttatttaatttcacaatataggcattgtagctctgtgcactgccggctgctctgcgggcctgtctgcggcttcggacccacgctcaggacatacaccggccagtatcccggctctcggagcagcaaacttttgctggtgttgtgagggagttctcacactagggcctccagctttgtcctaaggccagcgggctggacgctattgcctctcaaaatccaccgacaaatccagccgtggagaaacagccccacggcatcaaactcttccagcagtgcgcttcccgctgagacacgtaggaagaatgtaagtaatttcatcttttagtagctgaaatctttcaggctttttcctctccaaaccaccttgcagccctgaggtagaccaagccttctgcatgcttctttcttttcccttaagc

SEQ ID NO: 1848 - DNA, 542 bp, Homo sapiens
gccaaggactatgctaagttgctgggggacacagcagtgaggaagacagatgagatctctgccctcttagaacttgtgtcatgtcggccaggcgtgatggctcatgcctgtaatcccaacactttgggaggctgaggagagtaaatcacctgaggctgggagcttgaaactagcctggccaacatggcgaaaccctatctctactaaaaatacaaaaaattacctgaatgtggttgcacatgcctgtaattccagctactcaggagaccgaggctggagaactgcttgaacctgggagacagaggttgcaggaagccaagatcacaccactgcacaccagcctgagcaacagagcgagactcttattcagagaatgatgagggtgggcatgggggagggtgtctgcttgggtggtgaaggccaggctctctgaagagctgatactggaaaacttaaccaacccatgtgtcctccttttgaagccctcacaggccttggcatagaggctgagcacatgaagttctgctaaagtgaatgggaaa

SEQ ID NO: 1849 - DNA, 501 bp, Homo sapiens
tctcatcaatcaaaatttccagtgcaataagacgaataacaagaacgcatcttactcttctcaaaattattccaaattcactggaagacatggtttcacggaatgctaactctcctactgacagtttttgaggcttttgtgttttataacatcactaaaattaaacacgtttctgaggatttaatttgacatatttcataaatatttgtcaaaacaattattgtcaactacaatgtaatatccatattcaatctgatgactcaactggaaaattacttttttcctagtaaattttttccaaatgacaatagtgaatcggtgttgattagctgttcagtgtgtgctaattaattacactgggtaaatttacgtctgtgctaataacctcaggaaaaaaaaatccgtatacatgactgtgtcttaagtgaagagaaatctgctgtttgcctatttttcctgttctttctcttcctaatttctcccagaagaatgttcaataat

SEQ ID NO: 1850 - DNA, 406 bp, Homo sapiens
tatcaatcttgtggatgtagaattgttcatggtattccctgatgaggtctcagtcttcccgtgagccactgcctctggactgtgaactttatttgtcttttcgcgctttcacaagatcttctgatgaaaaaaaaagaagtcctaatttgaaggtggttcaaattatctttctttcctttgtggtcttgactccatttttcactaaaacgaatcaaaactccttggagagatgaccgattgctgggaaaagacagggaatgtacaagatggacctggaacgtcttttgtgccacaaagcaagaaggtgctcaaagagtagtgacgagtacatcaagtcagcttgaacaagcttccactggccaaattggggacaatttgaacatcaaaataaacaatgatcggcaag

SEQ ID NO: 1851 - DNA, 1127 bp, Homo sapiens
  misc_feature (1)...(1127): n = A,T,C or G
atgaagaaatgatgtgcacaagagttgaagaacctgctctcggtgaagaacctgctctcggttaaactgctaacatggctggttaaggattcaatcttcactttatatgattccaaagactgtgttattctccatactcctgtctcaactgttgcagaatcacaggatctaatattgcaaataagcttatagatggatctaattatttcaatttcaatctaattatttcaatctcttgaagctaagaaagtcaaagtagttagctttcaaaggatgagatgattcgcctggccttaaatctcagatttgccacctaatagctgtgcaacattgagcatattactctactttctggacagcagtattcctccttaaggatactaggaggtacacccgtatgttataccctaaggtagggttatattaagtccagataactataacgcaatttatgggtttgctatctgactaaaatataaaaaggtatataaagcacttagcctgggacctaatattaaatgtgggcaacttggcagcttctcaaggtgccaaatgtaagggactccatcacaagaattgatcagagataagatgctaggaacgcaggtttttctataactctaaatagcaggtaaaaataaactggcctcaatcctactggaaaaggagtgaggataagctaagcatacgttaacattttggctcaactatttttataaagctaacaaattgagagttgtgattacgccaactatgtagttatcaggcattgaagatggaaaatacagttaaccgtaattgtatgaggtctggttacatgtattagtaactgaaattatacatcaaagggtgcaagttatcattctacttaaaagactttatttatggaggttacattcgtgaccacctaatactatctagttattataacaagtatagttagtatttattggaagccttactatgttaagggcaggtttctgagacttttatatttattagttcaaggaactcacaaaagttctttacaagatagattctatttctctcagttttcaagataaaaaacaaaagcngtataaggccagcttcccttccctccttccctcatagtctcagtttttagt

SEQ ID NO: 1852 - DNA, 550 bp, Homo sapiens
aggctctgccactctatctggatggatgtgaatcaggaagcaacatagccccagttattaccaggtatcgtcctgcaactactacaacaaagtactttatggtgaaactaacatgacagaaagtagagaaaagaaatggaaagaaactggctccgtgatgaagcctgctgcttgcacagccagccctgaagtcagccccacctctggatctttcacttacaagagccagtaaattttctggtagttaaaccaattttaattgtcttcttacttgtgtctaaaaacactctaaaactaatctatatgtatacagcagtgattatagttcctcattatacaaaggcaaaaacttaactcagaatatagagtaattttcccaaagtcaaaactggatagaaactctggaaggtctgactataaacctgtctctttctacattaccccgctactattaaaatagcttatcatgtgtctaagatctatcaagattcaattcaattcaacacactgagagcctacaacattaaacaataaagtccgatgctggcag

SEQ ID NO: 1853 - DNA, 718 bp, Homo sapiens
ttgccgatctccgtttattgacactattattgtttttgaaaacacttttgcatataaaagcatcaaacacatttttaaaagtttagctattttaaacatttgtaattggctctagtataatacgtagcacacccagacaaaaataaacttctttaggattgaatcctcttaagtggggctgtttatttggcttgtccaccagaaacttgactttaaaagtcaaataagacgtagtcagttctggcccccctgcataatagtatctagagggctgtttcaacccaggattttatgtaatgaacaaagaatttgcagagaattactacaccccacattctgtaatgaaaactgtataaaattcattctacacaattatgtccaactaaccatgagtatgccctgctattagtttctgtttctttgtcatcaggaaggtggtattactctttagccacactggccaagaaaagagtcattgtcagccagcccgaatccttccccaagttcctgggaccctgtgacagatgtctctcattctcccatggatggtgttgggatgtccactacttgctttaggaaaaaaaacttagtcttttcttatgcatttgtacaaaacagtctttaagaaccaaagttttcatcatttggtatccacagatgtcatttttcccaccagcttgatctagagaagttaatggcttattttacgtagggacat

SEQ ID NO: 1854 - DNA, 779 bp, Homo sapiens
cagaggaggcatctgtctgccctggattaacttctctgtggtatctgctaatgaatcagtgaggaagagaagcttcctgcaggatctcccgacctcggcacacctgtccgcctgtccatctgcccacctcatgctgcagcgctggaattcacaccaataaaccagtaaggcagagtagcttcctgcaggatctcccgacctaggcacacctgtccacctgtccatctgcccacctcatgctgcagcactggaattcacaccaatgtgcaaacagttggcatcactctgaagccactccaaggtggcatctgcacttaataacaaacaccctgcaaaaaccgctgtgcagacgtgggcctaaggtatgtgcccacttcatcagcctcattctgggccacttgtcctgtcccgcttccttcatctccccatgcctgtcaccaccctagctgttgtgcaggttcttgagagtggtattttccctcctgctaccgggtcagggagagctcttctctgaggctggccagcccctccggtagttcactttactctcacaactgggctcccttcccatcacctcctgtttctacctaaaagcaggtccttccatcggaagctctcctaacagtgtatctttccttcctagctcttcatgcaggtcataactatacactatattttggtaatgatgtcattgtctctcatgctagaatgtaaactgtctagtgatagggtatatatgctgggtttttttttttttaataatggcatatctatacgac

SEQ ID NO: 1855 - DNA, 554 bp, Homo sapiens
agctggagtgcagtgatatcatcatggctccctgtaaccttgaactcctaggctcaagtgaacctcctgcctcagcttcctgagtagccggtactacaggaacatactaccatgcctggcttttatttttttgataggaacagggtctcactatgttgcccaggcttgtcttgaacttctggtctcaagcaatcctcctgccttggcctcccaaagtactgagattacagcatgaaaatgaaggatatgattcaccagcatgaggaggtaaagcaagaagatggagtgatccaagactcaagtgatccaatgtagaagagagttctcaagatgatagtaaaacaaagtctcaagatgaaagctgtgtagcagctatataaattggagcagaaagatgtaaggccccagaaaggatgcttctaatggggaagaaatgcggactaatacataaccaagcatacctgcttacatagagttgtttcagagtccttttggagcttttggggataaataataggtatgcagaaaactaagcaaaacaaaacaaatgaaga

SEQ ID NO: 1856 - DNA, 823 bp, Homo sapiens
cttttgcctttaggccattccacagtatattgcttcgcggttcgggtttgtgtccatcagtgttagagttaatgtgcccgacaaatggattatcttttctattgacttgtcaggttgcaaaatttttcaaacttttctgttctgttcttcttctgaatgctttgctgcttagaaatttcttctgccagataccctaaatcatctctctcaagttcaaagttccacagattgctaaggcaggggcaaaatgctgccagtctctttgctaaagcatagcaagagtcacttttactccagttccttttaagttcatcatctccatctgagactacctcagcctggacttcattgcccatataactatcagtgtcttggtcaaaaccattcaacaagtttccaggaagttccaactttcccatattttcttgtcttcttctgagccctccaaacttttccaacctctgtctgttacccagttccaaagttgcttctgcatttttgggtatccttataggagcgtcccactcctggtaccaatatactgtattagtctgttttcacactgctatgaagaaatatctgagactgggtaatttataaaggaaaaaggtttaattgactcacagttctgcattgctggggaggcctcaggaaaatcatggcagaaggcaaaagagaaggaggcaccgtcttcacagtacagcagaatggagctccatgacatttgctccagttaacctgatacagccatctgcctgaaggaggaggagaatttattataaagaatgacgaaggaaagaagcagagatatgtacatcttaca

SEQ ID NO: 1857 - DNA, 771 bp, Homo sapiens
atggagtcccattctgtcacctaggctggagtgcagttgtgccatctccactcactgcaacttccgtctctgggttcagggaattctcctgcctcagcctccagagtagctggattacagtttctatggaagaagtagaaaattgaggatctggcaaggtggcaaaatagaaacagctccggtctgctgctgccagtgagaccaatgcagaaggacatggattcactaaaaagaaaagttctgaagaataacagaacttgccagatcccatcagggatgtgaatagtcccagtgacggttttgaatttgggcagagcacttccatcttccatccttcctatctgagccttttgacaagacctcacatttctggctaagaggccctaatttggtgactgaattgctattgaagaaatgcctagaaagaaactaacatatatgatttctattatcaatattgaaatgtgcatttgaagaccaataaaggtgaagatggaaaatgcccaaatgagacagacataatgatgagactttcttaagaaatgtgctacattgttttgaattagccccaaagagaaacactgattgtgttttctattgtaagagaaattatcaattttgtactacatgtaggacttttggaaatgtatgctattattctgttcagcattggtaagataacacttaggcataattttttaggttacttattgctttctaatttgatttatatcctgtctttcctgcttttaggcatgtgtgttagttgag

SEQ ID NO: 1858 - DNA, 910 bp, Homo sapiens
cctagcggaacgactctcttaactaccaccgctacacgacctcacatttctggctaagaggccctaatttggtgactgaattgctattgaagaaatgcctagaaagaaactaacatatatgatttctattatcaatattggactgataaatctttgtgcctaagattgaagaggaacagtcttgataattagagttcatctataatcctttaaggaaacaaaaccatgtttctgaaagaaagaccagaacaacttaagtaaagttctcagatcatgttgtgttacaaatgagagaaattgttctattttttttgtttctgcttttctttggatacattgtaatcaagtaaaaaagactatctgtagaagggatgtcaaatatccatattttattaatgatggctgctgtctaatttcaatttagaaatgtgcatttgaagaccaataaaggtgaagatggaaaatgcccaaatgagacagacataatgatgagactttcttaagaaatgtgctacattgttttgaattagccccaaagagaaacactgattgtgttttctattgtaagagaaattatcaattttgtactacatgtaggacttttggaaatgtatgctattattctgttcagcattgtaaagataacacttaggcataattttttaggttacttattgctttctaatttgatttatatctgttctttcctgcttttagtcatgtgtgttagttgtgtcatgtatttaatgtacctgaatggcgtctttatattttatttaaattaaggatttagttaaatattactgatgtaacttgcagcctcatgtatacataatacttctttagaagtttaaaaatgtattattttaaggaatatattgattttttaaaaataaagcaagatcgccag

SEQ ID NO: 1859 - DNA, 327 bp, Homo sapiens
gacctgttggcttacctggagaagttgggatgactggaagcattggcgaaaagggagaacgtggaagtccaggcccactaggtccgcagggagaaaaaggtgttatgggatatccaggtcctcctggggttccaggacctatcggtccattgggattacctggtcatgtgggggcaagaggaccacctgggagtcaaggtcctaaaggacaaagacctccaattccattctttgagagaatggtaaatgtgaagatctttaaatgaattatttctctacagacttacatagcaaggaaaaataacatcatgacaaaataaaagcaga

SEQ ID NO: 1860 - DNA, 1238 bp, Homo sapiens
cggccgatccctctttattgcatcacttaaataactatctggctgagagtatgactgggaaaaggagctggaaaacaggtgagtttgggtgaggttgatgttaggaggagaaattgagatatttcaaacaaggtacattttagaacatagcaagcctatgaggcctggtgagagggagaatccatactttgtagtggaaagccatgagcgtccagaaagcatggtaagggcactgcataaccctggggcaaagagacattccgaaagatgggaaagggggttctgcaattctggaaagttgtttttatgaatatgaagactgagcggctttctgcccaaagtagcctagaatcacactgaacactaggtcatcgggttcagagccggaggggatcttaaatggtattcagtcccacaccctttccttacaactgggaatgcatagacacaaggaggtggcggattgtgatataaccaaaagaatacccagacccccaagtcagtggcacttccacagaatctccctaacttgtttatgtggaatgggagaagatttttatttctcaaattgtgcctgattatttgattctagcagctggaacaccaagattttttcagagtaatggagtgcttaatacacaccaggtggtaaagcttgtgatgatgggggagaattcaaactgcaaaccacagcaggtgaaaatcccacactgactcaggaatactgtgtgtaatctttccctgatggaggtggatgatttgtttacattttagaagatacttggcagcccttgctgccattttgccaagaaaaaatctccttccaacactacattcacttgggtattcattattccaaccccacaggctaaaaatatacaagcaccatgggaggaaggagaggggaagggggcaagcatatgccttactcagtgtgctaccacctcattagtgccactccatcttgcagcggccaaaatgggtttaagccattgtaacaagcagttcccttgctcagctttagcacccatcttccctcccactgatcctcttctgtattttctctttttctgcctcttgaaagtgctgtatgcttttgataaccatctggttcatttccattaggtgtggctgcctcttcttctctttctttccccttccatgtttgggaaacacattcaatgttacgcagtggctcctgtatactcagtgtgcttgagtcaccacgtttacagaat

SEQ ID NO: 1861 - DNA, 701 bp, Homo sapiens
tttttttttttttttttatgtgttaattctatatttgtatgaaagtcaagttttttaaagttttctaaattatactttaagaatatactaaattacacagctaataatttcaacaattccctcacagcagcaagagtaatcttcttgcacccgttaagaaattgaattggtgtgggatgggtctaggaaagaagtttaaaatagggattagtttgtaagcgattgaaattaccctaactagtttcaaagttcatgttcctggggagggcatggaggagatagaacattgagtaacattttcgatgctttatagccactccctaattccatttttcacaaaaacctgtggaatttcgtagttatttctccattttatagctgaggaatttaaggctcagagatgttaaataacatcttcagagtggtggaccccacatttgaacccaaaacatcccccttcctgtcttcattctggagcttcttttaccaggtgaatggtgtgacagcagactggcacactccactgtttaatgcttgtgtcagcggcagctgggattgtgtgaatttgcttctgcagcacggagccagcgttcaacctgagagtgatctggcatcccccatccatgaagcttgttggagagggtaatctggttgagaatttgtttttctacccactccttcaagggacattttacttgctg

SEQ ID NO: 1862 - DNA, 845 bp, Homo sapiens
cagggtctccctctgttgcccagcgtggagtgcagtagcatgattccagctcgccgcaaccttgaccttctggggctcaagtcatcgagattacaggcatgcactaccacatgcctgatgtgagctgaaaaatttctattgcctggtgacatcatagtcattgtaacaggtgttggtgtaaagacagacctacagatgaatgaaacagaacaaaaaatccccaaatagaaccataaatgtatgccaattgatttttgacaatggtgtgagggcaattcatggaagatatgtataagaaaataattatataaaccttgctcaatccatacatcgggtaacacaatttcatacatttatttcgtgttttttattttaccccccaggcgaacaattggtcttctacatatttgtgtttttttagcgttgtaggttgctaggattagtattatatcgatccattacccatctgtgttttagtcttgtcctcctgttttggttctttgtcggtccctttctttcgaggagcgtgaatataatacactctccctctctaaaggggcgagatgtttaatggagtttagagtgtaccttttattaattatcaacgggcggcttggggtctctccctttatttggaggtctacccctttaactactctttggactagtgcgcctcaattagacctcatacactctataaagtatcgtgtcccccatgctactataatagaacgaatcccattgagaataaatcttatatatttatgttaaatatttagttgaggtgaaacttcccaagttttataatcatattttttttattcgtcaataattataaaattatt

SEQ ID NO: 1863 - DNA, 538 bp, Homo sapiens
aggtgtgtgctccatgtggacactgactgctaagaagacagaaaagacagaaaagaaaaccaaacaacaacaacaacaaataggacacagcattgaatattttagtcaaattcttctgggactgaagtatccagataagcacttttatgtttctcttcctttttaggaatagatgttgatttaagtacactagacattcaattggataaatggaaaggagaaactatcaatcccattattgactctaatgaatgttagattaattaatgttgaagaaaataaatacaaaacgtgttagaagttttagaatgcattttgaaaatcttcctggaaatcattaaataaaaatagtaggggtctttggtaaaggaaaatgttttcgtatacacagacacatgcattttctagctatctgcttagctcatgtaagagaataaattagaattaatagtaaattaagttataatataagaagttcttaccttcttaaaggttcttgtcatccaaataaagacacttacacaaaaaaaaaaaaaaa

SEQ ID NO: 1864 - DNA, 328 bp, Homo sapiens
ccgtggcttcattcttgaagttagcgagatggagaccacaagcccactgaaaggaaccaactgcagacacaatgcatgtgagaaagactcagccctattttctggctttgaagctggaggaaggagccaggagcaaaagaatgaagacagtttccagaagctgcaaaagggcagggacagattcactccaggaagccccagaaacaaacacagtcctgctgacaccttgatttcaatccagtgagacatattttggacttctgacctacagagctaaaataatagtaagataataaagttatgttgccaccaaaaaaaaaaaaaaaaa

SEQ ID NO: 1865 - DNA, 290 bp, Homo sapiens
cgggctccccacccttgctcactgtgggagctttccttaccctgctggtttctgaatgctctgcccggtcctgggcctccccacttacccagcatggatgcctaagctgaactgagtgaccttggactgaattgttcaaaaagagaaggggagaggaagaggaagaagaacgccaagtaatttgatttttcatttttcatgatcaaaccaatgtcttggaattgattatcacttccatgggctacttatgctcctgtactgtttgatagagtttggtaaaaataaataag

SEQ ID NO: 1866 - DNA, 393 bp, Homo sapiens
agcttggaaggccttcccaggaatgcaagtctgaaccatctagagttctctcagccagaatgaaggctcagctcttggatgtttctaccataaaaatgagaaagcatttcctacctcctcctctgtcactccacaaagatgtgcttcctgtgtggctggctagcagataagagaagaaccgtgtgctaactcctcatcaaagaccagaagtagatcctgaattgtattcattctcatctctttctacctcctccaagacagaaggacatgattaacttctttatctcaatgtcagccttcaatagctacaaaagtctaaactgtaaatagcgttgaagctttgcataataaaattcttttccccagtgatgggcagtttttcacatagtaaaa

SEQ ID NO: 1867 - DNA, 241 bp, Homo sapiens
cctagagggacagtggaagaccagtttcttcggtgcctggcctcagcattttagagcaggactactcagaactgcgtcaaggccagcgttcaacgtgacaactctttcttccacggcaggttcattgtgaggttaaagacccatgaccccagagactgggcctgtttccctgctcttcccatatgaatcagacattaaaagcaagagctgctaaaataaaaacctggcctcgttggcctca

SEQ ID NO: 1868 - DNA, 773 bp, Homo sapiens
cctagaggttacctcttgttgcactggctggagtgcacatggcacgatcttggctcacctcctcctctgcgtcctgtgttcaagcgattctcctgcctctcctgggattacgggcatgtgccaccatgcccggccaattttgaacacagacagcctgcgtccagaatccctgctctttccctgtataccacatggcctcctgtgcacgatccagaggagacatccaggtgttggatacatgggcccggggtgcagcagaaaagcattgccccagtgcacagccatatccatatgccgttggcgcatggattggaacaaaaccatggaactcgatgaagattggccttcaggagagggccagaaatcagcctcctgcagcctgcaaagttggtgccaggctgctccattgctcattcctggattcctggatggaaactctcaacccaacctcatgctgcctccaaagcctccctcccctgccacgtgtcttctccctccaggcctccacttgggcagggtgaatgggctctcctctcaccagtatctgctctcaacagcagcagcctcttctccttcgctaaatcaatccctaaatcaatccccatctactttgcatttgaaaaacatgaaaaaaacgtggcccttgatatcacctgttttattttttgtttttgttgtttacgcctttgcaattttttccctctataattgtagtagggccttgggagtgaaagataataaacagcttctatttgtcaaaaaaaaaaaaaaaa

SEQ ID NO: 1869 - DNA, 247 bp, Homo sapiens
tttttttttttttttttgaaagagatacaagttttatttcagaattctcaaagcgtactgaggattgttgctggaaccacgcttatgcctccgctgtacggctggctgggggctcctggggtgggagccgattacaccaccgtgagcagcagtgatagaagcacaagtcggcaccgactgttaggctcatctgcagaaatccaggctctctgcattctggaataatttgatccacaccatctggcag

SEQ ID NO: 1870 - DNA, 376 bp, Homo sapiens
attgttcaaagaaacactgggaactttcccctccctgaggaacttccatagatgtacacctttggtctccatcccaaacttgctgacctgtgattgttcatccactgccagccatctctgtcctccacctgcacctgggacctgttgccctgcacccatggacaatctcggcttccatccagctccactttgcactctctccactcttgaatcgcatgaacccaaccaactggttcatgtgtttatttttcatttccttcttttgttctatgtaagtgtttgtttattttttaacctttttacttgccttgaatcctttttggaaatagatgaggtctaaattaaaattgtaataaataacaaaaaaaaaaaaaaa

SEQ ID NO: 1871 - DNA, 317 bp, Homo sapiens
ttgggaatgtggaagaagagtcacaggacatgactacagctgggaagaagaaaggaaagaaaaatctatttcatataaagcgctttgctatcaagccagactcctccatatacttgctgtgtggcctcagttaattacttttctgaaattttacttttattcctgataaaaaggagtcctaatgctcattcaaatggttatttttaggtgaaaaacatgagataattatttttaagtgcttaatattgtagctggcatttaatcagcgttaagtaaacattataaattcttgttcttgattcctaaaaaaaaaaaaa

SEQ ID NO: 1872 - DNA, 321 bp, Homo sapiens
ctgaagaatggctgggaatgggaagaagagtcacaggacatgactacagctgggaagaagaaaggaaagaaaaatctatttcatataaagcgctttgctatcaagccagactcctccatatacttgctgtgtggcctcagttaattacttttctgaaattttacttttattcctgataaaaaggagtcctaatgctcattcaaatggttattttgaggtgaaaaacatgagataattatttttaagtgcttaatattgtagctggcatttaatcagcgttaagtaaacattataaattcttgttcttgaaaaaaaaaaaaa

SEQ ID NO: 1873 - DNA, 571 bp, Homo sapiens
atttaatgtatgacttttatccaaaataacattaaagtacatcaggactattcattttaccaacatatatttactgggcacctataaaacgtatgatgataagttaggtgtgaaggtatgcaggtaaaagtaatatgagctcagcaaaaagtaggtatccatgatggcaggcttccccaaagaagtgacatttgatcaggcctttgaaggatgcgcagatatgtagagaaagaaagggtgtgacagcgaacctgggacagtgtaagtgggctgtttcttcagggatggtgagccattttgcctggctcgaaacaaggcacactgggctgtggcagaaggaagactggagactcccagttataagtcaggatgcaagaagacagggctggtgcttcaccaccattcccaggccagactgctcgaccaggaactcctcctagagcacagctccatgaacacttgccaaaaggcagtctgcagtaggttcttagagaattcaaggactcctcgcttcctcccttggctgctggtgttctcattgcgcccactaaggaacaagtttccttgcatt

SEQ ID NO: 1874 - DNA, 861 bp, Homo sapiens
cggcgatcttattttattttattagagacaaggtcttgccatatctcccaggctggactcaaactcctgggttaaagtgatcctcccatctcggtctaccaaggagctgggactacagctggggctccatgccatcgagcgttctttccctctcgttgctgaatgattttcctcattacatcagttattcattctgctatgggtagcccgtgggcagttttcagtttggggctatctctagtggttctcatatgtctctggtgaccatatatgggacagcagtctgaagtaggtgaagagcacagtgagaggttaggtctatctttgggaggtaaggactgcacctgtgtactcctaggtctgaggccaccgaggaagcctgagggactggcctccgtgtagagctgctctcactgccctgggcatttgggacaaggccaggacaagcaggaccccaaggcgtgttccattaatggcttaatgtccctacaaaagacactggggggttgttggcgctcgacatgcaaaggccatcgaagtacgttggaagacaaaggtgggcaaggggaggtgctcttttaagtgagttggagtaccccatgaaatactcagggatggatatagggaacaactaagccctccacaaccgaacagcatgagtccatggcaaataaattttcaatttgcgagccaaccggccatcttcagaatggagaggaaaagaacagacaccgtgagtaggagagcgatggctgcctttaaatgtgtgattacgtctcggatattaataaggggtggagtagaagagttccaatgtcataatcgattcgaggatgtgaatagatttgtgggggagacaat

SEQ ID NO: 1875 - DNA, 614 bp, Homo sapiens
cgccgatcagtgttattgtacattattcgtaactgttttattaaatctttagcatttcctgtgtagagtattttaaaaagttgaattgtacaaaatacattgtatctgttacttacacataaataattgtaaaaattcaacaaaagtatacatttacatcaagattcggaattttatttaggaaacaaaccatgctgtcttttttaaagaattatagtttttatttaatatggaattatagactttattcaattgataaaaatgtgatcttagctaattagaacataacatgtagagctgtatgtagacatgggctatttcctaagccttgaaggacttaaaattagcttaacaacatgctgacaagaatctccaattatttaatatcaaatctttataattcaaaaaaccatcattgctctagtagcctgaagctcttactcactggcattcaatcttgaaaagataaagggtgtccagttgagttattccttggtttaacaatttctgtagcattttagaatgccctctgatcattatagttcatatccttgcagagatcaaaatctatccagagaacacctttgcagttctcttcttccatggggtaggtt

SEQ ID NO: 1876 - DNA, 839 bp, Homo sapiens
aatttagacttattttgtgtggatggcagaaaagcaaaagatagaaatagttctctctgagaagcaaaaaggaaaacagtgtctgacatataggagctctttcaatttctcctttggaggccaagagggaaaagaagaaagaacataggaggaaagagaaaatacacatgagatctcttacttcaccaacgagcaaaagaatggctgatagcaacgacaggatcatggtcagggtgttttcaaagcctttgtgaatggactgaagacatggaagtctatcttcaccatgcaccgttaagtttttcttgggcagaatgagacggctggaagctcacaggtaataaagaccagataaaccgattcaaagaagaaaaccataaagaaaacaattgattcatggtaatgattttttgcttgtccaaaaagtttctataattattttttctcccatggaagtgatactgaagaaacttatagaaaatgtatgtgtgtgtgtgtgcgcgtgtttgtgtttgtctgattttaggctgtttattttatgaattactttacatactctgatctcttgtttaaaaagcacattgttaaagctacaaaaggagatcaatcacaccttttaagtaacaactagaaggtaaatagagtgtacaaaaacatcttacttttcattcaaaggactgataagaaactgctaatcctatgtgtatctcaggcttgtagtataattggggaaaaaattctcaacaggtatatattacttaattcaataggtatttgtacggatgtttctatttattttggaaaaataataacaataaataaatgtgttatcggcaagc

SEQ ID NO: 1877 - DNA, 461 bp, Homo sapiens
acaaggtcttgctctgtcaccaagctggactgccaccttcgtctcctgggttcaagtgattcccctgcctcagcctcccaagtatctggaattacagggtttcagtgcaattctatcaagtcaggaaggcaaataactacttaatcccccagcatcaattgctctacaatttggagatatcagacgaacagagggaaaatgcagtcagtggtctaaagctgccccttaggaaatctaaggctatatctggttccataaagtctttaatcagtcagtcagaacaactgcagcattcctgccgctcagaataccttaatggccttagtagctgaggtcctcacagcactggcaagagcaacatggcattggaatgggaggactgaagtaagtttcttccacaaaaggttgtggttacacattattaaagatgaatactaaagaagcgactaaataaaaagaga

SEQ ID NO: 1878 - DNA, 274 bp, Homo sapiens
gtgattcacatgtttggccaagatagcctgtcccactgacaggaccgtaaagccaatccaactgggaggagagccagggaggctgcgttcgtggacttgaagagtctaacaggcctgctcctggaatttcatccctcactctccccacttctccctccagcccagcgtgaacttcactcgtgccaaaaaatcaactgcataagaacaggattaagcaggaggctggagacggaattaaataaagtgcatgaatgaaacctcaaaaaaaaaaaaa

SEQ ID NO: 1879 - DNA, 844 bp, Homo sapiens
ctgcaaagggaaattatgtctagcataagacacaatctctgacattgaagaatttacaattgaattgaggaaataacatatctccggacaacttaacaagaccagcaaggtagttcctctacaagcctggaggatccacagcataactggttttgcagtgcctcctaaaacagaaatggctgcagtgaccaaagacttagatcacaacacccaaatccctgtgaatacatggaaaagcctacccaagaaggacagatacaaacaaatgcaaactaagaagagctttgaataagtaaggataggttcctttgcatccagtggaaaggctgcctgtccagtcagaagattgggcaagaagaggtcttgcagcatattttgagcagcagagcagatctctcagaaggctgcaaatccatcccacaaagatgtttccatataagaggcaaaagctcaggattattttgaagaaaattacaatttagagtatacattgaaatataccaagtggatgcatccaatgtctatagaagaattaactcttctagggtaagatgttgatatgcctgttttcaacctcaccaaaattccaaactggaaagaaccggaaggacacacaatagaatttccacaaacagaagagccactaccggaaatgctacattaaaattttaaaaaataaaattgtgattgttagaggtagaaatattcacaattagaaatcgcaacctcaattcaatagcttatcttttatatgaagttataaaatataggtcataaatcaaataagtgtgtttcaaaagatttagtaaggctttgtataataaagtaaacacgtatcgcaaag

SEQ ID NO: 1880 - DNA, 907 bp, Homo sapiens
attcatttgcagcacagcatattcatgattcatgtaactgctcctcccactacgatgaagaaccctacaaacactctcagcctcaacaaatgaactaaggatcccttgggctgcctttcaacatcgagagattgttctttctgttcaagagctgacatttatgctgacacctacagcaaagtgaagagaggaaaatggtcctatagagaaagaatgacaaattcaaagtttctgagatgacaaagatcttgcatttcagaggactttagagaagacccatggagctagcattcagtgagaaatgaggctagtggcccagttctcagtcggtatcctgcagggagggctcaagaaactgggttatcttctgagttgaaagggaagccactgaggggtttcatgcaggggagtgacattgttatttaatttatttcttaagaggctctcttttgctaacatgtgaagaaaagattggaggggaatgagtccctgaaagaccagtctgttgtctattacactacttcgaataagagatgatggtagtctaaggggatgattttggaaataaaggacgtggatgattctgaaatattacatacacatataattaacaggatatgcacatgtgttaaatagagggcaaagggagataaaagaatcaaagttgacccatagtttctagatctaacacccttgagaatgctcagatgaaaaatttagaaataggggatatttataggattaggtaggggaaagactgggaaaacaagattgattataataaaattttgctttaataaaacttgaggtgtctatgagaaaaattaagtgtaactggctactggctatacaaccttaagactcaaaaaagaattatgtaatagaaaaataaaccaatatcgcaaag

SEQ ID NO: 1881 - DNA, 127 bp, Homo sapiens
acccaaatctagatacacttgaagaagcaaccattaactgaaatgggaacatttttcaaaaagcagccagccttcctctacccccaactttatcatttccaggaggcaccctcacaataaacctcga

SEQ ID NO: 1882 - DNA, 386 bp, Homo sapiens
tggccaacagaggggatggtatgtaccccaggaggctgtgcagctgacccttgaacaacacagatttgaactgtacgagtccacttctatgtggattttcctccatctctggcacctgagacagccaaaccaacttcccactcactcctgggcccactcaacctgaagacaaccaggatgaagatccacctccacttgatgaatagcatgattgtaattagaaggctgaagaaagccagaggaaggtcctggcagatgccaagttaccattctggagaaaatcttcatggcctgtcgatctgtcacagaaatgaaaatcctttagagcctctggaaacaaaaaatggcatttctaaagtaactcttcagtttaaaataaatgcaga

SEQ ID NO: 1883 - DNA, 676 bp, Homo sapiens
acagaattggaaataccggttatattactaagactctgactgggatactatatttgagaagatacaaagaacatctagcttcaaagattctcagcctcatagtggctctcacttcctggcaggcccaggaacctcaggatattttggagagcccaagacaagaggaattcactaaaatctataggtattgcaggcaaagtttgatgatgagtccttggcttgacattatagctttgagaggcttttaaaagccaaatctgatatttcttataaaaagattcaggaaagtaaacttaaaggggccaacaacagccaagctgagaggtaaatcaggaaggcaatcccattcacaattgccactaaaagaataaaatacctaggaatacaggtaaccagtaaggtaaaagatctctacaatgagaattacaaaacatggctcaaagaatcagaaaagacaaagaaatagaaaagcatcccatgctcatggagaggatgaatcaatattatcaaaattgcatactgctcaaagcaatttatatattcaatgctattcctatcaaactaccaatgacattcttcatagaactaggaaaaactgttttaaaattcatatggaaccaaaaaaaaaaaagcctgaatagtcaaggcaatcataaacaaaaagaataaaactgga

SEQ ID NO: 1884 - DNA, 971 bp, Homo sapiens
  misc_feature (1)...(971): n = A,T,C or G
gggggagggctagctgcaacgactctcttatctttcaccgctacaggtaaagacactgaacagtatatgtaaaaaggatatcttaagactctgaaaggtagagagaagaaagaagacttgcctcaggacctgaagaaagacgtggtggtgggttcccagaattattttttcattcaaacatcacgagcttgaagctgaaaaagccagcaacccagaaatgaacgggcaaaaatagactttctttttngcctgctccctctagttgaaggaccaaaaaaaaaggaaagcctagtaatacatgaaaacatngagacaataatttttctactccagtgaaacgccatagaagaaacagntgaaaaagcagagtgaccctactntctagccataccagcaagggcctagtcggtgcctacacttgtacactctctaggctgtaatgtggcatccaacagccttggccagggtagggtaacattagacattgtaggaagctagaacttctatccgcaccatctggtaatgagtgactctcccaaatctccctcacatggtaaaaatgtcagtgcagaacatatagggagtctagtcttccatctccacctggcagtaatgaggtactcctccctctccccgctagagtggtgtcagaggagatctagtggagagtgatggctttgggcattaactctcaaatggagaggctacctgggaatccagaacacccatcttatccaggagtaaggaggaactccccaactcaggtgccagtggaggccaagttaggaagctgaatatctacgcccacctagtagtaatactacagtgtgcccaaaacccttttctctgccagaatgatgtgagggaaaaccaggtttaaaagaatgttttaaataagatctagactgtcatcataacatcacatagaaatgtccagatttcaataaaaaaataaagaacgatgctgcagg

SEQ ID NO: 1885 - DNA, 783 bp, Homo sapiens
agtcagctgaaatgtaccatcttcatggaagcctgctctgatcattccagatgaggagttgaatatgtacctattaagtggttgtcagatccttttctgaaaatggatagttaatgataccaccactatcaggatgaacagcaatttcccactgatgaatcgcaccaccaccacctctaccaccatcatcaccgtcaactttccctgaggcttttctactctttcctcatccccaatttctttccggtgatttaacaaaatgacaagagctttggaacaaagaagaccccactcaataacttcatagctgtgtgaccctgggcaagtcacttcacctctatgaggttaagtttcctcatctgttagatgggtttttttgtaaaaactacaaggcacctaggcaaggattgtcacatgtgtggagatctgaataaatggtggcttattttcacggtgtggacaaatcagtcagcataccttgctgatttccattttaatgtcctgaagtgtttcattcactcgaatggagcagaccaccatgatttctcttcatgaattttggtttcccagttgaacaatactgcttgaggcctctaagccaaaaatgtgggctttcagcgatctaggccaccacatctggcaagaagaacaaagctgtcctgacacgctgggtggggatttgtccctgtgtgaccctcttagccccacttccaaccatctggatacccagagagttgactgggcatgaggcaagaggcaagaggcttttgccatgaaccagct

SEQ ID NO: 1886 - DNA, 757 bp, Homo sapiens
  misc_feature (1)...(757): n = A,T,C or G
gcctctcttanttaaccccgctacagaagcacgctgtctttgtttttgtacgtgtgtcaagcnttcatctcttctttcgtcattttcttctgaaagaaaaaatgacttccacgaagactttcagcaatgatcctccgctgacatcaaaaacatgtcagaacaaagcaaaacctcaagctcccaagatttaacaagcacaggcacaagtcagctgaacccggaacatgtgccttaggaatacttagtgtttcctaagaacattccatttgttggtcaggagttgatgaattatgtgaacactgaattcatctgccttgatttatatatttatttaaaaaaaaccttccacattggggtgtttacccagtggcagtagaagagaaacccttcttttcagttgatttttggcaacacctcacatgtaacccaaagaccaaaataaagtttcattcggaaagacagtcacaattcagccgatcttatcctgcanaacctctttcacttggcggtttacatcatataatttgggaaagcgggttttacacattttactccttgtgaattttcaaagggggctttttatggatctngccaaaagtgggaccaaatgtcaacaggctttangggattggatttacccagngatttctgtctcttgggaaccnaattacctgtacctctgaaataaaacnccttgtaaaaccaaccccataaatntttangtgggaaaaaagcanttttcccccctnaccttggg

SEQ ID NO: 1887 - DNA, 785 bp, Homo sapiens
  misc_feature (1)...(785): n = A,T,C or G
aggatcttctagaagatttgcactatcagcttggtattcagttctctagcttgaaatgatttcagtgcctgctggcagtgcctcctataaatatttattaaaagcggcaagatcacggaggtctctggagcgaaatcacagccagattttatgaaaacagatccgagaagctgagaactgatgtacaaatgtccgaantggatgatttcnggaagcatagtcacattcccaaanagngccttccccttcatttttgnngnacccactgacntggtangccaatactctcagcctagcaatctnagcgcctttattgatgcaagtttcttatctgaccaggtgcggacaagcatgaactgctctaccaacagtttaactattcacacctgcatacctgtcgcattctcggtgccccatcatacctctaccttattatactatttactattaccttaattaaaccttaaagctggtccaattttcctgctttttcttaataggacaggacggcttactgttcaccgatgatcctcacatctcactaaccgcgatacacccgataaataatagtcgacgatcaatacacgatctcatccactatatatcaccatcccccccacttatattccctcgtattaacaattgctgttttagactctcagcagaattgtctacccattccgccttaacaatgccctatccatttccgccacaacttttatcccccagcaatttttacacttatatccgcggcgcgtataccttatttcacccgtgatgtagtg

SEQ ID NO: 1888 - DNA, 854 bp, Homo sapiens
  misc_feature (1)...(854): n = A,T,C or G
tagtttattggagggagttgatttcacataattagccaataatggaaaacaatgttgtttttaccgtctgagaagcctgtcaacaattgacttgttaaaaaactagaaatgtgattgtaaattgaagaatgcagaaagcttacctagaaagctgtttcacaaatcccccaagtggagagtctaaatttgtgtttgatggtaatggaatanctaatgtgttcacagcttaatgttaaacntacccatggctgattctatgcaaaagtatacataaataggctgngttagtatcattacctcaagngcattcatcatttctatctatagngnaatactgaatcaggtgttgctganctgaaggtcacgggttatgcatagctattgaaatactttatttttgagaccggctgaattactccctgacctgccgttagtgagtggggcagaacatcttcatctttatgccttcctgtcctttctaaaaatanccaggggcctttgacaanggatatattttaagccacctcatatttcacttgtctcatcagggaaaaaccttatttttggccactttgcatgccgtnanggtttgcatggtgtgcctaanttanactttttggaatanncantcccatgcctttttccacacccnnttnntntaaaaaaacctgccaaacttaaaaacncnggaaaattggctnacctnaaaaatattgggctncaaancanggggggcccccaaaaatngaaggggaaacccctttttaggaaangggantntnctttccnaantcttccntttnggaaanttnnacatnaattntcancntnntnggactggttttctaaaaacc

SEQ ID NO: 1889 - DNA, 847 bp, Homo sapiens
  misc_feature (1)...(847): n = A,T,C or G
ctagctgcaacggctctcttaacnttattgggtcgggccacagccaaccatatcagaggaggtagcatgtaagatgaaaggagaaagatgagtaagagtgtgcagaggcagatcagggaaaaggcttcctagcacatgtaaatgcataaaacgtgaatgtgctctgcatgtgcaggaaagaataaagcagaagcaactctactaaaatgtgaacaacgccatcccctcatgcctactattagcaaggagcttgctaactgagtgcttcaaatcatggtccaatccccacaatttggacttagaaagtctcctagtgtactgtggactcattcaatcaataataattgctgtcttcaattctcataaaggaataacaaggaaccccacagattttaatttttattagagctgcgtgttcatggtttattcaagtttaccaatatttggcatttgcaaactaatgttatattattcctaaagttaatgtggactccagggaaggtgtgcgcagctgccaatcaactgcaagtctcctactttccaggcaaaggtgcacatagagatagatcaaattcttgacaatttcagagaagacactttgtttttagtgcataatcattgttgccttgaggtggctctgactttcaaatactaatctaagtttttattagaaattactattagtttacctccatcttggacttcccggcctcccaaactgtgagaaataaatttctatcatttgtatgctatccagttgatggtattttgttacagcaactcaaagggactaagatgtcacttcagggtttattgtaaattcattatgtaaaggatgttgtaaaaa

SEQ ID NO: 1890 - DNA, 624 bp, Homo sapiens
ctttgcgatcacgatttgtttactttgggaattttttatttaatattttcagacaacctccgttaaatacaggtaactgaaatcccagaatgtgaaactgtagatatggggagacaaccacactctttctctgtttctcccagtgacatcctgtgtatcagctctgtgtccggggtctgcaccacttatttgtattagctattcccatgtaactaccacaaagctgaggggtttaaagcagcaattcggtatcatcattcacacatctgtgagttgactaggtgctcagaggcccttggctgatctctccttctcattgaagctctgcaggaagttaaggtggcagatttcagctgcagtggatgggactattcagtttccaagtccctcgtctttctcctggaaccagaaggttagttcatcctgtgatgattcttttggcctaaatgtactttctctcttctctgtatcagacacttccttcagttctttacgttctggctcaatttaatttctgtgcaggttgtttttgtttcagtgccccagttgctcctttctgttctcacagtagcctttccacgcctttattttattggtttgtttctggttccccaaaacactgag

SEQ ID NO: 1891 - DNA, 189 bp, Homo sapiens
cttgcgatccgtctttattgtgattattattattattaatgaaaggatgggtcatttacaagttgccagctgctggcacttctaacagcagagaccacaaatcgctgtggagcagtgtgcacatcagtgaggcagttgatcaggatggcagcagaacgtgtggaaccatctgttcttgactatgtggca

SEQ ID NO: 1892 - DNA, 336 bp, Homo sapiens
tcaggctttattcgattcagaccttcaacagattggatgtggcccacccacactggggagggcaatctactgtacccattttaccaaaccaaatgttaatctcagccagcccagtggctcatacctgtaatcccagcactttgggagactgaggcaagcagaccacttgagcttgggagtttaagactagcctaggcaacatggcaaaaatctgtctacaaaaaaatacaaaaattagccaggcatggtggtgtatgcctgtagccccagctagttgggaggctgaggtgggaggatcatctgagccctggaggtcaaggctgccgtgagccatga

SEQ ID NO: 1893 - DNA, 634 bp, Homo sapiens
ccttgctggcactgactctcttaatttttccaccgctacagttcaagaatgaggaggaaagcatgagatgttaacatcagagaatattggaaaaacaaaataaaacacccaatcaaacttttggagaaaaaaaatataatttcttggctaaaaagtgcaccggagggtatcaacaacagaacaacatggcagaaaagcaccttgcctgtttcaggtggttcccttatacttttgggcttggctgaaatactgcccccatgatggaagaatctagatttctaagaagtcactgaggggccagctgatgatactgaaaagcatgaaggaaacagctgttcactgagtgagaattgacaagctttgaagataatccctttctctctctcaaggttaacttcaagagcctttccctctctcaaggttaacttcatccttgcaccttttcatgaaaaatttagttcattgtgactacacatcagtgaaacatttttgacaattttaactccttgcagtgaatgtcgtaaagaatcatatttcctcgcttctttccctcttttttctttctccacttttctctatttctcattcaaaccactcgaggcttacgaattgcaaataaatatggatcgcaaag

SEQ ID NO: 1894 - DNA, 135 bp, Homo sapiens
ctcgcgatcaatatttatttcactgcgaagcctgtgaggactggacgcgaggacggggctttgtagaatgctcgctggtggtagctgttgttcctctcttgttttttcgagacgcctttttgtcaacataacgtg

SEQ ID NO: 1895 - DNA, 325 bp, Homo sapiens
tttttttttttttatcctttaattacagcccttttactctttgcttacatgcccacacccccgaccattccccagatgtcttatagatccatgcttcttgtatttctattaagttcaggaacatactgcataccagtactttctggatgacttgactgtccaggcaatcctctcttcaggccatttgatgtaccatttccagtggactttctttctttattaaatctggactatttgccattggattataggttttccatcacatgcaaaacttaaatgagcaagatttttggtaaaccatcctctggacaccggagggttcttt

SEQ ID NO: 1896 - DNA, 625 bp, Homo sapiens
aacagattctctctcctctgtcatccaggctggagtacagcagtggcaccatcttggctcactgcaacctctgactgccaggttcaagcgattctcctgcctcagcctcctgaatagctgggattacagtttctaggtaagggcatggcttagatgggccctctgcttagagtctcacaacactgtaatcaaggtgacacctggacagtgttctcatctggagatttgactgaggaagaaaccccttttaagctcactcaggttattggcagaattcatttccatgctgctctaaaaccaagtatccaggcttctttctgactgctggctagagtttgcccaaggttcctcaccatgagagcttcctcaacatgactgcttacttcatcaagccaacaaggagagtgtctggagtgagtctactagcaagacagcgtcttatattatgtaacacaataacaggaagaacatcccaccacttttgccgtattctgttggttagaagcaagtcccaggtcctgcctacacacgagtgaacacaccaggaagcaaggatccctggtggtcaccctagagtttgtgtgccaaatatagtaaatgaatgaataaataccgatgctggcca

SEQ ID NO: 1897 - DNA, 812 bp, Homo sapiens
  misc_feature (1)...(812): n = A,T,C or G
ctccctggcacatcantaccaagtttctcatgtcatgtcaacttcnatttcaattctaccccaggacncatgcacctcagnntggtcagctcagncagtatatcaatagattggcaaaatttaacagcctttataagagagctggatgaaaaggattccganctgtttttcaggacatccatgaatcatcgngntttcaatggagtgatttttcccaatgccccactcaagttgacaccaattcttgatggtgaggagtcatccttcttacgaagacaactatcattgtcattagtctccctaatgcctgcttatctctcatgatactatccccgctgcgacctgtaattgccagcattaatatttgttacttattttaattactttatctcatcatttagtttcggccccctcaccctcacttttcttattcttgctattcccgattacctccatccccttaagctgtttgtttataagcttgtactattttaccatcatacaactttagccgttcatcatttatcatgctatttccttattcccgcttttcccgacttttgtagtatatctgctccaacgaaagcagtgaccctccccttatcttacctcctatcccccgccctttaattatatcacctctaatacatgtcttattcttacgtggcactaatactctttctttcctgtatgctgttatgttgtttccgctacgacatgtgtcactttcctgagtaatcaccgcgtactgttcttgttctctaattctccccacctcgcattccgtgtattatcttaatttatctctcgtg

SEQ ID NO: 1898 - DNA, 850 bp, Homo sapiens
  misc_feature (1)...(850): n = A,T,C or G
agaaaattaaggctcataatgctactacaaagacacatgcacatgtatgtttattgctgcactgttcacaatagcgaagacttggaaccaaccaaaatgtccatcaatgactggattaagaaaatgtggcacataaacaccatggaagattatgcagccataaaaaaagttgagttcatatcctttggagcgacatggatgaagctggaaaccatcattctgagcaaactatcacaaggacagaaaaccaaacaccggatgttctcactcatagaaaaagagaacatcaaatggaattatgtacgtggaataacggacatacttcaggaaaatttttatggatactacaacaggatgaaacttagcaggacatgggaatcatggtttcacagaaacaggggattatgtgctctgcgtcacagccaagcttttggaagacatattactaccataagagtgggcaatgggcaaccactgagaaaagaaagcaaaatgcacctattgtgagccacacttacaaatagaaaaatgatcacccagggtagtcttctgtaagatattaaaaattgggcaccttgagccttgaaggttagccaagtctttcatgccaactaacttaggaccttacgtacggttgggcttacattgtttgacaatttttatcttcattcaaattatgttcctgaaggcctatcgaattaacaagccgcccagcatcacatgagtaactatatatttatattcacacacgcgacgcagncgtgcgatgcgcgctctgcttctctttgataagaggagatgatccacagacggctgtagattaatacattacgatagcaatcgccggatt

SEQ ID NO: 1899 - DNA, 1132 bp, Homo sapiens
  misc_feature (1)...(1132): n = A,T,C or G
aacgctgagctgctcttctctttgaattccaaagagacatctaaaggaagccctcagctctgaagaccacctagctggaatctcagagggagagctggggacaggaaaggatgactactcccaccattctgtggacaccgagtccagcctccgggaggacgctgagggaaccttttgggacagccagggcagagaacgccttttacttcttaaggctctggatcaaaacagagaagcttctgttttggagcctggcaatcctcgaacatcagtgtgcattttaagccataaagcgcaatactgattacaaacaggaatacggagggcttcctttaaactgcttcagaaaacaaactcctcggggacttcgaaaggagctctcaccatagctcctgcaatccactctgaacaggaaaccttctcatctatttattaaaactgaccccagaaagattttcaacagggaagcctggctttatgttgtgtatagccacaaagaagaacatatatttttaaaacacattgcctggggaaggctctcgctctgtcagtggttcttgaattctgcaagacagctgtttccttcctttcagtctgaatcagagaggtnttcatcaaaagccattttggagagaccaggtcaagttcagccttctcagatccaattttgccactaccatgacccacaggagaaattcctcccagcttgggactgtgctatctcggatgacgtgacagcgacaagccatttatagtgtgacttggggcttttcagaagcgcagatgcacgggaggtctgcattcaggtagtgacaggtcacaaggacagccgtggaggctccaaaattggcctgggaattgggattcattttcacaggatggggcggtgcctgagtctctgctttgttgactggctctgaggggtctgtgttattgctgttgcttgccggggtcgctctggtcaatctctctacgctcgccgtctctcgaacctgtatggcgcccagatgccggttctcccccgccccttgtccctgcttgctgttcagtgatggtcntgcgggtggttttacggtaattccatatgagttgtttccctccttgccgccttggggggtgtatcacggagaac

SEQ ID NO: 1900 - DNA, 817 bp, Homo sapiens
  misc_feature (1)...(817): n = A,T,C or G
gtctcttaataatccaccgctacagagtgtcttggaaactggaagaaagagaccactgccagtcagggtcacccaactccgagcagacaagggctgccaatatacaggtgcttgggggctggatccagagagtagatcacacttaggctcaaacccctttggcaagatgatcggtggagttgtgcgctttcatcgggaacacacaagcttggaacatgagtcctggaagtacctcaaagtgaagtccactccagttacccgcctagaacaagaagccactctggaggctctctaataattatctgttcagcccctgcttgcatacttcacagatcagggagctcactactttcaaagtcaacccatctcatctttgggaatatnttgattatgagaggacctttttataggctttagagcctcctccttgtcccctccttcagggaccctgcagaacagatctgtttgctctggcagggaaacattcctttnaaagactcctcttccagggagacttacagctggcccctttccctcttactgctcttttggctgtaatttcacataaattccctagctggggaanctgtggcctgatgtttgctcaaaattccaaaacaaggcttctcttaattttcaaaannggccgacattgatttagaggcaataaagtccaactgttaaacacttaatgcctcatttacatcccaagtttaccattgttgatgccattcacggaaacggaaacctttggtgagtgtttcattgtgaaaacctttcaccgcgagacaatattctctttctcagcacccggtgt

SEQ ID NO: 1901 - DNA, 354 bp, Homo sapiens
tgaagaaagtataaagcactgcagagaaaggggtgaaaaatcaattatggatacacaatgtattggcaggcttaaagggagtaagagacttgaattaggagattacagtatggtggtgtagacaaaggatttggaacaggagacctgaaattcaatacacattccatgctttgcaacttcgagatcttggggtccttgttcttggaaaagctggacattcaccaagtactctatatctcaaagtcatccaaccacaaatgctggacttctctcatgaagccactggattctgctaacctaaagatagtcttttcccaaactttgaatattatagacctcaataataaaaatcga

SEQ ID NO: 1902 - DNA, 370 bp, Homo sapiens
accccagaaccttaacacaattctgaggtggaagaaatggggaacaccaggcctggcctcatggagaccggggagtcagaacctgagcacaggaaccagctacagaatttgcaagtggagaatccagtgggtgggccttctccaatcaggccttaagagcaaagaccatggtttctcaaagaaagaattttcctcaagactgcaacatagagaccttgcctgagttgccagcctgataccctgaagaatttggactcaagactgcaatatcagctctttcctgaatttctagcctgctggcctgccctacagattttagatctcccagcccaattgcatgagctaattccttaaaataaataaatctcga

SEQ ID NO: 1903 - DNA, 570 bp, Homo sapiens
ctctctcttggaagatgaattatgtctggttttaaagaaaatatagtattggctggggagtcaagatggccgaacaggaacagctccggtctacagctcccagcgtgagcgacgcagaagatgggtgctttctgcatttccatctgaggagaattcaggagaaaaagataaacactggactccacaggactctatctatctatctatctatctatctatctatctatctatctatctacttatttacctacatatccatctgtctatacctatgcctatattaaaatctgtatctatcctctaaatttaaaatactttaattaaatcattgcatgaatttaattcattccacaggaatctttaggatcgatctatgctatcaatttcactcagacattgaatttcagaatttttttaaaattactttttttaaattattttacattgtctgtctgtcttttattttggaatgggtaacctgacaaaataacgctttatctcacaaattacaaacctaaacaaccgctttttctataaacgcgatatacgatcctatttttggcgcccgag

SEQ ID NO: 1904 - DNA, 210 bp, Homo sapiens
ctggatggaacgctgaccagaccatttgtgatcctgttgacatatcctcactgaagaaccaatcaatcgaaaaccaggattacgttgagtacaactgtgtctctatatccataattttctccaatgacttgaccattcacaatcagttctggaattccacaataacccgctgaaatgcgttataaagtaatatttttaaaaaaaaaaaaa

SEQ ID NO: 1905 - DNA, 228 bp, Homo sapiens
ttcaccgctcaggatgggagctgaccagaccaattgtgatcctgttgacatatcctcactgaagaaccaatcaatcgaaaaccaggattacattgatatacaactgtgtctctatatccataattttctccaatgacttgaccattcacaatcagttctggaattccacaatgacccgctgaaatgcgttataaagtaatatttttaatactgtgaaaaaaaaaaaaa

SEQ ID NO: 1906 - DNA, 719 bp, Homo sapiens
ggtgtgcgttcctttttcttcctcccctttcttcgtttgtcgccgtttttgtcgttcccggtttggtgtgtgttcgtcttttctttgcaaaaatctgggcatgtgtgggcatgtgcccctgtttgcatggggaaactttttgtgcgggtaagtgaaattttgggagctctggtgctctaactctggtttcactcactgaacaatgaagcttggagggcgttcctcatcagggcatgtaaacctcaatcttttgaattggggctgagtatcctacttcaataagcagagggaagaggggttttaaaatggggttagaattctgtttacccttcctttgaaagaggcggggctcttcaacattttctactcatgggacaattagagaagctcctttttctcctcaagaaaggctgcctgtggggaaggattgcatttttttcgggggatctgggtcttctgggagcagcacaggcatgatcccccttctggagagggataaaacagtccgtggaaatgtaatcgatggccaaaaggggggacaactctgccatcacattcgggttatgcttggttcacgttccttaaaacaaaattgcctttccaggccccacctttggttctgggctttgggggggagggagctcactttaaggtgaaccctttctaaaaaggggaaaagggcttttacctttcaactttaacctttgagccgggagaaa

SEQ ID NO: 1907 - DNA, 783 bp, Homo sapiens
agaacttagttcttcttctctcttgaacgggggttggacttaatgactaccttctaatgagcggaatatggtggatgtaatggcatgtggcttccaagactaagtcatagaaggcaccgaggcttcctccttgctagcgctcttggatccctcactctggggaagccagctgccttggtgtaaggacacgcaaagccccttaagaagaggcccactcacaaggagctgaggctttctaccaaaaaccatatgagtgagccatcttagaagcagatccttctgccctagtaaagtcttgaaatcactgatgatctttgcctagaactattaattcatcagaagttgtacgaggattttccagttctatcattctgtgattcttctatttatgaactgtgattctgctatgaagtattttccaacattatctctttggtacaaataaattacatttcatacaacaaaggctttgatttaacccacgcgtatctcaaactattcgcgcggaaggtacagcgcatggaggaaataaagggaagggtcccgaggccggccctttcctttaagggggggtaaatcccgatccccgtcaattaattttgttctctcggtcatctgggtggcgcaaccggatttatctcactcaaggggggaattccggcttcccccaaaatatggggataccgcagaagaaaatttggacacagaggtcacgcaaaggccaaaacccttaagggccggtgtatagatgttataaagggcccgccagtgacgaagaaaaat

SEQ ID NO: 1908 - DNA, 852 bp, Homo sapiens
  misc_feature (1)...(852): n = A,T,C or G
aactgactctcttaatcctccacggctacacgaatttattacagcagcaataagaaaccactacactgtgctttgaagatggaagaatgggccgtgagacaaggaatgcaacaagcctctagaaggtgggaacaactttcactgacacccagtaggaaaatgaagatttcagtcctctaaatacaagggactgaattctgctaacaatccagataagcaagaaatgttttnttcctcagagcttcaagaaatgaacacagcctgaagactccttcatttaacccattgagacccctttggacttctgaccttcagagctgtaagataataattttgtgttgttttaagccaataatacattattaatctgcccccagatccaaacacacacacaagcgtgtgctctcacacacacacacatagctctcttgacaatgtgaattcctactcactcatcaggtctcaacccagatataccatccttcaagatttcccactgctctctcaccctgcagtctagattgtgtcctacttatgtttctcaacaaaatctgtaaatagatctaatttagcacttaatttacaaaattcaaaatctgtctttgtctgcctttctcactacactttaagtcctctgggaatagaggctatgtgttgtctttattgctgcttccccaatttctaacagaagtcacccagtgtgtattggtgtatattaaaaaaggtgtgtattaaaaaaggtatattaaaagtgtatatcaaaaaaggatatatagaataattaaagagacttaatcagcttgcttttaaaaaaaaaaaaaaaaaaaaaaaaaaaaaaaaaaaaaaaaaaaa

SEQ ID NO: 1909 - DNA, 785 bp, Homo sapiens
  misc_feature (1)...(785): n = A,T,C or G
ctgtatttaggatatctcttgctcctcggcattcaaaagcatggaagacaccctcacctttcttctcaggcaacccaaatgcttccaagtgctcaaactaaacattcaaatttaaaggggattagacctggaaggataaatatgacaatattaaagtggacactgagaagagatgctacacttcaggcaacatatcttgtcagtggtggaccatggtaagtgattttgccattcaaaaatgaaagtaaggattatcgcatggaagaaaatacaggaccatttgtagtaacagctacccagctctgcaaaagctacaaaactaattcacttataaagccttataggaattacggaaatgtgtagagtgtaaacctaaatgccataagtagctactatactctgatttctcttgcttcactgagagaaatagttgctgaagaaagtggtgttggaagaggaatgcttttgaaaggtacaggcagtctatgaagtcaaagataagatctaaccttcagctatcttcttagtatcttttgaggaaaacatgaaccctatatacattcaaaactattaaatttgctgggatactaaaantgattaagtaaatttaagggaacaacttgaatttccaaaaaatatttaatattgatacccctctgttgacaaagacaggaaatttataagggatcaccttatggagataaacattgaattaaaaggtaagtgattgaagtatgatgaaaatattagaaaactcacccttttaacaatgatgtgggcggggc

SEQ ID NO: 1910 - DNA, 824 bp, Homo sapiens
  misc_feature (1)...(824): n = A,T,C or G
cgtggccgatcttgatttattatctatatcttattattatggaattttgttaaattctatttgtatgattttgattgcctgtttagttataactctagccctttattgaatatctgttccttgacctcatcttttataatcactctctttttattttattggtgttctctcttattttgaaaaatttcaaagtttcttctccaagtcactgactattttggaagtgtcaattctgcttgatagtgccttagaaataaattttaattatgccaagaccagctcagttggagagaccgtaacccagcagtgctagaggaattaaagacacacacagaaatatagaggtgtgaagtgggaaatcagaggtttcacagccttcagaactgagagccctgaaccgagatttactcacgtatttattaacggcaagccagtcattggcattgtttctatagacattaaattaactaaaagtatcccttatgggaaacgaagtgatgggcaaattaaaggaataggttgggctagttaactgcagcaggagcatgtctttaaggcacagttcactcatgctattgtttgtggcttaagaatgcctttaagcggttttccaccctgggcgggccaggtattccttgccttcattcccgtagcatgggagttacggccatcatgaacatgtcacaatgatgcagagattttgtttatggccagttttggggccagtttatggccagatttgggggggcttggtccaacaaattacttgttaaaagtttgagttttcttatatnttcatcttacttgcatcacttacctttctt

SEQ ID NO: 1911 - DNA, 749 bp, Homo sapiens
  misc_feature (1)...(749): n = A,T,C or G
ttttcactaaaaacacaggtaatgaaagcaaaaataggtaaatgagactatatgaatcttaaaaacttttgtgcaacaaaggacacaatcaacagagtgaaaagaggccaggtgcagtggctcaggcctgtaatcccagcactttgggaggccaaggtggtnttttnacctgaggtcaggagncggagaccagcctggccaacatggngaaaccctgtctnnactaaagatacaanaaattagccagcctgtggtggcatgtgcttttattcccaactacttgggatgctgatgcaggagaaccgcttgaatccgggaagtcgagattcgcagtgagccaatatgtctccctttcacttcaacctggatgacagggcgagactaccgcccaaaaaacatagcgaaatggcattgtctggaatacaataaaagatttttatttgcaccactttgtgctatagatatatcttttaatatccacatcacttttatgtctcattacgaccaatgaaattggctgtttataaattggtcttataccactatcccgaatcgtctacaatacatgatatatccatgtttaatacccacggttcggcctttctagactctatcacagtattcaatctcacacactatttaagatatatcagctccgtctcgcgtttagagtattcacgcactatatatacttatttaaaagcgatataatttttattaatccatactattttaacccgccccgccct

SEQ ID NO: 1912 - DNA, 804 bp, Homo sapiens
  misc_feature (1)...(804): n = A,T,C or G
cctcgcggtcaccatttattttcggttttatttcatactgtttaacagtagccatcctaataggtttgaagtgatacctcatcttgtttttaattctaacatcccttctatgcctggttctgatgcttgctctgtcctttcattgattttttgccttttaagatggcttttttttcccccttgatagcctgataatataccaagaaaaaaggaaccgctgcaatttgatcttctgnattgcggtgaggtgtggggagagggaagtaagactagatctcagatttgtagtgaggcctctggactgcgagcttcacaaatgtttctattttcttttccatcccacttaggcgggaaaggatggctagagtggtctgaagttggatatttctcttctcccatgtggaaggctagagctgactagagttgtataccgcttcttctaggcaagttagactcttaataatgcccccagcattgtaggtcctggtttactattgtctcctgagggcagaacctttttaagaagaaccccatgtaagaaaaaaaaatgacgatgaagaagaacaaagaaaaaagaacactgtgctgttggctattttaaaatgattcctttctccccctacaggaagcatgaagagggtcactctttaatatttacttgtaaaaccctgtacaagtcccacgaggcaaatctcacaaaatagtggcgatctcatatgactgggatcacttgaaattatatctttacagctacctcatctgaccttgcgtcctaatcctgttaccactacttcctctacacta

SEQ ID NO: 1913 - DNA, 745 bp, Homo sapiens
gtttctttaggtgttttggcatctgctgtcacatctgtgtctcactcagctctataggaaaacatttaactctctcctgccacctgccagagatatgccctgaggctctgtacctttggcttcagtcatcgcttgaccacatgcaactctctcaacacccgtgaagaacctgccagaatgtaggaacacaaccaggaatgtgagcatgggttatctcactctttcatgacttaaactaatgtaggattttagcacaaccctgtaagatatggcctagagaaaaaaaagaacacaagacaacagtcgtccgtctatgatccgtctcttgttctctcccattctataaccactgggatcttatctgagtaggaaagcaagaaaaatttgtttatggaataaactttatgacctgtgtcttataagattatacttcagaaaaacaaaatctcaccctcttgcacttctaaaagccttttctctcaagatcataatctctattttcagtaccaaaagtctgtttcaagtacagacttaaaatattgacccatttgttttcccctgaatttattttcctaaaagacacaattccatattttcctagctgttgggtaggggctgcaagtacaataaattgtgtttgaagtgtgagggtagcactgatgaagatgtagacatatcagtcaataattcaacatattcctacacatgtgctttcccccattagaaataaaagcgtgatcgcaag

SEQ ID NO: 1914 - DNA, 1310 bp, Homo sapiens
actcacccgatcacgcaggttttcttccctgattgaataatgtgactgcctacgtgttttcctcctgtgtcaaaaactactcccaactactttaggagaggaatgaagggatgaaaagagttggcatgcgagacgggtaagatggagcccccaatctcacaggagcttttgatctacacggggacaagagagatgtgaacaaacataacacagacagtggaagaagtggagctttaaggaagctggagccaaggttgaatgcaggtgctttgatctggactgttttgctgaaaggtttccagttgcctatggtggtagtaagaagatgctaaaataactaactaaataaaagccatagatcatttaagtcatcaaatctcaaccaggccaatcaaaacaaccataaagacacatcgagatgaaacttcaaatactgtggcacagctgtggactacgaagaaacaaagaactaaactcagatcagaacagttgttaaaatagaataatatgtctgtgtctcggagactaaaatacgcctggcaccaacagaagtactgagtattgaaagttgagacaagtcactcatgacttttatggactggtggtgaagacaggcagtgattgatacattacgaagtggtcagattcagaacagaattactcacagaattctacggaaagacagaagatagagcccttaatccagcctgaaagaatcattgacaactttctagaagacacctgggctgaatcttaaaggaatgacctaattgtcaagagggtaacatgttttgagagttgccattggaatagaagtccctaagcttccttggcttgtcagcctcattcccttctgtccggctttctcctcagccacataacatcactctcccacccaatttttaagttcatatttttttaaataggcaaagatttctctcctttaggcaaccacttgaaaacacctagtaaaaaattctgatttgcctggcttgaatttccttggaaatacttagtccaatcattttggctgaggtaatggtgttttctgattggtctagtttgactcatccaatctgcctggaatgctggttatctaagcaacttctatttaaaacctacagaaggagaaaagcatttaacagatgatgcagaaaagactgttgatcagattgaatagttgacacttctagggactatcattcaacctaccagtagcaaaaaggaattaccactctgtggatacatttcaggtcatgcttgcctaatgaaagactgtaagtcaaaaagaaataaacaatgatcgcaag

SEQ ID NO: 1915 - DNA, 270 bp, Homo sapiens
tccacgtttattgatttggggaatcaaatcactattgttcagcaaaagaaacagtgtggtgtcacagaggactcattcatgtggcctcagaaaagctatattatagactctggacattgaagctgggagggtcctccaagatcatctctttcaagcttgtgacttcaaagatgaaacagaggccaagagaagctgcaggccccaattcctgggcatccatatgtcttcaggctgttgttttgcctgtctgagtctcagtttcctcatctg

SEQ ID NO: 1916 - DNA, 603 bp, Homo sapiens
tcattatttatttatacatctatctgtgtgtgtatttgtacatccacccatgaatttatcaaagcatcatccattcattcacccacccacccatttttctccatgatctcaccccattaacaatttgtagaaaatagtctgacaaattcacccaaaaaggcagtaaaggaaaaggattttccatccattatccattctttttttctgccttaattttcctttctaccatctctcctgcatatctcttcctctgtctctggagagttacaggagtgaaaacgagatgggtcctgagagttggtatggggagtaaattgcttggtgacagcttggttccagggacggatgaaaaccttagccttaagcaaagttcagggaagcccaaggagagagctgatggacagtctgacttgttgagggtgaaatcaattaaagtacatcaaatccagaattcatgctttctcagagtgacaaatctatgctggaaactgagaaagacgaaaggagaaaattgcctttgaccttttgaagaccggctgttccttctgtcaggggagccaggcctggagtgagatgcgttcatgatgaattataacagccagc

SEQ ID NO: 1917 - DNA, 503 bp, Homo sapiens
caagaccctcatcactctctgcctactcaacctgaagatgacgaggatgaggacctttatatcatgatccacttctactcaataaataacaggagatggaaattctggggagaagagggcagttcccggcaaaggctccaccctcaagcctgaagacctgtggccctaaatgaggactggcattcttgttttcatgccaaaaagttgccttttggtccaccatgccccctttcctgcatccatataaaccccaaacgctaagctccagaagcagaccagcaagccagccgaccagcagatggacagcagaacaatgaggcagagaaagggagaagaggaggaacatctgaacactgagaggatttcagctaggggtggtcagagaggaatccggccgctgggcagcccaactccaggagagggtcaccttcccactccatccacccattctggctccccgtccatcctgctgaaagccacctccaccattcaataaaacccga

SEQ ID NO: 1918 - DNA, 1133 bp, Homo sapiens
  misc_feature (1)...(1133): n = A,T,C or G
cttaaataattacctcaagcatatcttataaaacaggtctgagattgaaaagctccctcagtttttgtttgtctggaaccgactttatttcttcttcatttctaaagggcagctctgccaggtgagaaacaacattggatggtttcagagatactacctgttacttactgtttgcagtcaatatggttaagaattcaaagcacaaggaacaattatcaaatatattatttgaaatatagaagtaaaagttacaaggaatgtaaaaatatcaaataatgtattatctgcatagcaaaaatagaagagtacaacaaatggctgctgtattttattttaaagcttcctggtaatattttatcctaaagaagtttggaagcaatcactcttgtccttacaacaagaaaaaatagacaatgtgaaaaatcaatgacttttctggtccacgacagaactgaagtcacagagtaaaccatcatccccaagtttgaagagacaagcacatctggagataaacaggagctctgtagcaaaagtcactaaagccataaaacggtagaagcatttatattataatttcacaaattttatggagtttgagtttcatcctacaaaagtttgggtgtacactgagttgagagtgagaaactcctgaaagcttaatcttagagggtttgcatactttcatgagctttacccccagaatctccaccaggttttaatggtgaagggcccagaaagatccctttgtcactctggaaaaaggaagagaagagtatcattgtgaaacattcaaagagttgtctctataatgaagtgttattctccggggaaatgacttcaccagaacacaactgtgaaagaaatatcttttgtctgcaggtgctcaacttttctgtctcacttggaggagaaagggggaatatattcagtttggaacaggagttcaagaaaatatatggggaaactgaaggggaactaagaagcaatgggggaaaaagaaaaagaaagtgcttgacccctgtataggagcactgtccatagccntgctgtgaatatgtagatggggtcggggatgtggtgtttgctgaatattttgggagggaggctacatgtggcatgcagatgaaggttaa

SEQ ID NO: 1919 - DNA, 714 bp, Homo sapiens
tggccgatcctggtttatttcagcagccgtggcattgaagttggtgggtgggatgagtgtggctggcaggtgagccggtgtgttggggactgcaggtctgccagagggatggggtagagtgcagcagcagagacgagacagcccagggagggaggatcagacccagaggacacacagttgctcggggaccttggagctcctctgtaagaggtgagaatggttttgagcaccggcagcctgacattatttaccttcttagaagaccacggattggagaccgcgagaagtgggaatgaatccagtggtagtggagataaggaaacaactggtttcgggacacaatctggagcaaaaacccactggacaggggacagttgcatgaggagggccagggaagggtccccggtttctggcaaatgtcaccagctggcgaagggctgctttccaggtggaggagaaacttggagcttggaggggagcgatagtctgggtttggctctgctaggttttctgggggggctggtgatggggaggctggagacggccccagcatggaattccaaagtccaggtgagggagaacatgggggcagagtggggcgttcccaggaggatttaggcagaaaatgactccgtgctggtacggagccacaacattgcatttgaaatcccactgttgtggcacttgagcgtcgctcacatagattcccagctt

SEQ ID NO: 1920 - DNA, 1161 bp, Homo sapiens
aaggacatccacaccaaaaacgcatctgtatatcaccatcatcaaagatgaaaagtagataaaaccacaaagatggggaaaaaacagagcagaaaaactggaaactctaaaaagccgcatgcctctcctcctgcaaaggaatgcagctcctcactagcaatggaacaaaggtagacagagactgacttcgatgaactgagagaagaagccttcagacgatcaaacttctctgagctacaggaggaaattcaaaccacaggcaaagaagctgaaaactttgaaaaaaatttagacaaatgtataactagaataaccaatacagagaagtacttaaaggagttgatggagctgaaagctaaggctcgagaatgacatgaagaatgcagaagcctcaggagccaatgtgatcaactggaagaaagggtatcagtgatggaacatgaaatgaatgaaatgaagcgagagcagaagtttagagaaaaaagaataaaaagaaatgaacaaagccttcaagaaatatgggactatgtgaaaagaccaaatctacctctgattggtgtactggaaagtgacggggagaatggaaccaagttggaaaacactatgcaggatattatccaggagaacttccccaaactagcaaggcaggccaacattcagattcagaaaatacagagaacatcacaaagatactccacgagaagagaaactccaaggcacataattgtcagattcaccaaagttgaaatgaaggaaaaaatattaagggcagtcagagagaaaggttgggatacccacaaagagaaacccatcagactaacagtgcatgtgtcggtagaaactctacaagccagaagagagtgggggccaatattcaacattgttaaagaaaagaatggttaacctagaatttgatatgcagtcaaactaagcttgataagtgaaggagaaataaaatgtgtgacagagaagcggatgctgagagattgtgtgaccaccaggcctggcctaaaagagctgctgaaggaagcactaatcatggaaaggaacaactcggatccaggcactgcaaaatgatgcccaaaatgagtagaccatgcttggctatgaagaaactgggtccactaacggtccagatgttgcatggtgcatgatgatgac

SEQ ID NO: 1921 - DNA, 1211 bp, Homo sapiens
  misc_feature (1)...(1211): n = A,T,C or G
agctgcagtgacagcctactttgcttgtgccctacaaaaatggaacaaccaagcctggatgagagagcatgtctgtttacagcatggtttattgaatattttaagcccactattgagacctactactcagaaaaaaggattcctctcaaaatattattactcattgaaaacacacctggccacccaagagctctgatggagacgtgcaggagattaatgttgttttcatgcttgttaacacagcatccattctgcagttcatggatcaagaagtaattttgactttcaagtcttattatttaacgaatacatttcataaagctatagtttgcatagatagtgatttctgtgatggatgtgtacaaagtaaattgaaaaccttctggaaaggatttactgttctcaatgccattaagaacatttataattcatgaaagaggtcaacatattaatataaacaggatttgggaagaaattgatctcaaccaccatggatgactttgagaagttcaagacttcaatggaggaagtaactgaagatgtggtagaaatagcaagagaactaaaattaggagtggagactggagatgtgactgaattgctatagtctcatgatcaaacttgaatgggtgaggagttgctttttatagatgacaaggaaagtggtttcttgaggtgaggtctattcctactaaggattctttgaacattgttgaaattacaagacagcattcanaatattacatanacataatnaataaaggaacagcnnggtctngagaggattgnctncnattctgaaggaaattctacgtgggggtaaaatactattaattagtgtgtgacatgacatagaaatttggtggtgagtttaatagtctttctaggtttcttacgttatgtgttgttcatgttgataaattgcggtattcacttaacgcgatgttaaacattactaggacgatgccccatcgatcagctttttcgatttatcttttttttcttttttaatgtttactcgttctccgatttatatattgttttgtttttttcttctttcttattttttacctatatgataccgttttcgacctcttctatagtttgttcctttattgtgagattttaattccacagtgtagttttttttttattatattttgtgtttctccgaggtttgtnttattatgattggttttccttagttattt

SEQ ID NO: 1922 - DNA, 627 bp, Homo sapiens
actatggaaatgatgttagacaaaaagcaaattcaacttcaaagtgggtcttaaaacagccaagacaacttgcaacatcaacaacgcatttgttccactgagaatgaacgtacagtgcagtggtggttcaagaagttttgcaagggagacaagagccttgaagacaagcagcatagtggctggccatgagaagttgacgatgaccaactgagaacaatcatcaaagctgatccccttaaaactacacaagaagttgccaaagaactcatcattggccatttgaagcaaattggaaagggaatggatacccaacctcatcaactatgcattaaaggaataaagacaatgatgcaagtttagatgccacctccacaagtaaggacgcatcattcctgagtcctatgatatctacaacaagtaaattttttgttgttgttaagagtggtcgtctcttaaaagtgactggtgcttagggaattagaattcacctgtgatagaggatcttaaagatgtgtggatgcctagagctaagagcacacataggagaaaggcaggaaactgtaatacaaaagggtgatagatttcggagtggcatttaagactgatcaacaagattaattgataaaa

SEQ ID NO: 1923 - DNA, 519 bp, Homo sapiens
gaggctcaaagaggttaagtgtctcacttgaagttgtccatcaaagaagaaactgagcctggaaccttggaaggacagtgaggagcagaggtccagtccgtgacctacagaactctgcattccatagagaagtcacagtgtggggccctgggtcagacatctctacaaacaaagttcatcgcaatggaacttctcaagggctttggcccctggaacctccctcaagaaccatccaagggaggcagggatgggggcccacagggtgcagagtggtggtcacttgagtggcagattgccgacaccatgtgacctggcttcccagtctcaacttttccattctgcccagtttatttttctttccctgtcccctccatgacctgaaatgctgtcacaaccatatctgggcttttctgtaaatgtcttttttttcttttaaaccttgattgctttcatgctaataatactaggtgcgtcaagccccagcacgctctcacactaatatgatttatattaataatt

SEQ ID NO: 1924 - DNA, 830 bp, Homo sapiens
tggccgcatccgggctttattaaagtttcagccaataacaacatttatatttcaaagagcatattctttctattcacagaattcaaccaatatttttagcattgataatttacaaaaagcctaaatgctttaagatacaatattaataaaataatgtttttgccttttaaaataagtagaaattggaaaaatgccccctcctaagaccaccataaaaataactcataacagtagagaagtccagtaaggaaattagctttttattagttttgtgccattgaatattgttcttatcacatcaacctaagtggggcacatattactagttatgttacttaatgttaagttaaaatattagcaatcagtgatattggatataaatgggatttttcacaggactctgttaaaatgggaaaaagtaatcaaatagaaaagttgagatgcactatctttgcatgaatagttgaaatgagcaaatgagcactatgtagaaaagggtaaacgtagcagaccagagactgctatcattagaaaaacctgcaagcaatgttagcccttggcaggcatttgggaactgggaattaaaagggttctcactatccctaaactgataagatgccccatgggcctaattggctaccaaaaaaaatggtataaggaaaacttgtttctttgggaatctgaatgtggtgatgtaggcaaacatgcctaccccataccctgggttttaatccttatagcgtcctgggaaacaattttaagtggaagcgcatctttctgttgggaataaaccatcctgcggaactcttggaagaaaattggaaactggg

SEQ ID NO: 1925 - DNA, 284 bp, Homo sapiens
tttttttttttttacttcaaaatttatctttattatttattagcatcttaggcaatcacagatgtcagtggattcttttccttttttattttatttgaaccagtttctcatccagcagttcagcatcaacatccaattcctcttgtattttggtagcgatgttattctcatgattatgtaattcttttaaaatatctcgaatcacaaacgtaggtagttgcatgttactttttaaaactgtttttgccacctccagataatcattactcaaactgctctaaaat

SEQ ID NO: 1926 - DNA, 249 bp, Homo sapiens
atcctgcacttgatggatcagctggcaccacccagatcgatgaactagctcatctggtcgttaggctcccaccctggaactgactcagtgcaagacgacaaactcatctccctgtgatttcacctctgacctgaccaattggcactccccactttctgacccccctactcatcaaattatccttaaaatccccagtctccaagttttcggggagactgatttgagtaataaaactatggcctcgttggc

SEQ ID NO: 1927 - DNA, 912 bp, Homo sapiens
cagttctccccagtaaaagctagagctcatagtaccaagtcacgatttaaggaaaaactgaggaagtgttccaaagtgaagaatcttccagagacaggacagataagtgcaacttgtgcttgaggactggatcttttactctgacggaacttactgagaaaactagtgaagcttgaatgagatctgtggatgaaacagtggcacagcctcaatgttaattttctagtttggaaggctctatctggtcacgcaggcaaatgcccttatttttggaaatacacactagaatatttcatggtgatggggcattatgtttgcaatttactattaaacgaattggggaaaaccaagttctgtgtactattctatctaatatttctgttactataacattattacaaatcacaaagtattgttaaaacattaataggggattaacctgaataaatttatattcccctataatggtatattaaatgaattaggctattggtctaccttataactagttttttacacggaaaaatctttactttattcctaattaatcgagatactaccaatgtaacaactagattgatatattattttattttatctattttgactgttaatctttcttaaatttcatgttgtgaaactcctgtttcttatgccttattaattatcctctctaaatttctcttttgtttaaatttaattagtttttattatattttgaattctctttctatttattgttctgcaatcatttctcaagaagataatattacttcactcttactgagtgcctcatattattattttcatttttattaattattatttttttttcgtcgtttcgattttaacgcagcctcttaatatctccttattgtttttcagcaggaagtttgatgatatatgctcact

SEQ ID NO: 1928 - DNA, 402 bp, Homo sapiens
tttttttttttttcagattaacattgctagtattttattcaggatattttcattattattcataagttatattgtttagttgatattttctccagattttactagcttttatcatcaatatacttgtttcataaaaataatttaaaattttaaatctttttcagagatctggaatagtacatataacatttaaattgtatatctttaaaaattcgatagagacaaagtaaattgaaaatcttctggaaagcatacaatcatcctagatgccattaaaaccattaatgatttatggcttccataataaaatgtcaaaatatcaacattaacaggagtttggaggaagttgatttcaaccttcatgaatggctttgagggatgcaagccttcaatggaggaagt

SEQ ID NO: 1929 - DNA, 555 bp, Homo sapiens
tgaggccaacgagcccattttcttttttttttttactttgcaacattctttattataagaaaaacaaaatcctaaacatccaaaaattggaaaatgtgattaagtcgattttgatatgtgacagactggtatacaatgattaaaatataaatctaaaaacggtgtatcatgtagaatgtttacaatataaagctaagataaaattcagatttcaatgcagcatcagcacgttgtttacatctgtgtcaaattatatgtgtatgtcttcaagaactggaaacaatctgtaattccaacactttgggaggccgaggcgagtggatcacctgaggtcaggggtttgagaccagcctggccaacatggtgaaaccccgtctctactaaaaatacaaaaaattagcccagcgtggtgatgtttgcctgtaatcccagctactcgggaggctgaggcaggagaatcgcttgaacccgggaggcagaagttgcagtgagccgagatcggaggttgcagtgagccattgcactccagcctgcgtaacaagagcaactctgtca

SEQ ID NO: 1930 - DNA, 1060 bp, Homo sapiens
cattagtgaactaattgtactttaatcgagtcagcagtgagcaataagaatccattaggaaatacagtaatatagtacagatttttatttccttcaagagctctcctcagaattcatggtctcagtgagaacactagcaatctgtgaattatctgggctctcaaaatgcagaaaagaatcaaaggagatttagaaaggagcattggcccattttactgagaattcagccaggctgatctgctcaatggttaaagagtaacagcaactacattaaacaccagaatggtcagtgcaattaatgcaattaaagtaattagtcctggcagctgtaaggtcaaatagaggtagctttgtaacaacaatctgccactgcaaaattactgacatttccaactaaattatattctctaaattgttgccttaatgctaaataaataaagttatgctaatgttgggactgattacagattgaaattagcacaattgcttgttatacagtctgctagggttaacaattttttaaaaacattaatatatggccttggctctctgtctctgggtatagatcctgcagctcatttgcattcttttgcaatatgctgacagtgctaaatgtcttaaaagaaagatctcatctgcaggcagaaaatgcgtttttcacgtcatcaagctaaaacttgttatggtttcagggcagtgttaataacaaaaatggccagaaaaggaatggataagaatgaggctagaatccgtttttcttttcagtcttgtgatccaggccttttctggagtcaatgtgaaatgtaattgctcttttgacctctatcttctctctccccaggtctgaggaagagctacactggttgattattgcaggaatgaaaggcactctgaccttgtcgaccgaacgccttgctgctttcaatgttgcccattatactgaaggcaggcaactcctggagagaggcggaatctacaggagagctgctccccgggcaacctgccagaaaaggcttcatcagcagcagttcagacatgaccaaacagcacaggcagtaaa

SEQ ID NO: 1931 - DNA, 756 bp, Homo sapiens
  misc_feature (1)...(756): n = A,T,C or G
tataataattcacacactgttcgcagatgaggttaagtataacacactgaattcattgaattggataacctagcccaagatcagaccttgtggagaatgaaagaatcttggatttgcatcccggaacttacgtggcttccacactttaaacaccgagctttgcctagttccaactatagctataagttgaatgttcttgatacataatactcagcaggaagacattagaggcacaaaataaatggggtatatgtatgagaatgcctagctttcaatgagcttatgttttcaagcttganccaaattccggcctggggtaccaaacagaatttatattttgagaagactgttgncagcttttcagggactgtgaggccggggagagacgccagaanactgtggctgggtacacactattccattttgnaaaagggnaanaaggttgattctgcaaaccatanatgctagagtcctgggcnaagttcttgaagggcatcctataaacataaaaaaagggaagtcattgntaggcaccgacaagttttcattgagaagagattattccaaatgaacctaacttcngatttctcataaggtgaaaaattggtatggctttatttagacaatacattttgctcattttcatgaaccagttgaaaaatctattttgtaaaaaaattaataaaaaagtggcctcgttggcctgcagcggtggagngntgngggaagntagnnannnannangnnntttcnggg

SEQ ID NO: 1932 - DNA, 352 bp, Homo sapiens
ctcacagacaacaacagaagcacgagcaccttctagactcagcaaaggtttggggacattgctctcacctctcaggcataacctagcaggagaaaaaacttactatcatcaactccaaagaagaacagggaagagagccacatggagagatccaatccagcagagacagaacacagaagaggaagctgctgattctcaccagagctcaggaagccacctcagagaaggtgtcacctgaattgcgtttttttccccttagatttattgaggtataattgacaaataaaattgtatatatttgaggcataaacctgtggcctcgttggactcagcggtggagctctgctgcaag

SEQ ID NO: 1933 - DNA, 148 bp, Homo sapiens
ctgtccttctactctagaatatatccaggttgagccaccgctcctggcctgcagcctcccttctaaacccttgtttttgtctaacatcccctggctgctgtccccacatgacccaaataaacagatgatcatgtgaaaaaaaaaaaaa

SEQ ID NO: 1934 - DNA, 157 bp, Homo sapiens
gagataatgaaaactgaagcagtcaccactggccctgaaatggaagtttctatggagtctggtatcagaagtctcccaccagccctgatctgcttccctctggattgtatgtatgagataaataaattcctatcatttctctcaaaaaaaaaaaaaa

SEQ ID NO: 1935 - DNA, 425 bp, Homo sapiens
cctagaatgacttcatgttattactttgtaatttaaaaaatcgctgtgaatattttgagatgaggataaatatagtcaaacattaaaatataaagtagtaaaaaccaaatatataacacttcctacttttattgataattctgcctaggaaccaaaaacgggcccatcaggtacaaaggataactatcatctccactccatcttttgacattgtgaaaactaaggaatctatgtcagagtgtcagctggaaaaagaaaaaaggactcattttcctggtatcaaaacttggcagctggtgattctccatcatgataatgaacagttaattgacagaaaaccaaagttgtttaacaatctgcttgtctgtctataaataatgagtatgtgtaataaaggaaaataacatagaaaaaaaaaaaaaaaa

SEQ ID NO: 1936 - DNA, 1260 bp, Homo sapiens
aataatggggaaaggaatttccctggataatatggaagatgacgtattttcccgaatccaaagtactgataaatggagttgtctccagcaagattatgcccatatcgcagtttttcgataggcccctgcatttttggcggcagaaataacagctggcgcaaattaatcttgaaatattctcaggccaatgctaatgtatgacatagttcaatattcagagtctggagtgatctcaaaccgtctacgaaatgaaatgaagtttctgttacagagaccagtaacgcaagagatccataagcaccagctacggattgtttctgaaattaggggtccatacttaactgtccaacctctatatcggccctacaaacagcaaaatcaagttaaatttctgggtcgtcgatccaagcaagctcaaatgaaagttgaaaaaatgagaaaagtttatttggctaaagaaaaaaatacttctgaggtgactgaaccaaaaacgggcccatcaggtacaaaggataactatcatctccactccatcttttgacattgtgaaaactaaggaatctatgtcagagtgtcagctggaaaaagaaaaaaggactcattttcctggtatcaaaacttggcagctggtgattctccatcatgataatgaacagttaattgacagaaaaccaaagttgtttaacaatctgcttgtctgtctataaataatgagtatgtgtaataaaggaaaataacatagaataagtcctgagtatgctctcttaactaaatgtgtgacatattttaagccttattgaattgccataggaacaaattcttttactgacagaattttaatctaaacaaattttttctattagatgcccttgaactagcagtatacagttttgtttaagagattagtccctgggacttttattcgattttgattttccttcatttaaacaaatatctgaacaggccatacttagcatatatattagaattcacagaatgaaaggctccttttgagtcagcttctagtgtcttttttaaagttgaaattcatttttacagaacagcttgtgaatgacctattctgaatgataataaaagtaataatggatttattgctacaggaggcatgacatggcataactaatcactattgagcattggaagcacctgagacagaatgttgcgtctgctttaatctattttggatatttttcaagtatgaagtctatttggagtaatatttatcaatttcattttcag

SEQ ID NO: 1937 - DNA, 122 bp, Homo sapiens
tgccttccaccatgttatgatgtgataagaaggccctcaccagatgccagaccctcaatcttggattcctagctccagaaccctgagccaataaatttctgttcattataaaaaaaaaaaaa

SEQ ID NO: 1938 - DNA, 758 bp, Homo sapiens
tctaaattttctccaactagccacttcttttacttcgactgttcagccacacctagtagtttatctgctgaagctgtatacaccccatcagtagcccatcctgcagttggctaactctgattccaaattcctttccggtggcgtccatctgctgtgcaaaatgttgcgaaaaggctacctattgactgtgattctccaatgtgcatagcagagggaatgactttcctcttgatagacttgggtgtttgaagaactatccctcttataacctgattgatatttgagtactggagcggaaatttggtaatttcatcagttcatggtgtttttttttttttttaatgtagtaatttttctgtttttaaaagactactacttcacaaaagcctaacaagaagatataacactaagagaaaactttgcttatggttatcaataaactttagttaattaacagtataataatttttgtatataaattgtattaaaagatatatacattttcctcattccgctcttaggctacctattatatatgtgatgttgaatagttgcttgtttatgcatgctcattatattttttaatatcacgaatcttttaaagagaaataataataccaaatcctgtgagcaatgccatttttacaaatacttctcaattagcttacatgtattaatttaaagaccaattttgttagttctgaaaaaccatttgaaatttaaacaaggcagttgaatcacaaaaaaaaaaaaaaaaa

SEQ ID NO: 1939 - DNA, 446 bp, Homo sapiens
agactctagcttttgcaggccgactgagcaggctaaagcagaaatgtgcaaagtgcctttccccagacagttagaatgtgtaatgaagatggaaatttccgagacctgaatccccaaacccagactgatctctcttctcttcttgaatataaaacaggtggacgtcaagaggaacacaccagtggaagaagacacaagtggctggatattgagaggaacgcactggtgaaagaacacaccaacagatgccatccagctgacaggccatccaccagtgccgcagagtttggacagggcagaaggagagcccagccactgagcagcttgactccagggcaaaaccatcttcctactccgtctcccttctagctcccccgtttactgactgctatttccactcaataaagtcttgcattgattctccaaaaaaaaaaaaaaaaaaaaaa

SEQ ID NO: 1940 - DNA, 632 bp, Homo sapiens
tttttttttttttttttgaaagttaaagaagagcttgtttattgttttaatgacagtggagagtatcaaattgcttggcatttcattgacattacatacccttagtctccatttttaaaatttgtaatgctaccatttctaatatgccagaagtttaaattttttctctattcacatatatgataaaaatttagatgccaatttaaaaaaactaacaaaaaggaaatattttaataatttttttggagtgtatatcaacaaaaatgtgaagaccactgatgtagataatacctaacatctgttgcatgtttttttttttcagttattaatttcaaaaatgtaaatgtttaggccaggtgaggtggctcgcacctataatcccagcactttgggagactgaggcaggagcatcacctgaggtcaggagctcgagaccagcctgaacaacatggcaaaaccccgtctctactaaaaatgcaaacattagccagatatggtggtgggcgcctgtaatcccagctgcttgggaggttgaggcaggagaaatcgcttgaatcggggagggcggggttgcagtgagctgaaactgtgccattgcacctccagcctgggcaacaagagtgaaactccat

SEQ ID NO: 1941 - DNA, 319 bp, Homo sapiens
caagctcgcttttgacgaccaatcgttcattttatatgacggtccacatctttctacaacaaaactgaataccaaattttaaaatatcattaatgaaaatattttcataactttgcaaaacaaaagaaagaagtgttgtaatttatacaaagatggtatctacctaattactcaatacattcacctaaaaggtaaatgtggcatgatgcatattcttttgtattttacatctttgtaccagagtcttatgcttgttcaattctcccaactattttctcaatttaaactaagactaaactctaaaaaaaaaaaaaaaaaa

SEQ ID NO: 1942 - DNA, 182 bp, Homo sapiens
cgttcattttatatgacggtccacatctttctacaacaaaactgaataccaaattttaaaatatcattaatgaaaatattttcataactttgcaaaacaaaagaaagaagtgttgtaatttatacaaagatggtatctacctaattactcaatacattcacctaaaggtaaaaaaaaaaaaa

SEQ ID NO: 1943 - DNA, 334 bp, Homo sapiens
ttcgaggagctcgcttttgtagaccatcgttcttttatatgacggtccacatctttctacaacaaaactgaataccaaattttaaaatatcattaatgaaaatattttcataactttgcaaaacaaaagaaagaagtgttgtaatttatacaaagatggtatctacctaattactcaatacattcacctaaaaggtaaatgtggcatgatgcatattcttttgtattttacatctttgtaccagagtcttatgcttgttcaattctcccaactattttctcaatttaaactaagactaaactctgcattagtttttgtaaaaaaaaaaaaaaaa

SEQ ID NO: 1944 - DNA, 824 bp, Homo sapiens
ttttttttttttttcaccttttagttttaaaagaaaaagaaaagtttaatagtcatgaaacatattaattacttttagaactttgatcagcatcttttcatttcacttaaaactgctttctgggacttattttagtcaattgtatgtttgaaaagttcatctttgtggttcactgataccaatgtgctgtgcattttcaccatgaatctgtggaacagatgccttttactccaagcagacttgttttctcaagtgcggataattccagaatgtagatgaatacggtctttattctttttcacttagtttgcacttaaatcctagcattatgaagatgaatattgaaaatttgtaaacatttttataacattagttttactttgtacatacagtatcattgatgtttttatgtttcgtttattgcatacttattttgcagttcctcaattactgaatttgtaattctgtagtatatggatctctgagaccacattcaccaggaaggtgaatactgtagttgctattatctttgtgttgtgactttcactgtaatatagtaagagcttgcattttcagcaacattgaagaatttatctaaatgactttctcttaaatgtgttgagaagtgaaaataggtgtttttctctggcaattgaggtttgctgtatagaaagtgcttgttggaccaagttcttagctcagaatgcttggcacagtacaaagatacttccttaagcatgaagagagttgacttctacttgcaatctaagattactcgctatttccttttttttgaaacgggtgtattttggtgccaggctgga

SEQ ID NO: 1945 - DNA, 132 bp, Homo sapiens
tttttttttttttttttggatactaatttttttcacttaacgttcattatgtgataggagttttccatcctattataccgctgtgcgatctgatcttgggcacgttaaccaacctcttgttgcctcgatttt

SEQ ID NO: 1946 - DNA, 226 bp, Homo sapiens
ttttttttttttttttttccaggacaatacagtattatattttaagaattgtatcggaagcataaccaaatgatgctatgaaagtccaaggaacacaaatttatgccaaaagagcaaaaaaggagttagaaggctccttgagaaggtgatatactggcggagtcttggaagggaaattatgttctggcagctgagagatctcttcctaaggagagtgcagcattgt

SEQ ID NO: 1947 - DNA, 317 bp, Homo sapiens
atcactcattctgggagaagacaaccgtcatatcatgtcatgaagatactcatgcagtcctatggagaatttcattggtaagaaactgagctagaatgaacttgacagccttgtgagagagccatcttagaagcagaccttcagcctcagacagctttcagaggattgtagccccagctgaaacgtcaaccacaatctcatgagagacactgaaccagaatcacccagccaagctgttcccaaattcctgagccatagaaactgtgtgagataataaatgtttattgttgttctcagcccaaaaaaaaaaaaaaaaa

SEQ ID NO: 1948 - DNA, 299 bp, Homo sapiens
aggtgggaagggaaggcacacagagaaatgggagactgaagacataggaatgaggacgtgcagctgacaagacaaggttctggaagaggtggaaagggagatattctatccaagaatttgctacagtctttctgtgagacaacagatttcttcatgtcagcacatcataatgttcaatgtgttccttggtttgtcacttgagaacgtgcagtagcactagcagtagaagatgtcaaggtggcagcttttatagcaatgcaagtgttagcattaaaagtgtaaggatttatatactaaaa

SEQ ID NO: 1949 - DNA, 446 bp, Homo sapiens
gtggcagctgtggctgtagcagatgaaatcagacatctggggcattctatggaggagaaagaaacaagcttctggaagcagcaacatagaagaacattaattctctccccacccagtctcacctacagagacagagtctcgctgtgttgccaaggctggtcacaaactcctgggctgaagtgatcctgccacctcgggctcctgtgtagcttggactaaaggtgtacaccaccgtgtccagcaaacatttatttaataatttaatggcacattaatgggacttattaaaagtgaatggtatacaaagacagacattgactatcattatactatcttctttattacatgggcctttttaaatatctttctaattgaaaaataaatgcatattgattattgaaaatttacaaaataaactaaagacgaaaatattaaaaaaaaaaaaa

SEQ ID NO: 1950 - DNA, 901 bp, Homo sapiens
caggacacaacatggagaagtgtctttaagcgaatgcttccaagtaaatgcaaggacagcctttaaccattcagaagttcctaataagaaaactgcagcatcaccagaacggagcacttcagagagtgggttacttggctgatagaaatttcaccattctccacaggaactccacacctccacttgctgaattgtgtgccaaaaccttcactagctagtgtttttccagtgagacatatcagttctttttctatctctacagcccattctatcacatgaactaactgattacgagagagtgaatcttgacccacacggcaatagaagagaacctgccctgtgtaaatctggatatctagccttccagggtcttctgattctccctgtgtttctgttccatgaaggtttttcttgggcagctagcaccttgcttcaagatcatcacctgctcccctgagttattctcagactcagcttccaggactgtgttatgtacctcaagattactccttaatttgtttttttaggtacagctactctctccaaccccagagtccttgtgtgagtgtgctttgttacgtctgatattctctgctatactagaaccatggaaagaattatattcgttggagagaataatcctgattctgccccagctaagcattgattcccctcaagacacacaccatatcacttactttgcaaatacaattttatatttctctgaaacattttatatttctccgtggagacaaaaaatgttccagtttcacatggaattcacatcaacccatttcaagatcatcaagtcatcaaccaattattctaatatttagaagaatcatttccacatcactggggaattaaaggaataacaggtcaataaagagtgatcgcaaag

SEQ ID NO: 1951 - DNA, 495 bp, Homo sapiens
agtaaatctcctgtcaaaggattggagagaaggaaccaaccgtctttcactcacccacttagaaccttctggaagccctgactgccttgctgtaaggtcggctgaatggaaagagacaaaggctgttggccctgataacagaggacatggagaacactgacgggccagcacagagagatggaaaaacaagacaccaagaggttaagtggttttaccaaggatacgtggcttgttaagtgccaagctctccatggcatattatgctgccttccaagtgccttaggctgtgtgttgactggggcatcctctctgcaatcatggctgtgagtgataggtggacttgccgactccctgattacctgccatccatggaaagtcaacacctaaatatgttgtcttatactactagataatatatgactattatactgcaaataatctttttgaagcaaattataggaataaattgagactaagaacaataataaacaagga

SEQ ID NO: 1952 - DNA, 661 bp, Homo sapiens
tagagacggggtttcaccatgttagctaggatggtctcgatctcctgacctcatgatccgccctcctagcctcccacagtgctgggattagaggcatgagccactgcgcccggcccctggagcaagttatttcttacaaagctgctgaagggggttgtgagggaaaaaagtttcactttcctgccctttgggacctctgtgcatcattatcagatttttaagaggctgatttctactctgctggtattcaaaaattgaatacattcttggcagggctatgatgtacatggcactcagtgagatagccagccaaagatgtgaagattgcagtcctgggatacccacaaggaggaaggaggcaggggtttccattgtgtggttgtaagctggacccagcatcacagagaatgcaacagaattgttcaaacagcagaatatccttagagatggatcagcttaatagtatattgagattgaggttcaggtcaagacacatcaattacttaaggtctttggcctcctgccaggagaatttatcacttccagctctctacgtgtgtccttctctacaatttccattgctaaaaagttaaccaataaatacaagcacattttaagtgagctttaaatgtaaaaaaaaaaaaataaaaaaaaaaaaaaa

SEQ ID NO: 1953 - DNA, 281 bp, Homo sapiens
acggggtttcaccgtgttagccaggacagtctcgatctcctgacctcgtgatccgcccgccttggcctcccaaagcgctgggattacaggcgtgagccaccacgcctggccgggatgcggaattgctgcttgggatgatgaaaatgctctggaaaaggatggtggtgatggttgtacaacattgaatatacttaatgccaccaaattatacacctaaaaatgcttaaataatacattttatgttatgtatatttcaccagcagcacaacaataaactggga

SEQ ID NO: 1954 - DNA, 512 bp, Homo sapiens
ttctgcaatcatgaccaaacagaaggactaaatctggatcagaatctgaaatgtaaaaaggctacttgtcaaccacgccattgttttccgttggagctagcagagcagcctcggctgcacattcccgggacgtgaataatatcggttgtgattacacttcagtatctcatccattaccagccctgtgaacactgaatataacctaattaggaaatgcgaagggccctttgctagggatgagtgctggggcagcagaggtccacatgccttcccgacacagggattcaccgggtttcagacacaggtttggatcctgcagggctcaaggacagactttactggtctagtccacattccttgtataatcaccagtaagctgagaatgtgacaccttggattccatcctatgttacactcctctttaaatgcattgcaaaggagatatgccaggactgataagtcagtcaatttcgaataggtattaaagtattaatgaagttgtatgcgcaagc

SEQ ID NO: 1955 - DNA, 262 bp, Homo sapiens
  misc_feature (1)...(262): n = A,T,C or G
atttcatgttccctgaggcagagaccagattttgttatcttgcatcgagctcccagacacctgactgaaaaaatgctatttgacttggagtgggtgagaagagcagtttaatgttttaatattttaaaaatgttctgaatgtgtatgtttaattataaagggcttgatttgtacctgaatcttaatattcactaaatatagttaaaatctgattatacacattaattaacagagcatgtaataaaaaagttatgcngncagg

SEQ ID NO: 1956 - DNA, 405 bp, Homo sapiens
ccagccagccttctggaaaattgatgtcattgctcatagaatgaatgatctcacaagataaaagtgtggatgactcagagcagctcatccatccaactagagactagagactgtcaacagctcagtaactttgtctgaatatgaaggacccgaaggaccactgagattggagacagaacaaaggccacaggattctgctgcaaattctaacaggaggaggcaatggtagcccttactaaaaccgcagaactacaggaagaggatccctgagtgggattcctgtgtgaaaggcattttcacctttttgtgtatcttcagaatcttaactttcatgagagaagaatagaaatgcaacaatggaacaatccactgtatacacgtagctgacaatttaataaacccgga

SEQ ID NO: 1957 - DNA, 365 bp, Homo sapiens
agcccagctactgctgagaactcaaaaacttcttcctttccggtgaacacgtctagacttgggctggggatgggatgaagatctctaacaccttcctggaaatcaagaagtgcaaataggccacaggattctgctgcaaattctaacaggaggaggcaatggcagcccttactaaaaccgcagaactacaggaagaggatccctgagtgggattcctgtgtgaaaggcattttcacctttttgtgtatcttcagaatcttaactttcatgagagaagaatagaaatgcaacaatggaacaatccactgtatacacgtagctgacaatttaataaacttgaaggaaatgctaaaaaaaaaaaaaaa

SEQ ID NO: 1958 - DNA, 1241 bp, Homo sapiens
  misc_feature (1)...(1241): n = A,T,C or G
acaatatatttgccaatgggaataataatgaagacagacccagtccccactctcatgaatcttatcaatgaagtgtggaaagatttttttttattgattgatgaaatatggctatctgaaatcctttatcatcatactttagaataatacaaggactactattcacttactagaagagatgatacaaaattgtaagtattatcgaatgaattatcatccccaaattcatatgttgaagtcgtaaccctcattacaccgggacatgactgtatttgaagatagggcctttaaagaggtcattaattttaaaggaggtcattagagtgggccctaaccaatatgatggttatccttataagaagaggaaatttagacacagacagaatggaaggaccaagtgaagacaacagaaaaagattgtcagctgcaagttaagcagagaggccctcagaagaaaccaacattgctgacactttggtcttggacttctagtcttcagaactgtgaggaaataagtttctgttgtttaagcctctcaatatataggacttggttggtacaagcaaactaatacagtcaggttttctttgtttaattgaaaacaacttaactttaatagttgagtccaaattctgatagaaaagaaaagaagtacagcattggcaattacttagacagtggctttcagcctcataggtaagtggactgntggcataattnacgagncctctttttattatttngncttaattgatatggggccaaggattccagttatcaaatgatccagacaagaagccttacatagacacaaataaatcctcaaatgtcaagatgtagagcaccggggacatttgaagcaacatttcatttccaagatcttatcctagaagataatcaaacacttcttatacaaagatttagcctgaagaattaattacctaaagcagtataataaatataataagccacatgcattctgccattaatattacagcaagagtattaatttgtattgaaagctattttaaatggaaatttcagtgaaaaagatggtttaagatatgtttctgattttgtgggaaaaaatataattatacaaatatgcataaagtggctagaaatatatgcaccaaaatatgtaatgatgattatctttcagtgaatatgttataacactgttttcttaatctttcacatgtgattttgtcataaagtttgaataaatcagtatcagaaac

SEQ ID NO: 1959 - DNA, 854 bp, Homo sapiens
  misc_feature (1)...(854): n = A,T,C or G
cctatatgtatctccagaggcgagatgtgtttctggtgggcagcatacagtgaggaccatggcttctgtgctgaagaaagcaaacaccagacgcatcaggccatggatacagtaccacgaaataccaaactgaacttgactccaaacatgcgctcagttccaaactggatatgaagaccatttaagaatcatgtgtgagtgaatttcattgaaagagaagaagcatttaaaaacttttaagtcctttctgaattgctatacatatattcagcaattcagtgatgcagcctggatgtgcacagacttgggtaattggtatagcttcaagtggacattattcttcttataacaatactgcattttcctccctcaaacactaacctgctatatttacaattacatttgttgccaaatatattaagtggacaaatgggtcactgtctgcctgcatttttctgacccagtcacaattcatcaagaaaaacaaagtttggctgggattctgaaacaagcacactaagctgtaaatgtatacttatgtttgcatgttagaatacatcttagttacacgataaaaaggagcaggggagaggtgggtgcttggaagtaaaaatgtgaccacaatgaaatcttgactgcagcatttgaggaatggtggcagagcagttggcatcagctcttgtctgcagcagtaatcagggcaaagaagcaatcttctgtgaccccaaactaagaatggagtcttgctttgagaaactcatgcttaccagttcagaagtaacatgctatagagattttcagaatactaatctatctcagattagtgtnttataaaataaaagtgtatcggcaag

SEQ ID NO: 1960 - DNA, 1164 bp, Homo sapiens
  misc_feature (1)...(1164): n = A,T,C or G
tttctgcaaggagagagaataaacctgaacctccagcatctgtctgtggatcatgaggctgcctgataaaagagcctgcatgaaggaaagctgaatgaagaggtggaaagattgaggcaaagttctgatgacatcatctgagtgcctagatccagctgtgcctgaaggctttccaaacctccctcctgccgacagacagccaggggaaacacacctctccaaagagaaacccaaagaagctgcagaagagatttcttagtctgttcctattcagggaagcccctggcaaccaccattctattctgtttccatgagctccacttttctggattccacaactttattctgcctgacacaatatattgctgagggggaaaactccaaattacgagagcaaatacagtactattacacgcccagaagcacacacacaatcccaggaaaagaagggatgtttattcagatgttaaccaaggttaatcctgcagactgaaacctatggataatgttgattgcctctcctgtgtccatcccccctactttcctttagagtaacttgtcactttgggctcaatatctccccaagccctgtttactcgagngnctcgggcagttgactgctttcatggttctctctgattgctcaaaaaggaatcccacccatttgtaagtgttggttaaggagtgggcgtgtcacccagttctggccaatagaatttgaggaagagtccattagaaagctcttacaagaaaatgtcttgcttgtaaaagagatgaggaagtctctctttttcctttcaatgtggttatgtcttgttgtaacaccttgaactactgttgtcaccattgtaagagccaatgggttgatgttaaaaccacactgaagacggcagatcagagagatgaaataaatctggatttttaatgacatcaatgaaccactggaaaaaccagccctgaaacccacccacctggccctggactccttgttatgtagtagtctgtattgcttaagccagggcttctttctcctggagctgaagcacacaaacagatataatgggtaattttaacttcttcttttggctcatatgagttttctaagtctttttatatgagaatgtatttcttttgtaatattaaataaaacnggtatgctgcaag

SEQ ID NO: 1961 - DNA, 419 bp, Homo sapiens
ctgcctactccacagatgagcttctttacctgttccatccaggggacaaggtgccattaaagtcctggaaaaatcaaggaccaaatcaacaactggctgaaaaatggactggatcccatgatgagatgctgacctctcattcatcagtcaacctgtccagaacgaaaccatgggtctaccactctgaaataaaggtggcttcaccctagcttgaccccacagaggaggctgcttggacatgtgagccaaaagaagagattaaaatactacttaagaaaaaccacaaataagtaaagccctatttttaatttcctgtagaatgaatagaatgaaacacttgcaggctgggcaacatagtgagactttgtctttataaataataatgataataataatattaataaacctagatcggccag

SEQ ID NO: 1962 - DNA, 301 bp, Homo sapiens
tcacccactctgaaagaagccatcttgaaagcagctctgtggataagcacatgggtgagaaactgaagtttccagtcaacaggcagagctgagacatccatcttctctcctccttggacatcaggactcctgggtttcaagcctttggactcagactgaactccaccaccagctcccctgggtctccagcttgtaagatgcatattgtgggacttctctgcctccataatgattgagccaattatcatataatcgtgatccgacagcccgccgcttttagaacgaaagtcagagggaaaaa

SEQ ID NO: 1963 - DNA, 579 bp, Homo sapiens
  misc_feature (1)...(579): n = A,T,C or G
cttgtaccataaccaatacccctgcttggcaactctaatgagcaaactgccgcaaaattgagagagaacacacctttttgatttcctgctcttctaagacacagtgatttagaatttttgttcaagcaagagaactaaagacttctttaaagaagagaaggcttttctttttctggaaaatcagatgaatgaggacattcgaaagtaaagaatctctgcattttgactagagagaattttctaccaggatgggatagaatgatcacaatggattatagagtgtgtatggtgtggtgtggtatgtgtgtgngagtgcacacacacgtgcttttcccagtttggaagtgatttgatggggagttctcttggtctcaggaaagcttaatcctttttgatcagcacttacctgtcaaccttagagaattaaacttggggcctgggtacttttttctctctccttgatatagcttaatggcgtttctcaaaaggtaaccatgggctagcaatttaaagcctttgaacctggggacagaatcatttaaaccctattcgggggccttaataaaaggaaagtgcttc

SEQ ID NO: 1964 - DNA, 828 bp, Homo sapiens
ccttgcgatccatttttattcttaaaaaaaaaagacgaccttctatcttatcttctctcttcttaaatggaatagcaaaaaactctttttgcaatactgaattagtgtcagcttcatacacacacacacacacacacacacacgcacacacgataacttgttttggatcgaaaattaattcagatacagtaacctgaacacaaaatagtaccagtgacaaaaccacagttgttgtcatagactgttaagatgtatgcatgccctctaaacttctgacatcattttaaaaacttaatatattgtctttgaatgaatagcatcaaaaagaaatatgctcgtataactcaatttctctgatgtaaaaatgtcgacattcctacatattcgtattttataattattttgtaatttatttagaaagtcctttacttcatgaaaactttttgctaaattttgtattaaaataagaaacacagcatcgactaggagaaagcaaagaaattcagagttcaacccattaagcccaaagagtcaggacctttgtgaatgacttcctctaggacactggatcttctggacatgttactgtacactcatcctgagggggacacttagcagattttctcttgtaaattcttttgtagcttcctggtagaagacactttccattttatggaaggccctcagaatatggttttaaatgaatctgttcacaaagtttaaaggctctaaattgctagaccatggttaccatttgagaaaacgcattgggctatataaaggaaagagaaaaaagtaaccaggtacaagtttaatgttctaaggttg

SEQ ID NO: 1965 - DNA, 738 bp, Homo sapiens
gcatagctggaacgactctcttaattctccaccgctacactgaaccacaggagaagaaaagaataagcggagtgatgtattggaatgaccgagaaagaatgagacgtaatttacaagtgaaaggaatggccttgactaggagtgaagatacacacaaagaatatggacatagttgcaagcagcttaagaagaaaacacagctggacctacaatcggggaaaatccataacaggcaagacaagagcaatttctctgccagcttcttgctacctgctgtctctaattggccaaacttctcacggtggagtgctctctcctccccatgtctaagttgtcttgtctggcccctccaggcaggcactgggaagccatagcctcagtatgacaggttgagtcacacatggcagtacagctgatgagtgcctgctcctctgggcatgatggacactctgccagtgtgtggcccttatcccaaggcaggcagagacaagcaatagtgggagaagataagaagatggtgatgaccagggctctgcaattgtggggactttgtgacttgttgctgagaccactctgtccaggagctagggcacagagctatgggctcttgttcttattctggggctatcatctagggagatcatgaggaaattgtgtgtctccattccttcatctgtttcaagacaacattttatgaggttagtaaaaatgactggaaataaaaaaagatgcgccaag

SEQ ID NO: 1966 - DNA, 169 bp, Homo sapiens
tcgactttttttttgacttttaccattatttaatgaaaagatttactttacatgaaaagtaatattggccggagtgttccctcttcctgtttctctccgttattcacagttggcccaaccgcatcaggcgctcctgaaggcctggttccaccaccagcaatgttaagtt

SEQ ID NO: 1967 - DNA, 658 bp, Homo sapiens
  misc_feature (1)...(658): n = A,T,C or G
ggtttagctggaacctgactctcttaatttttcaccgctacacgttactgacagaagactcctcccctggatggctttaaggagaggacagacatctgagagaatttccttttcccaaggcaaaatgcccatgacatgtaaggctaaatgatctgaaggatggctggtgagcatgtaatcaaactaaaaaacatctaaggttttacttccaaataacattgctacaaaaagagacattttttnagaataaggatgtgcctcaaagatactcttaattcagtattaggacaactggtaatcttaaggctgttgtccatcggccacctcaggagcagaataagggccagatgcggtggctcatgcctgtaatcgcagaatgttgggaagctgaggagggcggatcgcctgaggtcaggagtttgagaccagcctggccaacatggagaaaccccgtctctactaaaaacacaaaaactagctgggcatggtggcaagcgcctgtaaacccagctactgaggcagaacaagcaattgaacccgggaggcggagtttgcagtgagttgagatggcaccactgcactccagcctgaagcaacaggagtngagacttccgtcttaaaaaataacaataataaaataaaataaaataactctaaa

SEQ ID NO: 1968 - DNA, 897 bp, Homo sapiens
aattactccttctgaagtagccagccatcaagcaatctaccaagaggactgtgtgccggtgaactgtggcttcctttaacagccaggaagaaagtgaggccttcagccaacaaccatgttggggaaccatcttggaaactggtcctccagaaccccaccttcagatgtctggagcctcatgagaggccaggatttttaaccacccactgacaactgctaattcctgacccttagaagctgtgtaagataataatcatgttttgttataaatagctaagttttggtataatctgttatacagcatacattgagtaattcaagctcccacatcaagtgtctgactacatagggtttgaggtggaacttagaatatatatttaatgtaagcacccttctgattttgatgcaggaactcagtctttaggtgtcagaatagctgcaagcttgtattagtttaaaagcacctatgcctgacgtcagctccatatttgtaatattttgtgagtaatcatctcccttactctacctcctgatcaagcacatggagcaagtggtattacctgctaagttttctgctttttaaaacaagtaggtggacttctcattattataaaaatagtacatactcattgtaaaacatgaagaatataaaaacatattaagaatggaaagcatacttatagattctccaagcctctctactttgatacatgcccttcatatttagtcacaaataatcattgtactatcgtcatacagtttctcattaagttttcacttaccactgaaacagtgactgtcatgcagtagagttcaatatttgttgaataactattttgtgataaatttacaaattattcaacattttttgaaaaacaaataaatgaagatcggcag

SEQ ID NO: 1969 - DNA, 582 bp, Homo sapiens
cttgcgatcttgctttatttttatatcagaatacctgaaactgaatatctataaataaaaaaaatttattacagttgtggaagctgataagtctaaggtctaggggctgatctggtgagagacttattgctggtgggtattcttgaagagtcctgaggtggcaccagggcatcacgtggtggaaagtgctgagcatgctaacatgccagcttatgtctgtttttctcttcttataaaaccactagtttcaagcccatccatatttaagcattaatccattaattcaagaatggattaatcgatttcaatgacttcttaaggcccaatgtctgaatattttcacaatggggattaagtttcaacaagagttttgaaggcgacgttcaaaccatagcagcactcagtcattgtttccttaggcaaagtctttctcatgtccagtcactttcatcactgatgtttgggtatggagcttgtggcatcattgttgtgtgaatcaaagtatatttgaattgaaatacacacaccacacacacacactcacacacacacacacacacacacttttatacagccaaaaca

SEQ ID NO: 1970 - DNA, 949 bp, Homo sapiens
cctgacggaacgactctcttaatcctccaccgctacactgcagcagggaatccaggcctcctgccagctacagcaccagctgggcagcaccgtgcatgagccgtcttggaagtggatcttccagtcccagtcgtgctggcgcctttggctgactgggccttagccaacctctgcgggatcctgaagccgaaccactgaggaagccaaccaattgcagaggaatattcttcagcttctacaaagaatccggcctcttatttttcttgaaacttacagctgtcttggtgtgtcttatttttttcccctcttgatagagaagtgctacaaagaaatgtttttgtacttcaataaaaagacgaaatgtgttcagagtttcttccttctggtgggttcatgatctccctggctcaggattgaagctgcagacctttgcggtgggcgttaccactcttaaggcagtgcatctggagttgttcgttcctcccggtgggctcgtggttttgctggcctcaggagtgaagctgcagatcttcatgactgctacagggagacttcaagatgtagagctctatctctgcggtgaaagggcccagggctcctttttgccctcgggggctcctggagagggggaagggcccacttcaagaccacaccccctgccgatgaaggctcgagtgcgaggtcgggggtcatggccttcagatctattgacgtccccgatcgacgcccggccgagcaatgtacgaacgcactctagctccggtgcctgctcacgcccaggggtaatcaacacccctgttggcatcaccaagaaaggcgtcgcaagaagttccatccgtgatcaccgaccggtcggtgtcgcccgttcgaagccacataggcgaatctacctgctgtggctgtcgtttgtaattgttctttcttgcttccgggaactgaatcgccaaag

SEQ ID NO: 1971 - DNA, 647 bp, Homo sapiens
attacggcttctttgacgcatgaacgttttggaatttatgaggattttaatgaggattttctgaaaaaaataaaaattgttatgatctgggcattcatctatcctctcatcagcttttgatctaccacatcttggggtcgaacttgaagctgcagcagaagaagatatggaaaaactaaaatcttcctcaagcaaatattagagtaattgtcattatctcaccatgctctttttctggttataaatatgctagaaaacattcttactgtaattttaataaagtatttctctatgttttcttctgattatttttattattttatatgttatttgactatgtagtcaacttagaatttttgtgcatgtgtgtaaaagtgacattgcaagctaattttctatatgaataaaaactgtctccatgctgcttatttggtcattacgggtacaggaaaaagtcattttttaatgttgatcttgtattactgagccctcttattaaattcaatggttttttcagtagattcttctaagtttttaagtagatggccatatcatctaaaataatgctgcctctcttgactcaatattggtaattgcttttatctagaaaaatcaggcaattattatagaccgtaaaaaaaaaaaaa

SEQ ID NO: 1972 - DNA, 405 bp, Homo sapiens
tctggttttattttattttattaaaaaaaaatcctcctgcagatgaggctcatttaaacataatgaggaggcaacaaaggcgtcgcacagaggagcttcagattcggtttgactcaggggagggagaacaaacaaggagatgtcctgtccatttggctttcctctatagggcccagagcagctgcatttcagatgcaaatgggagatgcaggaggtggggagggggagggtgtggaaatgcccaggaagctggtgtgcaggtgttaaggattccaggcatcgctgcaacaacaggctctgaaaacacagagctcccagacagagcgggcttgagagtgcttgcttggagggctcaagtggacccgcagctgcactggacattcctttttgtggtcatcaatgggc

SEQ ID NO: 1973 - DNA, 718 bp, Homo sapiens
aaaaagaaataaaaaaatttttgggggggaaaacccctaaaaggggggttccccccttaaaaaaatttttaaggggtaaaaacccgattgttaacctttccccccattttttttaaaaaaacccttaaaactttttccccggggtttttggaaatttttacccccctttttaaaaattttcgggttcccccccccccctaacccccctttttttttttttaagggggtttttcaaaatttccccaaaagggggaaacatggggttttgggcctttggaacggggtttttttccccaaaaaaaaggtttcaggggccccccctggggggctaaaaaaaaaaaatttccccttttgaaagggggaaaaaattttgggggccccttctcccccctttttaaaaaacccttctctttttggggggccataaaaccccttcccccaacaggcttttgggaaggggcccccaaaaaaccggggggggctaattttttctcaaaacccaaatttgggtttttttgaaaaaaccccccaaaggaaaatcggtcccccccccgggcttttttttttgcggaaaaaccctcctttggcgccccataggggggccgcttcccccccaaatgacaaatattcttttttcatgggaaacgggaagcttttagcccctggagcaaaatctatgcactcctccgcgtaaaaggggctcctgcggggggggagg

SEQ ID NO: 1974 - DNA, 563 bp, Homo sapiens
cctgacagatacggcatttatttatctaatttattcttgagacagtctcactctgttgcccaggctgaagtgcaatggtgcgatctctgcttactgcaacctatgccacccaggttcaagcgattcttctgcctcagcctcccgagtagctaggattacaggtgcacataaccatgcccagctaatttttgtgtttttagtagagacagagtttcaccatgttggccaggatggtcttgaactcctgacctcatgtgatccacctgccttggcctcccaaagtgctgggatttttggtgtgagccactgcgccgggccttcattcttaataatgagtataacgtatgtaagaacagacttttcattctctatctgcggagctgtctcatggatttccagtccattgctgggggttgagccacagctgtttctggatttggcttatcttttggttcattggttcatttgagttgtttttcagcattaatcagtaggcatcgaagttgttcacattcatttcttgctgtgtagcggggaaaattaagagagcgtttcccgctagc

SEQ ID NO: 1975 - DNA, 577 bp, Homo sapiens
atgccaatctgaattccacagcttgatatgacctagacagaattttattaatctgtacaaaggtaacaggaacaaaattatttaatatggaggtactctcagccttaaactatctctggcctgttcatcctacctgtcaaagagaatcttggattttcccactaaacctcctccaatccctgatctttattctctaaagaagagttctacatgactggcctataaaatcatgtgatgcaaacttgggagtatagaaaggactagaaatgaagaataaaaatgaaaaggtaacaaaagagaagagagacattatggatgcaacagtatcagagaaaaacatgttgatggagaatgaagactatgaataatgagagaccctggagaagtcgctgtgctttacagaatagatgaacagaggaaaaggacatttaaagagttgtgtctaagattatttcttgaatccgttttaaaatcattagaaaaatatgtaaaggttgaaattgatgtttaataatactgattattagacagtgtttctttcagaaaaacatactgctaatactgaaaaaaaaaaaaa

SEQ ID NO: 1976 - DNA, 565 bp, Homo sapiens
  misc_feature (1)...(565): n = A,T,C or G
tggaaacactctatttgcagactctatgaagagacatttgggagcctattgggacctatggtgaaaaactgaatatctacagataaaaaccagaaagaagctatctttgaagctgctttgtgatgagtggattaatctcacagaattaaaactatgtttttatttaactggttggtgtcaatatttttgtagtaaatgtgaagggacatttcagagcttctttaggcctatggtgaaaaaccgaatatccccagataaaaactgacaataggctatttgcaaaactggcttgtcatgtgtggattcatctcacagatttaatccttccttttgattcagcaggttgaaaactcactatttgtagaatctgtgaagggacaattgggagcccattgaggcctatagtgaaaaatggaatatctccagataaaaactagaaagaagctttctgtgaaaattctttgtgatgagtgaattcatctcacagaaataaaccattattttgattcaaaaaaaaaaataaaatggtcctcgtggcncacagcggtggagtgttgcggccagg

SEQ ID NO: 1977 - DNA, 609 bp, Homo sapiens
ataaaagtgagatatatagaagaaagaaatgacacatttctatggttcaaatgcaatttgaggtgattttcaacatgtgatgaattgcatcgttaggaggcagaaacagagaagtttccaagtagagcaaaattcttagaagtaggaaaatacgagagtgatcatgcaacttgaagaggacttgcagaagaatttgaggttgaaaaagtatttagagttgttgttacagactggaattgcaaaatagtgccacacattgtattttgtcatacttctctaatagaaaaaccagggcctaaatgaaaatagaagcagcattacttaaaattgtgtcatattttgacaatatgttttggtattgcgacttcttaaattttaattatccttggcaacattgaaaaatttttaaatgtaaagagaatgtatgagcttaaaagtacttatttgtgtttctagcaaaatgaggtgattttatcacataaagagtgaatagaaattgtcttgtgtaagagttgagtgaagaatttttaaatgaaaaataaaaacagatgcggccgaggttttttttttttttatcttttcgtgctctaatcacgcttcacgcgtatg

SEQ ID NO: 1978 - DNA, 641 bp, Homo sapiens
ctggccgatcagggtatataatgtgtttagagaactttaaaaagtaaagtaatttttgcacatgaggtatatcaaatattgtatcctctagtttagccaaagggttttcattttcacatgttccatatgttgtatataaaataaaaaactgcttctgtgcctctgagttatcccttgactacttcccccaggctcttcccttcaagtcaccttcacagatttcaggttggctcggagtcacggaagaccctccttgtaggtcttgagctctatttgggtgtgtgggtggtgcagagtgtagaggttgcatggattcagccaaaatacttcatttccagtagctcctggcagctctgaagagagcagcggatctctcagcacagtgtttgagctctgataagggacagcctccctcctgaagtgggtccctgaacccccgtgtagcctgactgggagacacctcccagtaggggccgacagacacctcatacaggagagctctgactggcatctggcaggtgctcctctgggatgaagcttccagaggaaggaacaggcagcaatctttgtggttctgcaccctccaccggggatacccaggcaaacaggatctggaacggatctccagcaaactccagcag

SEQ ID NO: 1979 - DNA, 946 bp, Homo sapiens
atggagtcttgctctgctgcccaggctgaagtacagtggtgggatctcagctcactgcaagctccgcctcccaggttcatgccattctcctgcctcagcctccccagtagctgggactacaggcacctgccaccatgccaggctgatctcaaactcctggcctcaagtgatcctcccacttcagcctcccaaactgttggaattacaagcctgagccacggatggctgggcagggttctgcaacacagcagaaaccccaggcttccgcaacacagcagaaaccccaggcttcccaagacccaggatcagaactgtataatgtcacttctgcctcactttgttggacaaagtatgtcacaagatcatctcagtggtggtaaaattattattattattattattttaaggcagagtctcactttgtcacccaggatggagtgcagtggtgtgatctcggctgctcactacaacctccgcctcccatgttaagcgactctcatgcctcaaccttacccatgttaagcgactctcatgcctcaaccttaccaagtagctgggattacaggtgcatgccaccacagctggctaaattttgtatttttttttcatactttaagttctggggtacatgtgcacaacaagcaggtttgttacagatgtacacatgtgccatgttggtgtgctgcacccattaacttgtcatttacattgggtatgtctcctgatgctatccctccccccttccccaacccaagacagggccccggggtggatggataacatcctaatattctaacatggggatggtaatcacctctatgcctattggaaaaaatggttggccgtttacttaaatggtagagagaattgcctgaaattatataaggataaaacgggtgccgccgcttcctttagtgggggtaatatgaccttgctactgcccgtg

SEQ ID NO: 1980 - DNA, 805 bp, Homo sapiens
  misc_feature (1)...(805): n = A,T,C or G
ctgatctcaaactcctggcctcaagtgatcctcccacttcagcctcccaaactgttggaattacaagcatgagccacggtacctgacctagggatgtattttttaaaataaagtcaagcaactgccacatttccaggatggctgggcagggttctgcaacacagcagaaaccccaggcttcccaagacccagttttttaactgtataatgtcacttctgcctcactttgttggacaaagtatgtcacaagatcatctcagaggtggtaaaattattattattattattttaaggcagagtctcactttgtcacccaggctggagtgcagtggtgtgatctcggctgctcactaccaacctccgcctcccatgttaagcgactctcacgcctcaaccttacccatgttaagcgactctcatgcctcaaccttaccaagtagctgggattacaggtgcatgccaccacangcttggctaaattttgggttgtttttttttcatactttaagttctggggtacatgtgcacaacaagcaggtttgttacagatgtacacatgtgccatgttggtgtgctgcacccattaacttgtcatttacattaggtatatctcctaatgctatccctcccccctccccccaccccacgacaggccccggtgtgtgatggataacatcctaatattctaacatggtgatgttaatcacctctatgcatattgttaaaatatgtatgcagttttactaaaatgttagagagaatatgcctgaaatttatataaggaataaagacatgatcgnggcag

SEQ ID NO: 1981 - DNA, 1122 bp, Homo sapiens
ctgccgatccgcgtttattttattttattagagcaaggtcttgccatatctcccaggctggactcaaactcctgggttaaagtgatcctcccatctcggtctaccaaggagctgggactacagctgggactccatgccatcgagcgttctttccctctcgttgctgaatgattttcctcattacatcagttattcattctgctatgggtagcccgtgggcagttttcagtttggggctatctctagtggttctcatatgtctctggtgaccatatatgggacagcagtctgaagtaggtgaagagcagagtgagaggttaggtttatctttgggaggtaaggactgcacgtgtgtactccgaggtctgaggccaccgaggaagcctcagggactggcctccgtgtagagctgctctcactgccctgggcattggggacaaggccaggacaagcaggaccccgtgcgtgtttcctcgaatggcttatggtcgcttcagaaagacactgggtgtttgttggcgttcgggctgccagggccatcgaatccgggtgtctgccagggtgtgcagggggagtggcgcttttcaggtgtaggaacagctctggaaataaacgagggatggaagaaggagacagactaggccctccacagcccagctgcacgtgtccttggcgaagtcacttttcatttgaaaaccatcactgcctcctctgtaatgtgtgaacgatgatcccacctcccagatgtattgcaggagagggttgtagaagagaaggtttgcaaaagcactgagaccagagtcctagaattggccatttatcgaaggagccctggttctcatccttaattggtttctggtgttgttgcctagggatgctcttcctgtcctcccggggtttgttcaagacgggaataggctgttttaaacaactgtgagaggcaggctgcccaggctgagatttgtgagccaggtttaggccagaagcctggggctgaggacactcctgcgggagcgtgaggatagcctctcttcccgccctatttgcaagctcagatgtctgttcattcactagaaagccaccaaggctccatggtagtagctgttggggtggttcctgtta

SEQ ID NO: 1982 - DNA, 252 bp, Homo sapiens
agaccacccattgaattactgttctgaagtcatccctcaaccacctggagtagatcaaaggcaacagaaaccaagaggagaaagtttgagccttgccatatcaatattgggtactgaacgaggaaaaaactcaagataattactaacaacctgggactcctggggaaaaacagagatggcaccacagaccccattctgggaaaaacttcttttcctcatggaaccccaggaattgaaaacaataaatcccga

SEQ ID NO: 1983 - DNA, 1249 bp, Homo sapiens
  misc_feature (1)...(1249): n = A,T,C or G
ctttgccgatcatcatttattaatgttaatagaaaccattacaatcaacatatttattgccaatgaaaaataagtttgtttattcctgtagcataaaaatccatgcttcaagattctacaaactcttagatagcattttttgcatcttgctcattgtagaaacattttccctgcaaaaagttgttgatatgcttgaagaagtggtagttggttggcgagaggtcaggtgaatatggcagatgaggcaaaacttcatagcccaatttgttcaccttttgaagtgttggttgtgtgacatgtggttgggcattgtcatggagaagaattgggtcttttctgttgaccaatgccagctgcaggtattgcagttttcgatgcatctgatggacttgctgagcatacgccttagatgtaatgattacatcaggattcacaaagctggagtggatccagaccggatcagaccaccaaacagtgaccatgcccattttttggtgccagagccggctttgggaactgctttggagcttcttcttgttccattcactgagctggcggtcgatggttgtcatataaaatccactttttgttgccattcacaatctgattgagaatggttcatcgttattgcatagaagaagagaagacgacacttcataatgatggcttttttcaatttttgctcacctcattaggcgctcagttatcgagctttttcacctttccaatatgcttctgaatgccgagtgaccaatagaatgttcgactgtgagttcttcagcaacttctcatgtagttgtaagaggatcagcttcgtatgattgctctcaactgatcattggcaacttctgctggccagccnctatgctcntcatctcgtcncctttgcnnaacttcttgaatgatcnctgcactgtaggtttgttagcagttcctgggtcgaacgcactgttgatgttgtgagttgtctttgatactttacgacgcattttgaactcgaataagaaaaaaaaatggntttgctttttgtccaacatcatttccatagtccaaaataaattagcctgcaattgagtgagaattatctggcaacacagtccactatagaatctctgtgtttatcctcatgatcctgtggctgacggggggctgtggctcactgctactgcccagcagtgccagagagtcattatattgtatattgctagcgtgtagcgctggaaaattaagagagtcgttgcagcatacc

SEQ ID NO: 1984 - DNA, 1026 bp, Homo sapiens
  misc_feature (1)...(1026): n = A,T,C or G
caatgcatttaaacaggaaatggaaacccggatggcagagaagccatgttgttcaggtcctgctatttatgaggaaaaatatcttggaagttcattcacaatggacacttcagtttgtttctaatcttggctattatgaataatactgcaatgaacatggttgtacagatatctaaaagacatacggatttaatttcctttggatacatacacaatagtgggattgctgaatcatttggtaattctatttttgattttttgaggaacctccctactgctttccataatggatatacaaatttacattgccaccaacagtatacagggatcctcttttcttcacatcttcatcgacacttgntatcttttgtctttctgataataaccattctaacaagtacgaggtgatatctcattgtggttctaacttgcattcccccgatgatttgtgatattgagtattttttcatatacctggtgggccacgcatatatctttcttgaaaaatgtcttttcaggtcttttgcccatttttaaaaagcacagttatttgttttcttgctattgagatgtttgagttgcctatgtattttaaatattaaccccttatcagatgtattgtttgaaaatatttcctccgatcccataggttgtctttttactctgctgattgtttcctatgtggtgcagaaaattagtttgaaataacctaatctgtccaattttgcttttattgccaatgcttttggggttgtatccagaaaatgatttcctagaccaatatcatggagctcttcccctgtattttctcttagtagtttcacagttatgggtcataagtttaactctttaacccattttgtgttgatttttgcatatagtgtgagataagggtctaatttcattctgttaagcatgtatatcccatttacccaataccatttactgaagaaactaaactttcttcattgtgtattcttagcacctctgtcaaaaatcaacagacaataaatgctgatcggcaag

SEQ ID NO: 1985 - DNA, 764 bp, Homo sapiens
  misc_feature (1)...(764): n = A,T,C or G
tttgctctgcttaatgaaaagtacagagtggcatcttggtcccttttggaatggcagtcatcaagtaactggatttgtagaggcagggtttagtctctatagagaggaacttgacacagttaagtgggttttcaggacttgagttccagtggacctcaggtctattcattgtgacagatgccgaatcctacaactgagtatgtgcaaaggggccactgagaaaggcttcggcttaatagctcccagcaactcagatcagccacttagtcactctgctagtgactgccagaccaaatgtagactctacctgatgagaagaccccactttaaaattcagaggcactgcagaatcttgattgcagaattgctaatacctaccgctctgaagggctgggacaagcagagctataattaaagtaactagaaaaggaagtgttccaattccattgaggaggaaaattgcaactcacagatgctctggagaggcaactcaagaacagtaaagtcaagcagtcctgattttataaaatggactttgatatctgctattattttttacttctccctgcttttgctgttgatgattatttgaccaatgagtgcagatgcttacttgctcaacaaatgttatgtgaacttattgccaggtattctcttatactcttgggattcagcagtaaatatagctaacaaaagttgcaccctcatggagcttacattctaaagtaggaagacaaagcaaaataaaaatcgtatctgncaag

SEQ ID NO: 1986 - DNA, 845 bp, Homo sapiens
aaatcactagaataccaaaaaaattggagtccagatccatgtggtattcagaactgggtctatgaggatgtaaagaataaaccaccattttctcaatgtgagaagatttcagagatgaaccatcccagcccagtatgtcatacgtcatatggttaacaactggatttagaaagtttgcagctcctcttccctcactcttagctttattgagatggggtcttgctatgttgcccaggctggtattgaactcttggcttcaagtgtcctcctgccctcggcctcccaaagtgctgagattacaggacttaagcactgagtggccagcttcacacagctccatgaggtcacaggagaagactgagcccaggatgtgaacggacacccagctgggcagaagggagccagtttctcaaggtgatcaatccagacctctgccgtatgtaaccacctcctggtgaccacctccctgtgggacagctggatacaacctacttgactcaccctgatgactccaacaccgcgtatggactgtgcagatatgtcacaatgaccacctctcagtcgcagtgtgactccatggagctggtgcttgctttctctaaactcaattaggactcaccttgggaaacctgccttggtaatgtcctggaccccaaagcctctgcccacaagtccctctctcttgctcctcacccagaggttgagtgtgtgtttcctggatgactgtcttcttcccatcagtcctggtgatgtgtcctgcccttttctctctagatttgtaagtaataaacctgatgcggccacccccccctctttttttttttgctttcactctaccctcctcc

SEQ ID NO: 1987 - DNA, 392 bp, Homo sapiens
cagaaacggggtttcaccatgttagccaagatggtctcgatctcctgacctcgcgatccgcccgccttggcctcccaaagtgctgggattatgcattctctctttacatcacaatgaccatgaccttggatatggagtccactcaaaaataatctgaactaataaacaaattctgcaaggttgaagaatacaaggtcaataaaaataattaattatatttctatgtgatacaataaacaatcttaaaattaagaaaaaaaattcatttacagtagaataacaaaaaaatacttaaaaataagtttaatcgtgagatacaaattggtaccctgaaaactacaaaacattcctgaacaatattaaaggtctaaataaatggaaaaaaaaaaaaa

SEQ ID NO: 1988 - DNA, 998 bp, Homo sapiens
tgtttcctttcctgcccaatttatctggttaaaacgtctgatacactgttgaatagaagaggcaagggcacatgttcatgtcttgttcctgatattgggagaaagcatcccgtttttcaccactctggccaggacagcctatctgtgcaggaggcattgctggcaccccgtggggactgaggaccaaggaggagctgctcccccacacacgaaacggggtttcaccatgttagccaagatggtctcgatctcctgacctcgcgatccgcccgccttggcctcccaaagtgctgggattatgcattctctctttacatcacaatgaccatgaccttggatatggagtccactcaaaaataatctgaactaataaacaaattctgcaaggttgaagaatacaaggagatatggaatcaccaaagaatactgacacagaagaaccaagtaggagagtgtgcagttcccagtctcatatctcattacaaaaccaaactaaacaaggcattggcacaagaatagacatacagatcaatggaacagaactgagaccccagaaataaaaccaagtggtcagctgactttttgaaagcttgccaagaccatcaaatggggaaaaatttttttaatatacgttgcagggataattggatataaacatccaaaagaatgaacttggatgcttatcttgcaccatatgcaaaaataactgaaaatgaattcaaggctataactattaactcaaaaaaaaaaaatgagctgcattttcatgatcctaggctaggcaaaatactcttaagtataactccaaaaaaaaacccaccaaaaaacctagataaggtaaaatttcatcaaaattaaacattttgggcatcaaagggcatcattaataaaatgattgacttactacaaaaaaacagaaattgactgtataatcgaaacgtataagccccgattaactgcaaaataacacatacatccatcgcataataatgtctcgc

SEQ ID NO: 1989 - DNA, 578 bp, Homo sapiens
gggagtctcactctgttacccaggctggagtgtgatggcatgatcctggctaactgcaacttccgcctcccagggcagaaggctccaggggccccatggttccatacggaagcagaagccggtctctgccccactcaggactctacgttcattccctgtcccacaccagggaatcagtctgaccagcctgacaagctcagccacctaaccctgttccctccctgccagggcaccctctgcacccaaaagacagctcagaaaggttcaaggaattctcctgcctcagcctccagagttgcgtggactacaggaagaaagaaggaagaaagtccaagtcaaatctccagctgactggtgagtgtgagtccacccccttttatgagaagcttttgccaaagttcccagcggacagtaataacctacattctattggccagtcttgttatgggaccattcctggctgcaagggagcctagttctggaaagatctgacttttgaaaactctaccgcctgttggcatccatatatttggctttctgagcagattagacccttctgatgacttgctcatgggagg

SEQ ID NO: 1990 - DNA, 847 bp, Homo sapiens
  misc_feature (1)...(847): n = A,T,C or G
tcatgctgtaacgactctcttaacctccacgcgtcacgggacttatatttgtcagctttgcaagtggggctttgcttcggggaaggggcgagagagaagaaaggaagaaactgatgaagagaatgaaagaggagaagacctcgcctgacacctggatcttagnaacaaacctctccctaacaacaganctccaagcataaagagagtatttncaaacaactcnaaaaaatcattntttttcaacgatnntcagaangacaaagaaaaatatcntaggggactatgntcnttccncccangtgncttatgttctgaagntattcatctgacaccttctgntcttgncggatggcnggcctgtatacccaaagangcncattccagccaactattgctgagaaacaancgaccacaaaggtangacaggttaaaccacaacctatccnatttnntntcctcagtaccgggggnccananntcaggccaggagaagtgacnganctgcctccatatggctcgaacagnnggacncaaanggggnanccagnanngaagaaatngnatggccccaagggnctaacngaagntcaaaggctnnaccnccccncctgcacgccngacggngatgggnttnaaananggnnncccaccggggactggccnacgcgaagnnccccccncagccncnatncaactcnagcctncngccnnnnnagcnacngccaaacnaccnagacnncnacnaangncaanntganaaagccncnagacaccncngcggcgggcngcccnancgngncnccncatanaacgncttanaanccgnangcgncnnncncnacgngag

SEQ ID NO: 1991 - DNA, 302 bp, Homo sapiens
aagaagcttcaaatagagtcactgtgcctaactcccatctctgggcattttactcttcatcgaggtttatttgtctgctatcctctgtcgatgaattaagatcagtctccaacagatctttattgcaaacattcaaagagagggaagacttctgtggactaagttggaaaactactctgggagcagccgatgagtttcatcactttgcttcagtataaattaaaacagattgtattctcttcacacccccatcactgcaaacggaaaataaaattactcagcaattccgaaaaaaaaaaaaa

SEQ ID NO: 1992 - DNA, 691 bp, Homo sapiens
  misc_feature (1)...(691): n = A,T,C or G
ctaggaaatacgaagaaagaaaagatctgaagtgagctacctaggggccttagagggaaggccagcagtattgtcaacccatttggttctgccaaatcatgatgaaagtaatggcccaacccggctgagagccctgcctttctctgctggctgtcttcatcgggatcacaccagaacttctagcttatcacatctttgcttgactaacttcaattcatcctctaagacttagctcaggtatgacctaccctgggaagctcctttgagaccctcactgccctcccagggccatatgctgattttctctatgacaattttacattaaagccgtgtgcccattttgcctactaaatttggagcttgttttgcagagggaaattccctaatgatcttaatggtactctctgttagcctgaagcctggtatcctgtagacattgattcttataataatattgatgaatgaataaacaaatgagaaattgtgaagatggggcattatctttctaatgatcatcactgtatttggtgtaaccattcatattcatttaatgccaagacatagtagcaagtgcaaaggtatactgccaactgtgtgaagtgctattgatagatacttctgctganaccatgtacattatatgttaataaaataaactaaactaccaaaaaaaaaacaagaaaaaaaaaaa

SEQ ID NO: 1993 - DNA, 962 bp, Homo sapiens
ctaggaaatatgaagaaagaaaagtactgaagtgagctaccttggggccttagagggaaggccagcagtattgtcaacccatttggttctgccaaatcatgatgaaagtaatggcccaacccggctgagagtaagcccctgtgtttctctgcagcagatgactgagaagcagccaggctggtccccattctgagctgcagcccagcctgctcctgttcacttcctctgtcgttctgggaggtttgtcagcttgcacctcttcagctccttcatgctgacatcatgttggaaaagccactttacttcttagagattcaaataacccaagccttgcttgacttgcttctcaggacaacagaatagacaccaatcagaaactccatggcagtgtgaactgtttttaccttccaggccctgcctttctctgctggctgtcttcatcgggatcacaccagaacttctagcttatcacatctttgcttgactaacttcaattcatcctctaagacttagctcaggtatgacctgccctgggaagctcctttgagaccctcactgccctcccagggccatatgctgattttctctatgacaattttacattaaaggccgtgtgcccattatgcctactaaatttggagcttgttttgcagagggaaattccctaatgatcttaatggtactctctgttagcctgaagcctggtatcctgtagacattgattcttataataatattgatgaatgaataaacaaatgagaaactgtgaagatggggcattatctttctaatgatcatcactgtatttggtgtaaccattcatattcatttaatgccaagatatagtagcaagtgcaaaggtatactgccaactgtgtgaaatgctattgatagatacttctgctgaaaccatgtacgttatatgctaataaaataaactaaaataaaaacggatgcggccg

SEQ ID NO: 1994 - DNA, 314 bp, Homo sapiens
ctatggagcttccaagcccacacatgacctcactccttaaccaatgccagttgcagagtatgagagcccagctccctggctcgaatcaggacaaccttgcaggataaaacacagtgctgttttctcatcagataagttgtggaaaagcaaactactggtattgcaagacaacaatgtttattgcagctctagttacctgcaacatgaaaaaaacgtaaaagggccaatatttcatataaacaggactttgtcagccatagaaaaggttgtatcctaacacagcaaatctgatgtttttttttaataaaagacga

SEQ ID NO: 1995 - DNA, 824 bp, Homo sapiens
  misc_feature (1)...(824): n = A,T,C or G
acttcttcttaaaccacacattatggttacttggtctttgtcaaaaatgccaagatcacataaaagggaaagaacattttcttcaataaatggtgttatggctgctctgcctatggagtaaccataatttattcttttatttacctaataaaattgccgtcactttgctctatagactcaccccaaattatttcttgcatgaggtccatcttataaaaaataaaaataaaaaaaatagtgttaggaaaactggatatccaatgcagaagaatgaaatttgaccattttctcacatcatatacaaaaatcaacttgaagtggaagaaagacttgtatgtaagacctaaaactataaaactgtcaaaagaaacataggaaaaaagcttcttgacattggtctgggcaatgattttgtggatatgaccccaaaagctcaggcaacaaaagcaaaaatagacaaatgagactgcctcaaactgaaaagcttctgctcagcaaagaagaaacccatanggaaagagataatctacagaatgaaaggatatatttgccaacctacatctgggaagggggttacactcaaaatatttaaggagctcatncatttcaataccagaaaataacagttttaaaaattggccaatgagctgaataactgggatgccgccgtttcctttaatgagggttaatcatgaatctcgcttactgactccttggcttgggcgttcggtgcggcgaagcggttaactacttaaagcggtattcggtatcccaaaatcagggatacccagaaaaactgtaccaaggcacaaaggcccaaccga

SEQ ID NO: 1996 - DNA, 548 bp, Homo sapiens
  misc_feature (1)...(548): n = A,T,C or G
gtatgctgcaacgactctcttaacctccacggctacactcttctgcctgaacattccaaagagcagcatgcataggagaaagccgccagatagcgtgaagatgtttatctttttcacctatgccagaattgtttggcagtaatagatgaaaagaatcatatgtccatgaacccctaagcaatatcccatattatctgggaaacacctccacaaagatactgatgagcctatttttnaagacaagttctagaatatgttacttgttgggagaggaagctcatatgcaacagtgaacatagaagagttggaggaggacccagagaatcaacacggccatcattcctccctagcgctgtccaggatggagtccaaccaaacaagccctgctgatgctacctgaatcctgtcatcagcccgctcctttcccatgcaggacatgaagatcactagctctcagcctgggactgtggaagtggctgtgtgaactccttcactttgaagtacatgagtaaaaatttatatagaaacaaaagtgtaataaagcagga

SEQ ID NO: 1997 - DNA, 709 bp, Homo sapiens
  misc_feature (1)...(709): n = A,T,C or G
atttattgttcctggtgttttcagacttcacagtgatgaactcagatgtggatccttatttcctgtgccaggatgtttcatcttgaagactgttgtagctgtttttagagcctcacgtcagatgccttcagcccacctctcgtaccagcgccaacagttcctaagcaccctgacagcataccatctcagtcttttgctgcatctcttttcacagccaaagaagattgtacagctcctatacaggcagccatgaagtgcagggaagtccatgcctccaggcaaatccttaaccagtgggataatttaatacctcagcttcttggtttttgttgagaaaattccaagaggcattccacataccacctcagatttattgagcactcattgcccataggaataagcagttcaataagggtcctgctattgtcttctttttaactacctataactcttgctcactcattactggtgatctgtgataatcacctcccaaattaactaactatgcccaaatccttatttcagctttgttgttaggggctcaagatgcttcaaaattctaaacttttttttttctaaatatcatctatactcttgttcaatatgtgatcatgattgtgttgataataggatgatgtttgttctgggacaaagccattgaaatgtgctatagataaacccnactagaaataaaaaatgttcctccagg

SEQ ID NO: 1998 - DNA, 653 bp, Homo sapiens
  misc_feature (1)...(653): n = A,T,C or G
cttgcagcgattgctcacatgaactgatctgataccaagtggaagtgacctgctctcaggctcagcacttaaagaagcttctgatgaacacatccctgccaataagaagttccagaaggaattaaaaccaaaacttaaatgttgaaaagaaagagatcatcagtagccaccaaagaagttcatccatgttttcccatatgacatccagtgaaaacatagctgcaacatcagagatcaccatttgaaaatccaagaaaatgagtttgctctaagtcaacgaaattggtttctttgaatcaatactggccaaccctttccaatattcctaagacccatgatacacataccaaaaaaaaaaaggtgtgttgaaggtgtccagagtggcatgggtctggttcacagcagaactaccaccccccgatgtggcagagagcaagatatacactttctataactctaaagaataatcaagggagtcacagtgaatcacaagactgcaaattcctcgagaggtacatgaagcagtggaaatatgtttgcactggagtcaaacagccatggcctcggccgtccccttcttnattttccagctctgtgaccttgcgaagttacttaattttaaatgaaataatgtaataaagcacgatcggcca

SEQ ID NO: 1999 - DNA, 218 bp, Homo sapiens
acgcagctggcagagaagagagaagcagctgaacattggaactacagctggacattggagagaagcagcttaacttcagagggacaggatgacagtgaaactttggaggagaatctggctggagacggcaggacttcgggggaagattacctactaccccctccccttttcagctccccttcccactgagagccacattcactggcaataaaccctga

SEQ ID NO: 2000 - DNA, 861 bp, Homo sapiens
  misc_feature (1)...(861): n = A,T,C or G
ggctagctgcaacgactctcttaatttttcaccgctacacgttaaagaaacccattgtgacctaccaactgatgataacgaaacctttcacaaactagaacccagagattgggtctcttagaaatgacatcagagagactgccttgaactccattggaagggacctttccaggatttttcgtagaagtttagggtctggagtcttggatccacaagtctcaactcaaaagancnttttatattcctggaactgttcatctgttggagactttcaggtaaagactattaagaaagtttttcccaaaaacagagatgtcatactagacagggatagcttttccaagatcctggatcaagactggtctgtcatcataaaagtcttttatttttacctttaattcctatttcctgttgcccttatcactaaccttttcttgcagaaaaatctctgggaccataatctgtggaaggctttatcaagaaaccagagactgcttcttgctctcctaccaccactagaaatagtaccttgacatttccaattaataacctaatcactaccaaatatagaaaacctattccaagtagtgccctggcaaatggacaatatattggactttttatcatctagacctcaaaacttggggactacctgagacttgctatttggcctggctcatttctgcattttgaaccgcttttcctgcaagtccaatataccttccataatcacggttattacaggcttttaccaatatagtaccaatctcaaggagattgagattttaattccaactgagaaagaattcagggggcctctgggggctacctttggcggatggaaacctataatatggtttc

SEQ ID NO: 2001 - DNA, 803 bp, Homo sapiens
gaggtccccgcggcgggggtggcagcgccatgcactcgatgatagggagctctccgcgcgatccggctttatttgatattaaggatcacggtttgccataaaatggcctgacttgaagaagtgttcatctttgtagtaaaactggtaatgaaagtcgtagtaactttgaaagtcacaaaaaaaaaaacataaaaatgagtaaactttttagaagagtcaagctagctattcaccattcagaatgcctgcaaaccaaaatttagctgctcccactttttattatgtcctcctttcacctcaaaattttaaaaatgtattaagtggcgttgtctagagaaacaccttaagctttctgtagtagtaataaaaggggaaagataaatgcatcgttcagttttgttcaacaccttacacatgcccttaacatggacaaaaaggggatctcaagctgcataatattccattaagcgtttttgttgaacaccagtgttttcattcactttttggagagtgtcttctacttgcctgaaacacttgggagggtttcattggcacagaatcccggatatttctaatttacgaatcatcttgaagatccatattattagatatccactttttgctattaggctacctaatatagcctaactggaatttgttcttagtggaaactaaaattcacttctacttttgagatggtactaaattttgagttatagacgtgcttatattggcgattttgaaggacgttttggatattgtttgatagatggttcaatatcagttatgaagccagcgcaatc

SEQ ID NO: 2002 - DNA, 783 bp, Homo sapiens
tggccggcatctttctttatttttccaaatatttttcatcgacacttggttgaattcatggatgtggaacctatggatacaaagggccaattgtacaagattcattttgtgtcattatttgggctctgcccatgatattgctactactttttaaaaaaatttatgaattcccttctggaagacgaggtagaaagtagacaggcgattttgctaagcagttttgacatctctcacacacacctattttggctaaccttttcctgatctctcagtcctcagtagcccctctgtgcacgtgcccagatgtcacatttcctaacttattttctatttcttgaggataatttagtcacttttttctctacagtaagcagagaagggagagctggaaaatggggtctttatcagagctcaacctcgactatgaatagaattctcgcaggcaccgaccaatgagctgtcttttaggtcagtccagaaggactcagattcacaccaaacttacgtggctggtgaatgaggctcagattgtcctcccagtttcccactgccatccccaatcctgctccaagagcgccctctgctggaatggagcaggagccaacatcctcagccatcttggaagtggggccaactggaactcaggatagacgacctctctagtttttccccagttaaaaaatccaagacttgggttccttctttcaagaggagtaatgtaaaaagtctgacccctagtggtcatcgtctctgcattggacctgtagcggtggttattagaga

SEQ ID NO: 2003 - DNA, 777 bp, Homo sapiens
atcattattgttgtcttttatgcaattttctttcattatcaatcactcctctttcagtccctcttctcttttattaatttgtggatatgaacccattgaccaccttcgatgggactcacattgggattgactgtgcttactgagctcgcagctttcatcccctcacgggacggggagcatgcgggtgagtgggtacagggactgggacaaagtgcttctgggcatccgcaggactaaaatcctgtgcggtccaccggaaactccctggggggtgggggggaggggtgccccctccttgtcaaatcgcaagggggttcttcatgccggggttacgctcaccaaaactcaaaaaaatagatcgcgcagaaaagaatcctcaaaaattttataaactgatcacccctacccctctctacttttacccccgccggctctcgtcgtcaccctgaatttcgcccactgtgatcaaatgtgtgcttatgtgtgatgttcataaaaacgaaaatattaatgtatattagtttacaacagctatcatattacaagatgggttctgaagatcatcactgatctgttatcatccacggtttgtctgactaacatattgttataagaagatctctttcaataaggccacgaatcttctacatccccaacctctcttgttttctacattgtattacgattagatttctatgtaacatcaacccctcccggcaagcccgagacaagtgtaacgcgtctcacaatcacaactacatcgagagaccagaaata

SEQ ID NO: 2004 - DNA, 316 bp, Homo sapiens
aagagcgacactgaagagcctgagagcatcggcgtctgtgcagatcacggctttcgtgggacaccctcacacacagctgatcaccaaaaagtgtgaagttcacaacactcttagaacaaccctacagtgatcagaaaatttgaattgtcaacttataatgagcctaaacaatattgtaatgtgaaataaaacatagtgtaagaactaattgtgttttagggttaggctaagaaactactatttctccttgtactggtttctacattcaaaataaatgaaaaccagttttgcggtttcatgtacaaaaaaaaaaaaa

SEQ ID NO: 2005 - DNA, 895 bp, Homo sapiens
aacaaccccagtgttgttctggacaagaatatgctcactttcaaatcatggattactctatgacaataaaaaaaattctggtttgcagtttgccagcctctcttgccccagggaacatgcataagtcacagtcttgccccataagactaagctgaactctgtgagcactgccctcctttatgtttttgttagtcctgctctaaatgtggctgtgatggctagagctgcaacattcattttacaaccatgttcctgcacgcagaagagtgaaggcaatatgctaaagactgaaaataaagaaaggatctggacttcaaagatgtcatcaacagctgccaacctttaaatattcgatatgaaaaaaattcttatttaaggcacttgttagttcggtttttgaggcaacttactattgaattcaatctcaacaaatgattataaacaatcccagtagacacacatctacatgagaaagggggttagggttgagttgtagagagagaaatgcaaggctaaagagcaagagaatacttccttctgtgatcatacttttggacaaggttgcacttctgtgtgacatctaaactgtaggtgtcataccaaggccgtacatggtttctaaaggccagctaatgaagcagccataaacatcacttatctagcacacagaattgatgctttatccgtttgaccatatgtgactgggcacatgtgttggtgtgcatttttacacaaagctttgtataggccaagacctgggctacaagtaagacatttgggttctatctctggctattccacttactagatgaatatattactcaggataggctagattgtgctgcaataaaacaataagtgttaaaaataaataaaataacacgtatcggcaagc

SEQ ID NO: 2006 - DNA, 293 bp, Homo sapiens
aagcagggctcaatcactcttgacacaggttccagttttacaccacatccaagcggctcaagccagtggacggaaacgagaactcagagtcatctctcctgcttagccgacttgactctctgctttcctgctgcttcctgatcttcccagctactcgggaggctgaggcgggagaatggcgtgaaccggggaggtggatcttgcagtgagctgagatcacggcactgcactccagcttgggcgacagagcgagacgccgcctcaaataaataaataaataccgttccggcagc

SEQ ID NO: 2007 - DNA, 306 bp, Homo sapiens
  misc_feature (1)...(306): n = A,T,C or G
acaccatttaccaaatgggatgcgaacagtgtgatttaagcaacattggagtcatctctaatgtaaaagacagatgtttgcctccatgcgtgcacagaaaagcagacatacacatgagccaccttcaaccatgcagacaaggaccatgcccaaggtgacgtctgagcaacagnctggaaggaaaaagatggaatgattacacagggcaaagccagcctgccanacggngcctgtnaccangggaccganncatgacntgngaggctgatcttatnnnncccntngnatnntgnnagngttttntgt

SEQ ID NO: 2008 - DNA, 432 bp, Homo sapiens
cttaggtctgctggattttgctgggtgtccactccagcagctgtttgcctgggtatcaccagcagaggctgcagaacagcaaagatggctgcctgttccttcctctggaagcttcatcccagaggagcacccgccagatgccagtggaatctctcctgcgtgaggtgtctgtcaacccttggaagcactggggtcagggacccatttgaggaggaatctagagaggcagtctgtctacagcggttttgtcaaaactccttattgtttaactaagaaaaaaaaatcccccaaacagtttctgacttttatttccttggttcatcttcctctcattgtatcacagggctacttggttgtatttcagtattcaatttatgtatttcatattctgctgaatgcatagaatataaattaaaaattctttttctcaaa

SEQ ID NO: 2009 - DNA, 784 bp, Homo sapiens
  misc_feature (1)...(784): n = A,T,C or G
gaagttagaagaagaaaacgcctgcagaccagtggctaaagaaacagcaagaggaagctagtcggcttttaccccaattagtcatctgacctctgcctgggcttggtgaatttaggaaaacaatcaggttctattaaaatagcccttgtaactctctaggatgacggtgattttccaattttgtttcagctgtggaaacactatttgtattagtttgctggggctgccataaggaaataccacagactgggtggcttaaacaacagacattcattttctcacaattctagaggcttccagtctgaactcaaggtgtcagcaagtgtgtctgaattctaatctccccttcttataaggacaccagttatgttggattagggcccaccataatgacctcattctaccttacatacctctttcaaggctctctctccatatacagtcatagtctgaggtagaggggttaggacttcgatatgtaggtttttgcaggacacaatttggcccgccccttcttgtgaagaaactcacatacaaaactgaaaataaacctcaactgaaacacagtttgaaaagtacaagaagattggggaaaagtctggggatttcagaatgggaatatacctgaagttcaaatctcaactggggngactcatggttttgaggcattggtcaagtnattgtaaaccggttaaggcttcccttttttccttttctttctccagtttccggattaatggaaaaatcccataacataccctggcctaccttaaatttattatct

SEQ ID NO: 2010 - DNA, 369 bp, Homo sapiens
aggcagagtgacagcaagattgaaaggtccaagaagctaggaattcaaaacctctcagcagagaaggccgtgggaccactttgcataagctgagtcatctcccatcaccttgacaggagcaagaaccatccaccacccactaattatttggtgaggacttatctgcctcagcaaccagcaccttgactagcgattgccctcctgggaacgcctcatgtttgattttcgcttgttgatacctttgagacactcaaaagcccacacaatgtttccaggtaaccctgggcaacttaagtattgaaatgaatcagaaaagccctgtatctatgtgtgagatgaggctaataaaaaacttgaatacctccgaaa

SEQ ID NO: 2011 - DNA, 587 bp, Homo sapiens
ctttcagtctcccaggggaagaagagtgagagctgaagttaagtgggagaacagaaatccaggccaccagcctccatggcacctgatgaggatgcagacctgctctcagctctgcctactgaacatttaactgccgtttgcatccaaacagggagctcagaggaagcctccagctctttgcattccccactttcattcatctttcaggaagtcctaacagacacagagtcttgatgggggcctggagggagccctccatggacccaacaactgtgaacttttccctggctggcttcctaacgaatctgcttcctcaatactcagccacagccaagaatatgagaaagaaccggcatcttgaaattaacagagaattttccccttttgtttcttatctgaattgcttggagtgctttacaaattaaagtcaatatcgtggtgtacaacagaaacacatacaggatctaaaaagctacaaactggctgagggtctttctctccagaaatgaggaagaatgtgaggagaaaaaacaccttagaactttgattcaataaaatatctaaccatcaaaacaaaaaaaaaaaaa

SEQ ID NO: 2012 - DNA, 666 bp, Homo sapiens
ctctcttaataatccaccgctcagtctcccagggaagaagagtgagagctgaagttaagtgggagaacagaaatccaggccaccagcctccatggcacctgatgaagatgcagacctgctctcagctctgcctactgaacctttaactgccgtttgcatccaaacagggagctcagaggaagcctccagctctttgcattccccactttcattcatctttcaggaagtcctaacagacacagagtcctgatgggggcctggagagagtcctgatgggggcctggagggagccctccatggacccaacaactgtgagcttttccctggctggcttcctaacgaatctgcttcctcaatactcagccacagccaagaatatgagaaagaaccggcatcttgaaattaacagagaattttccccttttgtttcttatctgaattgcttagagtgctttacaaattaaagtcaatatcgtggtatacaacagaaacacatacagggatctaaaaagctacaaactgggctgagggtctttctctccagaaatgaggaaaactgtgaggagaaaaaacaccttaaaactttgattcaataaaatatctaaccattccaatagtatttctatcataaatttaaaaaatagaaggtctgaaaataacagcgat

SEQ ID NO: 2013 - DNA, 1209 bp, Homo sapiens
agaaattaaggcacagagaagtaaaatatcctacctcatgtcacaagctgctatatttggagtcaatattcaaactcagtggcactgactttataattttgctactaaatagttacagtgctgtattgacaagtaaagcaactgtcaggtgctgaaatgtaggagcaagagcaatacataacatgtgttctaccttcaagaaactaataagaatttctgcctcaggccattagagaaaaactggtttgggacttgtcctttgccataaaatgaaagaaaaaaggaaaactggacaaaatatatcaaacaactaatttcataccttggacaacaggaaggttgttgttggacaacaggaagccaaagtggaaagaacttgttgggtatatagtaaattgaacagagaccctagaagggccttggtgtaatagtaaggctaaactagccctagaatcaagattattttagactcactctggtaaaacttaaaaacaagacttgaaaggatcaagtacatctagagctgccaaaacaatagccaacactttttaaaggaaaaaaagacaatctagacagacactcaacatgtaaaatttattatatctatcattcaatcaaaaattactagacatgtaaagaagcaagaaaatatgacccacaactagaacacccactgaagagaagcagacctagaaatgatagtgatgatgaaatttgtagacaggcactataagcaactattatacatatattcaaggatttaagagaaatcagaaacataatgaaaagagatatggaaactatagaaaaggaatcaaatgtaattctataactgaaaaatacaatatatgaaataaaaaaattcaccttatgggctcaacagtagattagatactgccaaataaaagatacatgaactcgaaaagatagtgatagaagcaattcaaactgaagataaaatgaggctgacacataaaaaggctcttgtaaaaataagaacagagtctcatttttaaataagaataaacagagtctccatgacctgtgggacaacatcaagcagactaacatatatgtaaatggagtcccagaaaatgtcagggtaatggcaaaaaaacctgaggaacccatgactacaatttttcctaaatgtaataacaactataaactgacatttccaagaaacacaataaaacccggtcgcccgag

SEQ ID NO: 2014 - DNA, 805 bp, Homo sapiens
  misc_feature (1)...(805): n = A,T,C or G
tctctaactatcaccgctacagagaaatcttggcgccctgagttgacatctttgctggagactgacagctggaatgagatgttcaagtgaagaagatgaagagaaacacgtctctttaagcatatagagaatgaaaggaacctgcctagatggctcatagtgagccctctgtttatgcttgcagaaaaaagaaagantgatnaataaacagaaaanaaatgagaagaantcaaggaaaaaaggaagaaggaaannagaaagatcagcgngatataactaagaaggaatattattaatgccaaaacgcnattcgcnggagaaaacagaacncaacttcncttcggtatttcatncgctccgcgcctgaatttattaaggccaattatgtgcttcaattgcgacacatccgtctataagggggcatcccgttcgcacatggttatttctttcttctcatgatcctgtaatttgctgaatgatagttcttcgggagttatggcataaaataatggttttgctcaatcgagtaggggtccgttgcgctcggagtttatgagttggaaacacggttaattctattcaatttctattagtactcacgtgtatatgagaaatggtgggtccgtcgtaggtattttagtagtaattcggtgcgcccgccaccgtcatcgcttcgtctctccaccttgcgtacattgtcgtcattgttccgccggatttgccgtcagtatagtatgagttaccgctgtcattaatttagcgcgctggagttatactctctcgcgcgactattgtcattgctcag

SEQ ID NO: 2015 - DNA, 793 bp, Homo sapiens
aggccttttccactatgtgctcaatctcagagtcataccatgtgatgtggtctccatcggcatatgaatgggctgccattggctgtcttggcaccatgcaagaagtgcctttcacctcccgccgtgattctgaggcctccccagccatgtggaactaactctcaactgttggataaaaagataaagagaagaaaaggatcttcagtgggttcatcagtagacaacacaaagtccagtctgaccagcttttctggatctcattcttcactcctattgaagctcggaaaataatacgccaaagtgaagatctaagaagcagcctcagaagcaaagtttctctctggccttctcctgccctcctgtttgtcacccctcatctcccgaggctagccataaaaagtagaaactctctttcccaaggctggtaatagaaaccagagccctttctctccaaagccagccataaaaacctataaacattacttgaactttcccttacctttgtgtgtaagaactgaactggccataaagaaattctctgacctgccttgtttgattgtagatactaagacccccattccaaaaagagctctgccacatacccaagaggaaggaatggtgcctggagaggccaagaagtatctgaccagaaaggccttgctgggtttcccctactcagaatattagcattagatgatgccctttttgtctaatcacatttctgcacagctgcccattcctcatggaatgtaagcataaaaatggatagttttttccatgtctttgggctatc

SEQ ID NO: 2016 - DNA, 520 bp, Homo sapiens
  misc_feature (1)...(520): n = A,T,C or G
ctgtgaagtaccatcatttacatttaactgtcatgtcaatgaaaaatgaagatgaggccagaagaactgaatctagtcccagctttgctgtgtgatctgggtataaacggtgtgcttccctatcctcctactctcctctgaggaccaccatcacccccaggctgaagaggaagacttagccccacccatcacataaccccctcatcctggccaaagctgactggagcaagggtggtctcctgacccaagtggagccaatccaatcctccttcccagatatcntcgcctcagaatcaggcagacaccaatgtggtgtagggcactggagntgggaataatttggtgngagatgccttcatntaccatttngcccaaaagagaagaccntcattnttgcccctcatgttccataaaatatctcccatgaatcnttccaataagtccccatttgcnttaaccaatgtatttaattttgctggggaaggggaagggacttttaacataaacgtgatgccgccgg

SEQ ID NO: 2017 - DNA, 622 bp, Homo sapiens
  misc_feature (1)...(622): n = A,T,C or G
ctctctttggtgacttcctgaagcttgaagtatcttccttgggagacgtattatagaatttgaaatcccactggccagatctcagcatgtagtttcatcccaactctacagaagtctggaaaatacagagagaacatgctctttccctaggaagaagagatgagagctccatctctctgctggtggaaggagaggttgtctttcccttcccataanggcaagaagagnttgcctccacatcctccttctgctgtagctgaagagccctgtttnaagggacctcctgaggggggtcagcgctttggaccccaaaaaacatgggtttggcctgcctcctggaggtaattatgggagcctggggaggtggttgggcgccacacccacccgcttgggtgggaaagaaggaaagagctgcccggaaaacaaccccggaggccgcatattggctcagatttgaacccagggggacacccgcgtttgtttgggtggtgggtgttttcttatatgtgggaacggggcgtgggcactggattttagcgggggtgttgggtggagcgtggggaatgtattgcgctgaaagacgcagacctgtgggggcgtgggtatatgaacgactgcggaa

SEQ ID NO: 2018 - DNA, 223 bp, Homo sapiens
tttcgacaggactaacatgcttaatactgaacaaaagaagagtaactgtaagaatcgccctgggaatgcctaatccaagcaactctgcaggcaggtgggagaaaggacataaagccatccacgtgattttaaaacaatttatttgagcagttcttatgcaatgacataatgatagatgctaacaatgaaaaataaatgcaccatggctgtaaaaaaaaaaaaa

SEQ ID NO: 2019 - DNA, 886 bp, Homo sapiens
  misc_feature (1)...(886): n = A,T,C or G
ctctctaataaccaccgctacagaaatacagatctatggggtgaagcactctagcaaccatctcaagcggactggcgggggaaaaacaagaaaatcagcctgacatccctgagacactggactgcttacttcggaatttttggctttgaaggagaaacacaacacctatcttgcttaaaccactgttcctagcattatctggtctcattcaactgaataactttcatgttctgtagcaagtccaaggtcccatggctataaactaatgtagctttttctgattccacattctataaagaatgctaagagcagatatcttcaacattaattcanctagccagagtaatatgnaagggctaacttccanggactanaatgatctcattaggcccatctggtcctgagccacaaaaatagcttgtcgacagcacagatcagagacagccagcaggcactcatctagcactaaggacagccgaccattaacaaatattgcattgtctagagaccaaggacagaaaatgtcaccgctaccaagcagtggatagtctatgttcgtgggtatttccaataaatagataggcaaagaatttctattattgggataagtgccacaaaatctgttactatgacagcagaaaatgggagggcctttgacggtgttttggttttataaagctttagagagaacatgtcacatgtgctgacttctaaaagatgagtatggactagccaggcaactgggcatgagaaaacggaagattttaagcttcatgaagaagagaactttgtcttaatgactgcnagatccaaggaggaaagagcagatcccagcattttgaaacaccgaagtaganccnngagngnaggctgcggttccgacaag

SEQ ID NO: 2020 - DNA, 909 bp, Homo sapiens
  misc_feature (1)...(909): n = A,T,C or G
caaaccttctggagtctgaaccagcaacgtagcacacaatatactacaaaactccttctcatgtcctctcactccagcacttccattctccccaccaatggccctatttgtttactgccatgttgctgttgcgtttcacaaggttgctgatttcttctccaaagatttgtttcccgggggcctcccagtgttgtagaacctacagngtatgacttggaggagtcaatgagatttcctctccattctaatcacatataagtctcgcttgttgcccaggctggaatgcagtgcagtgggtgtgatctcggctcactgaaaacctccggcaacctccggctcccgagttcaaagcaattctcgtgtctcaacctcctgagtaagctgggactacaggtgcacactactactcctggataattttttcttggggggccaaatgggctcgaacctcctgacctcaaataatccaccagccctcggccttctgaagtccgggggaactccgggcggtgagccccatgccttggcctgttttctcttttcattcctttaaacatgtatgaagtaactttgaactggaaagcacttccattttaaataaaaatgaagtaatttgagggattaataatctcacgtaacaatcttgagtgatgagaattgacagaattcattgttttgtttttcagttacaaccaataaaaatgtggatcgttaagttcatgtgctcttggggcctacttatgggcttgagctccatcgtttacattaatgtctcaattaaataatttcccataacttttttttacatatttctccatatgacaataacacaaataaaaagcgttcgcgcccaaaagttttttttttttttttttcttgtactttcttaatagtaacctcttctgtccg

SEQ ID NO: 2021 - DNA, 576 bp, Homo sapiens
  misc_feature (1)...(576): n = A,T,C or G
aaaccatggcaaatagaagcttacacatttggcaaaggagcctgtcatcactatctctcaagattggatgcatgcagaagaattttatcagcttctcaaggcaggacattccacagaacactctacctttctgactttctaccttcatattccaatgtcttaactacatactttttttcccaaaataatggtacccaaactttaatgagcattaaaatcattcactgtgttcattaaaattagtatttccaagctcaatctgaaaaaaaaaaatattgtaatggacctggggctggacctaggaacctacatttttaacaattatttngaggtgattctttttgctttggtccacaaataaaangccccccntttttttttattaactgactttaaaggcttttttaactattaatccaggcatttgaagacctaaaatgatgccaagatgcattaacattcaatttatttcagtttctcccttttcctcctggtcaagaatatgcataagactgaaagaactgagaatctgccttcattgattagaactgtcttggctctaaataacatcatcct

SEQ ID NO: 2022 - DNA, 538 bp, Homo sapiens
tgaagaaagtataaagcactgcagagaaaggggtgaaaaatcaattatggatacacaatgtattggcaggcttaaagggagtaagagacttgaattaggagattacagtatggtggtgtagacaaaggatttggaacaggagacctgaaattcaatacacattccatgctttgcaacttcgagatcttgggtggtgctgaaaaccgttcccagtgtctttgtcatctgtgacacaggactaataatgtggacaaggaacacttgttttaaaaattcaaccaaataataattattgaaaagtcagcacagtgcctggctcacagttagcagccaataccctgactgcagtcatgaatgaggatgtccttgttcttggaaaagctggacattcaccaagtactctatatctcaaagtcatccaaccacaaatgctggacttctctcatgaagccactggattctgctaacctaaagatagtcttttcccaaactttgaatattatagacctcaataataaaaatcgagtctgccctgaag

SEQ ID NO: 2023 - DNA, 781 bp, Homo sapiens
  misc_feature (1)...(781): n = A,T,C or G
aaattcaatttggacctggaccagcgagccagcaagatgtcttgtctctccttcagccagtgtcaactttgtcacccgaaagagctcaacttgagctggaatagccactttgaatatgggtatgacacatgaatggaaagttggtgttggctatcagccaggagcttagactgagcagttccccatgagcctgcattcttctccatatgaatctatcctcagtattaattgggcttcgtcacagaatggtaggtgtgttcaatataagattatttaagaagatatcttagtttgttcctgctctgataacaaaatatcacagactagataattgttcctgctccgataacaaaatatcacagactggataattttaaagaatagaaatttattttctcctagttctggaggatgggaagtccaagatcaagcttccagcaaattcagtgtctgatgaggactgttctctgcttccaatatgccacttcttgctggggcctcacatgggtgaaagtgggaagagcaaaagggccaaaaagacctagtcagttccctccaattccttggtttaaggcacccaanttccattcttgaggactctgccctcaggacttaatacacttctaaagacccattgttgaatggtatcatattggaattaattaaccctaggaattctggagaaacacctattgggcaaacgatagccgaaaccacaggagaccacacctttcaagtttgggttgaatacagagaaatttaaagactcacccttgattgg

SEQ ID NO: 2024 - DNA, 774 bp, Homo sapiens
  misc_feature (1)...(774): n = A,T,C or G
agcccatcagcccaaaacagagttgctcaactgccctgtgagtgatgccacagttacagctgaatgtctttgggcccggtcagctgtaattccagatcacatggaagactcagagcagccaacccacatgaaagtcatctgtaaactgtatcccattaaaaaagctaatctggtgtttgctttaaaacacctaagcaagacagctgggctgaccacaacagtggattcaggttcaaaactggactgacatgacaccttggccccagttaaggctgggctcatttcggcttacaagcacgagagatatgtaagggaggactaatgcccagcagggcaggttcagctactccagcgtcacctgttccccatagaatcaatacattaacattccagatctttttgagtaaggaaattctggctgcaacacagtttgccacctcttttcctgactgggtcgttgggcttattcttagttaaatgccataaaagcgtaaccattggctttggcactacaaacgtggtttgaattgtggctaaacagactggngattgcattggaaaggctttcccctaataaagatataatccttagtccatagtttagaaaaaaaaggggcgggtgtagtgatattgagtttgcggccgcaagcactgaatgtttaatgattgggtttgccccgggggggcgcttttctttgggggggggaaggtggtatccttttaatatgcctagggcatctcgcgtttggggggggaggcgttaactgtttcaaa

SEQ ID NO: 2025 - DNA, 687 bp, Homo sapiens
ttcctagttattcaccttggaagagtggatgaaaatttcctggctaaccattaccaaaaatataatctccctgaggaggtggactgttcacagtaacgttttccatcttagaggctcctggaaaatcctaatacggaagcattagagtcaacaatatgaacaaacactgtgttgaagaacatgtgcctttagtttccatttcccatttggacaaactttgctctgtaaatttttatttcatttctcctttaagtccatgttgctgatgattaacatttcttgaatattagcctgtaggttttgaagattattcagcacttaattaatcttttgaaatcattctcacatatctctcctagctctgacctcttttaagaggacgatttttacagcaattggaagaaagtgtattaactcaattaacaattgaacaagcaaagtcctctgctctttgcctcagtacacttaggcaaaaggcaataaattcacacttcatcctctgcctgtcagcaagtgtcaggatgaaatgctcatgtatgagagcaacataaaaatatctggagttgaatttaaagaggaagtttcaaatgcaaagaaaatgcaatgaactatttttaaaatttaacattagccaaatttggtacagagtcggccgaagtttgcttttatttaatttttggaaaataa

SEQ ID NO: 2026 - DNA, 441 bp, Homo sapiens
  misc_feature (1)...(441): n = A,T,C or G
aacaataccctatanagaccttggaagaagaattagaanncananagaatanaagctattgtttnatgaatagnccctgtttgcctcatacctgcacatttaaaagtgaagaccttgcacattcaagctctgaagtgctgagtcacacctgtgaaacagaagagcataccaggaaacacatgaggcccagttttgggtgaagatgactacttggggaggccaggattgtgatggctctgacatcttaaagcantaaggccttcctgcaagtggctaacacagtgattactcctaaggggtgcttctgtaaggagcatgtctcaaatgtgcaaatggggccgaaagcctttctttcaagataaatccgactggcagagaagactagaactataaatcgagagtaaactaaggttcctcatgtgtagaaccaaaaaaagccga

SEQ ID NO: 2027 - DNA, 354 bp, Homo sapiens
taccaaccaagttttcaaagttctggaggctgggatgtccaaggtgaaggtgccggcagctctgatgtctgaaggtgaacatggtgatgggagatgtagtagctgtccagacctcatgatggaagctgcattttgaggatggctaagcaacatgattgaagatgtctgagtccctgatactatggagcatcaacaacagctttggaccactaatactctcagattcatatgtcaaagagaaataaacttttatcttgtttcatttactattattttgatctttgttaacagtgaccagatttatattcaactgaataaaggtaacatctaagcagtgcctgaaataaaaccaga

SEQ ID NO: 2028 - DNA, 777 bp, Homo sapiens
  misc_feature (1)...(777): n = A,T,C or G
cagtcctgctctgtcacccaggctggagtgcaatgacacgatcttggctcactgcaaccgctgcctaccaggttcaggtgacttagaatcacaagaacacctagaatattcaaaatgctttgtttactcactggaatggaacagaaatcaaaacacggtgtgtatctcaagagcattccacaacaaagattctgcctgcaatcctccacttcaagccatgtgaagggctgtttcccctttgccttctgccatgattgtaaatttcctgaggcctccccaaaagctgagcagacgtcagcatcatacttccttaacagccgatggaattgcaaactgaagcagcattaatttcttaaaacagaaatttacacttcaataactaatgatgtttccaacattccaagacttccagcagtatagatgctatgccacaaaatcctgacattgggccgggcatggtggctcacacnctgtaatcccaagcactttgggaggccaaggcagggaggatcaccttgggtcaggagcttgagaccagcctgggcaaacatgatgggaaaccttggctctactaaaaaatacaacacttgcctgggcatgatggcaaggtgccatcatggacgcccactttcttgggggggtcaccaccgggaatctgttgaatccattagacagaggttgctggagcctatatgtgccaccgccttccaccccggtgacccataagattcttctccaccataaattacctgggcagcatatcttgccggaggtcgt

SEQ ID NO: 2029 - DNA, 612 bp, Homo sapiens
  misc_feature (1)...(612): n = A,T,C or G
tctccctctgtcacccaggctacagtgcaatggtgcaatctcggctcgctgcaacctctgtctcccggattcaagcgattatcctgcctcagcctcccaagtagctgggattacagggtaaatcgacagctttgatgaataatagacaacagaaaattggtttatattatcccactgagaagccaaagaaatcagagaatgaaagaaagctcagagagaaatttgaaaaacactttaaaactgaattttctttggtacaaaaaaagggaaaaacaaaccaaaatggcttttccatttcacttttaaaagattatttaaaactacttgaaattcagctagctatacctaccaaggaaaaagacaattaatttcttacttttctggggnagaaagggngaggaggggagtngtgtntccccctggaggcggccgttcccctttagggggggggaaattaggaaccctggtactgagtcgctgcgctggggctttggttgggggagcggtttaacttactaaaggggggaatccggtttcccaaaataagggataacccggaaaaaccgtgagcaaagggcgcaaagggccaacctgaaagggcgtgtttggttt

SEQ ID NO: 2030 - DNA, 842 bp, Homo sapiens
  misc_feature (1)...(842): n = A,T,C or G
gtatgctgcgacgactctcttaatctccaccggctcacgcccagttgctgctgctgcttctttctcaagctattcaacataaaattgtgcacattgagcagtgccttcccaactctcagctgacggagagtttttgggtgaagactcacctgctttgaggaaaccgacggaaccatgaactctttagaaaagagctaccttcagcgtgttcccctctcatcacagctcactntttntccctggagagaaatggacacagtgataatttacctgttctacctcactgttcttgcccctttaggaggaagataaatgacaagtaaaaagaacttggagngggtgcccatgtcagaccaggactccattatcagttntcaaaaaatttcaacaccctatctatatcctgtatacaaattagcttatatgtgcaaaaggggnatctggtacatatataatggataaagttcctaaacctttacatttgatttattatttgaatcctaacacccctaacagggtaggaccttattggatccattgtgcagatgtaaaatttggcaaaatgggttaagtatttgccccaagtcaccaaattttaggttatgagccacgaatcaaaccaggcagacaggcccaaagtctgggtgcttagctcaacaccaactgctcttttgattgggtgtacttgaagggcagaaaacgacccttgtgcgtctctcggctgcgccatttgtcaccattgttggtcttcgaccttaatagactgggggaaatttttttgttgaaaatgggaaacttttaagaaatgggttgcttagccaggccagaccagttcgtgtaga

SEQ ID NO: 2031 - DNA, 827 bp, Homo sapiens
agaagagaggtgacccttcttcaactctgtaggcatgccacaaattcctgtatggacccattcccatggtctatgcagatcaagaactgtgtacgaggatgcatgtagaacctccatgacatgctagagagctggcactactaagatactgctgttagggcatgtttagtggtgttacccaggaaatgtcatcgtatcaatatttctattccaagggacaatgtttttccagttcaaaaagctttgctaaagttccattatggaagagtgacactatgtatcaacaatgcacagaaggaattaggacacacagcattcatacgcaaaaaggaatgttgaagacagagggattttcatgttccccttggtgtttggactcattgatggaactgctgcggcagcatagaatacacatgccctacagggcctgcctttgagagtgtagctgttgaaacagcaaagcattttgactataatgacacatttttttcctgaatcattttgatcagaattttgttattttttaaaccaggatttggtgaagccacaggagcaaaaatttaaaatatatattttttaagtatctcagatggagctagggtcatacgatataaaattctttaaggtattctcaaagataaacagagataggtttattgatgagagacctttactgagccctctttgtttgctaatataaattgaagaaagttatgtcggccatttataacccaaatggagtccatttttctcttctttttctggggctagaagaaccaatgaattaaggccgcacaacctataaccattctgattctttggacaca

SEQ ID NO: 2032 - DNA, 825 bp, Homo sapiens
cctcctagctagcttgtcatctgaactgtttgtctcttctgaagttccggcggacgcagagtttaggatccactcttacttctccaaatcctggcaaaagacagaaatggttcagacccagagtgaagcacaaacttgtttctatgcagaccttggcatcaggaaactatcatatgacagagattatagatggctctttaacaacatgggtttgaaccacaggggtccacttacacatggatttttttaaaaaaaaaactctcagattgaaaatacagtatttgcgggatgtgaacctggtgaatgtggagtaccgactttgcctatatgtggattttcagggctgacttcaggatttgagtatgcatggattttggttatgtgcaggggtcctggaaccaatcccttgtgtatactgagggacgactatatttgccaagctataacgataagggaatggtttatgctgaccatttaaatgacccaaatatggggcacaagtgacctcatttgcatattgccctctccctatgtttaaatctcctttatttgaaggccctctcttggtttattttctagtatactttgcttcacctacattttcacaggtactattttaatttgagggtgcatttaattggaggatttgggctatatgcttgactttattaactcccttaatccttataacaacctggtgagggaagagattgtgggttttttacagaataaaaaaatgggaggctaaggccagggggggggggctatgcctgtaatcccagcctttgggagagcaaggcgggcctatccaagggccggtttggg

SEQ ID NO: 2033 - DNA, 857 bp, Homo sapiens
atcttagaggaaaagttttcaatttttcattattcggtgtgatattaactgtggatttgtcatatatggccttcattgttttgaggatcaactaatagccgggggaaggatggacatagaacctgaattttcctttgtagaggtacatactcattgccactctcagccaagacatgggcacataacccacacttcagcaaattatgtggttctttcccctgggcacattcaaggatggatatgaaacctaagccaagagaaaaaaaaaagtctaattctgagaatttcattggaatggttggaaaatagaaggtaggagtaaagctgatacaaaattggagctgctagacacaaacagaggcggcctgagaacaaagggaagaaatgacagtgagtcccctgcgtagcttccatgtctagcaacagttcaaactaatattcctctgtacttttcctgagctccttctctttcaaacaagtattatttgcatttctgtcacttgaaacaagcatattttttattgaaaaaaatctaaagtttgttgctagatatgaccttggaggctatctagacttccttctgaatttttttctactgaggaatacccattggaataaaagtacacaacctttgaggtattagatgtttctgtcaaagcaaacaactgtaagcataacatttctttgaaaacttatgatctattttaatacagcatgcacattttgcatttcatgccacaatgtggctgttgctaaatctgttcctctaataattaatataagtaattatatagggacttaattaaataaagagagatgcggccgaaattcccaaatttttaaaaaatataaattaa

SEQ ID NO: 2034 - DNA, 793 bp, Homo sapiens
  misc_feature (1)...(793): n = A,T,C or G
ccattgctgtgaattacgtgagggaaagatattgaagaggagttggacactccgagagtgcagctgttctccccctgcaccatccgtgtcctgcattctgcgagtctgtgctcattaacaatgcgctgtgaccatgtgactcagcaatcctgctgctgggtatatacccgaaagaaaggaaaaggaagccagtatattgaagaggtatctgcacccccatgtttattgcagcactgttcacaacagccaagatttggaagcaacctaagtgtccatcaacagatgaatggataaagaaaacgtggtacatatacacaatggagtactcttcagccattaaaaaaatgagattctgtcatttgcaataatatagatggaaaaggaggcccttatgtgaagcgaaataagccaggcacataaagacaaacatgnacatgttgctcacttatttgcggggatctaatgatcaaaacaatggacctctttggacatagagagggaaaggtgggtgcccagaagctgggaaggatagggggggtggaggacgggggaatgggtacgggggcagaagggcaagggttaatggacctggtatgggtgagcgacggggacctccaggggtgaggtggggggggcgtggaagaatgctacaaaaagtgggggggccagaaagttgggaggtggaagcccgcgctggggctggtatttaaaattataacgttggggctggggggggaccgggggcccgggggatgtgtggcagatcggcggggagttatgatgtggagacacg

SEQ ID NO: 2035 - DNA, 811 bp, Homo sapiens
  misc_feature (1)...(811): n = A,T,C or G
tttgtattttcctgatttttacaatgagcatgtatctttgacttccatgtgtaaagatgaaatgttttattttaaaaaagaaagaaaaggtttgagatcaaggaacagcaagcagagacaaattcccctgagaagagaaaaccaagagaggaaagaactccaaactccaccaagaagctgtggatgaagctggtagagaaaatgttaagatccacctaagaggctgagcctaaacagaagccggggtcgggcctaagcagcgctctggaagtgaaacaaagcaggagccataaaagtggtaggactcattagagcagctctgtagctgtaatttaacctgcctgtgtgtattggtatcatccaaattgcttcacactttaataaaatagaccttggacctatattaccaactgaatgtgtgaactcaagacccactccagaagggcatatgaggagtggaagagaaagacaaccaccccaaaaggtgcaatctagacaggacagccccttgttgccaggtggaaagaggccatggcaagcaagtcttcaggagtacactggtagggacccagagcacagcttcccaccccagacagaccacccagacgcatagcttcccgaaggagacccagggctgggngtggaggagactctgggaaccacctccccggccctgcaccccagggtgagatatgcatttcaatctttgcttcccagggactggaattcaatgcagggatccaacaccctaaaggtggacttgtgagggtggtatggtgggcatgaggagagaaaacagaggttggtggtt

SEQ ID NO: 2036 - DNA, 710 bp, Homo sapiens
ttgttcttcacgcagcagattgacaatcgaaaaaaagtgtttatattatgaatttccctgttatataatggaagataatttaagttactttctctgctggaatcatgaactcctgaaattcatccatgacagttgaatctactttcttccaaactactgttaatgttgatatttttacctccttctatgaatccgcaagacaaactatcgacagagtaaacaaacaatctacagaatgggagaaaatatttgcaaactattcatctgacgaaggactaatatccagcatctataaggaatttaaacaaatgtaggagaaaaaaactaacaacctcattaataaggagctgaacaaacacttttcaaaagaagacatacatgcttatgagaagcatatgaaaaaaagctaagcatcactgaccattagaggaatgcagatgaaaaccacgatgagataccatctcaaaccacccagaatggctatcattagaaagtcaaaaaataacagatgctggcgagattgtggagaaaagggaacacttacacactgtggtattattcaactactgtaaattagttcaaccagtggggaaagcagtatggcaattccccccataggctaaaaacagacctaccatttgactcagcaatcccgttaccgggtgtgtacccagaggaataaaaatcattctatgataaaaaaaaaaaaa

SEQ ID NO: 2037 - DNA, 468 bp, Homo sapiens
  misc_feature (1)...(468): n = A,T,C or G
atacagaacagagttttggaatcagagaaggagacaaatgattccaaggacgttaaaagagaagaaaagctaatgcacacaattggtgtaaattctctcccattgcaccaaaacaggaagcatgtctactattccctctctttactgtcccaagttaaatggaacaaaagaaaaacctcgccggggcgcggtggctcacaccggtaatctcaacgctttgggaggccgaggcgggaggatcacgaggtcaggagtttgaccagcctggccaacatagtgaaaccctgtctctactaaaaacacaaaaattagccaagagtggtggcacacgtctctagtaccagctactcgggaggctgaggcaggagaatcacttgaacccaggccgagatcatgccacagcactccagcctgggcaacggagcgagactctgtctnaaaacaaaaagagaaagaaaaaaaaaaaaa

SEQ ID NO: 2038 - DNA, 176 bp, Homo sapiens
gacagactgctgcaacctgaaacaagaagtatttcaggaaaatccaatcccctcttggaggacaatgaagatctttccacaaaatttagtcaataaatatttactgagttctcactgtgttcttggcataatcatcactggaaaataaaacacacagaaaatgaaaaaaaaaaaaa

SEQ ID NO: 2039 - DNA, 486 bp, Homo sapiens
agccaattcccagaaattctgcagccactttgccccacctccttgtcctgaggacctactgtttggaaggaaaaattaagacaaagagtcaatgcttgtaaccatcttctagggttactgggaggattcgttgagctcacacacatcagagttacaagagtgctgggctggtagaaagcacacatccagtgttatatgcgcacgttactctttataagcaaaccagaatttcatcacaaggcagcgttgttgcagcagaacggcccacagtctggcatcagaaagacctggaatcagttacctgctttcccctttattggccacatgaccttggaggaatgccttccccatgctgctcctcagtttccccacttataagatgggcccagtcatggtacaggactgtgctgcctccaggcaataacaaatatcaaactggtcaaacaataaatgtgaaccgttaatacacttgcaaaaaaaaaaaaa

SEQ ID NO: 2040 - DNA, 298 bp, Homo sapiens
ttgaattatctctgtgggatgacatctcagagaacccaaacatctgaaggagggagaacacaaaaatcacaagagaaacccaaaggagatctgaaaaggcgcccgcctgagacaacccacactcacataagcttccattatgcatgaagttgctgagaatcttcgcaatggctcatgggagatctatttacatggattttgttacagaagctaaccacatttcgagtcagacagagtggtgtctgatgttaaataaataaataaaaatttcccttgtgaaaaaccaaaaaaaaaaaaa

SEQ ID NO: 2041 - DNA, 334 bp, Homo sapiens
ccttagaaagatgtgattgcttccccttctgccatgatcggaagtctcctgagacatccccagccatgtggaactataaataggaaaccctgccatgttgaaaggaatacaacccaacatggagtagaaacaagaaatcaagatatacactctaggacaaggagcaataagaatttgacttaaaatggttatttagcatgtattagagttgcaactggattttatgtagttatgagggaaccctgaaaaaagtaccattgaacagaaatgagatttggtttcagaacttcagcccaaatgctattaaatcttttgcatttcttgaactataaaa

SEQ ID NO: 2042 - DNA, 1087 bp, Homo sapiens
  misc_feature (1)...(1087): n = A,T,C or G
agtgccactcctacctgagaggtttcagcctaagaatttcagatttgcctattcatgccctctaaacaaagaggtttccatgtaccaggattattattatgcagctgatcatctgtctttactcacatatcacaatgctagtaaaagtagagtggtgaagcaatactgtagcagatatgaaaaagcattgacttttcatgtaagaagatctgaatgattcacttttgaaggaaacacagagaagagacatcgaagagaaaggcaacctgaagattaagacagagattctaacaatgtgacaagaaaccaaggaagccaaggaatgccaacagccatcagaagctataggagtcagggaagaatccttccctaaattgtccttcaaaaaagtgagaaaataaatttttgttttaaaccaccaagtttgtggtaatttatcacagacactgcaaaaatgaggacgagttcttaaaaatgcgggagacatcttgcatcctttggatgtaaggaggccactctcttcagctttccagtgctggcaaaatgaactaatgatgagactatatgtggaactaaaaatatggactacttatcatcaataaactatttagctactgctgctgtaagtgcccaacctgctggtggaagagtgcatgctgagcctttcatgtggctacttgcttgaggaggctagtcagccatttagtggcatggagattatactgcagccctttgagggacaatgattaatcattaacagatatctnctctggatatgggtttaccttccttacacagaggcctnctgtacatcacctctttacttacaacatgattcctctatcactgtgcaattccatgcaatattaactcacaccaaagaacagttgggacaataggttattgacatgatatcatgtcatattaccatgaaccttggattcaaatgcacttgattatgatggatgggctaataaaggcccagataagatgccaattaaggcccacaacctgaatggtggggctttaacatacaagatggggaatttggtgaaccctgcaaagggttctactatggggtagaaat

SEQ ID NO: 2043 - DNA, 520 bp, Homo sapiens
  misc_feature (1)...(520): n = A,T,C or G
tgaggccaagaaggccatttttttgttttttttcaggatcacaataaaagtcacatttgggtttttgcttttcttttgaaggactaatacggtgtttatcaaaaaagaggcgaaaaactgctcaaataattataggcactgtaaacaaaaatggaagagatacacaatctgcatcctgcttgatgggggcaaaggagtctcttcaagtgatccataatggtacaaggaaatgtgtgaacaggcgcgttatcacatgatgcccacaagcccaggtcatagaatgacaaagtcaatgtccagaatatcaaagaaataagagagcgcaatgggccatactctatatgtatggagaacgaaagtcaagcagttgaatgtatcgcgtcgagccgctattctagcaatgtatgttgctgtattaattcccttctcgatgattgcatncttacacctaatgcccaaggtacacgagancaggcctttcctctttccgtggtatggcgagataggtatgagccagcta

SEQ ID NO: 2044 - DNA, 306 bp, Homo sapiens
cagctggcttctagctaccgtgtagtgtcgctgaatggacacttggggagagatgtacacaaccagctcttgagaataagggcaaggtgtttcccaggatcatctgaaaaaactacttgcattgaatcctgtctcaagatccatttctgctggagctcaaaccaattcaaacttctgtacacttcaatttccatcttttgcagatgtctttgagtatgaattggagtatgaatgtctattcaaacccatataactattcagtatttcccatgcttactgcaataaaggtgtgatgcttcaggaaaa

SEQ ID NO: 2045 - DNA, 663 bp, Homo sapiens
gtctggatgagtcaataccaactgctttgctgaagagcattgaccaagttattatcttcaactctctcaaagggtgaagagagaaaagcaacactgagtcaactggctggtttttcatccctttctcttcttcagttgtgggctggagagagatgtaattccaggacattggccagccttttgttatgtggatacgctttacacaactacagtttatccatcagaatgaaatacagacaaaagctgaggaaatcagtcttcttaatagatagaaagtgatcctttctgcctccaaataaaactgaattataacattcttcgtatttctctgggtacacatctggtttaaaaattagaagttaaattttaaaagtaggcagaagtttgtatttagagaaagacattttaactgtaatagtgatcattattttaatgcttataaagtccaatcaaagataaatgtcaaaccataactgaatatattgtgtgctgtgtgagagatgaaatacatagagaaaatccactttaaatggtaaaaaaaaagaaaaaatatattatggcttttttctagggaatattctgaaaagagaatggcaaagctgtgcattgaagagccaacttcaaaaaggcgaatatataggtggaatattaaaaaaaaaaaaa

SEQ ID NO: 2046 - DNA, 404 bp, Homo sapiens
cccgcgccatgacgggcgtccgattatattcagcggtcctaggaatttgagtttgagtacttctatacagtgttgtagaggagtggtgaaggtgggcatcattgtcttgttccagttctcagagctttgtagaagaggaggaagacaagagctaccatctggagagcagaacgttttgggaagccatcaaaggcaaagaacctaagaatccaggaagatcttgaactattaccctttactttaatttttaatcatggaaatatttgcttggaaaagagactgtgtctacaatggcaaccatttttatattcagaaatttgccatgtaaaataattgaatgtcagatgaagaactgcctgtcatattttgctattaaaataatatatttttatgcataacctgaa

SEQ ID NO: 2047 - DNA, 274 bp, Homo sapiens
ttctgtgacaccaaagaaagaatataagaaccctgctacatcctccttcaagatagaaagaagaaaccctaaacacagagaatgcaagaagcagaagagggccccatctttacagcgatcagctagcagagtcaaaaagcctgtgtggagttttcaacaaagcagaggtgcaattttccttggaaaaaaaaagtaacaatatggaacacttctgtctcacatgtcagaaacttgtggaaaataaaatggtgaaaagctctgaaaaaaaaaaaaa

SEQ ID NO: 2048 - DNA, 240 bp, Homo sapiens
ctgatccttcttcagaagatctcaattagatgattgttttaaaaattgtacttaaattctgcgttgaccatcagaagacaaagaaatgtttgtatgatcaccctaaaatcttctgtagtacagttagcatttacaatcaatgatttctgtttctgaaatgtgtgctagtaagtatgttactaggcaatacttgataatgttttaaaaaaatataaagtaatatatgtttcttacctctgc

SEQ ID NO: 2049 - DNA, 259 bp, Homo sapiens
  misc_feature (1)...(259): n = A,T,C or G
tttaggtattacaacccagtcttgtgnggactggaaaagcgncacctgnacccagcccactgggaatacaagaggattcagatttcagtctccaagaaaaagtggaccctcaagttcatcaagaagagagcgggaacacacatctgcaccataagaagtgagaggagctgggcaatatcttgacctccaggaagcgactggctgccaagaagaacngtgacttctccccttctgtgtataataaaacctttacggaaaa

SEQ ID NO: 2050 - DNA, 413 bp, Homo sapiens
ctggatactaagcagccacttgagtactggaacagggaccctgacccaagcccactgggaatacaagaggattcagatttcagtagtgatcccaaaggtatccctaaaaaaactgtctgcatgctaatctccatctcagattccacttgctgggaaacccaacctgtgacaataaccatgtcagatcttccacctctgtccacctgacacggaagtcaaagggcaacacaggtctccaagaaaaagtggaccctcaagttcatcaagaagagagcggggacacacatctgcaccataagaagtgagaggagctgggcaatatcttgacctccaggaagcgaatggctgccaagaagaactgagacttcttccccttctgtgtataataaaacctttacggaaaaaaaaaaaaa

SEQ ID NO: 2051 - DNA, 342 bp, Homo sapiens
attaagccctgaaatgtggcgccaccggcagcttacctttgtctactttggcgtggtgtggaaaaccgatgccagagctttaaccaagccttactccagagcacgtgtcccgccaaggcctcttcccgcacctgctgcggtgttggcactggcccccgagggcaggaggaaggaaccatcacgttgcagctccagctccagccctgctgttgttcgtgtttttccatctcccaaaaacctccagggaaatgtgacatcataacaaactgtaattggcataacaagtaatgcccccatcaataataaataaaatgatttcttttaatcccaaaaaaaaaaaaa

SEQ ID NO: 2052 - DNA, 497 bp, Homo sapiens
tttttttttttttttttaccaaaacagaaacattgtattacaattagatcacaaataccattgcacagaagccaatataaggtagatctaccctggttctttctgtccaaagaatttcattgtttgatagtcctgtaagagtttttatatagcaccgaggatatgttaaggttgccattgtggcaagggtttaaaggacatagtttactaagttatttagatgctagttatcttggtaacttcgtccatttaaaaatatttcttcattcaggatttctgttccattcctggagactggcaggaggaaaatcagcttggcagatgagaacaagcattgttgtctgccttcagagtggctggcaagagtatctcagaagcagtttctaaagaaggggatggtggcccccaaatacctctgatgaaagaatttgggacttcagtgccctcctctctttttgtcaagtaaactatatccattcttctaggtcaatacttca

SEQ ID NO: 2053 - DNA, 848 bp, Homo sapiens
cctagaactttgtgaaagacaacatgtgaaaaactccagggtaatacactggaggtgagagctatatggcccagttacccctgctgatcgagctcaaaggcagccagcctcaactgagtggtaactggccacagaaacctatgtaagaccaactgccaccagaaagtctatgcaactgagcccaccgaacttaccagccttcagaatcatgaattccataaatatttgtttttaaccatttaattgtgcaggctttgttattcaaccagagttaaccgatacacatggtatgttccctcttcacggactcttcagtgttccttacaaataattgtattattctttgctcatgagattccttcgttttgaattccctatgccttgctctaccttatatagtcttactcgtttaatctcctacagtattcttttatatctgttctttatatcttatttaatggaatatctatattgattgatttgcttataaccataacatagccacaaataataaaatcttagaaataaggaataaataagacttttaatcagatatgacataaaaatgaactggttaaaacttattttgaacactagatattgccaaacaaaaatataggtttattcaagaaagtaaatttaaaaaagggatttctttcatacatgaaatattctgcaccttggttttttactcggaaaagggtaaaaagttttacctttttttttcttgtgggggggaagaggaaggggggacttttcagtcgaagggtcttctgtaaattttatttgggggggggttattataatacaaatagacataaacccccttcccttaaaaaaggaagaag

SEQ ID NO: 2054 - DNA, 219 bp, Homo sapiens
agaaatagaaaagcaaactttaatacgagcacttttcgccagtcactgtgcctacatctctagaggaaagagcagagatgaaggatcatgcagaaagaccaactttgaagaggcctaaaaagagttcctggactcagttgctgctcgatcaggtccaagtctcaaagatctgtgatttgccctcaataaagtcagcagttgctgtttgtatgataaaaa

SEQ ID NO: 2055 - DNA, 225 bp, Homo sapiens
ctgaactgcaacatgaatcggccttatgctccctgcctccagaccctattcttctgagccgttttccttccttgttgcctgggtcttgacgagacctaaagcagccatcctagaccgaaggtggaagctgggtgcggacaatggcagagtcaaccctcgggccctggaccactttggtctgttgtgtgaaataaaagtgaacttccttctttaaaaaaaaaaaaa

SEQ ID NO: 2056 - DNA, 340 bp, Homo sapiens
attatcttaatctcatatatttattaaaaaaatattaaaaaactaggttccaatatgtcaaatgtgagggcttctactcaacttaccccccaacactcactaccttcactggccccggacaatgtcatctatgctctttgaaggatgtctgctcttctctgtctagagaattctaaatcaaaatggaacagttttataagtgacatcataaaccttaattttgaactgtgactcaaagtaaaagccaaaggagatatgactgaaatacaggtattatttctacaaagtatttccagttataagaaataaaataaaatgttaaatggcaaaaaaaaaaaaa

SEQ ID NO: 2057 - DNA, 802 bp, Homo sapiens
aaggcaagaagtgatcccagcctccagatggaaagatcaaggcccagagaaggacccccataccctgctcccagcatcgtctgcctcagctaagccatggggattgagagaatggagctaaagggcacagctcatagtcctggctgccctagccagacatctgccccactagtcctgggttgctgccccatcaacccatcccggataactcccaagatctcagcccaagccaggctgacagtgttggctttgtacttgcttcctggaacacatctggcctcagactcctgaggccaagacacactccctaccagccaccctgccatggcttgccagctctcctcacccagggacaacagtgggcatctgtccacaccaaccaggctcgtcaggtctccgggagctgcttgaatccttccacaattttgggtgtgggttttgctacccagcaagtggccaccatgaccaagcctaccacaatcatcgaaaagaatgggggacattcttccccctaattacacaccagctcttcaataacacttaatatcagctttaagttgaggggggatgttctctaaacaacaccaaagatcatgaggtcatgtcttttgagaccctggatgtgtgggatacttgttcacctggagaaatgggacggtgtaaatacccaccttgggctgtgtgtttatcgatggaaacttcataatgtacctcccccgcgggaactgagattagccctcgcactgatcgaaaatgaagatcacctagctgcacagtactggcctctactctgtcttgaggt

SEQ ID NO: 2058 - DNA, 799 bp, Homo sapiens
gttgtgagacaacttcaacaagaagcggctgacagcctaaaaaaattaactacgttagagtctccactggaagatataaacgcctcctggaaatgacaataaatatgtgaaatgtatttggaaatgaagacgttggttgccatggagacttaaaaacagatcaactgaaaatggatattctgattaagaagctaaaacagaagtttgataatcttatggcggagaaggaagctgtatcttcaaaatgtgtcaatttggctaaagagaatcaagtttttcaacaggagttatctatgaaaaaagcacaacaggaatgtgaaaaatttgaggaggataaaagatgttggaagaagaaatattaaatcttaagacacatatggaagacagtatggtagaacttagtaaactacaagaatataaatcagagctagatgaaagggcaatgcaggcagtagaaaaattagacgaaatacatttacagatcgaataagaaaatagcaatgatcagtttcagctctttatggagaaagagcaggtggaaatatttctcagcactcttcctgcaaggcgaggtcgagagtcaccttgtgttgaaaatcttactagtataggactcaacgaaatatattccccaaatgcccataaaattcctacttcaagcctcagacttcaaataattgccagaactacttgcttgaggttagttatatgacccgttctttttaggagttcatttctctagcgtaattcttggttataattggggaaatactgaattgttatgttaactttccattgg

SEQ ID NO: 2059 - DNA, 196 bp, Homo sapiens
accatgaggtacctatttccccacggagaacatatttgagacatatatgaaaatcggaggagataatgcactcgcagagaacttctaatcctgttctacaaaagtccaaagaaggagcaaataatgccaacttcacttttcttgttttcacatcaataaagacattgattttagtgtcacactaaaaaaaaaaaaa

SEQ ID NO: 2060 - DNA, 978 bp, Homo sapiens
  misc_feature (1)...(978): n = A,T,C or G
tttgaggctgctatggacactggtgttcaagactttgtgtggaaagaactaaatgcctagaagcagaattttggagttatatgcctggaccaattctaattgttactgccagtaaagtagaggcatgaacactactgccagctacaatgtccccgaaaccccccaagaactctcgccaacagtacagggggagggtccaaagctgacgagagcaacggaaaccagcaagcagcattagccacgtggagcattccccttctgaacaaagcaacatccagtatatgaagagaggttgactcaaaagatattcagaccagcctgaccaagatggtgaaaccctgtctctactaaaaatacaaaaatgagctgagcatggcggcgggcacctgtaatcccagctacttgggaggctgagggaggagaattgcttgaacccgggaggcagaggttgcagtgagccgagatcgcaccattgcactccagcctgggcaacagagcaagactccgtttcaagaaaaaaaaaagatattcagttacgtgtggacttaatgagctaaatgtacttcatatttgcccttttccttaaggaaataagtcaaacaagatgaacttaaatggataaatccaaaacatatttactgctaagacatatactaaactcttctcatgcctggactattaccataatctcctaactgatttctctatctcagtcacttcatctgcaatttattttgtattctgcccccccccaaatattcacaaagcatgatgttcttctcttcaaacacctcttattcctctgaataactagagtatgttgtttatactattcatgtggtacttaacttatactatcctgtgatttaggaatatgtatacaatttataccccctnacgnaatgtaagcactttaagagtcgccccttaaatgtttagccaaagtaagcacttaataaagaacgagtccggccggac

SEQ ID NO: 2061 - DNA, 782 bp, Homo sapiens
agctaaaagaaaagaaagaagaaaataaaaataaaagaaaggtagcttcacctccacccaaatttggaaacatctattcatgcattttacagatatatgtgtgacatacactatgtaggagaaaattcaagctgtgaaagagaaaaccagtgcaatggctgcctgcatggagattacagtgcaatgaggaaaatagatgtgaataaatgaatgcaagtgtcatcgagaggaaacccaagcagctactggaatgtagaagccatggacttcaacaagtcttgaaaatggagtgagtgagaaggaaagattcttggcggaaaaaaaaagctggagttaactgaagaagtgaaaagaacatttcaagacaaaaaaatggtaaagtaaaatgactgaggtaggaaatcgaaaaatccatttgagaaaataaaagaagccaagcattggatggatcttaaacgacaagtgagaaaaaggcacaaaacaagtctgaagagaaatacatgaagaaacctagagatcaagcaccaagtcaactgcacaagatgttataatatgttcggcttaacttggaaccattgcagtattacctcagtcaactttctttactataattgaaagtgaatgataccggctttttagctaatatcaaaaaagattcattccaatctagaagactgcctgcaagcaatgcgaacacgtgtgtctagtttcttggcagggtctcccagtttcccctgtctttttttttttcctgatcaaaatcacaaattgctttacagctt

SEQ ID NO: 2062 - DNA, 809 bp, Homo sapiens
agataaacctgttgaatcaatgcagacaaaattgaactaccttagaagaaatctactcattttagttggtattatcatcatggtttttgtctttatctgtttttgttatctccattataattgtctgagcgatgatgcgtccaaagcaggaatggtcaagaaaaaaggcatagcagccaagtcatctaaaacatcattcagtgaagccaagacagcctctcaatgcagtccagaaatacaacccatgctatctactgcagacaagtcatctgattcatcgagtccagaaagggcatccgcacaatccagcacagaaaaattaatcagaccctcaagtctacaaaagccatccataccaaacagtgcaggaaagttaactaggccatcatatccaaaaaggtcatccaagtcatcatgctcaaaaaaaattaagcaagtcatctcacctggaaaaggcacataagaaaggcagcctagaaaaattatgtaagctagactatgcgtgtaagctagccagttcagataagccagtcaggccacctcagctattcaagccactttattcatctcatccacaaaatgaaatctcaccatccaagccattcggtccacaggaattggctaagcctcccaaacattttaatcccaaaaggtcagtgaggctaggcagggcaaccttattatccaactctgaattagctgaaacttgtcaaccctacaagaaaaaacatcttgttgccaaaacttataggcccttggttcaatgatatttctgaggcaaaggagaaaaacactcaaaacctacatgt

SEQ ID NO: 2063 - DNA, 1051 bp, Homo sapiens
  misc_feature (1)...(1051): n = A,T,C or G
cttacattgggttacaagatgcttctttggctcagcagtttgttattacccaccctctgaagcctacttccgtcagttcaaccacctcagcctcagcccagttctgtgccattactagagaggtgctgcagttatttggaggagaagcacactgactttcaggccactcttccatacagctgatgcagtttgctggtggtcaggtccagaccctagttgccttagtttttcctgtacctggaagtatcactggtgaaggctgtgaaacagcaaagatggcagcttgtttcttcttctgaaagctctgtctcaaggagttctctttgtgagtgccatggactgcagctgcttctaatcagctatcccgtccccgtgaaatcttctttttaaaattggaagaatacattgcaagaaaagaagacaaaatactggggtgcaattgaaattaagaactaactatttcaggtcaaaaagttcctgtgttttcacttaggttggatattcctgctcataggtctcttacaattaagcaatcaaggattccactggggtttcaggtatcttaaggttcatttgaggaaggatttttttccaagctcagttacggtgtttgttggcaggatccaatcttttcacaggatttttgaactgaggatgtcaattccttgccagtcgtgagctgagggtctccatcagttcttttccatttgagtctgtccatagagtggttcacactggaagctgatttccatttgagcagaactgaatcaccattccactcaaaaatagaagagatttcaaaaggtgtgaatatcaagaggtaaagtcttgagctgccttctttaagggtgccttcccctcagtgaatgacatgtagtcagcacttgattaatatttgtcaaataactgaatgaagtattatattattaaaatatctgtgaataacccaatgatattttccnnnnaannnnnggtttncccnnncacannnnnntncgttccgcccaccttttttttttttttttttttcgctcccgctcgcgcgtgttct

SEQ ID NO: 2064 - DNA, 821 bp, Homo sapiens
  misc_feature (1)...(821): n = A,T,C or G
ggctgcattatgttcacatagaagaaacaaaaaatgtcagcaagtattgggatctgcagatttattttaaagactgggattctaaagatgcttcttggcagtctcctaccttgtattgttccagatgagacatctgctgttgtctttgactgctttattcagactgcttttaaatattcttgaatgttgtgctaggagagaggcacattacttggaagcagtgtgatcctttttggttctttccatagcctcaggtagtttccttagatgtctgtgccaatcaacattcaactgcagacttaaggaagactctgcaaatctcatggtctgcccctttgtacagatgttttctcgccagtattctgtgatatgaattctagctgccttagacttaccagtcacctacttttgcctcctaaactcagagataccttcatgcttcacctggattacctctgaaaagtagctcaaaagtatcttcaggctataatccagcataatcacagtgttcacttcatttgtctctcctctctaaaggaacactgttctgataaccaatatatgaaaatgtgttttaactaacttcatttcattttgtagttgtttcagtcagataggaaaatatagactctattactctatcctggcttaaaatgaaaattccccagagatggtccaattattttgaagaaattttttgttggtctttttggcagccttcctatggtttgatacttgtgtccctccaaaatcatgctgaaatgtaatctccaatgcaacattattaagaaatgagtccttangagatgattaggccaggg

SEQ ID NO: 2065 - DNA, 690 bp, Homo sapiens
  misc_feature (1)...(690): n = A,T,C or G
atattgccacagccactccaaccttcagcaaccaccatcttgatgggtcagcagccaccaacactgaagcaagactctccaccagcaaaaagattacaacctgctgaaggctcagatgattaaaattttttagcaatatttaaaaattaagatatgtgcattttttagacataatgctcttcacactttaaatagactacagaattgtataaaactctttttttttttcaaatgataacatcagtagtaaacctaacttttaaatgcaccagggtacccaaaaatgtatatgactcgctttttcatggttgtctggaactgaactcgcagtatctcctaggtgtgcctgcaattcttttgggatccattctagttgctgtatcaatacaatcacgcactgcataaccacatttcagtcaacaatggactgcataaatgatagtggtcccataagactatgttggtgaaaaattcctagcacctaaggattatcacagccttcataacacaacacattactcacgtgtttatggtgatgctggtgtaaacctactgcactgctataccgcatatgactatatgaaagtatagcacatacatatgtacagcacgtaatacttgataatggtaataaancntgatgcgcccaggngcttctttggtctggttcttaggggtgggcttctttgt

SEQ ID NO: 2066 - DNA, 1256 bp, Homo sapiens
ctgcgcgatcagattttattttattttattttattttcagttcatgggtacatgtgcagatttgctacataggtaaacttaagtcactggggcttgttgtacagattatttcgtcaccaaggtattaaacctagtacccattaattacttttcctgatcttctccttcctcaccccctccaccttctgatagtccccagtgcgtgtttttcccctctgtgtccatgtgttctcatcatttagctcccacttataagtgagaacatgcagtatttggttttctgttcctgcattggtttgctaaggataatagcctccagctccatccatgctgctgcaaaggacataatcgtgttcttttttatggctgcatagtattccatggtgtatatgtaccacatatatgtacaacattttctttatccaatctgtcactgatgggcatttaggttgattccatgtctttgctattgtgaatagcgctgcaatgaacatacacatgcatgcgtccttataatgaaacgtttcatattcctttgggtttatacccagtaatgggatcgctgggtcaagtggtatttctgtctttaggtctttgaagaattgccacacctgtcttccacaatgtttgaaataatttacattctccccaacagtgtttaaggcggtcttttttctccacaaggctctccagcatctattattttttaaatttttgataaataggcattctgactggcgtgagatggtatctcactgtggttttgatttgcacttcagtgatcagtgatattgaccttttttacatatgattattagctgcatgtatgtcttctttcgaaaagtgtctgttcatgtcgtttgcccacttattaatggggttgtttatttttttcttgtaaatttaagtttcttatagaagctgaatattagacctttgttggacacatagtttacaaaaattttcacccattctatagattgtttactctgttgatagcttcttttactgctgcagacattttcaagattttttttaagtctgccccctcaggcagcatgttaaatgtctcctctttcatcagtctgaaaatgggaaaggtaaggatgatgaaaattaggttttaggggtgagaggtcggagttattttcttttgttttgtttggactgataatatcctcctcctatcttcatataattacccctccctgaagcagaaaagtatagatgaagcttctcctctatcacgagccctg

SEQ ID NO: 2067 - DNA, 859 bp, Homo sapiens
aaaggcaaccagcgagctcgctctctttcctccatgtgaggacatagcgagaaggcagccacttgcaagacaggaagagagccctcaccagaaaccaatctaccagaccttcaccgacgagctacagcctccagaactggtctcgctctctggctcaggatggagtaaagtggagtgatcttggctcattgcaaactccaccttccgagttcaagggattctcctacatcaccctcctgagaagctgggattacaggcctgcaccaccatgacagactaattttggtattttagtagagatgggctttccccatgttggcccaggctagtctcgaactcctgaccttaagtgatctgcccactttcgcctcccaaagtgcttggattaccggtgtgagccattgcctaaaacagcctgtttttcgaagtacatttattctccttgtgcctgtcccagagcacaggtttcgctgcttggccttaatgtaatttctcttttgagcatttccgtgcacactttgactgtggccttcatccctcgtcaggtttgcaaccgcaattttcactaatccccgtgagcactttccctcacaaggaacagagagcccaggctgttaacctagtcgaggagactggaccacatgttagatatcacaggcctttgattccaagcaatacttttcagttgacagttcactgagaatttaatacatatttaacaaagatcatagagagatgtttatcctggttgccccccagaaagagtccctacatcagaaattccggctgatttcagagacgtctgtaacctgcattaaaattcagaaacgtattttcaataaagacggatcggcctgag

SEQ ID NO: 2068 - DNA, 876 bp, Homo sapiens
  misc_feature (1)...(876): n = A,T,C or G
tctctaataaccccgctacaggctgctgttcttgttgtttttacgaagacatttttctctccaaggcagggctcgagctgtgtgggccatcaatttctgccccttcatacagacaaatcagggctgcatggtggctcggccttcctctgctgggaagcagccctggctcacctcacagggtgcccatgggccggccagcagggaagggagtcctgtaggtnagacgtctgggggtgctgcccaaaaggcactgggtgcttacccttattgatattgcagagaaaaaaaatcagaatattgctaagtagtttcaagcctgtctagcagtcacagaagagaattcctgttagattttctgagctgaagtctgtattccctaagccaggccctctttccaagcctcagcccctccactgcgaaatgaaaaggcacatgccctggttgctcccactttctatcatcccatgacctcctctggactgggaatggtggaggtcgttagaagcctggaaaatccaaaagaatggaaacccccagtatattctgttcgacttagaggagaatgtgtgcatctacatactgaagccacaccatcaagaactgacccagaagcttcccccatgtctccatcctgcccccctgaaatcctgaaaatgtctctgctcacctgtctagaagaatacacatgactgtttctgcattggctgtgctcccatcccatccccgacttctctttctcatttgtctatctagttagccctgtctctgattgggagagtgatgcttggtttaacagacatctctgcaggaaaactcaagaggaaacagagaggctaatacatcaagcatgattaaaataaccaagtatgctgccag

SEQ ID NO: 2069 - DNA, 590 bp, Homo sapiens
gcagggaaacctccaggaatcgacgccgacaaaaaaaaacgcctttgcgccgcatcggggtttatttttatacatgaaaacaggtgtatcggactataagcatccattgtgagtcactttagccaggcgaatggaacacattaaccattactattattgagtggaggtagctggaatttttttattgactcatataccgtttggtcatactattgtctgtccatcacagtgtgttgtcttccagcctcttaatcattccttctcattcactgatcgtcttggtgcctgggcttacatttcttctctcttctccaaattctattatcctgagtgcctggcaagacctgtgttcagcccaaacaaacctttggttctaagcacgttggtctcatctcgaatgactttttccagtccaatacccttcaggagtccaccgcaatgctaaagtcaaggagtatgttgttcaggatggcaaggcagctctgctccacacagtcactcagagacccagcttcttttctcctgctgctctgcatccctgcatcatcagtggctgctgtttgcagctgggttgctgttaaattcagggt

SEQ ID NO: 2070 - DNA, 414 bp, Homo sapiens
ctagtcgtgactgactctcttaattttccaccgctacacagttcaagatttcaacattttaagataatctgaaaaaaattggaatgtgcccccagctgccaatactctctcaacactgtttatcaaaggaaccaatatggaaggaaaaacattgctttgaagggaagatggatggatcccctagtaaactacagcttgaggtgcaatttcctaaagttcaaatgcctgaaaaaggaaacgaaagaaagaaactcaactcttgagacagcttcaatgctagctttgatctcaattatagagttatttatgaaaagtgcatttttacaactaaaaataaattaggatcaaaagcttctagaggctatactatggagtgcttactaaaaagttgagtaaagagtaaaaaaaaaaaaa

SEQ ID NO: 2071 - DNA, 800 bp, Homo sapiens
cttcttcctttggtgaactgaatgaggcaccaggatacacatgaactgccactggacatgaactgcacacaataaaaacccggcattgaaaacgggctggctgcccttcagaagtgacagtgtcctgaagcggggtgatgatggcaggtggataaacaggcatttcctgatcaggagacacaacttctggaactaaagaaagaaaccacaagatttgtcatgattaagtcaccatagagacctcacagaagggagcatgtaggtttatcttaatttatttcactgcagagtgctttcaaagttgggtagcaatctacttttatgagctccaaattgtatttttaaatgcactgggaaaggacaaaagcctgcttcttaggttttattttcagctggaagtagcgaggcattcctaccttccactgagagtgaagctgatgttgtggcaacaccatagtcattcttgggcttacaggtatagactgccgcatcctctgggaaggcttcaattagcaaaagcgtgtactcttgcccatcatgaaaaaatttggcactggaagcccggtggaaagcacctgctctttcttgtaccagcaaatttggggctgggggcttccggatatcatggcaccaaagcgggcaggcttgccaaactgcacagtgacaggctggaacttctgcagaacttggggcgggtcaggagctaggagtaatggttgcaaatagcccatgaaaaaggggaaaacacaggaaagctgcgaaactctccttatttggtgctggctagtatacatccaaag

SEQ ID NO: 2072 - DNA, 796 bp, Homo sapiens
  misc_feature (1)...(796): n = A,T,C or G
tttcccaggtaattctgatccacatcaaagctcgaagaccactagacaatcattgagaaggtgtatattgttcagctcctgcaacagaagagattttcctaaatggcctctccactcacatggaggaatgctaataaggacctgctctacaaactcattcctgcagtactctggacatgatgttgaagctgctgtttatcctttctgtgaagccccatgtgaaagaaaaaattttaaacccactggtctagcaaatcttggttcatcctgaagcattaatatactttgagggaggggaaataggaacagcgagtatttgtaattatatttttcatttccttttggnggccaggattctttcctcaatttgagttttcatacctattcttttgcctgatggaatcgtatgaaattcttggatttccaccagatgtgtccttctattatctgtacattttctacatatatgtcatatgccagaatttaacactgattttcctgtttatcagaatgcttatattcctggatgccttctcagagcctttttgtagaatgatagaatgaggcacggcgagtgtgcgcgtgtgtggttgcttatccaccgtgcttggccaatatttcttgagtcctgactgtcttgtgcagtctgtagcaccgtggtgtctctattcctcaatcctaacagcgttctcactaaagcaagtgctaagaacgttattaaatggacgggtggtgccattgattgaaaactacatgaagaatgcagtgattaaaatgataggttgtgagagctttc

SEQ ID NO: 2073 - DNA, 868 bp, Homo sapiens
atggaaaaagcatgagactcccagaacacacaagcttgctgaagcagccaggaggagctggtatgaaaagcaaagacacagcagccccagatggtggctccagcctcctgcagacaggggctcctccagggggctgcctccacctgcagatcactgagacacctggacggacgtggggaaccggcagcacctgggctggggccctgggaactgagctgagttcaggaccagtgtaactccagagaggacaattcttccttcagtttttgatgttcatgttccaggcttggcatccttccccacccatccacacgctctccctcagcaactgtactccggtatggcatcagccactatccaaatgctgatgtccacgaaatgacagctccagctccaaccacttttcgcagttgacaggaatttcggacagcccacggaaattatccacctaggactcaaaactcaacttgtacaaaactaggcccatcctgttaatagcattctgaatcttctcaactacacaagcagggaatcttggagtctttctagaaactcactttcccttgcttgtcaaactcagtggctcacctcacctcctcctccacctctcacctggattcctcccttacctgggctcctgcccccatgcagtctcccccagtacaacctcccccgccactgtggatccttctattacacaggctgggaagacacacaagaaactgagaagctgcttgtctctggagaggggagctggggaaagagttgggaggaagggaaattttctttgcaatgcatgttttcaatgtcccctcatgtgcctgtgtattacctcttctaattaaaaaataaacattgttgcgaccag

SEQ ID NO: 2074 - DNA, 636 bp, Homo sapiens
ctagatgctggtgtgccagaaaaaataagcctgatttccagagatgagaagagtgtacttgtggtgacctacagtgacttaaagcgctgctttgaaaatacttttcaagaactgattgcagctgcaaatggtcagttgtagtatttgctaaaaaagcacgcaggacatggctaaagaccttaaccaatagcaaattgcactacagctgaacttttcatcatctcattcacatttgggaaacgaacaggagatgagcaaagctgcttgcacttcagtcaggtacactgttacttgaaaggaagaatgtttcacttacccaagagctatggctgccattggaggctgttatctgtgaagaatttattttagatttaggagcaccatcaggtgaatgatgttcctgcttttgttttttccacttgtatatgcactaattttaattttttaaagactttttctgatctttgaacttttgccacattgtatacttacaatgggaaactttgcaaggacatttttgggaagcaatgcttgggcaccgtttttgccattgaggggttgagaatttgctctttttgggatggtatacgaggcagcatcccaaatgctgtgaattaacacacgattcacttgctg

SEQ ID NO: 2075 - DNA, 1481 bp, Homo sapiens
ttctgaacactgggaagtccaagagcaaggcaacaacagattcaacatctgatggaccttctcctaaaagtcttatcttctaagtctcctaagtcttggacttttcaaggccaaagatttaaaggccaagtggaccatacgggagatctagtttcccatccagacagccaagctcatgcatccctggatttggatggatggtttcccatggggccttggacagattggacccagcactggcacagggttgacttggaggaataagctcctggaaacctcaattagcgtttggggtatgaacattaaacaatactgaatctggaaacaatacatcacacagcgggtccaaggaaataagcagaaggctggcagcaggccagggccaggggccaaatcgctcctcaaagacaattcttcatggagaaatgacagcaggtttgaggacagcagggtaatttcctagatgtgaaatatttgtttcaaaatctatcagcattggggtggagccaagatggccgaataggaacagctccggtctacagctcccagcgtgagttacgcagaagacgggtgatttctgcatttccatctgagctttgaagagagcagtggttctcccagcatgcagctggagatctgagaatgggcagattgcctcctcaagtgtgtccctgacccccgagcagcctgactgggaggcaccccccagtaggggcagactgacacctcacacggccgggtactcctctgagacaaaacttccagaggaatgatcaggcagcagcatttgcggatcaccaatatctgctgttctacagccaccactgttctacagccaccactgttctacagccactgctgttctacagccaccactgttctgcagccaccgctgttctgcagccaccgctgctgatacccaggcaaacagggtctggagtggacctctagcaaactccaacagacctgcagctgagggtcctgtctgttagaaggaaaactaacaaacagaaaggacatccacaccaaaaacccatctgtacatcaccatcatcaaagacccaaagtagataaaaccacaaagatggggaaaaaacagagcagaaaaactggaaactctaaagagcagagtgcctctcctcctccaaaggaacatagctcctcaccagcaatggaacaaagctggacagagaatgactttgacaagttgagagaagaaggcttcagatgatcaaactactctgagctacaggaggaaattcaaaccaatggcaaagaagttaaaaactttgaaaaaaaattagataaatggataactagaataaccagtgcagagaaggccttaaaggagctgatggagctgaaagccaaggctcgagaactacgtgaagaatgcagaagcctcaggagcagatgtgatgaactggaagaaagggcatcagtgatggaagatgaaatgaagaaataaacaagttcgcaag

SEQ ID NO: 2076 - DNA, 815 bp, Homo sapiens
acagaaatatgttgctgcacatgggacagatatggatttacctgtataaccaggggcacagaggcagttgtatccatcagtcctgtagacacaattttcttcatctagacaagtggcacctgaaacaccagcaagagagaacccttcactccgatggaaaggggtctgaagccagggagccaagtggtcttgctcagcagatcccacccccacagagcccagcaacctaagatccactggcttgaaattctcactgccaccacaacagtctgaagtccacctgggatgctggagtttagttgagggaggggcgtctgccattattgaggtttgagtagggagttttcccctcacagtgtgaacaaagccgccaggaagttcagactggtggaggggggggccaccacagtgcctcaaagctgccgtagacagaccgcctctctagatacctcctctctgggcagggcatgtctgaaagaaaggcagcagccccactcaggggcttatagataaaactcccatctccctgggacagagcacctgatggaaggggcggctgttggcacagcttgagcagacttatacattcctgcttgccagctctgaagagagcagtggatcacccagtacagcgctcaagctctgctaagggacagactgcctcaagtgggtccagggctcccatatgtcctgactgggagacagctccagcagcggtcgacagaaacctatacaggagagctctggtgggctctggcaggtgcttctttgggatgagttcccaggaagggcctggcacaatattggcttctgag

SEQ ID NO: 2077 - DNA, 1206 bp, Homo sapiens
acagaaatatgttgctgcacatgggacagatatggatttacctgtataaccaggggcacagaggcagttgtatccatcagtcctgtagacacaattttcttcatctagacaagttatcttgaagatacatgaaaggattcagattctgacacctacccataattcttgttttttcaattatgatttccttctgaattttgccttttgaaccctttgttagtttttactaaatgttattgttgcgggaagtcagggaccccaaatggagggaccgactgaagccatgacagaagaacgtggattgtgaagatttcatggacgtttactagttccccaaattaatacttttataatttcttatgcctgtctttactgcaatctctaaacataaattgtgaagatttcatggacacttatcacttccccagtcaatacccttgtgatttcctatgcccgtctttactttaatcttttaatcctgtcagctgaggaagatgtatgtcgcctcaggtccttgtgataattgcattaactgcacaaattgtagagcatgtgtgtttaaacaatatgaaatctgggcaccttaataaaagaacaggataacagcaactgttcagggaataagagagataaccttaaactctgaccgccggtgagctgggtggaacggagccatatttctcttctttcaaaagcaactgggagaaatatcactgaattctttttctcagcaaggaacatccctgggaaagagaatatgcacctggaggtataggcctataaatgccccccccccccaaggtgtgcccatctcttatggttgagactgcaggggtaaaatagaccccagggctgccatagcgctcccaggcttattaggaagaggaaatggctgcctgataaatggtggggagaccagttggtatcaaaaccctggctgctgataagatggaatcattgacaatggagctcacaacttttttaagcttgttaaaggatcgtctgtctctgtgatgcttagcctacttaatttgtctcaggttgttctattcatgtcaggtatactaaatacgattttactatttcacccccgctcttgattctggatgatgatagtctattaactaccctcttgtctcttattttttatcgaccaattgattaatcccaatgatgtagatatgtgataattaataaatattaatt

SEQ ID NO: 2078 - DNA, 690 bp, Homo sapiens
cctggccgaacgggttttattgtgtgacaacataaattccttagtgacgttttcaaaagaataagagtttttaaccatttagttaaatagaaataaattgatgatgggaaatgtctgcattctatgtttaatttttctatcaatctaaaactgctctaagaaatagaattcattaactaaagtaatgatgtaggaaaagtttaaactaatttactgtttacttatactgcaatagcaaaggcaggagaataacttaacaaccttacagttaattatttcacaggatatgttacctgcctttcatcttccctgagtataagacaaggaagcagacttaaactctcatgagagaaatgtaagttgtataaaaaaaaaaaaattctgatggtcagagtctgctaatagtattgaaacttctggatttcatatcctggatgcaggtgattacattgtctggtatagcttaacattctcttgcctggtagtcatttggtatgcttggaaattcccaaggatacaacttatattaactgtttctaggtcctgaattttcttctagaaaccagctcactggaagttcatggagtctaaaaatgtttttcagcttgtagtcaaattttgctggagaaagactttctttagaaacattcaggtttggatttggttgcatatctatggcaaattctgaat

SEQ ID NO: 2079 - DNA, 498 bp, Homo sapiens
gcaagagactgcatatttatgtatgtaacagaatcttgcagaatgttaaaaacttatattcctgggcatcatcttcataccagtaatatcggaatcccaagacccaggaatatgctttctcagcaagccccccagacttttcagacacgatgctgcgataaccacatatcaacaatctctaacctaaagaatgttcagtgtgaatgaaaaggtttatcctttttccactgcatacactgaataggatctgaagtagaggataatcagagtcagaaagctgggataatcagacttttaaattagacgctacttgatcatgggggagctaagtctgtctcattgattcttcttctttagactggcagtcaaaacatgttagcaacagagaatcaagcacttccgtatgtcaaacctcatgatatggctctgacatacatgctacctctctcaatctttagccaatgtgttcacaattacaaaaataaaaataaaaaccga

SEQ ID NO: 2080 - DNA, 681 bp, Homo sapiens
acatgagatgatgaacctcaagtaccaccccagacaacaaggctgcttcatcaggacacaaacctgcctgtaccaggacctctgacctgtgtgcagcagaaggagtgggtcaacatagcttctgaagagcattcattggagtgaatctgccatttattggctgttcttcaaaccataagactgatattgatggtcagcttacagaggtatgctctctacagattgctgatttacttctcatggctagccgggtgcctgaaaattccgctggaagaactcaagattttccttttattccatgctttgaggcagagaggtaactggcaggtgcctaagaggggtcactgcgccatctcataaatagcctatatttttattctttttaaatttcttttaatttatttcaattttattctgaaatctctaacttaaaatttgtctctattttgctatttttgcatttttagaattattgctattttgtattcttagaattattaatcttaccttttcatttatattgcccagaagtttttggattattttattttttctacttgcttgtatattttatttttatttcatatttacatacatatatatataattttggattgggggtgcatgtgcagaattgttacactgatataatactataataaagaacgatgctggcctgag

SEQ ID NO: 2081 - DNA, 840 bp, Homo sapiens
ctttagctgcagctggctctcaaattaataacaatacaactgactgggtttttcattacagaagaaatagaaaatactttccagaagagaagatggcttttggagacatattacacaggagtgagtccgtgctgctgcacatgccccagcctctgaatccagagctcagtgcagggcccatcactggactgagggacaggctcaaccaattccgagtgcatattactctgcatcatgaagaagccaacagtgatatctttctgtatgaaattttgagaagcatgtgtattggatgtgaccatcaagatgtaccctatttcactgcaacacctagaagttttcttgcatggggtgttcagactttcacctcgggcaaatattactgggaggtccatgtaggggactcctggaattgggcttttggtgtctgtaatatgtatcggaaggagaagaatcagaatgagaagatggatggaaaggagggactctttcttcttgggtgtattaagaatgacattcaatgcagtctctttaccacctccccacttatgctgcaatatatcccaaaacctaccagcccgagtaggattattcctggattgtgaggctaagactgtgagctttgttgatgttaatcaaaagctcctaatataccaccatccctaattgcttctttctacccgcctctcaggcctatcttttgctgaattcacttctgacaagaaaacaatcaaaaatgtgttcacatgctgggtgaacccctttattccaggaggtcctctttcttgtgccttaacatacaggacaaataggctctattttatgtcttgaattgccttc

SEQ ID NO: 2082 - DNA, 931 bp, Homo sapiens
cagcagactattaccatctcatttgacgcatgagggaactgaggctaaggaaagtcgaatcacttgcctgaggtgaaacaagcatggatgaccctgcttttcatttcccaaagaaaacagaagcaaccagcagagaaccgcatacccttcagcctgtgttcagcagagcctccttcctttctgaggctccagacccagctcgggcacccctgacctctagtgcccaatttcctccctcctgcctgttggaagacatcactcttttttgcatgatcagttttctgcctttctacctggctattttcatcagtcagtacacctgctgtcattctgctattgaaaaaacctgagtcctctctttacctgacttaaaactttcctcaatatcatcaaattctccactcctctttataaagcaaaacatgaagtgctcatgctcatactcagcgttcccattcttcctgaaagccactcccatcagcctttggtccataccactctctcaaggggctccctccaaccacctcctgatacggtttggctttgtgtcccgacccaaatcttttttcgaattgtaatccctgtgtgtcagggagggggcctggtgggagcccattggatcattgggggagatttcccccttgctgttctcgggatagcccggggagttctcacgagatctggcgggttgaaagtgggtagcatggccccctttgctctctcttctgccgccatgtgaagaaggtacttgcttccccttccccttttgccgggattttaagtttcccggggcctccccagccatgtttcttgtgcagcctgcagaactgtcagtcaattaaacctctttttttttggttttaaaaaaaaaaaaaaaaaaaaaaaaaaaaaaaaaaaaaaaaaaaaaaaaaaaaaaaaaaaaaaaaaaaaa

SEQ ID NO: 2083 - DNA, 439 bp, Homo sapiens
agctcaccccacaggcttataggaaatttggccttctcctacactctgcaatcagacacccatcctctgccttgtcaggaagaatgcaaccaagcaccccaaggaagagtgagaagagtgtctccagttactacacatgtagatttgttgcagagcgagtactgagatcacagctcgatgaaggtcctgaattccagcaaaacagctgaacagctgatggcaagcagtttgaagacctccacagaggaaccaaatcagcatgagaatacagtttcttcatctccctcccccatgacttcaccctgcactcttccatcaatcaacaatctccacactcttaaaaatcctagcccagaactccttggggaggcagatttgaggttccctcttatctcctcatcaggcagccctataattaaacttccttctctgctgcaaa

SEQ ID NO: 2084 - DNA, 818 bp, Homo sapiens
cctcaccccacaggcttataggaaatttggccttctcctacactctgcaatcagacacccatcctctgccttgtcaggaagatggaagttgcaaggtgtggaccactccttctttctagaatgcaaccaagcaccccaaggaagagtgagaagagtgtctccagttactacacatgtagatttgttgcagagcgagtactgagatcacagctcgatgaaggtcctgaattccagcaaaacagctgaacagctgatggcaagcagtttgaagacctccacagaggaaccaaatcagcatgagaatacagtttcttcatctccctcccccatgacttcaccctgcactcttccatcaatcaacaatctccacactcttaaaaatcctagcccagaactccttggggagacagatttgaggttccctcttatctcctcattaggcagccctataattaaacttctttctcacatccaccatacaaagtacctcttaaaagtcatttatagtgtgtaatcctgtccgcatcaaggagatttaaggaggtttagtaatgcattaacaacaataacaaaaatatctcaaagattaaaaatgaataattaatgcaggaaaagaaaaagatgtggtaataagaataactaccctttaggatatggggaagagggaacccttatacgttgttggtgaaaatgtaaattagtacagccactatggataacagtatggaggctcctccaaaaaataaaaatagaactaccatgtgacccagcaatcccactgttaggcatatacacaaaataaagggagttccgccagc

SEQ ID NO: 2085 - DNA, 686 bp, Homo sapiens
ttgcatatctctgcacaattacatcacagatgtgtacaaatgaagctatcttatttctctaggaccaaaattagtaattctaaagacccatttctactgatggtggaaaaactcttcattttgtccctttcagggaaacttggctacctagtataatataatcctttttcaggaataatccactcaggattccaaacagaagtccacgtacccatgggagttcacccatgtatcctaaggggtctgctgattctttccaaatttttcatctccatgggctgttacttgatttcagaggctggatttatggttatgtttaaggctgactttggcactaagtccctttactttaattggttctgactaatgagaagaaagctgacctattacttattgatgcttctcaccgagcaatagccaaatcggtatccagcacactgggcaaagaaagacttcctactagatcaccaagcagaagtcctggacagattcttacaagaccccatgggctgaaattagaagtgtggctcctagggtggtaccggaacatttaagaaggagaacatcattcggcgcctagattcgggtggctacctgagaatatttgggtgcaattatggagctctttgggggagatacctatgcctgcgaactactatcacatcgacacattacgatcaacttaa

SEQ ID NO: 2086 - DNA, 746 bp, Homo sapiens
agacagggcctcgccatgttgcccaagctgattttgaactcgtgagatcaagcaatcctcccgcctcagcctcccaaagtgctgggattacaggttggattcctcaaagggccattctgaagaacaagtaaaaatagtctatgttaagggtatgatgaaaaccatcatcagtcagtaaaaggtgagaatgagaccaggttcaccttcacacctgtggatcaagaaggaacatgagatgtccacagtagagagacaatacgtatttaatcaggtgtctcgacagtgtgaaactcaacaactcaagtagagatggagtttggcatggatcaagaggatttgtgatgcctggggaaaatacggatgctgatccctgccttcaaggaatgctggccagttttctggagactcccagcctctagctgagacccatgtagttggtcagactctatactgcaggaggtaccctgtgcacatgaaagaaaagccttcaaataagaagattgagaagagttgggatggctgctcagggctgcagctggtataaagctgtctctgttctatggctggaggacacagaggagagcacacagcaacacctgcactgcagtatctcctgctaatatcatacttcataatgagaaaccacatactttctccttaagatggaaaacaaagaaaggatgtcttctctcatcagtcctattcagcatgtactaaaagtcctactttgtgcaaaaaaaaaaaaa

SEQ ID NO: 2087 - DNA, 652 bp, Homo sapiens
  misc_feature (1)...(652): n = A,T,C or G
aaagccttggggaaacatggagtttctgaatcctctaccatgttcgcaagtgaaggagaaacattttcattcagataccgattgaacaacacctacctatgtacctcctagttcatctctctgcctttagccttggccccagtgatccaggctctacactgctagtgcaagaatctcatgaagacagcaaatctgatgatgcccagactctgaggaaaatctttcagtgccatctgcatgagtttactattgctgctttaacaaattaccacaaatttggtggcataaaacaattcaaattttttatcttacacttctataggttaaaagtttgacatggatcttactgggctagaatcaaaatgttagcagggctgcgttccttttatggagtctctagagaagaatccatctcctagcgccttgcccagcttctacatgatgtctgtattctttgagtcatagcctcttccttccctttagcaaaaagcaggtaaagttatntctctgcctcattctgacttatacatagaaggttttttctttactcgntttgtcatagctttatccccagcacctagtagaaagtttttactacttgtgtggttaataaatgaaaaaaatcaaaacctaaaaaacatggactaagtgt

SEQ ID NO: 2088 - DNA, 852 bp, Homo sapiens
cccgcgttttttgccgcaaggggggcatacccaattaaatgggtacgcacccatggctcttaacagaccacttctcgtctttaaactggcagggcttcttttaaggtaaccctcggctctagccgggagtgtgaaaatgggacctattggatttcgcgcacctctcgacaaattacttaccaaatgtccagtgtggcaaggtgtaatccaaaggctaattggttctcctcacccaaaaaaaaagctttccaataataaaagaagaccatgccaattcatacccccaaaagggaattcgtgaaccctattagccacaatttgcatggcaacgaatttagattaccctagaaataatggcataaatttctaggcaaattcccattgcccaggcctgacgtttaagaaagtagaaattttgccccagcttaataatgagtaagaagttcgcataaatgatataatgtctcccattaaacaaaagcccagcacaataaggcttcccctgttaaggtctaccagaatatttaaagaattagcgccagatattctcattttttcccaaaaattgaagagcagagaatactttcgaatttattgttcgcaccccccccctgccctattatcaaagccagacaagaataccacaggtaaaagaaagtgcaggcaatatccttgaggaccatagatgcaacaattgtcaatacaatactagtcaacagaattcaagagcacattaaaaagacaattcatgataatcaagcgccacccccccgtgggatgcaaggattgtgtgagcttatgcaaagctataaatgtgatgccacattaacaaataaagggggatcgccaagc

SEQ ID NO: 2089 - DNA, 451 bp, Homo sapiens
gctctgttgtcccaggctgaagtgcaatggtgcaatcagaatttactgcaacctcaacctcctgggctcaagtgatcctcctgactcactcagcttcctaagtagctgggactactgccatcataatgtgaagaagccgaagcagcctgtgaagaggcgctagtggtaaggaactcaggtgcccctgccctcagtcccagctgaactctcagctgacagccatcaccaacttgccagccacaggagtgagccaacttgagagtggatctttcagtcccagtggagccatctcagctgacacaccatggtaaaaagatgaaccatccttgctgatccttgccagtgctgcagatacataagcaaaataaatgtttttgttgttttaagccactaaaaacaacacaacacaccaaccaacacccacacgcgcgagtcggcctcgttggcctca

SEQ ID NO: 2090 - DNA, 540 bp, Homo sapiens
ttttaaaccatgttatataattataaaccaagcagaagtctgggggcttctacaaccaataattcatacggtaaaggaaaggaacttgcccaagatcgcacaccttggaagttgcagtgcctgctttgtctgtcctcttagatactatgcaagtcacaggccaataaatgcattatgttattatggcagtgggaatgctggatgattgaaagacttgttcaagacaaagaagacacccatggcagagctaaaataagaataatttgctctttaatagtaaagtaattctttgtcttaaccatctgatcctaatgaaaaatgactgatgatttaatgcagactaaaaaccaaaacttgaatttgattcgttgacatggacaaaacctagattgcctgcaaatattcccacagcagggataagagccacccttaccaaaagaattgaaatatgcttgaaggctgaaggtggcaaccccgctctccccacagagtatacctttcctcccgagggccttggttactccacttcccttcccccta

SEQ ID NO: 2091 - DNA, 811 bp, Homo sapiens
  misc_feature (1)...(811): n = A,T,C or G
gagtttctaatttagagaatgcaaaaccaaaaaagagaaagttattccggagatttatgtctgaaaataaaatatttggttagtgattcctaaggttacaagtgtaaacgatgtattctgtctccccacaagttcttttctcctgctcctgccacaaagcaacaaaactgattaatgaaagtcaaattgagttgtctttgaattatatagaagaacattttttaaaagtggcttcattctaactttaaatggctatgacaaagaaatcattgatttatttgcaatattttccgtttatatttaaacagaataatcctctttggtagttcattggctgctcatcttccagctctccatgtgtagcttggctgctccgtggtcaaggtgacttgttagagatcattttagatctgtgaatctaggagacaataaaaaattagccgacaaaaacaaganaattatatttataggaatatgtgctgtcgggggattgttagataattgtcataataaaataataaaaaccctccaccgcggggcgaatttgggtttttttctaaagattccgggggttttttcttggatgattaacgaagagagttggaactctcatctccccctcttttaaaatgggggctagggaagagccctatttcaaccttaaaaaaaattgtttgtctttccttgagagggaaaaaaaattttttaaccatacaaaaatgattttagggcaaacccccgaagatcccaaaattctgtttttaaaccaaaattttaaacaacaccttatgctttgttaagaactccccag

SEQ ID NO: 2092 - DNA, 521 bp, Homo sapiens
cgttacttcccaatcactgatcagctccaatcctaagtgttcaagaattacagcactgaaagtgtcaacggagagactggtgtcttcgctgtgtttccagcgctgtctaatctgggctacaaactcatagatttcaaagaggtcaaaagttccctgcttgccaagaataaaattcacctaaatgatgtgactgtaccttcaacataaaagctagaagctagtagcaattctctcacagctggaggcctgggtttgttacagtcagaaaagactttgcaataattggggaattcgatgccatggtgtgtacaacctgatgactttgatatgagaggttatgaaatgtagtagaaataacatgtaagcgtgggctgctgaaaacctgggtttgcttttatcctggttctgccacttaccagattatcattagatattcacttgttcattcattcacccaaatatttccctgaaggcccaactaaagtgccaagcaccactctattctccagacatgcagcaat

SEQ ID NO: 2093 - DNA, 270 bp, Homo sapiens
acctactttcccagactccttgcagttggaatttgccatgtgacccacttttggcaatagagagccatgttttttggatctatggctgtaactttatgacccagagcagtgaaactaaggaaatgccatcaaatgaggatgacagagaaggaggctagaaagagaggggttactccataagatcacagagccactgaagcaaacctggaataggctaccttgagactatataatagagttttctgtgccttgcagctaaataaaacccga

SEQ ID NO: 2094 - DNA, 1087 bp, Homo sapiens
atggagtcctgctctgtcacccaggctggagtgcagtagcatgatatcagctgactgtaacctccgcctcctcggttgaagtgattctcctgcctcggcctcacgagtagctgagattacaggttttggagtataaaaagatggtctaaaccgcattcaagcttcattctgtagaaggaaacaaatgaggagaaattaggcagcactatcagcatctccaagatcaattctatgtgggactgaacataacaattagcattctttggagactgaaaatgtacaaatgctggatgttaatgagttgctggagactgaaaggtcatacaggtgcaggatggcaggcagatgttggcactataagggtaggctctgtctctgttttgctggtcattgtatctaaggtgggcacagtgattcaaaaatggttagctcctcataccatgtattgaatgaactacaaagaatccccaaatctgaaattttaatttaaaacttaatgaattcctcaagttacggcttctaattaatgcatttctgctaagccaaggggagccccttgagaaactggtccagagttctttctcatcgtggatcataaagagcttctcccactgggtgactgagtggatgggaggagtcactggatttatgtttgggatcttcattcactagcttggcttctgacttccactgcatattgttaagaggtactgcttaaaaatagtccagcagtaatgttttataaatgattactagtttcaagtagtttcttaggaaagaacatgatgcaaccacagaaatgtatgtaataaatcttaaatgattctgtaacatgtattttcatcagagtatattgaacttctaaaattaagataacaagatattctctttgcttttctaattgtgtggaagcagcactttcttagtatcctctacatatctttctggatgcttcttccgacatcttcaagggtaactattatttttatctgtctcactcttaaacacagctctcaggctgacagaaataaaagccggagcgacaaggcgtctatttctctttaattccgagagcagataatagagt

SEQ ID NO: 2095 - DNA, 846 bp, Homo sapiens
gatagctgcaacggataaagctacattcctcagataaaggacctaacaaatgaggcccttctagaagaatgaagaccttctggcagcattctctttaacccatgatggaggctaagaggagtgaaccagtgttctgttcctggcaactatgaggcaatgaaaattgccaccaactacaaatggcccctcacacttagggtgtgaaatgaggtaaataagtggacatccctcatctatacataaccacctcagcttggaaaatagagcaacgagctcatcacagccaagaatccacatatattaaaataccagtgatttttgtagtcaaatttctaggtgttttgaatagaatattttaaagtgagaaaaggaaggtacacagataatgggccaaaaccacaactatgataactgatggctaaagagaaaagagaccatgagaagagtctatcagaaatagaaaacagtccttgcacagactttctcggttctgtactaatcaaaattgaaatggttggaaagcagtggatcccatcctgaagcttgtgtgcagtatgttgacgtgtctggcagccaaaatgtggccaagaaggatgccaaaagggcattcttccctgtattttcttcttgagaggacctgccagagttgctccaactgcaggctccctgttttgccaggggttggtgaaaaatccttaaaactcacattgagctgaagtgtggagatcgctcgtgtacatataaagttagtctttatctatgcacgtgacatcaagcacttaaccatccaagcaatatttatagacctaaagaaagatattgaactctatccactagataaggaaa

SEQ ID NO: 2096 - DNA, 757 bp, Homo sapiens
tagatgaagaatctgaagctggatgaggtgaggttgcttcgtcaagatcacaacagctaatgagtggcagaatctacatttgaatctagacctgtttggacacatgtttggtgcccactagagcatatgaaatgttgggtacaaaaaaaatagaataaataagacctagtatttgaccacacaacaaggtaattatagtcaaaataatttaattatacatttaaaaatacctagaagaggccgggcatggtggctcacgcctgtaatcccagcactttgggagaccgagacaggtgtatcccttgaggtcaggagttcgagaccagcctggcaacatggtacaacctcatctctactaaaaaaacaaaaattatccaggcatagtggtgcatgcctgtaatcccagctactcaggaggctgaggcacgagaatcacatgaacccgggaggcagaggttgtggtggctgagatcgcaccactgcactccaagctgggtgacacagtgagactttgtcttaaaaaaaacaaaaacaaaacttgaagagtataattggatgtttgtaacacaaaggataataaatactcggaggaaagggttagtctattttccatgctgggattgttacgccctgcatgcctgtattaaaacattttaatgtattcataaattatatacctactatggtcccacaaaattcaaaattaaaaataaatcctgttttaaaaaaaaaaaatacatggcctctctggccttaa

SEQ ID NO: 2097 - DNA, 311 bp, Homo sapiens
  misc_feature (1)...(311): n = A,T,C or G
agaaaagactagagaggcttgcaacacaagctggaagatctaccacatcttgccgctgcccaagaccgcccctttatctttctatgcaagtttttactgaataaatctttgaccacctaccaacctggagaagtctgcctctttgtttggtctgagctttccttctacttattgggggcagttcttggttgtggcagggggttttcccagnaactgtgttaaccagaagtattaggttggtgcaaaagtaattgtggtttttgccattacttttaatacaaggcactaaatcaagtgttgaaataaagcca

SEQ ID NO: 2098 - DNA, 322 bp, Homo sapiens
atggagttcatgctttgaaaagatcaataaagtataaaaacatctagcaagtcgaagaaagaaaaagaagaaaaaaataaatatctattagtaatgtaagaaagggactatcatagcaattgtggtacttattaaataaaagatatggtatacaactttagcaatacatgtgagaatggaagactagatttaacggcaggtattttaggaaaatatgcattaatagcaaattcaattatcaaactgactgacaagaaacctagaataaccaataaacacaaatgaaataaaaagtatgtcaaagatgaaaaaaaaaaaaaaa

SEQ ID NO: 2099 - DNA, 372 bp, Homo sapiens
agaagcttaccaacggcagaggaaagtaaatcatacctgcgggaactggtacgggaatccaaaaatccccactggttgtgaaagaaatggggagttcagcgctttaaaaaataaataaaagaatcagttttagattcttccgtcactacatttgctgcctcgtacatttaatatgatgctccaaaatgagaaaactgacaagcaagcagaacagacataattgcctgagatttaacttcagaaagcaaaactaagtttccaaaatatcaaaaatattttaagtgttgttgtatttgttgttatattaatacataatttggttttattgaaataaaataataaattttgtatgttcaagtaaaaaaaaaaaaa

SEQ ID NO: 2100 - DNA, 437 bp, Homo sapiens
cgtaggactactacatcagattacctatgcactttgtcataaatatttcagaatgcctatgagaaaaagaataaagctaaatcaagtccagaatacagagacaaatcactgctgcattgacagagttctcaacattcatcaaattatacaatagtcagaggagtttcctgtggatataaggtccatttgaatccttaagaaaaagagtggatattgaagaaatatgttctttattctgagcagaaaggccagcaaaaaagataatggatttgccaaaatatatcaggacaatactattagccataggtaattggatgataaaaattgctgttacctttatgtgcttttgaaactctacatgattttctttgcaaaaaggtcattaataaaaaattgcataatttaaaaaaaaaaaaaaaatggcctcgttggcctca

SEQ ID NO: 2101 - DNA, 536 bp, Homo sapiens
cctggcaaacaacaaaatattgaatcaagtcctgatttgaagcattggctgatttcaagctacccaaatggcatcgctgaatgtggagataagaagtgatgtgcagcagcacaccattatacagtatttccaacatgtagataaagaaaacataaataacctgaaaagtacagataataactgtatgccttgaatgcattttattttctctgaagtacattcttaagtgattttttcctatattttgtgggtgacaaattgtctgagtcttggcatattaaaagtttcattaatttgcctttatatctggataagaatatagctgggtataggaatctagtttcagattatgtctacccataaatttaagattattgctccactgagctctgcatttgtactcttgtcactaagaagtacagtattaggagttttttctctattgttggtagctgggttttagtcattaaaaaaaaactaaagatttttgaaacttttgatttattaaaatttttgttataagaaaaaaaaaaaaa

SEQ ID NO: 2102 - DNA, 248 bp, Homo sapiens
cctaggaaactgaaactgtggaacgtgaaaccatggataagggaggactacagtacatcaaatggaccaatcatggctttctgcaggcacaattaacagaatgctgatttgtattagaaagtagcccaacaatcgaagttgccctgcaatctaaatttccagactcaaacttcaactactcatctacatgtagccatcttatcaccataaaataaatattttggtatgcctccttaaaaaaaaaaaaa

SEQ ID NO: 2103 - DNA, 392 bp, Homo sapiens
attctgagcctccccagccatgattctgaggcctccccaccatgtggaactgaaactgaaactgtggaacgagaaaccatggataagggaggactacagtacatcaaatggaccaatcatggctttctgcaggtgtgaaaactttaggaatcatctaaaattttcctaaaatatccaagcttgcatgttcaggtctgtagtaatataatgatgctgatattttgataggcacaattaacagaatgctgatttgtattagaaagtagcccaacaatcgaagttgccctgcaatctaaatttccagactcaaacttcaactactcatctacatgtagccatcttatcaccataaaataaatattttggtatgcctcaaaaaaaaaaaaaaaaaa

SEQ ID NO: 2104 - DNA, 290 bp, Homo sapiens
agctttgaacaagcaaacttcctggcagcctctactagctgagaatggctgcccgttgacaatgaggaaggaaggaggcaactgagttctacacctgcaagagactgaaatctgccaaggaccaatgagctggaagaagacctcagcctcagatgagactgcagatccagatgacatcttgtttcagcctttgagacaccaagcagaggacccagagaacacatgtcagattcctgacttattactgtgagataataaatctgtattgtttcaagctaaaaaaaaaaaaa

SEQ ID NO: 2105 - DNA, 426 bp, Homo sapiens
tataaataaaatggtggatgctatggaacaaactgggagctgcttagaaaaaggacccaagaacttggagctgaaagacaggtcaaaactgtttacccatgaattttctggttgtctttgctgcgtagctttagctgctgctccaactccaaactaccaaagaccctgcacttgatggatcagctggcaacacccagatcgataaattggctcatctgatcttgtggctcccacccaggaagtgactcagcacaagaagacagctttgattccctatgatatcatctctgacctgaccaatcagcactcctggctcactggcttcctcccacccactaaattgttcttaaaaactcggatccgtgaatgcttggcgagactgatttgagtaaaataaaactctggtcacgtgcaaaaaaaaaaaaa

SEQ ID NO: 2106 - DNA, 1194 bp, Homo sapiens
ttttttttttttttttttgacataaaaattatttttatttaccttaggaaaattataatgtaagaaattaaaattacaatgcaaaaaaaattattttagtaatacaatatgaaaagataaaatgtacgatgttaattagaatagaattagaaaaattaagttattttatttccaaaaatgtttaaatttgtttaaaatactgacacaaattcttatttgttaaattgaaaaagtaaacaaggaaggtgtaaaaccatatgtaaactatgaaccaaaaaatagctatttgaaagtaaatgtgtgttaatccatttttgtgttcatgtgtactgccgtgaacttgtacacaaaattgcatggggtaatattttctcgtcattttatttactaggcagaagtatatatttatgacttgcatatctttagaacttttctctagatgatgcctaatatcatataattgcttaaatcaatctaatgaagattgaggaatcttataatattctaagagggtaaagtataaagtaattcctgaatcatctaatgcttatgggtaagaatgaaattttaaaaaatacattacagttttacctacagatctgaggcagagtttttcgaattctcataacaccaacatagcccttgtcttcacaccatttaataatttttgaaggcagctaaaattgtgaaatattatgaaaataaaagaagccaaagatcagatggttgtagatgtgtggtattatttctgagggttctgttctgttccattggtctatatctctggtttggtaccagtatcatgctgttttggttactgtagccttgtaatatagttttaagtcaggtagcatgatgcctccagctttgttctttttggttaggattgtcttggcaatgcgggctctttttgggttccatatgaactttaaagtagttttttccaattctgtgaagaaagtcattggtagcttgatggggatggtattaaatctataaattaccttgagcagtatggccattttcacagtattgattcttcctatccatgggcatggaattttcttccatttgtttgtgtcatcctttatttcattgagcagtggtttgtaattctccttgaagaggtctttcacatcccttgtaagctggatcctaagtattttatctcatgaagcaattgggcaaccctag

SEQ ID NO: 2107 - DNA, 500 bp, Homo sapiens
caggctccctctgcatcacagaggaagacaagactacatttccacaaattcccattaggaggcacttcggttgagctatgattccttatggatttcactggccctgtcttgtctgctcatttacctgcttatgtcttgattacctgaggagagaagatgatcaaaatggaatggaaaggatcaaataaagaagagagatatttaatctatatatttaattatatatacttatttatgatattgttcattgttttattttaccacttcactattctgcaaaaaaaaccataaatgcaaaatttttaataatatgttgccaacctataagacaagtgaaataaatgagaaaaaacttaaagtataatggtagaaatctatgtttgtaaatttcaacaatcaataagaagtagaattattcaagcaacagaactccttgtgattacatgtttcaaaaataaaaagatgattttgttccaataaatattctaaattactacaaa

SEQ ID NO: 2108 - DNA, 1004 bp, Homo sapiens
caggctccctctgcatcacagagggagacaagaactacatttccacaaattcccattaggaggcacttcggttgagctatgattccttatggatttcactggccctgtcttgtctgctcatttacctgcttatgtcttgttacttacagcaggacagagtctggatttaactactctgtccctaccagattacctgaggagagaagatgatcaaaatggaatggaaaggatcaaataaagaagagagatatttaatctatatatttaattatatatacttatttatgatattgttcattgttttattttaccacttcactattctgcaaaaaaaaacataaatacaaaatttttaataatatgttgccaacctataagacaagtgaaataaatgagaaaaaaacttaaagtataatggtagaaatctatgtttgtaaatttcaacaatcaataagaagtagaattattcaagcaacagaactccttgtgattacatgtttcaaaaataaaaagatgattttgttccaataaatattctaaattactacatatatttgtcaatatattgatgagttaatattaagattagtatagattttaaatttctacattttttctcttaactataaacaaagttcattatcttatgatgaatctttgtatttactttcattcaacactgaaaattctaaaataaaaaaagatgagaaaatcttattgaagcatttggacatccatgttgttattattaacatatatttatatgtgggtatataaatcatatgtaataaatatcaaattattacacacatttggcttactttttcaacactattttaaattaactacctttttactggttctctttttttattgctttttcctcatttcctacctcttattagaatatttttcaattttgtctgaaaacatcctttagtatttgcctttaatgaatgcctagttatgagaaattttttcagggtttttttttggctaaaata

SEQ ID NO: 2109 - DNA, 521 bp, Homo sapiens
ctgatgtgctattgtgaagagagctgctgtgaacctgctgtttccagagtacacaggagagattatcccctggatctacagccaaaattacttcatcacacagtatacaaaattatacacaataatatctagctgctttccaaagcattggtatcaacttatgtttaaagaaatgatatataaaagactcagaggactcacgtctttttaatcacttgatataatgacctttttattttatttttccaatcaaatgaatttaaaagagaactcaccatggtatgatatgtaattctctaatcattattaagtccaaaatatgtcttcatatatgtttactagcaatatataattcctgttctgtaaagtgctaatcatgatttgtggccatttatctatgaaattgctggtgctttttaatcgacttagcatttatttatatattgttgataatactttcttcattgtatataataaaaatgccttctagagaagaggcagagcaaaaaaaaaaaaaaaaa

SEQ ID NO: 2110 - DNA, 680 bp, Homo sapiens
catcccaatgcaagaagttcagctactctgaagcatccatggtatgaagaagctcaaaccatatgggtacatgggaagccatgtgtagcagctctggttggcagttccagttgagcccagtctttgtttcagcacagcacaagcatcacacttatgaaaaaagaaactgtccaatgttttcagctcctggtcattttaattatgcttaggcatgaaaatcttcccaattgtggccataagcagagcagaacaagtcatttttcatccaaattcctgacccacagattatgtgaccccttaaaaaagagttgactagatttgctcatatagatttgataactcaagtattttaagtcctttgtatattacttggacctgtggtaaacgatatttattttgtgatatacagaaaaaaaattatgtactgtttttcaaccttagattaaacttttaaacacaaatcacacagagtatacttttggttccagagcaaaacatacctattattatatttactataaaagtggatgttcccatgacagagcctatgaaaacagatagcagagaaatggtagtgagattttggggagtcaaagcatccccatctcataaagtactatgtcaaaaaaaattgcgtatacttgctaaaaaagaaaaaaaaaatggcctcggtggcctca

SEQ ID NO: 2111 - DNA, 851 bp, Homo sapiens
gtcagaatcaattctagcagctttcaaatgcgtgtacttaaaaaaaagaaagaatttccaacagacatataaaatgccagaattaaacgttcaagggtactgggagcagcaaagaaaagccaccgcaacatcagtttgaccacgaatgctgcttaatggtgtgttaaaatgctgcaatgaagaataacttgctgacatgatacctcctgaagggacacacacaaatgctgactcctttgttttttaattggttccttcgccatttcagctgccaccatcccctctccccaaaaccccagtagacatcaacagaatccagaaactacagggtccactggcatggcagggcctgtaggattcttttccaatgtgtacagattggctgatgcctggactatgccagttcactgttttaaagattactcttgattgtcacaattaaaaacaaagaatatttagaaccaaattatatgtgttgcacattaaacaaaacgttttataatatgttctaaaagtcagcaaaggttatttagctgtgtatgattcatttcacaattccattttttaatattgtaattctcccttatgccttctaattttttttgaaatgaccacagatatcttctgtaggccaaatagcatattacacatctgtcaaaacatactttattatcatataactctgtttacaaagtctcttgaaccctttcagattgttctggctgcttgttttgtgttcatttctttctttaatgtgtttacattttccagtcatttgtataaataaggatgtactagaataaatagtcctttcccctttaagacccagtctaaatttaaaaaaaaaaaaa

SEQ ID NO: 2112 - DNA, 321 bp, Homo sapiens
atttttgtcattctattaaccatggtttgtgaaatgatagattgtggactaagagaaataatatattattcagattaaccttactttccatgagcttctgcattaataatcaggttttaatataagtattacatttgactgacatacactatcattttgttcatagttaacatactgcacaaaagtgaagatgtgagagattcttctgaaggattgattgcagacaaaaataattcccttttagtacaatgcattccgcattcctcaatccattcatcatcatcagtgatatttgtattcaatgctgtcatgcagagctag

SEQ ID NO: 2113 - DNA, 424 bp, Homo sapiens
cctagctagctctgcatgacagcatttgaatacaaatatcactgatgatgatgaatggattgaggaatgcggaatgcattgtactaaaagggtccagaaattgccacaagtctctttttgagtctcagagaagcaaggccatcatgtataagccaggaattatttttgtctgcaatcaatccttcagaagaatctctcacatcttcacttttgtgcagtatgttaactatgaacaaaatgatagtgtatgtcagtcaaatgtaatacttatattaaaacctgattattaatgcagaagctcatggaaagtaaggttaatctgaataatatattatttctcttagtccacaatctatcatttcacaaaccatggttaatagaatgacaaaaataaaaagctttgtttaaatgaaaaaaaaaaaaa

SEQ ID NO: 2114 - DNA, 458 bp, Homo sapiens
atgaaacttaagtccaacatgttgtttgatggatcatggagataagtagacaaagaaaatatggagactatcaaagaattcaagactcactgagaaactaccttaattccagcacaatccttgattgctgaggaaagcaaccctggctgtgatgaaacacctagcagtacccataaactctgaattgcggtaacgacacaaggccagacattcctgaagccccagcttaaactgcctctttccaccattattattatgtgtatatatttaaattgtcaaagtctctatttgactgtcaaaattggaaattacagtatgtatttatatttccttgagaatttgtggaataaatttcagtataatatgtacttatattttcttggaatatgtaaaataaaatgagactaaagttaacagtacagaaataaaattaatgtgaataatgaaaaaaaaaaaaa

SEQ ID NO: 2115 - DNA, 606 bp, Homo sapiens
cctgggaaaacctagaagtcaaagatgaggtaatctgaaaggattgctcgaaaatgacaagactgaggcaacgaatgatacagaaaatatacacagaaataaagaagacacagaagatccataatactaactactaacttagtgacaactggtattcaaatatgtaatatgtattctagatcctataatttgaatatttaggttgttttaacttcgttgtaaactgtacagattttaaatgagccatgtttaaaacataaattctcccagttcagataatcttatttaatcctatcactcttaatatttctaacttattttcatcagtatcattgattcatcttttccatgtagataatctgaaattatctaaacattcttacttagtagcattaaaaaatgtaacttgactctaaatattttcaatttagtaacagtagatcttgtgtagctttgatggatccttgagcacatatattgtcaaagccttttttaaaaattgcttttcagtggcatatagtatttgatatctcactataccattttatttgatagaaaacacaatattttttaaaaattaaaattttgataacaaaaaaaaaaaaa

SEQ ID NO: 2116 - DNA, 572 bp, Homo sapiens
ctgaaaggaagagatggtatcaagacattttctctttattatgggaaaagaatctgcactaatttatatgactgatatacagagtaaacataaaggttcacgaagccagtggttcacaaactgaggactacacataccctggaggcctcaaggaacacaaattcatgcactcgttacgattcatgtgaggactgagtgaacaatgctatgtaaacacacacagatatatccacatatattcatatatatgcaacattgctgtttcaaatataggttgtttatatagaggctattaataaaatatattttaaagtgttatttaatttataaaagcttttatcattgcctattttctcagccaacatttgctattataacacgttgtggttctacattttaatattaatattaataattaaattgtgacactgttattactagtaatgtctattattaattgttaataataatagccaacatttattatgtgccaggcactgttctaatgacttaacatacattatgtactcacatactcattaaatcctcacatgatcctaaaaaaaaaaaaa

SEQ ID NO: 2117 - DNA, 845 bp, Homo sapiens
  misc_feature (1)...(845): n = A,T,C or G
ctggcattatcaactgatgtcccacatggaggatgaagatttactttctctctcatcaataaaaatgtcggataatttttgtgggtacgcaattccaggttgaaaattaaaggcaatattccactgtattctggtttccaatgtcggtgtgaagaaatccaaagccactgatacagatataagaaaaagatttgagtctttctacatcaagcagaacatccttggaatttctagcctggatttccaatgctaacagaatgttcagaaggcattcaggccagtgaagttaccaacacaacaaagatgaacgcttttcaaaaaagaattgcattatttgctaataactgatacttagcagcaaaataaaaaccataaaataaagaggctgtcatttacacttccataatatagacatgtattgtgaaattgttctttattttgttttcctcaatcaatctggctggcagggctttgatcagtttggatttaattcactgcttttgaaatgatcacatttccaccatttttgctggggatacattccaagatccccagtggatgtctaaaactggtgatagtacgaaaccctatatatactggattntttcctatacatacatacctatgatgaagtttaatttataaattagggccacggaagaaatttacaattacctaatgggaaaatacaacacttggaacaacatttaatgtgggaatgggaccacctttgtaccaacacacaagggtatgtgaatggggctctatcaaactctatcttattgacctggtcttacgggactgaacgagaacaaaatcccaataagaaaacttgccttttattt

SEQ ID NO: 2118 - DNA, 632 bp, Homo sapiens
ctgtcaatcctcagacaaccctatgatgtacacaccattatggcagatgaaaaactgagtgaaagacatgagcacagctttgccagtgatggatgcaccaaccctttgggtgtagaacaaaggagatgaagatgatacattattcaccacttgtgcttaagagcctagaaaaatcaaccatgaagaaagaacacaggctgcagacaagtgaagatttttttaatacagaatatatgttctccccccaaaaggccttatccttttatgcagttcttgactcctctaaatacctctggaagaatgttatgtgtgagccaggataagtggcatttatactttagtttatcaacctatgtcctgtcttcctgtagcagctgtaatgaacagggggtttagtgcagcatttgagagcaaagactttagaaaccatgcagactcatgttcaattctggttccatcatctaccagctgtgaaactctggagaattcactttgcctcactaatcatagtacctacacttcatagcattctttcaaaaattaaatgagacactgttcataacatgcttatcactaattttcattatgtgtgctataacattaaaatcatgcaatccacaaaaaaaaaaaaa

SEQ ID NO: 2119 - DNA, 272 bp, Homo sapiens
cagaaaagcattttaaggtaaaggtaaccttctgatttcaattgcccgtttggatcaaccatcagacccagtcatggagaggaggcagaaaatggaatctaggaaagaatgagccaggatcttgtggaccgagctgaagcgtgaatcttcctcgccagaaacaccccagcaaccaattaccctggacgtgacgccgaggcccacctagtggtcagccatctgcctaggcagacaataaagctcaatttttctccttctcaaaaaaaaaaaaa

SEQ ID NO: 2120 - DNA, 238 bp, Homo sapiens
ctagtgttatacaaaccactgagagatacagaactttcctcaaagccaagaaacagctttcaaaaggaagtttcccaaaaactcttctaaaagtaccagcatatcttcaaaccaaatgaggaaattgcaggccacagatacaagtaaccagcttaaccactggattgtgctctctctttccttctgtaatctactttgaacaaataatacaaacgtgaataatccaaaaaaaaaaaaa

SEQ ID NO: 2121 - DNA, 573 bp, Homo sapiens
tagttcgatgtggccatatgatggagttacagccaatgggatgtgagtagaggtgatgtgtgtgcatctatttcctcttctgctgctaaccactacacccaggagcagaatagactaaaagagggaaggatcctggatccctgaactctgtcttggagatgatttacacactgatcaatcatccattttaaaatatgaaatattatgaatgagaaatatttacttcatatttgaaccaatatgtgcctttttgttacagtagctaaaattagcttaaattgtgtatctttcttatagattttacattttactgtaattgtttcttatattgaaatgtgagctttcaaagggatttaaatttttttatcatcctatgcatattacagtgactgacttacagtaggatatcagatttcctttattaattagtaaagatgatgtttttatttcatcattcacctttcaatttatagagcacctgctgtaaatatcattttactttcttgttccataaaaaagagaactggagaaagaataaagctaatttaattatgcttaaaaaaaaaaaaaaaa

SEQ ID NO: 2122 - DNA, 710 bp, Homo sapiens
  misc_feature (1)...(710): n = A,T,C or G
cttttccatcaccttctgccatgactggaagtttcctgaagcctccccagccatgtaaaactgcttaatgagaagtccaacaaaagagagagagggagagaaagagaatggtatggtgtgtgttcctgtaaagtctcaggcatcgcttcgcaaacctttaccagtttgaataattttgtatataacttaaaccctagttctagctatatgaactaggcatgataaaagtatatttacaaaaagaaatgctgtttcattgaaacttttctgcctatatgtttatagtccaagttgtgtcacaggagaatgctaacttgcagactatgtttacaccatttgtcctttaggaacttttattttgctgcaaaccacaacaactttgtaatgggcacttctgaatcatacatatttgttccacggaacactatgtgctgcaggagactttagccacctgagaagctcaaaactgatgaaactttgaacccacactcatctttcaaccagaaaatgctcattttcaatgttaaacttctaagtaagattgtttgaaaacacaattttgctgataaagtaaattactttttaaaaattgctatagcaaatggagtattctatcagttggctactaaaattgaatatcatttgaaaataaatgctatgcttaaatttcaaaaaaaaaaaaaaaaaatggcctcgnttggcctcagcgt

SEQ ID NO: 2123 - DNA, 1133 bp, Homo sapiens
catgtgtgaagaaggtccttgctttgccatcaccttctgccatgactggaagtttcctgaagcctccccagccatgtaaaactgcttaatgagaagtccaacaaaagagagagagagggagagaaagagaatggtatggtgtgtgttcctgtaaagtctcaggcatcgcttcgcaaacctttaccagtttgaataattttgtatataacttaaaccctagttctagctatatgaactaggcatgataaaagtatatttacaaaaagaaatgctgtttcattgaaacttttctgcctatatgtttatagtccaagttgtgtcacaggagaatgctaacttgcagactatgtttacaccatttgtcctttaggaacttttattttgctgcaaaccacaacaactttgtaatgggcacttctgaatcatacatatttgttccacggaacactatgtgctgcaggagactttagccacctgagaagctcaaaactgatgaaactttgaacccacactcatctttcaaccagaaaatgctcattttcaatgttaaacttctaagtaagattgtttgaaaacacaatttttgctgataaagtaaattactttttaaaaattgctattagcaaatggagtattctatcagttggctacctaaaattgaatatcatttgaaaataaatgctatgccttaaatttcttcaggataccagtatttttattttatgttattcaaggggccacaagatcatttttctagaatttaaaaaaaatccaaagaaaggaattccctttttgaaatgatctgaatttacgtaactctataataaagccaaacaaaacaaaacaaaaaatgtgatacatgcagtttgcaatgactactgtttaacatagtgaatcaaatctttgatactgtttaccattgtgtggtgtttttattataaaaaaatcctgaaggaacttcaataaattatctcataccttcatcagcttaatgtgacaaggaaagaaaacagaattgttgagtatacacatcatttccaaacctagaagtagcatttcttctcagggttgaacatataaaaagcagggaaaataaaataataacatttcttgtgcaaaaaaaaaaaaaaaaa

SEQ ID NO: 2124 - DNA, 510 bp, Homo sapiens
catggaaatagaagaatttttccagcgctctgataaggatggtgttgttgtgttttctctggagtcagttgtgaaaaaccttacagaagaaaaggtttatcttatcacttccgccctggctcagattccacaaaaagtcagtagaacctccaatccttataagaagctattcacacaatagagaaagttttatagagattcaaaggaaagaaaccagctacactgggaaccaatactcagctctacgtttggatatgccagagcgatcttcatgataagattatgacgtagtaaaaatgaggaatttcataagggaaaaattgaataactgtttaacacccaataaatttaacaaaaatttaaaatttatagtttgttattttacctttaattttaaagtgtatataattgagtaattggtggtcattatattgtttgattcttacttttatttttaaaggaagtttcaggcaatgcagaaataaattaatgcctcttttccttaagaga

SEQ ID NO: 2125 - DNA, 471 bp, Homo sapiens
tagaaagcaacagcccacaattgcctgcattttctttcctcttcaaaaccacttctgctccaaagaccatgaacctgaactgaagaaacgactccttcctgctggtgtgagataattcagtctccatgatgtcttaatcctgggcctcccttaattgacttctaactgtgctgaactgtggctgctaggagttgcaatgtggatcgcaatttacaaggcactggaatcgtttcttgtcttcaaattagtcctgagctgtactggagaaagaaaaaaaaggggcctttacccttcttgctgtcttgtcaccacaagtgagactttcttacagtctcagaatggatggttgccttttaacaatttagttagggacagaaaggaaaaagagttagggttgccaatacttcgtcaattttgtcttaataaagttgcctcacatggcctatcttgttccggggaaaaaaaaaaaaa

SEQ ID NO: 2126 - DNA, 388 bp, Homo sapiens
agggtcttactctgtcgtccaggctcgagtacagaggtatgatatcagcttactgcaacctccacctcccaggctcagagacagggtttcactatgttacccaggctggtctggaactcctaggctcaagcgatccactcacgtcagcctcccaaagtgctaggattacaggtatgagctactgcacctggcccatactttctatttcaacacacaaaatcctgaaaagatgtttactcaaggctctagagttaataaaattcatccagtttttgctgctttaccaaagacattcttttttaaatttttttttaatgggagttctgagcttttaaacaactgtgactaacattcttaattaaaattggtagttttaaaaaaaaaaaaa

SEQ ID NO: 2127 - DNA, 344 bp, Homo sapiens
agtatgatatcagcttactgcaacctccacctcccaggctcaggtgatccttctgcctcagcctcccaagtagctgacaccacaggtgcacaccaccacacccagctaattttttgtatttttgtagagacagggtttcactatgttacccaggctggtctggaactcctaggctcaagcgatccactcacgtcagcctcccaaagtgctaggattacaggtatgagctactgcacctggcccatactttctatctcaacacacaaaatcctgaaaagatgtttactcaaggctctagagttaataaaattcatccagtttttgctgctttaaaaaaaaaaaaa

SEQ ID NO: 2128 - DNA, 684 bp, Homo sapiens
agagacgtggtcttgctacatcacctaggctggtctcctactcctcagctcaaaagatccactggcctcagcctccagagtagctgggactacagatgcacaccaccaggcccggcttcactagataatttttaataacagaggggaaaatagtagcttcacagtgaagaagcctggcagacatcacattaaccaaaggagcaaagttaccatccctagttagaaaacctactgatgttacataaactctgatgtgctgtaccccccttctgtgttgtatttttttctaaaaatgcataacttcaatttaatcctagagaacttcagatgaacccaaattgccggactttttacaaaagaactgaccagtactcttcaaagtgtcaaggtcctgaacaacaaagaaggactgaggaacctactagaggagattaaggaatcctggattaaagtctagatgagaacaacacattagcgagaaaagcagcaaacttgaatgaagcctgccatttaatagaattgtatccatgtcaatttcctggtttccatcattggactatggtcatagaagttgttaacattaggggaggcagagtgaggggtatacaggaactctcctatttgtgtaatttttctgtaaagtctaaattatttcaaaataaacgcgtggcctcgttggcctca

SEQ ID NO: 2129 - DNA, 710 bp, Homo sapiens
ttttttttttttttttgccagtcacatattgcagtgtgttttattgtcagggtacagggaaccctgcagagaaaactggcctacatgcagtggacagaggagacaggagactattgtactgcaccaggccgatgtgcagttgcttatagtgcttctgccttcagtagaatggaggctgtatttggttctttgatcgccctttacaagccgcagcctgataaggtcactcaagtggagcctgtttggcagcacccatgccaagatctagcttgtcatcacatggaaatctgagaacatctaccagacaccaggcatatacactgtgctcatatatagggggttgacactagacaggagccttaacaggcatgcgatcccagcccatctcttacagatggagaaactgaggcccaaagggagcctcttgcagagctcactatcaagcagaagtagacctgggggctcctgccccttccgtgggtgctctgtcttcaattctattgcagcagcctcctctgcctctgaaagagcatggagtgttgcctctgattttagttgctaaccgttggtcaccagttttgtgtactcttgggtttttttcctccgtctgtttgcttcctcctgttcagcgattatttcttattggacggtggaggcaacttggatccagaagacttggttatttacattcattggtcctgagacaccat

SEQ ID NO: 2130 - DNA, 331 bp, Homo sapiens
tgctgtggcaactgagccccatccttacagtgtgatgccccatgagcaaagagccctagaggactcacaatgcacaggagcttggtgagactcaaagcatgtacaagcagatctctctactcagaatccagtgggccatcccagcactgctcccgctcaaacaacatggcatcagtgaagacaggattgatagctctgtttattctggaaaattccttcaaatatagtcacttgtgagtcaaccacacctctttaggaaaacatgacacagcctcatgttctctgtgacactcctgagtccatgaataaatgaatttgaaaatgctcaaaa

SEQ ID NO: 2131 - DNA, 346 bp, Homo sapiens
caaatcactttagtatcacctgtggaattccgttatgaatgacatttttttttcactttgcaaggaagagcccaagagagaattcacttcacaatgaccctgctctgccctgtatttattcggcaatgatcctcagaagaaggattttgaaaatgcattggaactcgaaccaagagcgaatgtgattttgaagactttattgctgcctaaaattctattttaagctacttattataattctttttaaaacaaaagaaaaaaaaggaaagatgcttttgctgttacaaatgaaaggctgtgttcctgatgccgaaaaaaaaaaaaaaaaatggcctcgttggcctca

SEQ ID NO: 2132 - DNA, 325 bp, Homo sapiens
cccacctcttctatcccctcccatacactccacccaaccccatcgtttttgcctgaccgcccaccaaactgtaaactcaagtttactgctggacacttaggatactcaacatgaagcactcaacctggtattatgacacccaatttttgttgaagacatcacttgaagggatttataatgatttgtattcatttaaggaaatggaataaatgaattatgtgggttggaagagtttatgttatctttgctatattatactggcttatttattaataattgtttgcctcacccacaatatatggtattcccagcaaaaaaaaaaaaa

SEQ ID NO: 2133 - DNA, 226 bp, Homo sapiens
caggtttctgcactgatttgattgaaatatatccagagattgcaagctaaactgccaataagcatctgtcatttgcaattatttatctgggtgaatcagaattttctgaatactctgcaaacaaaatacagaaataaactgcatgagttgatgttaggctacaattaacttttgaaaaattttggtatacataaaagtctcattttcctaattaaaaaaaaaaaaa

SEQ ID NO: 2134 - DNA, 248 bp, Homo sapiens
ctggaactaccacttctgcaccgtgtggccttccttgatcacctgtgtaagcagaaatcagaagtggaggaagaaggggaagaagaggaagagggggaagacgaggcatctctggatccactgaagccatgttctcctaccaaagaagctcccactggagagcgagcccaaagacgcccttcaaagatgacagaatgaccttgaataaaaatctttgaatttaagtctcacctttaaaaaaaaaaaaa

SEQ ID NO: 2135 - DNA, 244 bp, Homo sapiens
agaagaaatggctcctcaattttctatctcatgtggaggcaacatttctgcatcagattcagcctgtgggcaaaggaatgaagcttcttctacgatccttcaggctggcccttcctgaagtagcaaagcatgtgtcattacaaaacatgattgtaactcctctttcagtgtcactgattttgtcgtgtgggaaatttttggcaggttttggcaataaagtgtctatcaagcaaaaaaaaaaaaa

SEQ ID NO: 2136 - DNA, 322 bp, Homo sapiens
aagaaaatggctcctcaattttctatctcatgtggaggcaacatttctgcatcagattcagcctgtgggcaaaggaatgaggcttcttctacgatccttcaggctggcccttcctgaagtagcaaagcatgtgtcattataaaacatgattgtaactcctctttcagtgccactgattttgtcgtgtgggaaatttttggcaggttttggcaataaagtgtctatcaagcaattttgatgggattagggctttacatttgttatgaatctcaggagagaattaggagaagacaaataaatattaaaagtaaaaaaaaaaaaa

SEQ ID NO: 2137 - DNA, 352 bp, Homo sapiens
cctaggaagaacactgatagaagactgtggccatgatcttactgcctgaagcaaagtactgccagccaaggtacccctttgaaaaagaaagatggcaaatctgcaatgggaaagaagaatgcgtaacagtcacagatctctgcttaaaacctctttttctagaaatcctgcttgctttttttttttattatactaagttttagggtacatgtgcacattgtgcaggatcatgctgtttggactatcagacaggaattgaggagagagctacaatcattgtggaaaatattcggatagtgcttacatgatacatgacaaataatgaagaaagcaaaattcaaaaaaaaaaaaa

SEQ ID NO: 2138 - DNA, 653 bp, Homo sapiens
cctaggaagaacactgatagaagactgtggccatgatttactgcctgaagcaaagtactgccagccaaggttcccctttgaaaaagaaagatggcaaatctgcaatgggaaagaagaatgcgtaacagtcacagatctctgcttaaaacctctttgtttagaaatcctgcttgcttttttttttttattatactaagttttagggtacatgtgcacattgtgcaggatcatgctgtttggactatcagacaggaattgaggagagagctacaatcattgtggaaaatattcggatagtgcttacatgatacatgaccaataataaagaaagcaaaattctctctgtctcattttttaatcataaaagccacattatggtttatccagacagaagatgcaggcttgtaatggtaggccctaggaaaccacctcaaaatgaaatgctgacctgcctatatgttacaaatctgggtgagatttggcctttacccatcacataaatgctcagttgctgaatgatatgcaagacaagtcattatttcctaaaaggaactcttccaacttatattgagagaagaattatggccttttgcatttgttgctcattttaattaataaaaaataaaatactaacatccacaaaaaaaaaaaaa

SEQ ID NO: 2139 - DNA, 536 bp, Homo sapiens
aggtttttggtggcttctccgcagtgacagctgcacaggaagaatgcaggctcctgggttcttcagatgtagtttcagcagcagtgcaacgtgagtgctctatcatccccatcaacatagtgctcaggtgctctggctccggcagcagctgtattagaagtatttgagatcctgcagcatcagtggaaatgaagaagactgatagaagactgtggccatgatttactgcctgaagcaaagtactgccagccaaggtacccctttgaaaaagaaagatgacaaatctgcaatgggaaagaagaatgcgtaacagtcacagatctctgcttaaaacctctttgtttagaaatcctgcttgctttttttttttattatactaagctttagggtacatgtgcacattgtgcaggatcatgctgtttggactatcagacaggaattgaggagagagctacaatcattgtggaaaatattcggatagtgcttacatgatacatgaccaataataaagaaagcaaaattcaaaaaaaaaaaaa

SEQ ID NO: 2140 - DNA, 195 bp, Homo sapiens
atggtgacaacgccagcttctgcaaagtaaatgatggcagtgtcctacgtgacagcagggcaacaagatagaaggaacctctcaccgaatgaccatgcagagcaaagttactcatcaggcaatgactactcataccaggattgctacatgagcagtaaataaactcctttgttatttgaaaaaaaaaaaaaaaaa

SEQ ID NO: 2141 - DNA, 194 bp, Homo sapiens
ctgaagggccttagacagttttccacctttcaagataagacagtagtagaggagaatacattattcaaatcgtataagaggccttctggaaaggagaagaaaaaagcaaatatgaagacatcatttattagtgaatacactgttcttttagacacctctaataaaggaacagcaacattttaaaaaaaaaaaaa

SEQ ID NO: 2142 - DNA, 192 bp, Homo sapiens
ggccttagacagttttccacctttcaagataagacagtagttgggagaatacattattcaaatcgtataagaggccttctggaaaggagaagaaaaaagcaaatatgaagacatcatttattagtgaatacactgttcttttagacacctctaataaaggaacagcaacattttatctcaaaaaaaaaaaaa

SEQ ID NO: 2143 - DNA, 885 bp, Homo sapiens
atggttttttttttaggttttgtctccttgaaagcacatctccatgaaaaaccctgacaatcacacaaaaaaaagaactacgcttcatggagggagaaaagccacggggagatttctcattagtcacctgcatgaatcctcttgaagcttccagcacagcccagctaccagctgaatgcaacagagtaaatgaccccagttgaagccacataaagcagaagcattgcccaaaggagcgccatctgaattttacactcatgcattttagccaaatgaaatgaaatgatgattggttttttagccccttattttgttaagcagcaatagatcgttgaaatgatgagtatttgtatgtagatcctattttgtgatttggcctctgaagaaaagttttttgacccattccttagagcctgcttggtttcatgaattgttactgtctttcaaaaactcagaaatatgtggtgttcaaatattcaaaaaggataaaacttgcataatttattttaaaatgatatatatataatagcttgcaaaattacatatatatgtttttaagctgatacttgaataatctttcttggaacaggcaggataaattagaagacctgccaaaatactatccaggccttataagtgtataaaatattccgtgaacatacccaaatcggtgtacttttatgcagaaatgaaaaaatgtatgtttcttgaaaatcacatgctttatcctgcaatagctacttattagttctgtgacctctgagcaaatgacttaacctttctggtcctctgtttctccaccttcaaaatggggatgataacaaaggattatttttagaattatgcaaataaatttatgtacagtgtctaaaaaaaaaaaaaaaa

SEQ ID NO: 2144 - DNA, 632 bp, Homo sapiens
  misc_feature (1)...(632): n = A,T,C or G
cctagagggaagaccgtagaagctttatcatagggcctagtgtcatgatcatatatttactccataaatacctgtgagatgtcttcaagcttatcttcatttacattacatgggaagaaagctaatggaacttgagagcaggtgaaatggaaggctatgtgcaagttctaagggaataaagtttgttttctaatgttgcctctttatgtagattgttttttcataacttgattaaaagtctccgtccttttcaccttctcccctgcctgaagtcatttctgccatgtatatgagctaacgatttttggtgtagtcaccttttcaattgatctgtgttgtttaccaagtctcacatcaatttcaactgtgctgcctcccggagttctgctaacttgtgaggacaaacaatcctctccgcctggcaggcagcggatgaccagaccgcgctcagttctgattggttgaatcccctgggtctgattagtccagatgagtcagaaggcacgttcccaagcgtgagctatgtttatcgttcgttattgttctaagtcttanacaactggaaagataacacataaagtttcccttgaaacacaaaacaaaaaaaaaaaatggccctccttggcctcaac

SEQ ID NO: 2145 - DNA, 171 bp, Homo sapiens
ctgaatatgaagtattacagtaaaaaggatttcactaaaaaaaatcatctaccatacagacactatagaaggcttggaaaagacattgtaatataaaagatatattttaaattgtgtctatccctggaactctattaaaattcaatattaagaaagtcaaaaaaaaaaaaa

SEQ ID NO: 2146 - DNA, 544 bp, Homo sapiens
tgccaggtgaagtataataacattagaaggggtgaaagcgggggggaggtgtgaagcattggcagagcctggcctggtggccagcaagaggctaatggtgccaattaccaacagagggagcctggagatggagcagactcctggaatatgatgatggaggagactgactcatttttggatattttatgagcctgaggtgtggtgccactgaagacacagcatgaggtagccaacccatccctgagactgctgtgggggctgatgtctacgctggctggccttgttgcatggattccacactgtttttactatttacccgctagttcctgtggctctcaatcaataacttcttttttgtactgaaccttctctaacatggacaaggttaaaaagagaaagtgtaccttttcagagtctaaaagtgctatgtgggaccacatagaacatttatctgagattgtggctgtatatgataggatgtggagaaactggacaaaaaaataaaatctgacaacacattacaagagttacaaaaaaaaaaaaa

SEQ ID NO: 2147 - DNA, 487 bp, Homo sapiens
ttatttttttaactggtgcaaacccttctttatccaaagaatttgctttgcttctttcatcttccccttgaggctggctcccaaggccatacaatgaaaggggcctgaaaaagcatgccaccagtaaaccagcatgccattcagtatcttttcttacacaacagttatttgtaaactaatcaataaacttttctcattttgtttgctcctttagaactcttagcagccgcctgctgaaccatgaagaaacttaaaatagcgatgatctcctcttgacgctgccgcctctttctccccatagaacccacgagccaatctgtggtgtttatactcgaggccgtatgaagctaatctgtatggaaataaaggatagaaatattcagattgagttttactaagtgaacctgaggtttttcagttcagcaaaataggccaggtaaatgcgtttctgatacggaataaatcactggtttgaaaaaaaaaaaaa

SEQ ID NO: 2148 - DNA, 149 bp, Homo sapiens
atccatgcctggggaagctctggaagcgtaaccacactgggatggtgaaggggaattagtcaatgactttgggtaacacctggaatttgacctgcagactggaatacagcttcctattaaaatgtttcattcttataaaaaaaaaaaaa

SEQ ID NO: 2149 - DNA, 377 bp, Homo sapiens
ctcaggctaaggaaggccttgtactggttttagagccctggacggagctccaggtgacatgggccttcctggttctaccaccgacctgctgggggtttcagcaagccttcaccttccacgttggcgttctcagctctaagaaaaggaagttgatttccatgagaggtgatcaaactgtgctgtagaaacctcagcgattccacagaacattagagtacctctgccaagcagaattctccacatggagaaacctcccctcttactgattttatatgccatgcatgtcaacgctctggggaagattttttgcttgagaaaaaaaaaaaattcttgctgattaaagaaaaacaaccctggaaagtgcaaaaaaaaaaaaa

SEQ ID NO: 2150 - DNA, 1152 bp, Homo sapiens
atagagtatttatttagtaatgtgggaagtgtatgtgagggggcaggtaatgtgttagaattggtgaagctggagggggaggatgtagggtgagacgcggagtggggtcacgctgtaatgaatgatggatatataatagtgaggaagtaatgggatcggcttttatatccgaggagagatggacatttattttatgtctgaagtaaagtatagaaggcaaggggtgaaggaaaagtaggggaggtgagtagtagagataaaatcaggagtacacagtggggtcgcgagtggagcggggaggaaggtagcaggggggagctgtctgggtcgtgaggtcacatccaacttcagtgtgaggtagaggcatgcaggagcggcgttattgatcacatgagacgtagccatatcattccacccgtgacccctcccatgcctcatgttcttttcgcatttaaaactcaataatgtcttcccaacagtcccctaaaggtttagctcattccagaattaactcaaaagtccaagtccaaagtctcatctgagtcaaggcacatctcttccacttttgagccgttacgcattgctgggcaggccttgggaaacttgcaatcctggtggaaggcaaaggaggagcagccatcttcttcacagggtgtcaggacagagagactattcattactaagggaatatcctttgggtgaagcaagttcaccgtttgaagcttaaatgactccaaggaggctttccggtttatgggcagcactagaaggcacgtgacttgaagaatctcagagaaggatgtgggaaatgaatgcaaggtcaaccctatgtatgtaagaattaaaagaaagtccagcctccttaattactaaccatcatttaaggaaccacctatagctggatatgtgaaataattaatccattacagttaaagcaattttcaattggatgtaatgtaaccaacagtataaaatgagacttggcaaactttttctaaggactatatcacaaatatttcagactttgtgggtcctaaggtctctgtcacaactactatgccctgctgttgtaaagcaaagtcagctataaacaatgtatcaatgaatgagtgtggctttcaataaaactttttatttacaaaaaaaaaaaaa

SEQ ID NO: 2151 - DNA, 161 bp, Homo sapiens
atggattgagactctatgaagactctcctacagtttttgccaactcagagaattaaaagtggttcagccatcacacagcacttggagaaaatttccatttcattaaaaggaaacttccacgatgaaataaaaattttcaatggtgaaaaaaaaaaaaaaaa

SEQ ID NO: 2152 - DNA, 575 bp, Homo sapiens
  misc_feature (1)...(575): n = A,T,C or G
ttgaagttttttattattccttttactggtttcgaagtgatgatccttttattattcttttagcgcttcccttcaaattttaaatgcccattattgagggcttgtcaacgtctacaaaagtgtactggaattttgattgggattatgttgaatcacttgatcaatttttggggacctgccaactcccccaatattgagtgtgtaggtttatatatgtgatggggggtctccatgtatttagatttttagtttccctccccaatcttttatagttttaattaaccaaattgcacacatattttaaaaaatgtatccctaggtattttacttttgatgctattgtttatgctattgggctttttaaaaaatccgccccccttttctgttgtttttgttaaatataaaaatgcaaataatttgtgttcatacaccttatatctggaaacgttgctaaatgtatttttttatcccattagctcttttgcttactccttantattttttttgtgggtagttttgtcatccccnaaacaaacagttttactctttttcaccctaaaaaaaaaaaaaaaaaa

SEQ ID NO: 2153 - DNA, 372 bp, Homo sapiens
  misc_feature (1)...(372): n = A,T,C or G
ggccatttttttttttttttttttaattgcaatcttttttatggtaggttctagtgcattacatgtagcaacttgttaatcttcacaataaaccaactgtgccacaattttcaccatttatcaattaacaaactgagacaccaagggagtgaaagacttgtccacagttttcagtcataatggccgaggcaagattggatccaggcagtgtggcagagtttatgagtgttggagcctgtaactcccccccacccccaattactcagatgtcttcatggcactggacaggcaagtagttctcaggtcctagaatcttgtcacagatggaatatagccccccncccccctaccccctcccccccccccccctcc

SEQ ID NO: 2154 - DNA, 755 bp, Homo sapiens
tttttttttttttttttcttttttttttttttttttttttttttttttttttttttttggcaggtgccaagatttaataaagtgaaaacagagttcccattcaatgggaggggacccaaagggggttgccactgcctctcaaatacctgtgtttatatcccaatcactgtccctccccctgtgctctcaggggataaatgattgactatttttttacctcctgcttttaccctaattggtagtttagggagctctttttactacctgatcggtcaaatgtaagctgagttacaacccctatattttaaaggggggggggggcaccttccccacctaggcttaaaaattcttattcagccttaagaaatccacctagtcctgtctctaaatcccccctttaaacaggaaaacccaagtgcttttgggaattttggccaaaaaccgttctaaccccttcctgctaaattggggcataggaggggtcctccattccaaaattccttagaaggggtgcctctcatgttttaacatcggaccattgggcttaccgcccgggcaaaggggcggggggtagcttttaattaaaaacggaatacgggggtctcttgtaaaaaacatttgcgacgttcacggatctgtctctgaaaaactaactcgggccctctttagaactatatcactacaatccatgtcttttagaccttcaccatcaccaactcctcccttcaccataaaattgtaaaatacaatgccag

SEQ ID NO: 2155 - DNA, 180 bp, Homo sapiens
catgggcgtgcatatgacatttctacttcatgaagtcccttgtgactctggtcccttttcttgagtctgagggtgaaattacactgaaagtgaccctcttgacagtcaggttttcttgacatcaacctgaagctgaagattactgtgcaataaatttattaggaattaaaaaaaaaaaaa

SEQ ID NO: 2156 - DNA, 485 bp, Homo sapiens
gttcctacgaaggatatacactttcacatgtgtcaagtatgatggttaattttatgtgtcagctggactgggctaagagatgccaagattgctggtaaatcactgtttccaggtgtatctgtgaggacatttccagaagagatgagcagttgaagcagcagactgcgtaaagatcaaccttcaccatccacattgtgtgcatcatccaattgactgaaggcccacacagaacaaaaagctgaattctctctcttcttgagctggacatccatcttcctccctcggcatcagagctcctagtccttcagactctgagacttaatctgcagtccccggttctcaggcctttggactcagactgaattataccagtggctttcctggttgtccaggttatagatggcagaatatggggtttctgatcctctatcattgcataagccaattcccataataaataaattaattaatgaaaaaaaaaaaaa

SEQ ID NO: 2157 - DNA, 848 bp, Homo sapiens
catggaggatgaaatttaacccatctaagaacctacagctctgatactctcagaaaaaataagactcaacacaaagagagtaaaaagagttattctgtcaacgaagggtcttgaccgaataatgtatacatcagatcttttcatcttgcacttcttggacactgtgattcaaaagggagattatttgtgtcagtaaagaagtatccataatgataaaacacaagtacttcaaagaacaacctgtgcttctcaaaaggaaaatagtttggatccatttacttttctcctctacttcacattctaaatgactgagaaaatgtcttctcgttttcaatacaacccatgggaaatcatactcaaataagaagtaactgaatgaactaatctggaaaagtggtcctcaatttgtttctgtaatatcagctatcacaatactgccttgatatttcatacaattctgcagagtataaaaaagcaaaagcctctaaaagttggtactagaatgtactacacgctcaatatagaccacaaaatggatcagacatgaagcttagtattgtctgtgtgcacagtgtttaaatattcccttgttttaaaagtgccagtgtttgttaagtaacttaaaatatttgccacatgtagcttattttttttactttttattatatttttgtcataggtaaaaaagtgaaaagatttatgacagtcatttttttaaaactaagttaagctatataaattggtgtgaaataaaatacattttaattatatacaataaagatcctaattttaatttgcgagtattttcaagatacaagtaacgttatcaattggtttacttataacat

SEQ ID NO: 2158 - DNA, 547 bp, Homo sapiens
attattccttgaactttttgatgttatcaagtcactcggtctggaaatttgtgttgcagaatatcctgaaatgtttaatatttaacagagaaagcaaaacccagaagcgcctaattcttttagccattcaactcttccttcccatgccccctcacccactctctcaagccagtggttgtattctttatctctctggttctttcagtagcaaatcaactttacaaaatcttgttggaagaaaaaggcatttttacctggtgatgaagaagtaactgctgtgcttcaaacagattttcagtatccaagatcttctcagcttgttcctggacttctttagagccagaaattaattcttcgagagaatttttgactatttctttgtactggacacagtccccaaaattgcttagcatcttttcaacctatattttcatgaaaaaaaaaaacacgtaaatcatatgctacttgttgaagtttgtataatttttttggtaaggtatgattgacaaataaacattgtacatatttaaggtgaaaaaaaaaaaaa

SEQ ID NO: 2159 - DNA, 453 bp, Homo sapiens
atctattgaactcaacaagtaattattcttcgctttcatttctgcaactaaaactttccattactgctaaaactcaagaagcgttcatgactggaacctgtttgaaaaagtagcaaatcaactttacataatcttgttggaagaaagaggcatttttacctggtgatgaagaagtaactgctgtgcttcaaacagattttcagtatccaagatcttctcagcttgttcctggacttctttagagccagaaattaattcttcgagagaatttttgactatttctttgtactggacacagtccccaaaattgcttagcatcttttcaacctatattttcatgaaaaaaaaaaacacgtaaatcatatgctacttgttgaagtttgtataatttttttggtaaggtatgattgacaaataaacattgtacatatttaaggtgtaaaaaaaaaaaaa

SEQ ID NO: 2160 - DNA, 596 bp, Homo sapiens
ccatctgctaaactcaagaagcgttcatgactggaacctgtttgaaaaagtattccttgaactttttgatgtcatcaagtcactcggtctggaaatttatgttgcagaatatcctgaaatgtttaatatttaacagagaaagcaaaacccagaagcgccaaattcttttagccattcaactcttccttcccatgccccctcacccactctctcaagccagtggttgtattctttatctctctggttctttcagtagcaaatcaactttacataatcttgttggaagaaagaggcatttttacctggtgatgaagaagtaactgctgtgcttcaaacagattttcagtatccaagatcttctcagcttgttcctggacttctttagagccagaaattaattcttcgagagaatttttgactatttctttgtactggacacagtccccaaaattgcttagcatcttttcaacctatattttcatgaaaaaaaaaaacacgtaaatcatatgctacttgttgaagtttgtataatttttttggtaaggtatgattgacaaataaacattgtacatatttaaggtgtaaaaaaaaaaaaa

SEQ ID NO: 2161 - DNA, 465 bp, Homo sapiens
acccaaactttctagggcacatttgccacatttgctttagaaagtgacaataaaacatcaacagttcttggatgttgaaacatagccaaaagtgagaccatcaggagaagggcctaagaagaactagattaacaggaagaaggtgaaaaagtgataataaatcttttaatcctgccacctacacaggcgattctccacctaccagaggtgagagcatatcttactaggtcactaacagcagcatagtctctgaagaaggttttccagttaatatgtggaccaaaaaagcacaactggaccaatatataaaataaacacactcctttactacaacaattcgggaaactaaattttcaatgatggaaggaatggttatatggttaaaaccaaatgctaatgttggatacatttattaattcaataaatgaatattcatttatttatttactgaaaaaaaaaaaaaaa

SEQ ID NO: 2162 - DNA, 401 bp, Homo sapiens
atgtgctgggctcatttgttttaacagcactgggaattctctttccatatcagtactataaggaactttaaaagatcatcactatccttctcaatcaattatggactttctgtggtttgtatttattctgtgaataccaaagtaaaaatacaggtaaagagataaggaggaagaaaagatcaccagaaaggaaagaaaaaaaaagaactacaatgaatccagaatggattcaatcagtcaagacaaataatagacttataaagcccatagtgtaaactcacatttccttgaccatgaactcaagttctatttagtaaaggaaatgtaaaattcatcaaatgaaagtgttacaattataaaggtaaataaagcagagttatacaagaaaaaaaaaaaaaaaa

SEQ ID NO: 2163 - DNA, 500 bp, Homo sapiens
gggatttgcctgcatatatttattgatcaaactgagagcttctattcagttgctcctacagcagggagaagtgagttacagagactacctgactttgactatgtggacttcagaagttaatctctgctggcatcttttccaaaaaaagattaccaccatcaattccaatgtgatatatatttgtataaagaagatagttccaactgcaaggaagaacaccaaaacactgagtatggagaagagtgggagaatcattgtcccctgttcagagcatgaaagactgcccacggtctgacaggagaccgtgttgttcttcaaacatgaaaaaagaagtcccagaagcctaattattgacatgatatcaattcattaaggtatatattgacaggtcttctctagagaaaaagacttagcaggattgatgaagcatgttgacactgaagagagagatttggaaataaataaatccactgtgctttatacaaaaaaaaaaaaaaaaa

SEQ ID NO: 2164 - DNA, 676 bp, Homo sapiens
cattttttcaggtcctcacgtctcatccacatctactctgtgaaccctggcttagtctgtctgctctgcagcatctgctgtggggatcatctcacagtgaccagaatggcttctcactcttaactctataaacaaccacctttcacatatcctgctgggatcatgaaggaatacctggacacaagagccactgcacaacagccaaggaactttgagacctgccattacagaacctttcttggcctactcacactacgctgccattttattctgtttgtagtagtcctctgttgggtgtggttatcctgcaagtttttctccttttagaatgatgaacaggaagcagggcaaactcttgaagatttccagctttcagtttttgtttttgttttttaaccattatttacctgagttttcatccttgaggaggtgaagtagtcaggaccatgaagtcagacctcatgccctcttcctcctctttcctggaagaagtattcagtttccttttcctttctctggtaactcctcctttatactattcccccctcccttttttttgaggaggagggcatcacccttccagtggggaaaggtgttaagttaggagcttctactggacaatcagaacttggagattttaagaaaaggcaaaccggaattaaattggaatctctaa

SEQ ID NO: 2165 - DNA, 362 bp, Homo sapiens
cctgacactgtctgacaacgtcatcgtgaccttgaagccacgtattgaaaatgaaggagccatcttcctctggaacagtataggaagagaatggattcctgagtatcctctttaaggaacaacccaaccaagaacaatgcagtggaatttataccaacaagatacaactgtttgttgcattaaaacactgagattgggagggttgttactagagttagcatggtttggctaaatcataaaaacagtgttttttttttcatttgcatgaaacaccaacaaaatgttaaatgcagataaaatgtgttatgttgcatacttttataatatagacacaattatttttcacccgaaaaaaaaaaaaa

SEQ ID NO: 2166 - DNA, 949 bp, Homo sapiens
catttgtggcagagttctaatgccctgactatgaaacttggcaaaatcgctgctttcttaaaaaaaaaacttagacagtagagcagtgaaaaggacactgaaccagaactcatataacaacgatcctctaccttactatccatgaaggaggcaggtgactgatctcggaatcatgaccagaagcaactgtgccttgctctctttgttgcaatgtaaagataataataccacaatgttggtgggacataactgttattatgttgttcagcctgcaaagaaacaatcaatccccaaaagtcctaaagattaaatgttagctctagaaaggcttttgctttaaacaaatgaagtatattaaaatctgtatttaaacaaaaagataaatgagcaggtagttattcactttactttagaaatatctgatgtaggaaatgcattttaaaagctaacttccataaaatgttcagagtacaatttaattggcaaatattgaattcaaatgcacctatagcaaggtctgacatacaactgcattttaaaacccactgaggggctttgcatgcaatttaggctaatttgataaaggaatagtacatcaaattggacttgattgttctgaatcaactgtcggtcagtgtcatttacatgaagttggtcaaataaaaaccaaaactatctttggcttggaaagagtgagaacttcccactgctgcttaaattggaaattaaccagttggtcagcaaaatggtctcattcttgagcttgacttccatgatgagaatgaaatgtgtctcttggttctgaacccttgctttggtagctagctacacagcgaaatatgccaagtgcacactggagtgtttctgtctcttagcaccatgaatcaaagccctttctgtaaaatgctcttggaaaataaacggtggagcttcaaaaaaaaaaaaaaaa

SEQ ID NO: 2167 - DNA, 467 bp, Homo sapiens
catgaattatctctgagccaaagtgatatttggagagcaagctaggcttatgtagaatcacagagcgttgcatgaccagaaacgatctaattcttggcaagaaagactctataactcagtggatttgtcctttttctttgacatcttgaaaacctgaagtttagaagtacaactagagcaacaagcacacaatcagttcctgaaaacctacaatatctttgatggttatttttaaattttgattttattttttccaacattttattatgaacattttcgaacatgtagcaaaattagattaattttacagtgaacttcctctaggagcagggatgtccagtcttttggcttccctgggccacaatggaagaagaaaaattgtcttgggccacacataaaatatactaacgatacctgatgagctaaaaaaaataaaaatctcaaaataaatcttaaaaaaaaaaaaa

SEQ ID NO: 2168 - DNA, 784 bp, Homo sapiens
agtgggaagtcctgatgaagacactagcgctgatgagggccttcttgctgtgtcatcttgtggtggaaggtggaagggcaaagtgaggacaagaagaataaagggtggcaaattcccttttatataatgaacccactgctgtgataatgatattaatccatttactctaccctcatggcctaaccctctctgattagtccccacctcccattggggattaagtttccaacctataattttgggggaacacactgcattggggattaagtttccaacctataatgttgggggaacacactcaaatcatagcacctccaacacttacatgctaaagtcctaaactccagtatttccaaatgtgatcgtatttggagatagggttattgcaaatgtaattggttaagttaaaatgatgttattagagtgggtccccattcaatatgactggtgttattataagtagggaaattggagtgcacagacagacataaagaaaagagagacaacgtgaagatgtggagaaagctgtctacaagacaagaagagagtcttggaacagattcttgcctcacagtttttagaagaaaccaacatggctgataccttgatttcgggcctctggcttgtgaaattttgagacaatacatttctgttgtataaatcactcactctgaggtaccttgttattgtagtactagcaaattaatccagtgtgtaacatctttatattcatcatataaaatttatttaattaaaaatttgggatattttaaaaaaaaaaaaa

SEQ ID NO: 2169 - DNA, 839 bp, Homo sapiens
gaccctcttgggaaaatggaacctgttactggtctacagtgctctcagccttaatggtgagcgagaaagtttacttcctgatcttctttgcagacttcgcaataccttatctactgtactactgctcacgtgttagcacagagcatcctgtgtgcaattcctctcagagtccaaatttaagggagaaatccagctccttctgcttcctccttgccctcaatctgtctaaaattcctagcattcattaacgcatggtgttgaatttcttcttaagaacaagtcagactagatcgggcacattcaggatggtatggcagtagacagaaaaaagtcaggaaacaacagatgctggagaggatgtggagaaatagaaacacttttacactgttggtgggagtgtaaattagttccaccattgcagaagacagtgttgcgatcgctcaaggatgtagaactagaaataccatttgacccagcaatcccattaccgggtatatacccaaagggttataaatcattcaaatataaagacacatgcacacgtatgtttattgcagcactgttcacaatagcagagacttggaaccaacccaaatgtccatcaatgatagactggataaagaaaatgtggcacatactcacccatgggatactatgcagctattaaaaaggataagttcttgcctttgcagggccatggatgaagctggaaaccattttttcaaaaacccaggaacgaaaaccaaccctgccgttttcacctataagggggagcgaccatgaaacacctggccacgggggggaacatcccactggacctgtgaaggggaaaggctggc

SEQ ID NO: 2170 - DNA, 259 bp, Homo sapiens
ctgaatgaagaggaccctgaagccctaggagacaagaacagaaccacaagatggaaagagtttgggttcccagaaggtggcccaccaactgtcaatatctgtgttggatgttcacctgaatgaaaaaacttttattgtattgaaccactggagtttgggaatttgttacagctgctagcattaccttgtttattttgttgttggtaaactggtaaatctataactaataaataacaggaacatacgaaaaaaaaaaaaa

SEQ ID NO: 2171 - DNA, 304 bp, Homo sapiens
taggcatgaaaacagccctggaagtctgccctggcgcctgcactgagactaatccaggtcactttagggaaactgcccagctctggcaccgcactgtgtgtctgtcagctctgtggggtgctatggcctcattttcccactagaggacactgtggctccaggacttcatgtagcgcccagccagtcttgctactccagcacctctaaggaggcaaagcctttagtgtgcatttattaggtaccaactgggtgctttctgtatcaagcagagaaataaaagaggtcaaacacaaaaaaaaaaaaa

SEQ ID NO: 2172 - DNA, 327 bp, Homo sapiens
tcttgttgtaatatagttatcttcctcgtagaatagtaagaaagcacacagctatgagtttagcctacaattaacgttaaatccccaactcaaatttacttcaacaatgggaaaattgattatcctacataagaagtctggagcttgggtgggctccaagaagtataatcaatgtttatgccgaaaggggcccaagtcctttctacctctccattcagccattgttcatgtgttggctttattcccaggctggttcccttcatgggaacaaaaattctatagtggtttttgtcataaaaatgccaagagaaaacaaaaaaaaaaaaa

SEQ ID NO: 2173 - DNA, 399 bp, Homo sapiens
cttggacacaattggagaaactggttattttatcaagactttgactggaatggtgtgctttcccttggaatcaaacttgacttctggaaccaagatagccccttggaaaaattggcctcttacctttatctacacagcccctgtacagggttcctgatctgtgccttaatttccatcaacaaaatggcatagctgacaggatttcagagtgacctccctggactacctagacctgcttccaacctttgtgcatgtgccagcacaaaatccattgtgttcctggacttagatgcccctgctgagtgctacagatgagttcctcctgaaatcaatgaagttcctgtcttggttgatgttctggtttattaaagctggtttcctccttgaaaaaaaaaaaaa

SEQ ID NO: 2174 - DNA, 855 bp, Homo sapiens
ctttatgcgcaatcacatggagccttctcctgatgtcctgatggcggaatcccattttgttacaccgtgggtggagagagcagatgccccagtgcctccttgcagctttggacacaacgtgcagatggcatcattatctcttttacatcttggatggattgctgggaaggacattctgttaaatagttattttaaaagatcatttgggaacttatgacttttttttttgctatttccttatatattttatgactgacatatattgttatttttaatttttttctgagttcattcccttagtttatcatgttaaatttctctaaagagtagtagttttctttcatttattcagaatattatattttcatatagagggagatccagcacccataaaacattagaaacactcaaaaggtaatttacatattgttttttaagatttttaatattattgaaaatacattgtggtcattttattgtccatcacaaatgaataaactcatacacaaatatatgataataaaaaatgctctacatgcctatcgatatttcttcacacagcggtgccctgaaatctataactcgcaatttaacaagtaatcaccgcaatctattaaacaaaggccctcctatctccctcagaggcgatctttccgaccttttccttttatgggggggtatatctctgtacccccccccttacactcccgtccctgcgtctcttggttgtgctgtgagttgttttcctctctttagcggtgtattcctttttacctcaatctcgcgggtaataccagagaaaatctcgtcctaatagcctttaaggtccctaacctttataagtcctttgttttt

SEQ ID NO: 2175 - DNA, 142 bp, Homo sapiens
cttgtgctgcacatatgccaggagctgattcagtggtttcatccaaatgtaaagcaaaatatggaattatttcaacatataataataactactgttacacttatgtaaggcaataaaaatatttttggcaaaaaaaaaaaaa

SEQ ID NO: 2176 - DNA, 662 bp, Homo sapiens
atgctagactgatcttctacaactaaagatcatgtttgaacttctattttttgcatgtggatctgaagactggaaagagtcttcataaaactgtagagcatcttttcatcagagctggttatcacatcaagacaaagtgggaccaaactgctactgtgcttattgtggaagaactggttttctgctgattgcaaaagctcaggacagagctgtggaaagtagtgaggcagccacgagtacttatgcaacattggttcattagttgatgacatggctgatgatgacatgtagccttgcacacacaggtgtttgagtgctacagtctgccctttatttctggtaacagttgcttcttgtaagagctgtcattactgacagattttcatgctgtgagggtcaacatacagctcttggggtggaaccagagggccaaagaccccaacagctccacctcactcttgctgagctgcatagagctgtgaccagcagaaacacggggacaggtggtgcaggaggcagtcaaccagatcgagctgcaagttccaatgccaccatgaactcattgtattgtcttagactaactaatcgttgtacattttgataccctcatttgtaaagtagaaaataataatacctgtattggcaaaaaaaaaaaaaaaaaa

SEQ ID NO: 2177 - DNA, 504 bp, Homo sapiens
ctgatcagttgtggaattacgttcttacaggaatgcaaatcctgctgtgaactgcacatatgagggatctaggttgcatacttgttatgagaatctgatgcctgatgatctgtcactgtgtcccatcacccctagatgggactgtctagttccagaaaaacaagctctgggctctcactgattctacattatgggtctggctctgtcgtccacaatggaatgcaatggtgcaaacatggctcactgcagctttgacctcctaggctcaagcagtcctccttaccaagcatcagcctaccaagcagctgggaccacaggcatgtaccgctatgcccagctaacttttaaatattttttataaacaaggtcttgccatgctgtacattcctgggctcaagtgatcctcccaccttaacctcccaaactgttgggcttacaggcatgaatcatgctaactggcttcatccttctattaaacaatccattaattcaaaaaaaaaaaaa

SEQ ID NO: 2178 - DNA, 643 bp, Homo sapiens
cttaagctatatttcatttttctcatttagcaaatcttgcactgtgaattggcagagagaagacacagtcacatgttgggaaggaaaatgtttcattaccgcatatgttatgatctgagatgaatcatgtcgaccggagtgataccttgtgctgtacataataatcagacttaacaataaaaaaacaggcagggtctcctgttttcttgtatctgtacataaaatgactctggggttataattaagtgatgttttaaaggcttaagtataaagatacgagtctcaggtataacaatttaatatgattttgttcacttgttcattttgaataagaataatattgttaaagggaaatgtgtaaaatactgttattttaacataacagggaaataaccagacaaattagctttttacttaactacccacaacaattttctggaattggtatttagtaatatttatgcaaggctacagacatttcgaaatgtcttacagcttctccaacagcttgctcttctggccatgaactatggcttactacccttaactataatgccattcaaaactgttcctgggcccaatttcttagaaaaatatgcaagcgttttctaaaataaaatgttaataagtaaaaaaaaaaaaa

SEQ ID NO: 2179 - DNA, 821 bp, Homo sapiens
gagcgtgtctcgccttcacttgatccgcaattacaccttcttactgttctatactaccagaaagcctcttgtcaacagccagcgacaaagtgaggttctcagtccagtagcttgtgagaaactgtatcatgctagcaaccatggagtgaaattggaagtggatgctacttcagttgaatgttgagatgactgcaccctgggctgacaccgtaataacagtctcatgaagactctgaggcaaaggacccacctagatgaactgtgcctgaattcgttgactacaaaaactgtattaagaaccacacacagctgacttgttctgctctcataatgacttgactttggttattgaaaatagctagagttaaaggatattccgactccctattcatatccagctatcactaaaccccttttttcgtctagatttaacattgactcaatcctctcagagaaatatctttgttttaaagaatgaaaatcctactccccacagattcttatcctttaacagagactctcatcaccgctctaccccaattaacaaaaactacttactctctctactggacttaagcgtttatctatctagtcaaccccatcatcatagggctcccccctgctcttactaaataacttaatatataagctcaactactgttccacgctctcccgtcatatcacttggccgtactacgttctcccctcaaaacttgcctaatcacaaactatcccttatatacacgcacaattgtgtcgaaacccccacactggaccctctgccgcgtcatctaggacctggtcataaatcaatgtcaaat

SEQ ID NO: 2180 - DNA, 902 bp, Homo sapiens
aggttataaagactgtgacttctgccttgctgatattctctctccctgggtcatctcctgtgcttgctttgatggaaagacctaccaggaaagcctcttgcaaacagccagcaacaaagtgaggttctcagtccagtagcttgtgagaaactgtatcatgctagcaaccatggagtgaaattggaagtggatgctacttcagttgaatgttgagatgactgcagcctgggctgacaccgtaataacagtctcatgaagactctgaggcagaggacccacctagatgaactgtgcctgaattcttgacctacaaaaactgtgagatattaaatatgcatcatttcaagttgctaagttttgcattaacatgttatgcagcaacagataactaacacaacagtgtttatcttttgtataataagcaaaactaaaaaaactttttttttaaataagaaagatacaatgggaaggataaattagcagcaaaaagtcaagatgtatttgaaaaattattatgaagtggattgaaactgcatgacctgattgtccttaatgatgcccaagtatacaaatgtattttattttagcatagcctcataaactcatagtatgaattttcattacaaatttggctggaaattagtaattccaatttataataattctttgaaatatggatatttttgatattttattggtgagaattttggccatcaactctatgaaacattttgctctatgaaccattttgttttgcaggtattctgaaccacagaaggctgacttgttctgcttcataatgacatgactttggtcattgaaaaatgcttgaactaaaggaagtcccgagcccctatttatattcaactttaacaaacccctttttggcgaatttaacaggg

SEQ ID NO: 2181 - DNA, 327 bp, Homo sapiens
catggttaaccaggaaagtgaaactgtaattatcagaatgacatttgaggccatagagaaatactcactgatgaagaaccagaagaaatattatcttcaaaaagatgatgagagagagagaaaccaggaagtttgactctccctaaatcggcttcatgttccaagcatcaaaacattcagctgatttactctcttaatatgattcagcctacggaattatatgttaccaaatatagcacaaatcatgcatatatatatttctgtgctaggctatttaccaaaaaaaaaataaaaaattttgtcattactaaaaaaaaaaaaaaaaaa

SEQ ID NO: 2182 - DNA, 269 bp, Homo sapiens
attaaaaaaaatggaaaagtagaactgtagaatatccaagattatacaatgtgatgaaacttggatttacttgtgtggttgctgatttttaagtccatgatatcccaatagatcaccccaaattaaaggattaaacaagagagcccataaaaacaagagcagagaggagattaatcttcaaatatccccagaagataaaataaaatattgatgtttcacagaataaaaaataaaaccaaatagttctttccctattaaaaaaaaaaaaa

SEQ ID NO: 2183 - DNA, 216 bp, Homo sapiens
ttcagttccaatcatctatcctgaagttcttaccatccaaaaagaattcatcggcttgccttgatttccccagataaaagggaccccttccttctctgacccacgaagacactctgtactgctcacatcagctgtatatggctttgtattgtggtatatgttacctagctcccctattggctattaaacacttaagaatgaggaaaaaaaaaaaaa

SEQ ID NO: 2184 - DNA, 304 bp, Homo sapiens
cttggaaatcagggcctttaaaaactctcttaaataatgaagttaaccaggaagcacgtactacagctaccacttgcggggaacaagccgtaggatgaagccaagactgtactgcgaaagagagatgcggcaaactttggtcctagatgacgatgctgagctttcggattaaccaactctgaaggctgccctaattttggatttcagttatgttttttattcccaaaccactacattacatcatctctaataatgactgagggcaacataaatatagtgacactctggagcaaaaaaaaaaaaa

SEQ ID NO: 2185 - DNA, 340 bp, Homo sapiens
ctgacatggacctgattcccaaatgtgcattggccagcgtgcaagcctgaggaaggaagccacaccatgaggacagtgaggcctgatccttgatgatgtctgtccttgaactagccatccacagagtgctcccatacatccccttatatgagcaatgtaaacctgttttaatgtaattcttctcaaatcctccacatggctatgtttcactattttctttgagtggtggctaaacagaatataatttttatagagtttattattttaaaatatgttcaattaaaactcaattataagacaaagaatccaaataaaatatttgaacctaaaaaaaaaaaaa

SEQ ID NO: 2186 - DNA, 897 bp, Homo sapiens
aggtgacaaaaggccatgcttcttcctccattttgagatgttaaatttggagaaagtctctccaagaaaaccgaccactctgacaccaccatgctcaagagacccatgtttcctgtctagtgcctttctcctggggtgaaaaaataacctaagcaagtccattaagaggaatagctggattcttgcaggaaaaccagaaaagaggctccctcttcttgctgaatttaagtctggaaaatgtatgactgaaagcggcagccattggccaccataagcctgagaacaaagccagcatagacaaggaagaactgagagaagaaattgcttcttgatgacattgcattttcattttcattttcattacaatattattaaaagagacaatgcatttacttttttaaaattaggtaatttttgaattattatttcctaaaatgcatttaattggaatagttcttaatggcttctcgtcttctcagtctacctgaagattcactgaatctatggcaaaaatacatacgtaggctcacagtttgtctaagtacttaaaaattacaaatcaagctaaaagctgtcaaataaaatttccccccatatttgccaaatatgccttcataaagatgaaattaaaaacataaagctgtttttatatgaccgaaaataattgaaatatcagacagaatttaagtattattttaaaagtatggctattcttctgatgggctggtgaaatttggacagttagcaaaaaagatatatattaattactaaagtattatttctttattcaatataaattacttttctgtttcgtattttagacaaaatactaaagtactataggtggatttgtacataattttaattctaatggcaaggctgacctaagggtaaaat

SEQ ID NO: 2187 - DNA, 808 bp, Homo sapiens
atggattcatcctaggatgaatggttcccagatcagcatcaacattgcctggtaacttcttggaaatgcaaattatggaatcacattccagatctactgaatcagaaacttgcaggggagctagcggagaaacccaattaatcctgaagagtgggatttatcctctagagaaatcttcattgaaaatccttacagtaatcattgtctactagtaaaatatttctgagtttgcaatcttcgtgaagtttgtgtactatccctaacatgtgacactgtatattagttgtttcatatatgtcaagcctatttctctagaatcaattgtaaagtatctaatcataaaatttgtgtttttatgttagcctagcacagggctgggccaaactgtgtcaaataatgttgtcttgattttctcttcattgtgaagagaaaaaaaaatggaattgcattacattttcttttgatacaattgaacattgagggcatattgtatttcatgtatttgctgaatccaggcgtacatttactcaacagcattggaaataaacaacaataaaactttggagctattatctgcctttattaccaataatttgacacaaaattgcgttggattgttttgcaggattggaacaaagaaacatatttttttcttatcaatttttttccagaatttcttataccaaacattaaaattacctcccaaaagtgaattatttttactacctgcttgacctgttttgttactgggaattcgaaaggcgagcactttagtggcggtggatgtgcatccttaggcgggtggggg

SEQ ID NO: 2188 - DNA, 349 bp, Homo sapiens
catttttttttacatgtacattacatatggagaaagagtgctgggattcttcaaattcaaacatggatatagtttctaccttcattggactgatagagcagtgaagaaagcaaatatttaacaatgattactcatgcaaccattaaaagggtaatgtgactcttacaaaaatgaaatatttaatttgatcacaaacagtatttatttatttcttaagtgaacgaatcatagttactgtgtctcaccattgtacacaatatggaataaaattataactgtagataaattagtaatgcagcattatgagtcttttctaataaactgttatttaaattgaaaaaaaaaaaaa

SEQ ID NO: 2189 - DNA, 803 bp, Homo sapiens
cctaggatggacagaaggacgacctgtgaacttttctcgttaggaaagactcggggactgaggtgactgtcagtctcagaacagccatatctgagacgaggaccaaggaccaaagaccaagtagctctgtctgagacaaggacaacctccagaacagtgtgtaccttctttctgtgtggaactgccaattcttctacatggattaatcccaaggagtagtttctctgctcattctccaccagacagtagctcttcattaggatgccttgatactctgatgtggtgccaccacatcctcccaaagcaagtctcttccctctggcagcagagaagcggattttctgctcaacctgctttgatcaccaaatgagtcagggagaagaacatggatggaaatattctcagtcaagaacttcacaagcaccagttgctttaaccaggggctctagaaattttctagaataaatgcttctcaatttgtaaaaaacaaaccaactacaacaacccaccactcgcacattctcaccaatcaatcacctataaccaaaccacaacacaacgatctttttactctctcccgcccccccacacgaccacgtctccccaccttgctccgttctcccctccatttcttttttccgttgtgcttgtgcgcgccctctccaccacctcacaccactttaatccgtcttgtctttgtccttctccccgccccttcccgtcctcctcatcccccactcctccttccctcctcttcccaatgcgctcattctcgccgctggcgctatgccttcccgccctct

SEQ ID NO: 2190 - DNA, 542 bp, Homo sapiens
ctgatgggacaaggcgacctgcttacttttcttgtcaggaaagactcggggactgaggtgactgtcagtctcagaacagccatatctgagacgaggaccaaggaccaaagaccaagtagctctgtctgagacaaggacaacctccagaacagatttccacattgctttctttccgtttccatgacttagacaacaatggcatctgtgtgtaccttctttctgtgtggaactgccaattcttctacatggattaatcccaaggagtagtttctctgcacattctccaccagacagtagctcttcattaggatgccttgatactctgatgtggtgccaccacatcctcccaaagcaagtctcttccctctggcagcagagaagcggattttctgctcaacctgctttgatcaccaaatgagtcagggagaagaacatggatggaaatatcctcagtcaagaacttcacaagcaccagttgctttaaccaggggctctagaaattttctagagtaaatgcttctcaatttgtaaaaaaaaaaaaa

SEQ ID NO: 2191 - DNA, 345 bp, Homo sapiens
ctttgatgggacaaggacgacctgtgtacttttcttgttaggaaagactcggggactgaggtgactgtcagtctcagaacagccatatctgagacgaggaccaaggaccaaagaccaagtagctctgtctgagacaaggacaacctccagaacagcctcccaaagcaagtctcttccctctggcagcagagaagcggattttctgctcaacctgctttgatcaccaaatgagtcagggagaagaacatggatggaaatatcctcagtcaagaacttcacaagcaccagttgctttaaccaggggctctagaaattttctagaataaatgcttctcaatttgtaaa

SEQ ID NO: 2192 - DNA, 370 bp, Homo sapiens
ctatcacgtttttattctccaccaatcataaaacgcccaacaccaccctatttagtgcggtcctctccagcgtaccgttcagtcaatcaagttaacactgggtgtcatcagtatgtacagcatgtaaggactacagtattgatgcactcactcagccatggggagcactgcacaaaatcactcaacatggcaggaatcatttatttctgtgaagggaatcagtcctaatcttggaaaccttgcagcacttggcttctgtctgcttgactttgggcattaaccttcagaatacgaacatgacagattctagcaaatccaggaaaaaaatgaatataagaataaatctgtccaaatgggaaaaaaaaaaaaa

SEQ ID NO: 2193 - DNA, 611 bp, Homo sapiens
cataggtcttatttttttctactcatgagccaagatgcagagagtatttctgcagtcagaggagagatggtccttacaaattttgcaattggaaggatgaggcaaaatgaggccaaagatgaaaaaaccaaggcctggataactaattcacagccacacaagtatttagtcgcaaaaaatggtaatagcatgcagctctctctgttcagtgcccttttcaggatgtgaagaaagatatctgtataaatatgagaagtccttcccaaataagtaaagtaactggcataactgaggagctctttggcaaatctactctgtataccaactcaagaaaaacagggaaaaaaccccaatctgttctttctcattgtgtgccaataaaaagtcaccagatctttctgaacctcactttcctcttctgttaaacttaaaaaaaaatacataaaagtaaataaaaatataactttacttgtctcaaaagagtttaagaattaaggatgataacaatataatggcttgacatgtaggaagtgatcatatacagcattaattatttttccttctgcccctcaaaatatgttttggggtttgaattactaaaaaaaaaaaaa

SEQ ID NO: 2194 - DNA, 277 bp, Homo sapiens
tcggaaaggagaaagccatgtgaaggcagaggcagagacagagactggagcgatgggtctacaagccaaaaacaccaagaattgctgacagccaccagaagctgggaaagtggcatgaggcagattctctcctggagcctcccgaacaaacctgcactactgacaccttggtttgggacttctggcctccagaactgtgagaaaatttctgttgctataaaccaagtgtgtggtaatttgttatagcagcccaaataaatgcatctactgtacaaga

SEQ ID NO: 2195 - DNA, 221 bp, Homo sapiens
gctggtgtcacgttttggccaatctagtggaaatcagaaagccagtgactccattgctgctatccataaagtttagcttcctgaggcacagaacatgctaccaaagggtggagagtaaatttggaaaagcgaatggaatgcagcacagttcctatgctgaaagatgatatgctttatgcttaaaagattattaaacacataaacttccaaaaaaaaaaaaa

SEQ ID NO: 2196 - DNA, 274 bp, Homo sapiens
agtacatttgctcttggatcccatccaccacgctgtgaggaagccaaattacctcatgaagatgccctcaaggagctgaaccaaaggctctggcccatagccttacggatctccaagttgaaagtcagcaccaacctgctagtcataagagtgagtcatcttgacagtagatcctccagcctccaacagatgccctgtggagcagagaggagtcattcctatcaaaccctgaaaaattctagatctctaataaaataaattattgatactaaaa

SEQ ID NO: 2197 - DNA, 118 bp, Homo sapiens
ctgatttagcagcattcacagtcaaggactgtcacggaccgtcatgatgtcattatttcctagcccctagagaaggatctgtgctaattaaacacatttaatgggaaaaaaaaaaaaa

SEQ ID NO: 2198 - DNA, 921 bp, Homo sapiens
tcaggctcatgggcagaagggactagccttgcctcagatgagactcgggactttgaacctttgagttaatgctggaatgagttaagactttgaaggactcttgggaattcatgattgtattctgaaatatgagaaaaagaggccatccatgaccctccccacaatacagtaggcctgaacaagatgttgaccctgtacattgaagataacagcaaccagtgtatacacatgttaaacttcatcacaaccaaaacaatgagtgtattcatcatccagaagtttcctcaagcccctttgtaatccttcacccttgcctctcattgtgtcattctcgatgcccaggtaaaaactgatctgctttctgacaccattgcttagttttcattttcaagaactacatctatgtcaagtcatacagtatacattatgcttatctttttaaaactagtatgattatgttgttgtattagcagttcattcatttacattgttgagtaatgttcttctgcatggatataccacagtttctttatatgttcacctgtttaaggacatttgattggtttcagtcttgggttaatgcaaatataaccattcttgacaattttggataaggcctttggatagaaatatgcttacattctttttggagtaatacctaggaggggagtgcctgaacatatagcagcgggatggggacatataagcaccatggggaacgggtttccaaggggctctgccatttggataaaaacaaaagaaaagagggccggcgttgctacttattgctacaactgggcgggccagactttcgaccctccttttggggggagggaacaatttgggaatgggcactcctcaggacaggaggtgtctcaatctctcactccgagagaaggtctcgcggctagggcgcggagg

SEQ ID NO: 2199 - DNA, 842 bp, Homo sapiens
ctggctcatgggcagaagggactagccttgcctcagatgagactcgggactttgaacctttgagttaatgctggaatgagttaagactttgaaggactcttgggaattcatgattgtattctgaaatgtgagaagaacataatatttggaagggatgagaaaaagaggccatccatgaccctccccacaatacagtagacctgaacaagatgttgaccctgtacattgaagataacagcagccagtgtatacacatgttaaacttcatcacaaccaaaacaatgagtgtattcatcatccagaagtttcctcaagcccctttgtaatccttcacccttgcctctcattgtgtcattctcgatgcccaggtaaaaactgatctgctttctgacaccattgcttagttttcattttcaagaactacatctatgtcaagtcatacagtatacattatgcttatctttttaaaactagtatgattatgttgttgtattagcagttcattcatttacattgttgagtaatgttcttctgcatggatataccacagtttctttatatgttcacctgttttaacgacattcgattgttttcagacttggggtaatgcacatataaccattcttgcgcatttttgtataagtctttgtatagacatatgcgtacattttttttgagtaaatacctaggagtggagtggctgaatcatatagtaggcgtatgtgtaacatataagtaacattgtaaaactgttttccaaagtgctcctgccattttggctaaaaatcaaagaataagaagggtctgctttgtctacattattgctaatatttggtatgggc

SEQ ID NO: 2200 - DNA, 182 bp, Homo sapiens
atttttggctttactacattgatcttacatcttccttctcccaacttggaaacctggttttcgatgatatcagcataaatacccattttcttgatcctataatagcaatatacacaataatgttaatatggcaatagctacactcctacttataatatgattactaaaacaaacaaacaaaa

SEQ ID NO: 2201 - DNA, 854 bp, Homo sapiens
  misc_feature (1)...(854): n = A,T,C or G
ctttgaaaaacactgcataaacatggtatccaaagagaggaagcagagacatgatgcaccaactactactttagtaattgaagagagagagaagagcctgaagtcattcaataattagatcaaataatttactaatggatcatttgtcttcccttccaatcttccttagcaagttggctaattgctccatggtcacaagatagctgctgaatctctagaaatcattcccaagtcccattcaggaagaaactaaaagggtgcattggctttttctgtttccctcttctcagaactctctcagcagactttcacttacgtgttatatagtccagaactggatggcatggctccccaccgtgtgcaagggagattcaacaggatttggtttttcagcctctgttgggagagaccaagagacagaaggagactgggtaacactgtccaccgtaaccacttagtatagtgataactctgggcaaatattaattactactgggctagttgaaagtttctgggaagcaaatcagttgctaagcacatgctctatgagaacccatantataaataagaagaagaaaaaagaaggtttaaatgttggcttacttagaggaatgcctagtttcttctctatcactgtggtaaccactaggttacaactgttacccttttctcacagaaagacaattccaaaacagacctccaatgaaaatgctacacaaataatgggattaattgggtaccatttctactcttctcatcatgttttacaagcagttgaaataatatgtgcccctcccagtcccttttagtatttgtcagtagaatagagtgtcaaaaacgacttaccatgccta

SEQ ID NO: 2202 - DNA, 803 bp, Homo sapiens
catggaaaaacactgcataaacatggcatccaaagagaggaagcagagacatgatgcaccaactactactttagtaattgaagagagagagaagagcctgaagtcattcaataattagatcaaataatttactaatggatcatttgtcttcccttccaatgtaagtttaaattcttattacagagagggacaagggaattgtggaaaaaacacaaagaatttgagactcctagaacctaaatattggcccaactacaagtaccagaaaatcaaaattccaatacattgaacaaacaggagttcatctttttctccaggtaggtaggcaagtatagagctccatggcaacatcaatgactcaggatccttttatctttctattccagcttccttagcaagttggctaattgctccatggtcacaagatagctgctgaatctctagaaatcattcccaagtcccattcaggaagaaaataaaagggtgcattggctttttctgtttccctcttctcagaactctctcagcagactttcacttacgtgttatatagtccagaactggatggcatggctccccaccgtgtgcaagggagattcaacaggatttggtttttcaacctctgttgggagagaccaagagacagaaggagactgggtaacactgtccaccgtaaccacttaatatagtgataactctgggcaaatattaattactactgggctagttgaaagtttctgggaagcaaatcagttgctaacccatgctctttgagaaccttattataattaaaaaaaaaaaaa

SEQ ID NO: 2203 - DNA, 773 bp, Homo sapiens
atgggaagctttacaccacattttgtttcctgacaagagaaggagaaatcgttggcctctgcgtgacatggagggtccccccacctgcaagcttttgtgtttgctggatcttggacagtaccctggcgaaaagcattcggcaagattatccggctagcacagctttcaaggaataaatatctaacaccttgttcccttttgcggttcaaaagccactgtcactggggtacataggcagttttaaaaaaggctacaattcatatgcaaactagagggggatttccatgatttcataataaaatgttgaaacgctttgatctggagttgtaaggaggtgtgaaacagtgcctccgaaacagacagatatttgcgtaatcatcctttatgtattgccagcgcggaataataacatatcaaagccccaacctacctcatgtgcgctggacgggcaagccgtagataatgggaaacacgggaattactattactcactctccgacaggcatagcgcgtcctgcaacgtttatcacccgcggccccaacatcactgatgccattacccccgatcaaagtccatacgccgtatccatcgcccgtccgtcctcccccatgtccgatcttcaccctactatctcgccccgaccgccgtcccccctcgatctccccgaccccccgatcccggaccgccccgtccccgcagatcgtggcccattcacgtcaccgcccccgacgctaatgccgacagaaccacaaccccccacccgcgatgctct

SEQ ID NO: 2204 - DNA, 336 bp, Homo sapiens
atttcaacatctgcctgagaaaattctaaatctttgatgactccacaagaaaaacatcagccagccacagtgcaaacaagctctattgcaatctggttcatgtgctgggaaataaaaatggtttctaccttaacgaaaaaaagaaaaggaattcagcctagaacacaggaatacaggaatgacattttcactttgaacaactgacgagaagctagcattaccttaactagcttttatttgcatttcttttaatttttcacttttcttcacgacaaagagattggtggttttaaaaataaattggtttaaggcttaagaaacagaaaaaaaaaaaaa

SEQ ID NO: 2205 - DNA, 299 bp, Homo sapiens
caggactaagataacaagtgcattccagtataatttgagaatgagaactccgctggcaaaagactgaatctaatatagtaaatattaatgtattatacatttcaaaatcaataagagtaaatttcaaatgttttcaaccacaaaaggtattagatgatggatatgttaattagcttgatttaattattctgcattataatcatgaatcgtaacatcactttgtgcctcataaatatatacagctgtaatttgtcaattagcaattaaaataaaaatttaagataataaaaaaaaaaaaa

SEQ ID NO: 2206 - DNA, 362 bp, Homo sapiens
ttctgaggggtgctggctggatatctgatagaattttcctcatttggatctgcctgatggttttctcatggttagactggtgttatgtatgggcttggagtactaaaccatggagtacccttgaagcaaatcattcagtggaacccaccctaaagaggaagaagttaagttcaagatttaggaaatattgattcaagactttgactttcttgtctcacttgccagatggccttggataaatctgtttcctttttgaaattgatttttctcatccatgaatgaagctataaatattcagctgtctgttgtaaaatatcacagaggataataaaatatagattctttggtcaaaaaaaaaaaaa

SEQ ID NO: 2207 - DNA, 333 bp, Homo sapiens
cattaagatagcaaagccttcatactctacttgactccgggaaggattgtgtcacagagtaaaagaagaaattgcttatagactacaaaggctaacatggagatagaagaaccacatggagcttggaaaatgggaatctcagtaataacataatggctgtgagtctgcaggggtgtcctccagtgcttttgttcttgttaaatccccaaggacctttgaaggatagtggggaggggaatcctccaaatacctaagattaaatttcctactggcttggtaggatggaacttgtaaatgaaattaaatttatttatattaaaaaaaaaaaaaaaa

SEQ ID NO: 2208 - DNA, 275 bp, Homo sapiens
gctttgccgatacccaaatatatcctatgaagattaacgcttcaacatacgaattttagaggacacaattcagtccacagcaacgatgcatagaagacaaggcaatatgaagtgagaacagaggtatttgaagctgtcagccttcaagactggagtgatgcagtgacaagccgaggccaccagaaactggaagaagcaaggaaggatcctctcctggccttcagaactttgacagaataaagtttttttttttttaagctgcaaaaaaaaaaaaa

SEQ ID NO: 2209 - DNA, 486 bp, Homo sapiens
cctggtgctactggccaacctactgacaaccctacaacaaccaagggcctagtctcccttctgttttaagcccatcaagcaagaacaaaagggatataaacacttcctgttccattggaagtaagcctggaatgaagtcccaattccatgccgaggaaccagtgagccccaaaataaagcgatgtctccatatcacatcttgaatcacctccatttccaaccagattcagaatccaatgctcagggataagggagagcgtccagtagtttccactggcctcccttccgtttctcccttattgtctgtccctccaccaggggtatggcctataccagcttgtgaagagctggtggctaaacgttcaggaattttcagaggcgattgttaaatatagttattaaacaattaaatgatgtaacccttccactacataaactatattaaaacaaaggtaataaatacccaaaactctaaaaaaaaaaaaa

SEQ ID NO: 2210 - DNA, 294 bp, Homo sapiens
  misc_feature (1)...(294): n = A,T,C or G
ctagactcacatgggagaccgtttanggggtggcatggaaagctccaggaacttctactctgttcaagtgaccagtaattcacacgcaagaaatgcagcctcgtgaatggggtcatgaccagtaccaggaaaacaagtgctgctgatctcccgtctcagttggacatgcaaatccagagcttaaagtagaagtcagaactgactggagatattaatttggaggtaatcaaccatgtgtaacataccacatattagaataaagttttctccccttctacttgaaaaaaaaaaaaa

SEQ ID NO: 2211 - DNA, 349 bp, Homo sapiens
attgttccagcagttgcagaaatgctcaccaggatctgcagaacacattgcaagacaaggagagctgggaggactcagaccctgacctcatccaaaagtgaaaaaccaatcctgccaaagtgaatgtattttctctccccaaaggcagacttgagacccccagcttcagggtggcttctgcctgacttccagagctccagccagtgccttttgtctgaaacctccatgtccaggacccttgggcggagaagaatctgctggacactgcttggggctggaccctgagagcgctcacatttgacaccccagaaagcaaataaaacagttgaaatatgtaaaaaaaaaaaaa

SEQ ID NO: 2212 - DNA, 404 bp, Homo sapiens
catataaagaagctgaagtcacgaaggaaaaacaaatcctgtcacagtctcatgggacggggtaggaactagaaccaacgactcatccagagttcatattaactccgaactgttgccaccatttacagagactcataggagaagccgcttgctctacagtgtgaggattgcaagctgtgctaggattcaagctcagagtccctgagcctttgtctcctgttctttcctgtgtgcttatgtggtcagtccactttccttctccgacatgaaggcttggcccattccaagtctcctttggaagaaaatgggtaaactatgaatgccattgtttaacactgtcaattggaatattaaaatgtttctttcattagaaaaaaacttttgtcaatttaaaaaaaaaaaaa

SEQ ID NO: 2213 - DNA, 570 bp, Homo sapiens
catgggcgtctacttcaggaatttcgtttcttgatatccatgatgaagtcagatgatatttaagaaaccctactgatcctgacctggccaacttagatgtctgcctttcttttctgcatgaaaccattaagactcagagagtgataattagtgatgaagctgtaactaaagtctggactcctagaacagtgtactttcattaattcagaaatggtctagaatggcttcataaacagcaagctgagggcacattcaaaattacaacttacatgagtggtattaatatgtatggaatagatcttgatgccttgatccaaaggtactgacttgccatttgaataaaaggggaaatctgatggttagagagggtaacatatatcccaactccttttccccttgatggaagaagttaggtctcttccttactacaaactatgctgtaaactcttaactatttctggtgccatcaagtgattaaagattgatttgcttgtagtgaaagcatcctaattgaataataatccagttatgataaacaataaataaccaatattgtcaaaaaaaaaaaaa

SEQ ID NO: 2214 - DNA, 651 bp, Homo sapiens
ctaggactgagtgcaggggcaccttatgctatgtgtaggagaaacatctgcctctgcccaggtccaactctggagtttctggagtcaagagaacgcttgagcattggcttaatgaagatcgacagtatctaagcatgcttgtataagtctgtgtatacagacagacgtatgtgtcattgttcctgcactttacagaatgcattttggtattaaacatgttaccacatgtttaaaggtagacatgattctaactcactacactcccacctacctgacttttatccatgacagctgcgaacatacgaaccatatgagtttatctatgactatcacatatacatacaccaggctatttagaataaaacttggatctacatatggacgtaatctttaactatgggcaagcacatgatttaaataagatgtctctttaaaaatcggtcgtaatggacaagatagcgtataaagatcatgtgcaggatgctgttcggaaaaacactacttcaatcgattatgccagattgaccttgtgaactatctgcctacttagtgccgttacctcattgacagataaatatgttgaagagcttcgttgactccatccccaaatcaactatgaatattgcaatcgattaatgttatgtagccctc

SEQ ID NO: 2215 - DNA, 228 bp, Homo sapiens
cctagacccaagaaatatattctgaaatgcaattcaaggctaatgtaacaacaaggttacaaatctgagcatatatgtcagaacagaaaagttacagttctcatggtaacattatatcatcagcattatactgcctgcacaataaaatacgtatttagaaacctaactggtaatttaaaataccacatgttatatatattaaatgaggataagttaaaaaaaaaaaaa

SEQ ID NO: 2216 - DNA, 424 bp, Homo sapiens
ctaggtgtctttctgcatttctgaagcggtccctgtaagactaaaatttgtattcctcaataattgaattgaacttggtgaggacacaatctaaatattatgtgctgattaaatagagatcacatttaggggtgtggaataagcatgtaatacaaaattgtttatacaacttaattaaaattttttaaaaagtataaattaaatatgagaaattatctccataaagattcaggcccactgaatttaaaatttactttgtgtgtgtatatatacacacacacacatatatacacacacataacatatatatacacatatatatacacacacatatgcatatacaccaaagtacgttttagaagaattttataaatatcagtataataaaactttaaacaaagtttttgtatgaaaaaaaaaaaaa

SEQ ID NO: 2217 - DNA, 151 bp, Homo sapiens
aaaaacaatgcctgtctttgtctgactcaaaaagcatgctggtaatttgcatatgagatatattttattaagatgtttttatatttgaaagctatgtcatctcggtattgtctaagaaatacagttcacgatttatggaaaaaaaaaaaaa

SEQ ID NO: 2218 - DNA, 170 bp, Homo sapiens
taggagttaccaatcccccttgaggaggctgtagcaatttccagcgagctgcaaatttgggtgccagagtatctgctggggtgtgggaagaaaatgttagatttctacttatactcatttctcaacaaaaataaaagagaaattgtgatttattaaaaaaaaaaaaaaaa

SEQ ID NO: 2219 - DNA, 292 bp, Homo sapiens
  misc_feature (1)...(292): n = A,T,C or G
ggctttgggaggtaaagtcatgaggatggagccaccatgaatgggattagtgtccttacaaaagtgaccctggagagctctctagccttctttctgccacacaaggacatcaaaagaagtccaaagtctgcaacctggaagagaactctcaccagaacctgaccttgctgacatcctgaccttgaactgctaatctccaaaactgtgcaaaataaacatatggcctcgttggcctcagcggggagtagngatagtccaaaggcctcgtggcctcagcggtggagctctgcgg

SEQ ID NO: 2220 - DNA, 236 bp, Homo sapiens
cctagggtctaagaaaggaggcccatggtactcgccccagccctgagaaaagaagattcttcaactatggctccaggacaagttcagaggtcacctgggagttgaccttcgaaagttgccagtgtgacgggatcaatcaataaggccgtgctcaactgaactttttgtggagaaagtcctaataaactgtgttaagttctctttgtaccaataaatctatggcctcgttggcctca

SEQ ID NO: 2221 - DNA, 289 bp, Homo sapiens
tttgctgagcttccttaaaacaagtattttgaattcttcatcaggcacagggatttctccattggactcctctactggactcttgagtactctcatccacgggtgattgtcagaataagtgtttctatggggagcatgacggctgaaaactcctattcctatcttacttgtattacctcaaagccttccaattttagagaaaaaaatattttcaacctagaattttatacctagtcaaataatcaatcagaaaagaaaaaataaaagccttatttgatcatccaaaaat

SEQ ID NO: 2222 - DNA, 1041 bp, Homo sapiens
  misc_feature (1)...(1041): n = A,T,C or G
tccggccgcagagctccaccgctgaggccaacgaggccagctatttattgctcggtaaccaatcagcccaaaacttagtgacttaaaacaacaatattttgtctctcagggtctcagtggatcaggaattcaggatgggttaggcttagggtctctcgtgtggtcttagtccaatgatggctggaagtagaatcccaaggaattggagttcatgagggctgatcagtctctctctctctctctctctcagggcctctccacgtggtctcttcatgtgggctactttcggcttcctcacagtgtggcatcctcaggggagctgagcttactgcttattaagtggtagctgaaagcttcaagagtgagggttctagcaaacaatgtgcaagctgcattgccttttatagctttatcctggaggtcacgcagcatcacttctgcaatgttctgtttgtcacaagcaagcaaaaggctgtgtcagatgcgtcccctgggaagcagacaccgagatgggagttaggagtcaagaagttgattgggagtcatacctgagacagagaacgggaggaggaagcagaaggaggctggaaaggccttcaggacacagtgtggctctaacagctgtaaagggaaaggaggggacacgggatggtgcaggagagtctcaggtggcagcatagatcagacagggtcttggccaacccacttcatgctctgggacaaagagtcccatgatgaacagaaacagccaggccctagacccctgccctgcttagtcattggctgagactgtccagaaagagagtggccttggcttgaaggcgaagacacaccctggtggtgctaacaggtgcagaccacacttacagctgaaagtaactcttttcttgaagggagacctgagcggtgaaatcctcagctaccaaacaagcccacccagattcaggggaagagagttaggttccaccctctgatggggaattggcgagattgtanaaaaacacgtgggacaagaattgattctaggaaaattcaaattct

SEQ ID NO: 2223 - DNA, 212 bp, Homo sapiens
cagggtggagagatcctcctgggggaccaagccagaagggaggagaacagagtcaagagctagagatcaagttttgttggccatctgggggtacctgcattcaactgtggttgaagaaaagtgcaaatcctgggttatcttctaacataaacctagaccaaaccagaaggaaaccacaacagaacaaataaacagaacattcttactcaaaa

SEQ ID NO: 2224 - DNA, 400 bp, Homo sapiens
cttagatgcaggcttcctctttatgcgcaaatggaaatgctctgagcagtacttattctacctgaacatagaggaaggaagcctagatggctggcagaggagcacagccccacgtgaagatttcagcacctgtcccttctctgcccgacgacaatggaagagcaggcaccgtgagatcctgggctaaccacctcctccccgcagcacaacgcaacatcctagctcctggtctgcggttccccaccacccagcggagacctgaactcagtctgaggaaagtctgatgccgccatttctaacttaaacagtatttgccccacttctaggtaataaacttatgggcagggctttgaccctaataaaataacaccttaataaacaactggcctcgttggcctca

SEQ ID NO: 2225 - DNA, 790 bp, Homo sapiens
cctagaagtggcggtttcaccgtgttgcccagactggtcttgaactcctaggctcaagcgatcaccagagtccaccttccgaagtgttgggattacaggcgtgagccactgcacccggccctgaatagcacttctttcaagaaagtttcatctctatgatgtggtgatttatataacataatcatgattactacctgcaaaatggctgtatgactaacctgacattttatattattaattagttaagaaaatcttctctcaaattcaaataaaatgaagggaaaccaaaactgaatatttatcctgtcataactattaaaactattacaaaaagacaaacattatatgcctcctgagggaagtttgtttcactaataagtattactcctggggcgagaatgggagctggggggaaaagagcaggattcacaggacaggtagaatatgggatctatatgaaacaagattaactaacacaaaccatgatcgataactttttaaacttgggtaatacatacctaggcattgagattctatctctctatcactgcgaatgcttgcaatccgttataacaaacagttaaaacatgtatgcgaaaataaaagagatatacagtgttcattttcttgttaaaataactaccctattacccataaagattattcatatggtctaaacccccctaaatcattttttattttctcatttctgttctccattcttacttttctatatcctccttgtttatttttgagaccacggataggaacctcttttaatcttcaatag

SEQ ID NO: 2226 - DNA, 505 bp, Homo sapiens
aacatggatggaactgaaggtcatcatcttaaatgaagcaagccaagcacagatagacaaatatctcgtgttctcactcataaatggatgctcaaataacgtgttcagatggatgtagagagtagagtgacagataacgaagacttggaaaagtgagggtaggggcttggtggagggggggatgacaagaaaatggttaatcagtgcaatgaatgttatttgggagatggatgccctaaaaacccttacttgaccactatgcaatcattgcatgtaaaacaatagcacgtacaccccataaaaagtaaaacaaaaatagtaagttatccaaaaatgcttttcaattttacatccacacagaactgtaatatagtggatagcctaaaaaatgcagtaaattaaagctgaataaagaaaacaaccactttataggcccttgaaattctacaaataaaggactgaagtctggatacaaaaaaaaaaaaaaatggcctcgttggcctca

SEQ ID NO: 2227 - DNA, 531 bp, Homo sapiens
catcttttaacttacaccaatctctggctagggacagagcacttcttcattaccataagcctaaccctgtgacagacaaggcggaaatgagaattgaatggacagaatcaaagctgaggcaagccagagagagtgatagaagccactgtgccaccaggaatgccaatgtccaagattaccaaaaggtgtggttttggtattatgctgagctcctagatgactctaaaactaacatactctgagaggcaaggagttgaaggcggcctccagactacagccagcactgaactgaggccctccattcgatggcccatgaggaactgaactacgccaactattacatgcatgcatttataatgactccatctccagtcgagccttgagatgaccagagccctagccaacacttcaagcacagcctgtgagagaccctgagacaaaggacctacccagattgctgccaaaaactatgataataaatgttattgtttgaagccaaaaaaaaaaaaaaaaatggcctcgttggcctca

SEQ ID NO: 2228 - DNA, 600 bp, Homo sapiens
cctaggagaaatcaatcacggaatccatcgtcttcatcaggcaacagaatctcacccaaatggtcatcattttccttcaatgagaaaaccttctaaagttctgagtaatgcaatgccatctctctctatactatcaggcttccaagctggggcatcctttcccctcctgattggtttatttcatgaggggttttccaggcaaaactgatttttctatacctgcctgcaaatttctgagtcttaattgctttgttaactttatgcttaagccccagtgaacattcttcattatatttcaggaaataatatttttcttgtgagtgagagtgaattagaggtcagaaatacttaagttttttttctcagattcattactgatttatttggtaatttgttgtgttctagaaccctctatattttagtttccacttacgattagataaacattatgattattttattttttaataatataattttgataaagggttttattgtacagctgggaaaacattaaaaagaaatgaaatatagcatcttatttttcaaaacaaaggataataaatcttatcatgtgaattctaaaaaaaaaaaaaaaaa

SEQ ID NO: 2229 - DNA, 862 bp, Homo sapiens
  misc_feature (1)...(862): n = A,T,C or G
gtatctggtaactttacagcagtcatcaagaatacggaaagacaaacagaaaaagaagaaagagaaattaatggtgaaatagtcatatccattaattaataaaggataaactaacagaaaagcagaaagagaagttcgcaattgtgcacactgaaagttaactttgactaaacctatgtacagaatttttaaaatttttatatttaataaaattttaagatttattgacttctctcaccacttctgtcatttgatctatgtatagaattttaaaaattctataacaattatatacttatttcagaataaaattttaatatattaaaaaaaaagcaaaacacaatagaatgaaaatataaaaaataaaaaatagaaacaccaccaataatatataaagataccagcagcacagagtccctagccctcgtcgctccctgtgtagggtattcatacgacccttatgatctatgatggtgttgtaaaagtgtgtgagggaagcaactttggtcatatgccaattcatgccacccgcgacctctgtgcagcactccgccatgcttcgtttcaaataccgtgttttccagagacttgagaaaagcccaacgaagcgtcagccgcaatcgactatataaatgtgcgtccgcccctctccccgcatccccttccacttcttaactatccatcgacggggaagtactacgtgtaccccctactccacagcccaccccctcagtggtcttccgtgaagccattcgatctgttatacgactagaacgaagtcggccatgcagtggccatcagtccatttgtgcggtcagatgtnccttatagtcctcccgctgactacgagtgagagtgaggt

SEQ ID NO: 2230 - DNA, 592 bp, Homo sapiens
taatctgcactactctcttaacctaccaccgctacacctctatcagaaaaatgagaaaatggaaagatgaagaagctaataatttattcaagatcaaactgccaagaagtgaccaaactaccttggattcagatccaaatcggctggacttccccacttacgcttatgaccgctgagccacgccaccttcccaagttcatccagtgctctctcatctctgtcaaactggcttccctgaaataatttgtatttcttatccacagtgggataaattagagaaaccatagccaggtgtgtaagtggaaagattgactaatagacatctgatagagcaaacagcctaagtctgcaatatctctctcaggtctgtctttattcaagtgtatgagatggtggtaatcatcaatgttccccagtatcagtacctaatatttaaaagggtcatcacgttgggccatacgtttgggcttgatgattcacaggaggtgaagagaacttcaactctcaattgcaatcccaatgcatttgtcatgatgctgagttacacagaactagggcacatgtaaaataaatacctctttttgttccaaaa

SEQ ID NO: 2231 - DNA, 570 bp, Homo sapiens
ctagggagtacgaaacaaggctactgtccgcaagtcatgataccacgataaacattttaaaagaggaaaatttaagaaaatcccagtgtattcacctatgaagtgtaaagtcatgaacaacatgagaacaatgcaactatggcacacatttagacgctgttacgagtaacaacaaaaaaaattttgcagcgtttgaaattatattcagcgtaactttttgtacttatatacactactactgtataaatttaaaaaattaatgtcattaatttcctctaaaaagtgattatttttaattgggctagtttgcctgccaggaaaactttcatgtacattttgttgattcaaatcaataaaaatccaggaataatgtgagctaattatgctttaaaatgtgaatataatatttgtatcataacaggagatcaataaatgattgttgcctctgacctctcttttcccacccaacacacacacagttacatttcatacttgtgtcatacacaaattatttgtatattgttgtggtttgatgtaatgttctctttcattcttagaaaaaaaaaaaaa

SEQ ID NO: 2232 - DNA, 1020 bp, Homo sapiens
atggagagaggaagaaaaagtgaaggaggaagagaaagaaggaagaggaaaatcaggatgacataacaggaagaagtttcaaaaatgttataaagattgtatagttgaaattactgtttattcaaaaatgtgccttctgatttgtttgaatataatgaaactttcgaaaaaatgtattgaaattgatatcacatttagatacagttattaaaataaattgtaaaaaatacttttaaacagatttggaattcattacaattatttgttattagattaatgaatcatagatacaagttttcttattatgtactgatgatataaagtggtttgataaaatactatctctgtgtatatatagcaaatctaaaaagataatttgtatttttaataaataagacaaaggttcaccttctaccttgaaaaaaagatgtttaaaacatgttaaagagagcactgaaggtttttgagctattttgaaaatttatctctgcatattttcttcatttctagtttcatgttaactttcaaattacaattaatataaaataagtatattatgggaaaaaaattcaaacttttatgtaagacaggtgccctacatttttattcataaaatggaacttaaaatttaaattttacactattgaaagaaaaattaattatagatttctatttcttctttataagatacttgaagaaacaagtcatgaaaatgttaataatttctggaaaattatatattattatgtcagagtctagattaaaaacaaaaattctacatgagcccatagaatttaaattaaactatttccatctggagaatttctttgactagtcatagaaattgacattatcaccagacaggatgacagacattttggatgctgttatgggatgaatgttggtgttatagcttgaagttctgatactcaatgtgattgtatttgaagatggagccactgagacataaacataattatccttgttttctgataaaataaattttaaaattagcaaaag

SEQ ID NO: 2233 - DNA, 365 bp, Homo sapiens
caatctgggtaacatgcccattgtccttctcttcttcctcctgcctgactcatggacacgatgcttgatggtcaaggagctgtcttgccaccatgaagatgaaagcaacaatctaacgacggtaccgggagctaggaggaacctgggtccctagagcagctgcagcagcctggcctgcccacctttgaatcctgaccatgtgggaaaacaaatccctgtttggtaaagacatggtaattgggtctctgtttacatgcatgcagacgcaatgctgactgatacattcagtatttccatttttgtgccttttgtacagctccaataaaaccaagtaacaagatcattgctacacaaaaaaaaaaaaa

SEQ ID NO: 2234 - DNA, 410 bp, Homo sapiens
cctggagaagaactgaggttcaatgactagtaaccagcagcagatcacacatgctggaagacaactaagagcaaaaaaagaggcacaattaaagtgctaagaagtcactgcagacagagaacctgacactgacaaggagaattacatatgcatcaatgaggagctggcattttggctcagtctagaagtcataggaattttcctggagaaagttttttcaaagtgaatagcatatgcaaaaatggcactttgctgagaagaattctgaggtcctgtttgatgtcaacagaaagaaatgctataatcaatgtgtaatgacagccatactagtgacaataagaccaggtaattatcaaatatgtaatcagtataataataaaatcttatattgtacctgaaaaaaaaaaaaa

SEQ ID NO: 2235 - DNA, 216 bp, Homo sapiens
ctagaaacaacaattgaaaagaatatccaaaaggaagaagaaataaaggaggcattagtgtctacaatttcctgtgtttttaaactttaatgaatgtacaccctgttgttgtaatgttttctatcatttaaaagaaaaataaaataaaaagcacttttttgtgctgttaaccatttgtgacaatggttacaaatgcaaactgtaaaaaaaaaaaaa

SEQ ID NO: 2236 - DNA, 285 bp, Homo sapiens
ctttggtaaagaaatggacgtgcatgatagaaggtgatctgtccaaggacacactgctggctataggccgagttgcagctaaaatgaagatctcctgattcctggcctcatccctttctccttttgcatgtgatttacatacaaatatatatagaaaaccaagacaagttttattttaaaagtactatccttactatgtgtgacaaactaacattttctattgttcttttatgaattactagtcacaactcattaaatccattttacaacacaaaaaaaaaaaaa

SEQ ID NO: 2237 - DNA, 416 bp, Homo sapiens
gttccagtgccttgcggtgatgtcttcaccagtgctctaaaaggcaacaggattttctgccctgtatccagcagcttaaggcttttgtttcaaaagggaataagagagaaaaatctctcctatcatgcttttcttgcggtactgttgcctgtttttaactttttgtataaatggaatcattcagtatgtacattttgtatctgttttctttcactctacagtatgtttgaaatgtttttatgttgctttgtatatagttttcttcagatttctgaaagtatgaccgacaaataaaaattctatatatttagggcataccatgtgatgtatatatttacatatatatggaggcataggggaatgattaccacaatcaagctaataaacatatccaacacctcccaaaaaaaaaaaaa

SEQ ID NO: 2238 - DNA, 502 bp, Homo sapiens
ctagacaccgaagctgactgactggcttcctcctgtgggctctattgcgggattatgggcacttattagcatggatctcttcacaactcatggagttaaacatacgatgttcattttttccagttgacgatcgattgaagaatgcgatggaggactgcaaaactaggataataattgatgtcatctatatatatgcaaaaatgtgaacactcttgttatcaattggaaataggtatagggagactgactctgaatcacctattattttcataacttaaagagcaatacctgttactgcatctgcttaatggcactgaacatattccagttttgaattgtgtgcattataaaagcgattgagacagacatcagaatacattgactgtaatagacaataggaatctccccttatcctcttttcatttgcaaaagaaacactatgacaagacattaaattctcactgcctgataaaaactaaaaaaatggcctctgtggcctcat

SEQ ID NO: 2239 - DNA, 367 bp, Homo sapiens
atcattgttgcataaaagccactaaatgttgaagtggtttgttttgcacataattgatacacatatccatcacgtatgtatatataattattctctttgattataaattaatatatttttaattctatattgcaggtttaaggaacatcgattggctagattattcaaggataaaattagctaacaaaagtattaaaagtgaagtgaagtgataatttggaaaaagtatgaaataagtgaaaaaataaaatgatttgtggatagcacaaccagtatatgaaacgatctataattgacatggaagtacttgccctcattattctatttgtccaagaataaaatgaatggaatctgaaaaaaaaaaaaa

SEQ ID NO: 2240 - DNA, 313 bp, Homo sapiens
ggaagctcaaagaaaatgacagcaattataagtcagactgtcagattaccagtataatatattttctacagttgctactgcctactttaatttgtatttccccctgtgtatttttttaaaatttctcttaactactttattgagtgttatttatatacctgctttacctaataccttgtgaaatgaagtagggaatggagaagttgtaaatagatagataggtacaaatgtatcagtctctgtctgtctctctctctctctttctctctctcatcaaataaaacaaataaattcacaaggaaaaaaaaaaaaa

SEQ ID NO: 2241 - DNA, 625 bp, Homo sapiens
gctaggggtggagcacaactttgatcttaaaggaattcatctcaaacagtgaaaccagaatcccaagaaagatgtgggagggattttccgagaaaacctccccacgttccgaagacagagacctgtcacacagggccaaggaaaaatcatggagctgggagcaggaggcctggaaatgcaattataaccttttgcctcccctgcacctgaggcttgctacaggccaagtccatctagctatgtgcatagacactccagagtggaactctcacccaccaggaggttgcctcgggagataacagtccatcgacgatccaaaggatgtccgtgacgaaactctctcccacctggagagttttcagctgctttacaacctagtcctgcccatgaaggtgccagcagtcaccagttttaccaccgcctggtagataaagcaccaagttagcgcacagaccccccaaacccgctcgcttcctccctgtgtgccgttcatgttaggcccccttcaaaaagcacttgccttctgctccaaaagtcaagccttaaggcaggaagcctgtacttcttcccctaagctagcttgggaataaaaagtgactttctttatattggaaaaaaaaaaaaa

SEQ ID NO: 2242 - DNA, 847 bp, Homo sapiens
  misc_feature (1)...(847): n = A,T,C or G
cctggtatactctaagtacacctggtttcagagtgaagacattcattccctgattctggaccagccaccaacgagctctgtgacaagcacaccatgggatgcaatcattgtctggtatgaactgaacatgagacgattcatctagtccctgaggggctaagctttctaactaggaaaatcagaagatcgtattaatgatccataaaattctaactcaaaaattcctataaatgtttttaatgggttttttttttttccaacttttaagttcagggatacctgtgcaggatgtgcaggtttgttacataggcaaacgtgtgccatggtgatttgctgcacagaccatcctatcacctaggtattaagcccagcattcattagttattcttcctgatgctctccctctccccacccccacaccccacaaatgttggctgttattctgcatgcttcaagtctactatctcatttaatcttcgcaacaaccctcaatgtgctactgagaaaactcacacaaagttaatggccccaaaaccctcagctgtagggcagctccattagtcaaactgaggtgcttaggctgcatgcagttgcctctcaagatctcattcttgtacaggagaaaatctgatttaagccccattgtgtgctgttccccccaaccatgtgtccatgtgttctcatcattcagctcccacttataaatgaaacatgcaatatttgggtttctggtcctgcaaaaaaaaaaatgcctcgttggcctcacggggggctttgcggcggttcctttaggaggtaattaagaactngtcactactcctgccctggcgtcgggtggggaggggta

SEQ ID NO: 2243 - DNA, 878 bp, Homo sapiens
cagaagagagaattttcagaggtcctgaatctgccgtttcgctagtgtcaccttatgagagctttttaagagagaaaaaaaaggatggcagcatgaactcagctgggccccgtggtcctcagcccagccctcggcagaagcagtgaattcagccataactacagcagagtctgatcattctcctgatgaaattacactgatctaatttgcacgctgtgaagacatttggcactggctggatctgagccttgacatcttcattggaactaaaagtacactaagaactgacattacgtttcacattcttttctgccaggctgtggcatttcatcctctttaaaggcattatttcaagaacatttaatttggctttgatatgcctgccattttgctgggtggaacatactgcgccagaaaagctcagctgtaataaagtttggcaccaacagctcaccatatacctgcaccatcctgtgcaatttaattggcattcagtgggttgataaatggattggcttaatgagacaatatacttgacatatgcagaactctcctgaggaataggattcatttttttacttcacacattcaacatgttacagataccaacacagtctccttcagcagttgcactgtagccaatggacgccttccattgggttgaccagtaatattaccttgcagcttctgactccttcctcttttagcacaaaagtagtgtataaattacattggcttttaaattctctcagatttaaagcgtaggataggctccatggttaatttacataaagctggttatttgagcagacatacagactctttttgggagttaacaagactatgttaacctacctggaaatgacctaactttcaag

SEQ ID NO: 2244 - DNA, 419 bp, Homo sapiens
agcccctttgaccacattcagtgatgatgctgcggtcagcagctacatcacacccacgttcaatgagccactgttagatcctaaatgaaattcctgtttcacagcaagctacctctcctgcatatggggtgtgcatccacacacacggagcagggggcttcgcattccacaggaaggacggacaggagcatttccttaatgagaatggaaatacctggagggcagcctcagcccaccacgcccgtcctcctgttaacaagactgctccagtgagaccgaaaaggtgctgaggctaaaaggagatgcctcgggcagaggcagatctgagaaagacgggaccccgcttcggctgttaattatgtctccagtgcaggcagctggttattctttaaggaagaaccatgaataataaaatgtga

SEQ ID NO: 2245 - DNA, 969 bp, Homo sapiens
ttcatatcacatgaaagctgtgaacgatctggtcaagaaatttgggaagagctgagggaacagccttctaaggctagagttgctttctactctaccatgagtccaaccaagcctatctaaaatagggctggtgatacacacttctctcatctggagcttcatggaaagtaaactccatgaagacaaggatgtcatgtttatgttcattttgatagcacctataataatatatcagcacctgttattcaacagaaggtcaacaaacatttgttgaatgaagaaaaaacaaaacaaaacaaaaaacccctctgcttttccccagaaaaagtcagcatcacatttccgccatctcatccactgcctcacagctttttccaggtcttaacttttacagagccattcacaagagatcaacagatataaggcattggtttctatttctttagaaaaaaaagaaaaatctgatacaacttcaccagccaacgtgatatttctggtttcttgaattatttggcaaagggaaagcacaggttgaactgtttagaaaagataatggattctttcttgaatttggaggactggagcctttacacatggtttcaaagttgattgaacactttaagtccaatgaaggcagattctgcaaatgcaaagaagtcctagctgatgtgaacccaaagtgtgaacacatcacaccacaaccatgtggaaacaatagcctgtatgggcaacaaaggtttctatttaatgagagaagtgccattgttcttgaaagcctaattttgtaaacatcttacagtgctgactcatcagtcctgaaaatccaataataaatcaccactgtgatttaccaccggtgctagatttagatcacgaagcatgctacagcatcagctgaaactcaaacaggtcgctgaaggtgcatttcatcagcaaggaattaattcatatcaaggaattctaccccaa

SEQ ID NO: 2246 - DNA, 1155 bp, Homo sapiens
gccccactctgttcccccaggctggagtgcagtggtgagaccatggctcactgtggcctcgacctcccgggctcaagggatcctccaaccttagcctcccaatgtgttggcattacaggcatgcgccatcgcaccaggcaaaactggactcttgttctggagtcatgtgggggaactgggcccctgagcgaggcgaggctgtctcaggtctgggccttcttttccgagctccctgacgtctgacatacccttggtgaacagcagaaggcacatcggatctacattcagatgcctgcctatgctgtgggatgcaatcctcccttatggaacagttcctgcagaatttctcggggccgtgcagataagggaagcaggcagccttaggaagctgggcaggtggaacctactgtacagcccacgagcgccagcctgcactgaggccactagcattcgcatctcacctcccgggagcaccagcctgcaccgaggcctctagcattcatgtctcacttcctgcaagcaccagcctgcaccgaggcctctagcgttcatgtctcacctcctgggagcaccagcctgcaccgaggcctctagcgttcatgtctcacttcccgcaagcaccagcctgcaccgaggcctctagtgttcacgtctcacctcctgggagcaccagcctgtaccgaggcctctagcattcatgtctcacctcccgcaagtgccagcctgcaccgaggcctctagcgttcacgtctcacctcctgggagcaccagcctgtaccgaggcctctagcattcatgtctcacctcccgcaagtgccagcctgcaccgaggcctctagcgttcacgtctcacctcctgggagcaccagcctgtaccgaggcctatagcattcatgtgtcaccttctgtaagtgccaacctgcaccaaggcctttaacgatcacttgagtcccttgtggaaacacctccctgtaccgagtgcctgttcttttcgtgtctgagcttcctcgagtatcagtcagaccctagagactcagtcttaacgcaaaatgtgcgtctgtcgcaagttgtttccgttgtatcgtccttgatgttataggcccgaggaaggctaggtccagggggcgcgttggggagatgtgggtgccgtgggaa

SEQ ID NO: 2247 - DNA, 1074 bp, Homo sapiens
agttgaccttctgttttctgaagttactttaaggatcatgtttcagaaggaaaacaagcctggcatagaaaccacttcagcgcctgtttatccagcacgcagggtgaggacactattaggcgtgaaaaaacaatttcatgggtattaggctatagttccaggactcaccttcaaggactgagggtcttaggctgctgctatgaggatgtcaatgccagtgtccctgaggaagaggccagattgaatattgctgaatttgttttctgaataaatatttagaaacagccacccttcacttttcatctttttgcctgcacacctgattaaacatttataaaaataactgcaaagtgaaattatcaccacaatgaggaccagatgcaattgtacctcctggagaagagagtgaagtggatgtggaagaaaagcatgtagggatgatcaggaacggagacacgtgggggcgatgagagatgggtctcagcacaagactggggaggtcattctggaaccattcctggctctcgaccaggcctgggagggctaaggctgaaccaataactcataaaatacctctagtaagtgagttaatcatttaataaatacggaaactatgcatgggcctcaaggttaaaggtgaatgggcagggtttcaaaaacaatttcattaagtagacaataatagactacaactgatggcttgtgttcccacattaaaacaaaaaactctttcaaatgaactaatgcaccctgggttcaaaataataaaaagatattagaagactgagaaaaactgaaatattaagatataagtaaaagaaccatatgatatgtagcatatagcagatattggccagctacttgtgtatatattaatcttgctgaatagagatagtggttctatgaggtcagggccttgtcttcatctttctgttcctcacagcatgtgtgattaagttgaattcaatacacgggaattcagttcaattccatgtaaccctcgcctcgtggttatgcattgtgtaattcagaaaaaaatcaataaaattgtctatagtatcaataacacgatga

SEQ ID NO: 2248 - DNA, 585 bp, Homo sapiens
actgaaccctgacttgggactatttgccttgaaaaatgagttttctccagctctgcagaggatggctgctgtgtataatggtctctgaaatgctaacggaagccaagaaatcacctgacatgaactatgaagctattagttatgaaaagcaatatcgatatttaccttctaactcttcatgctggagggtaaagcagcacaacctggacgtgcctggtgccgagccaacataaagagaacatctgcatcttccctcctctaccatttttgaaatggaaataatgcttatggtggtaataatgtggtgactgtcgttcaaagccccttcacacacattatgatctgatctgctcctcccaggaatcctgcatgaggtgggtatcatgaatgttataatggccagaagcaggaactgatgtagaaagttagggatgttcctcaggcaaccccacagagcctggaagggttgctgttttgaccctggaggtgagaggaattggttctttccacattaacccccggccggaattatttaaaaagagcacgggtgttaatttgggtctatctttgctttggtaataagaa

SEQ ID NO: 2249 - DNA, 750 bp, Homo sapiens
tgtgaagaggaaaagtaaaaccagcagcaagaagactgtagagatccagctgtgagaagacagcggcccattcactacagtggctctgggttctggcctctggactcatgactggaccaagccctccaggaatcactttgtctcccctctctcattccctgatgaagacaagtctctgtgaggttggtcagtttgttatagttgtgtatcagtcatgttttttttctgcattttatgatgctttgacaacttgggacctgcccctcccagggttaattaatttctgagatagcaaacaacttgcctgtgagcatgcctttcgtatgcaaactaactagtccagaactcttacttcaaaccatctctagctggtttttacacttcagaaggcaatattcctctgctctaatcattccagggccatgcagtggacaactgaggaccaccccaatagcccagagcccatagaaattattcaaaccatccaatcctacccctgctttgctccttaccctttctctcccatcctttcccatgacaaccacaatcaaggcttctgcccgtgctttcccttttctctttctgcctctcctctgacccacatttcaaaatctatgtgtccctgtgtggtactgcaagctccctcctcctgagaactgtgagaaacagactaccttttcagtggcaactgtctcctcatgtgttggcctcaccatacctgaataaaaacaataaacccagatgcggcca

SEQ ID NO: 2250 - DNA, 1140 bp, Homo sapiens
  misc_feature (1)...(1140): n = A,T,C or G
agaaatgtgatcaaaacccagaaaaacagaaagaagattaaagtcctccaggagatgcagcagttccacacagctggaaaccatcatcatcttcagactcaagaggaatttcgggctttgttccaagcctggagcagcacaatcagaataaaaggcaaagacctagcagatgagcagagggtaggaggggagactgtcttgccgcgcagcctcacacagcgtgtggccatggttccctggccggcatcaggtcctgttgcacctggactccagctgctggggaggaactgggggacctgaggtgtggcttctggaacctcacagctgtcactcttttctgaagttgctagccatgaagaacagactgtgataaaatctcagagccattaagtgcctgttgttggaattgctttcatggctcattgaagtttgtactaagcatgggctctggcagtcaggcagttcaagtagggttccagccacaccattgaccagccctgcgagtggggcagaaagctcactactctggcacttgaggcatcacgtcgtaaatttaatgcaaccaatccctttttcactgttacctacctttctctataaacaccatgacctgatctctgctagcatttttcttaaaatggataaacatatgttatatagtatatattattcttcctcatgatttttttgctatattgtctctttccactcatatgagatatttacagcagttaagctcatacgaacacgaagtagaagagtagtttccagggactacacaaagggcaatggaaggggagtgttgtttactgggtacagagtttcacttttaaaagattgaaaaacagttccttatgaacttggacaatggttgcaaaacactgggagaggataaaattgccttagactgcacacgaaaaaaattagtaaaaggtcaatgggcagagtttgtatatggcactaaatgggagaaactagnngttagaaggaaggaactataattatatccttctgatgggtgaaaattacntaaggtgttggttgtgccaataaatgatattgctaggtggggcagtgaggtggctcaggcgtgtacggagatagagggtgtagccacgccacgaccagagcaccataatt

SEQ ID NO: 2251 - DNA, 811 bp, Homo sapiens
  misc_feature (1)...(811): n = A,T,C or G
acatcgtccatatcaggtgatcactgctcgagttcatccatgagagagcaatgccagttgggtgatgaagggtaccttggagttcctggtcagcagtgaccctgtggctaggctcttgagggaaaacttcatcttcaagatcatacccatgctcaacccagatggtgtcatcaacggcaaccacagatgctcactgagcggggaagatttgaacagacaatggctttctcccagtgctcatctgcagccaaccatttaccatgccaaaggcctcctctaccacctgagcagcattggccgaagtcccgtggttttctgtgacttccatggccactcccaaaagaagaatgtgttcctttatggctgtagcatcaaggaaaccttgtggcaagcagcatgcactgtgggcacatctactatcctagaggaggtcaactacaggactcttcccaaaatccttgataggctagcaccagcattcacaatgagcagctgcagctttctcgtggagaaatctcgagcttccaccgccccggttggtggtggtggagagagatggggcgcgttcattaagctaccccttggaaagganctttctgtggctgcaaccagggcccttatnnnggctacagtttgggtccacaaactgggggaaatgggactcatgttttggtggggccttcccatcctggaactcaatattggcattgcagccataagttctggttcagctgaactttgtgaaggctgaagaagacgtctggaccacgctccacgggtaaatgtcccagggcttagaaaattcggactt

SEQ ID NO: 2252 - DNA, 368 bp, Homo sapiens
agctggaggaacttcagtaagctgaagactctgttcagaggaaattacctaattgaaaatgtctgggctaagagaccgacaataaaggaaactggcaaaagtactctttaattacaagttctttttcatcttcatccagcacactgatttatgtgctacactgggtttgtattatatctatattttaattccacaactagacactaactttattgagaacagcgatattcatttcttcaatttcatttgtgttaacccaactgtaggtgatagtgctctgtacatcatagttacccagtgaattacgtacctgacatatgattgcttatttctggtattaaaacaagatttcataaaataaacagtga

SEQ ID NO: 2253 - DNA, 805 bp, Homo sapiens
  misc_feature (1)...(805): n = A,T,C or G
agacaaggtctcactatgttgccctggctggtctgtaactcctggcctcaagcagtcctcttatctcagctttccaaagtgctgggattacagaactcttgatggcctgcttcccatcctccatcctggaagactgatctgaaaccccaggaggaggtcctctgagccctgaggcagagatctctcacctggaagatgggtctaatgactgcgccccacacacaccagagaggactgcagatagtgcgggatgagaggaagatctctggccctggagacagcatcatcaagcggtagcttcatctttgggagctggggcctctgcaggagctttaccctcctctctccatgctgagcctgtctcaaccccctaacctgcaccccagtcttttggggtcacctcaaggctttggctgatgcttctttgctgacgtcaaccaagaaaacgtatgaggaagaaaatagccgatgagaagaatcaaccaaattccggaagctggtaggcagatgcaagaaggcccttgaatgatgccagcaccttgatattggactttccagcctccagaaccatgagccaatacatttctggttcataaaaattacccagttccaggattcctgctttagcagcccaaaatggacctaaacaatggtggcacaagactaattgctggggcctggcatgcaacaaggtccttggaatggcgggcctgggtggaaaatgaaaattggggaaaggcatctctcttcaaccccttttaagtttttgtgaccactggccacttggatntgtttaaaaaactcg

SEQ ID NO: 2254 - DNA, 468 bp, Homo sapiens
  misc_feature (1)...(468): n = A,T,C or G
agtgaagaaataattatctaggatggcaatgaaacacactgatcctacatttataatatggataaaagaagaaaaaaaagacaggatcaaaagtggattttagttgtaaactcagccatggcagcaatacaatgaatccactgaatgcatccttcatttgacagtacagaggtgaatggatgagccaatgaaaaataaagacaaggactgcagtgggaggtgcccaagaatttttctgacataaaaagagacacacagaccaatggaacagaataaagaaccagaagcaaatccacgcatctacagtgaagtcatttttaacaaagcttccaagaacatacattggggaaagacagtctaaacaataaatggtgctgagaaaactagatatccatatgcaaaagaataaaactagacncctatctctgaccatcaaaaaaataaaatcaaaatgaataaaaagcttca

SEQ ID NO: 2255 - DNA, 941 bp, Homo sapiens
caggcccagaggtgctgtctgggagacagggcttggagtcagaaaccttagaaatctacatgatgctctattctactgtggctgagttaagctggcatccaagccgcaagacaaagtccttctgactcttccttccgctttccacaaacaggagtttcttcccatggccaccaccaccctagaccaatgatgtcttctctctgctctctggttgaagccagtctgcagtaagaaagaaggaagccaaagaagtcagcatgcaaagagaaggagagggtgctggcagagtttgagtccctagttcccacagttacacaagacagcccagtgtgatggtttaaaaacatgtctgaaaatgattttgatgcccttcctctgagaggtagggtatatttcctttccccttttatctgaatagactttgttttgcttgtaaccaaaacagtacagctgatgggacattatgagtcttccaaaaacaagtcataaaaggtgatacaacttcaattttgttagctggaaaaattgcatggagccctgatccaccatgtaagatgctccattattgtgagactcacatgctgtgaggaagttcaggccatatgtagaggccatgtgtagatgctctggttgacagccccagctgaggtcagttaacatcagccacccaggcatgtgagtgaataaatctttagatgattccagccaacaaccagtgagtcaccgtcagccattgaatcttctcagatgagaccccagacatcatggagcaagagccattcccattgtgtcctatgcaaattcccaacccatataattcataggcatgataaaatggttgataaagtggtcgctttaacctaccaggtttggggataatatgttacacagtaatggtaactggagtattcaataaccagcaaataaatccagttcgcaag

SEQ ID NO: 2256 - DNA, 236 bp, Homo sapiens
ggggggtctgaagggtcaacaacaacagctggaacgaaggtggaggccaagtgaggatgggagatggcccattatcatgtccagccatgctgggggacgaacactagagggtacacagaggacaaaagctgacgcccaaagccattatgatttttctcttctaaactattttcctccagaaatcagccttttatatttaagaataaaaaagaatcaataaaatgctaccaatgaaa

SEQ ID NO: 2257 - DNA, 746 bp, Homo sapiens
agcagtgatatccaacccttctggcacccagagaccaccagacctccttttctacaatcaagccaaaccagttcctgttgttggtgccaagatagactacagctggaaattccccaaatgaccaacagatcacctggtgccaactgactgaccaccaggaagagcgactattgactttgggcttaaaagtcatctaatccacactgtttctcactcccctgactaccctcctctgccctgaggtttttttgcctttataatctcctattcactgaccctgcctgagagcatgatttctttttacaccaggggctgcatctccccaatctgcaaattgtttcttatggaaaatgaagctttctcttttccttccacagatctcatggtcttttgttacaaggaacctgtctcaagacagtcatactctgttaattcactataacattaagaacctcaatggagttcaggtctatgagaatgattcattcataacatctatcaccttaaaatttattgactagggcctaaggcacaactgccttgccctgggctgaattctaccctagggcagagttttcggtggcctcggtgtactcttagtagtatttctactaaaaagccaacatagagggcatagactccaagccttagagactcaaacaagaaacaacatttgaccattccatgccctccaaatctattggatgccaccaaacaaaggcaaaaataaagtcagatcggccgaa

SEQ ID NO: 2258 - DNA, 215 bp, Homo sapiens
cagacacggtctcacttcgttgccagctgctttcacactcctggatctaagtgattctcctgctccagcctcccaaagtgctgggattacaggcatgagccaccctgcctggacagacctaccggagatatatttttcatatgtttacttcgcaatatttattacttaaatttttaacaaataaataatctacgaaattgttaaaaaaaaaaaaa

SEQ ID NO: 2259 - DNA, 929 bp, Homo sapiens
caggataaacactttaaagaaatgcaatggaactctttcaacagaatttccgggtccaaaaggcaatctgaatataccagcaggatccaaactgctctgaaatgtggtctcactgaaacaaattggttttgccagcaaggtggaaatgaattcatcaagtctgtgtcacgagcagccacacagtgtgaaaacagccaacacttctcctgttgactgacatcacttcgcggatttaacttctgtgcttccaagcccaacctcttatatcctctctccaggctttttacatttcacttgccactctctactctctaaaagcagagaagcagctttgcgagaagtagtaaaattatgagaataagctggaagaaatgttttggataaagagctggtaacatttaaggcaaattgctctggtataaattcagtcctgtactagcaccatctcatagatcacagagtagccggtcggtgaagttgatgggatattgattccagcaggaaaataaagggctataaaacaaaagatgattaacacgaaatccttgagtaaagcaaagtcttaatagactgggagctgttaaatcaaagagtgggtgagaggactgggctttcagatcacttacaactgaattcttttcattgtgtattaaaattctcctgtgtgtttttactttcctgtatattatcaatccatattcctccagtgaaaaacatatgaaattgcatgtggggaaaaggaaccaaatccaggacacatcatcaatcagaaagaaggcaactcacaaagcaatggcaatcagggccttaaaaacctataaatactgtcagaaaatgaatatttttctatttctttcatttcattaagtcccactaatgttctctacataccacgtgcacctctcttttaataaaccctgatgcggcag

SEQ ID NO: 2260 - DNA, 812 bp, Homo sapiens
agcctagactacaagagaatgctgacgcatggctctctaggtatatcctctgtgtgtcctaggagtatacaaaggcctaccaagtggtttggaggatgctgttcaaattattaatggctacagtaagactttggctgtgcattttaaaaaaaaaagttttaaattttttgtgaatttcctcttattggcatatcaaaatctgtaacactatttctctttcattatttattctcccaagtacaaagtggaaatacactactttatcacttggtagagtatattatgtgatatggtttggctgtgtccccactcaaatctcgtcttgaattgtaattcccataatccccatgtattgtgggaaggattgagtgggaggtaatcaaatcatgggggcagttaccccccatgctgttcttgtgatagtgagtgagttctcatgaaagctgatggttttataaggggcctttccccatttgcttggcacttcttcctgctgacatgtgaagaaggacgtgtttgcttccccctccaccatgattgtaagtttcctgaggccctcccagccctgtatagctgtgagtccattaaaccccttttctttataaatacccagtctcaggtatgtccttatagcagcatgagaacaaactaatacattatcttactgacataatggaagggtcaaaatttggaaacaaatactttatggtcaatagactctacttggccggaaaagtctctggttacctttcttgtcccaaataattattgaggtctaacttctcgcaaaccttgcttaaggactggagata

SEQ ID NO: 2261 - DNA, 554 bp, Homo sapiens
aagccaaccatgtgatctgaaaggaattgattccaccctcctctccaaagataaaatttgtctctagagtaaacgttcagtcttcagtgttctgctctcacccccaacacttctccaagatagaaatctttctcctcccgaacaaatacagggtggtgtacttgatttgttatacatgtgtggaagaggggcagggcatgcagaaacttctaatcagatctacttcactacacatgggagcaatgagagatgaatattctaatcaaggttcctgttacaacttcctactggtcattggacttttgtggctgtcaccttccacattaccagtaagagtaaggccaagccctcttgatttttacttttcggttaccattccattatagaattttgccattgacaggtgtggagattataaaaatttccccaactcttcatccttccatgtatttacatccttctcaatgtgaatttgcaattctgcctatcaagagatggcatctattttcccactacttcaacttgggccggcctagtgatttgctttgaccaat

SEQ ID NO: 2262 - DNA, 438 bp, Homo sapiens
  misc_feature (1)...(438): n = A,T,C or G
agaggaagcggggcgggggggggacagtcttgaaagaaaaaaaaattgccatgcgacaacactgggtccagtaatgctatcctttagataagagagatagtctttcccagataaacaaaagctgagagaattcactgccatcagaatgatcttacaagaaatgctaaagggaattcttcaatctgattatgatcggccaggtgtttgcctggattccattcctantcagtccccgccggtctagttaggaaccgagctttgtancgagtcctaggcttggtcctgcgtgctccttggaaggaagggtggtggtgggcanggaggtggatggctgggtcccccgggcctttctattggacaangctgcagctcgtcctctctcaggctccagggcggggagggcaccttctttagcttacagccttgctgggaaaggta

SEQ ID NO: 2263 - DNA, 750 bp, Homo sapiens
attctctccctgggcttttctctgagcaaacctattttgctggggtgtggagggagctcctttcatgggactgaagagcttccagaatccacagaaggtgctgtcagtgataaagcaaaaatgttatggacgctgcaggaagcaagaaagcccaacgtgacagtcatgcgcggcactcgcgggtctccaagggggacaaacccaccagaagcgtcccgtgccaagaacagaagcaaggaaaggagcgctgtgaaggaaagaaagagaaaagcgctttccattctccaacaacagaagtgacactacacttttaaaatttcacaagtttccagatctgttcaaaggcaacactcgatcccggagttcagtctgcctcaaaggtgatacaaagcaggcggaaataccttctcttttcaggtctcgtgtgctggcctggagcattacaaagtttgtccctcccgggcgggcgtggtggctcacacctgtagtcccagcactttgggaggctgatgcaggtggatcacgaagtcaggagattgagaccatgctggctaacatggtgaaaccccgtctctactaaaaatacaaaaaattagctgagtgtggcggcacatgtctgtagtcccagctactcaggagactgaagcagaagaatcgcttggaccctggaactggaggttacagtgagccgaatcatgccatggtctcaaccctgggggcggagcgagatctggtttaaaaaaaaaaaaa

SEQ ID NO: 2264 - DNA, 870 bp, Homo sapiens
  misc_feature (1)...(870): n = A,T,C or G
gagaaagtctgaagtcagtccacctggacagatgtcacaaaccaccgtctaccctctgagcccaacagacttcgtggaggccattgttgtgtcagaagtgggattcgaggtagagcctctagcaacccccaggagtgctgagtgaatatgcatggtacctgcaggacccacttgtgtccactgatctcttggagcagctgaggattgtgggactatggtgcagccagctgggtcattagggccactcagggaaagataacccagaagcctggtatgccggcaaaagggtaagaatttcttaccagtcagacttctgatctctctctctctctctgtgcaaactcattgaatgaatggtaaaaatcactgtttatctcctctgtaaattttgattaatggaagaaaggatttgtgaggctggtcttaaactgtagcaaatctggtgtgctttgcgtgtctttctgtgttgttctgtcataaagaggggtaccttaagatagaacacaggcttaggacgcccataagcccactttacaagatggctcagcaaattggtcagttatgtccttgggagcttgaccttgtaattatgtggccatggcttctcttttcagattggcggcccggtttcagggttcaatccctagattaagggatgaacctttctgattaatattttgggtgacctttgccatttttaaattctcttcccctccaccaactggtcttgaattttcccttctcagagcactatgaggtactttggttaagttaaaggccaaatttaacctttggcctgcctacggcaggtataaanttctaaaagatttataaagagttttgttaaagcagttattaaagaatttcagt

SEQ ID NO: 2265 - DNA, 372 bp, Homo sapiens
ggcagttcagaggtcacctgcccggggaaatctacagcagagctgtcagcggtgaatcccatcatcactcacctgtgccctacagaggctgcttactgggaatacctgtgactcgtcagaagagggactcaaccaataatagaaggggagttggtagataaataccccaggtccctcattcctcagtggggataactatgagatgtggttttcattgtctcccagagtccccagtgggattcagctccagctgcccataagaacaagcaactgcttgaaagcaactcctatccctggccgccctttcttccctgtctcacttcccccactgccttaccggtttcctgagatcacctctcaaataaacaccga

SEQ ID NO: 2266 - DNA, 1091 bp, Homo sapiens
  misc_feature (1)...(1091): n = A,T,C or G
tgtatatcaaattatatcacttttgtaatgtcacttgtataagttctgtctcatcctaatttccatcagtgtctcatctcatgttttatgaaaagaatagccactgtcacctactcttctctgaatacattttcccttcataaaatttctatttttttcttttgaaatgttttctggttgatctagggaaattacagccagaatcttgttgtgaaagagcatcattttctaaatcaaagaaaaaaaatagtcctggaaacaagatggaagattctctcatccagaatgagtgctgctgaagtgagagggacaattctgaagtctacaaacagtgaggctccactttttcagaggcagttctgatgctgtgctctacaaagaaaggtgattgaatctcttcataaggactcataaatttcaagtgtaatcattccatcaacgctaaactcgctaccatctgaatgaatgacaagaacagtgaaaagtcttcaaaccaaagatgatcccttaaattaggagaagttttgaatattattttctagttaatcatggttccagacatattctctatagagtattaattctaagcaatggaaaggaatactgantccaaatagtgataganttatagataggtagatagatagatagatggatagacagatgacagatagacagatatcatatattgagcccacataaactgccnagaaactctgttaaatgatgtttatttcncttaatcctgaaagtaatctataagtagaatttttatttacattttacagataaatanaatgaggcttagagaanaaaaatagtggtagatattgggccaacgacaggtttgattccaaacccaatactcatgnacactacacaacactgtttactgtttattgagctgatactgatgatattcaatcctaataaatnctatcattcccattttataaatgtgaacatttggccttgaggagattaaaaaattgacataataagttgcagaaccaggattcaaacacacagtggtctgaccccagtgtcagtgtctttttcactgttctgtgctccctgagancagcaagacc

SEQ ID NO: 2267 - DNA, 1140 bp, Homo sapiens
aataccctggatttgttttttcccctgcctgtgtaccacctcctatactgttttcaagagctcgcatgcagctacatactttcattaagtgatcttattcaacctaatggcttaaatgactactttggagacttccaagcttacttcagaacactaaaaactcctgacaaatgaaaacaatgacaaggtgaactgaaaaaaagactcccctcaatgcttggaacagagatagtatttttctccaaccacttgtttcattgttttggactctactctgatctgcaaaacttcctgaagaagaagttgcctggatccaagccatagatggagacatgggagaaaccagcatatatagattcattgctagaccaaacccttccatttctagaggctgacaagctcaagaccaaggctccagaagttttgagttctggttgtacaggaagcgtggtgccagcatctgctgtgcttctggttaggcctcagggagcttttactggtggcagaaggtgaagtatgagcagcatgccacatgatacttcaattgcttgaatggaaatctacaattgtgagaagtttgaagtttatgctgcatggaactcttcaagacactgtcaatgtggaaaagtacatgctgccatatatgcaaaatacatcctggcttacatgggaaggcctctgagaataatcagcctccaataaacataaatctctaatgctgcttcctgtggaacagtattgctcaaaagagaagcatccctttgccatgtaatgcctgcaattcactgtctacctttgtgacttacaatgtgagttcagcttgaaaccattcttcacggtatcagaagtcacagggaatttctcctgatcagtattgcataggcttctcatcataccccaggttttgttgccctgggggataacaacctgtctcctgaagtgtactcgaaaccccaaaggaatttcaaatacatcattttgactggattttaagcaggcttcccacacaaatgctgaaaaattgggaaacacttttttcagtcattgttacaggatactcaggcaaatcgcaataaaggcagatgcggcaaacaatgtttgtttaaatacacctaaatatataaaattagagaagaagtt

SEQ ID NO: 2268 - DNA, 356 bp, Homo sapiens
cctcagacaaccgaatgcagtgtgtgggatgtcaagccatctgggaacaacactttcttaagaattcatctcaatttctgcgttttttggaaaggtccttaattgtttgctgcctctgcaagctagacatctctttcagcaaatggagacccagatggtgaggcaagagaaggaatgaccaaattaatgaaaatgttctttcagcttgttattgagcttgttattctcctgaatgcttgctctgcgactgttatgctaactgaccctgtgggtagaggagaaggaaatatctcttctgttaaattaaaaaataataataaatgacaatcaaaaatacaaatagaaaaaaaaaaaaa

SEQ ID NO: 2269 - DNA, 935 bp, Homo sapiens
acagcaataattctcaaacttcagtgtgcaccagacttagcagtgaaactttctaaaattacggaaagaagcttcaggccctatcccacacctgcagagccagaatctctagggctggagccctggtgcctgcttttttaataaaccatccaaatgaatccaataacttctgctctcaagaattgacagaaatcgctttccattccaggacaagaaccaaagacaaatacctatttgtctcctcttcatgatcttaggcagaagggtctgtcactactgaagacaacaaaggataattcactttagtcagtactgacttgcttggagaagaaatgtaaaagcactcaaaggcagaaaataaaagcagttccagtcctggaagtcatttggacagttccagttgaagagccaaagcagaaaattaacattccagctcctagaaattttattttcgcctttcttctaggcataatttataagtcaaatagaattgctttggcctgggtgattttgcataatggttcctagcatggtattagggtctgcattcagcattatttttcttacatttctgtagagcaatgacagcactattccccaagcatcccaacaaagctctcagcccacacccagctgctgcccaggccagtgacctgtggaaagacaaagacaagaatgctatgcaataaatcagaaatggcctggaagataaacctggccaaagaactgagtgcctgcagccagactacagctgttttctctttgggcagaaaggaggaagcaagtgtgactcctcagactccctcaagccctgctgatcaagacaatggctcttcttcattactcatctatatgaaatagttcagacattgctgtttacttatttataataaacctaattactcatcttattgccacaaaaaaaaaaaaaaaaa

SEQ ID NO: 2270 - DNA, 706 bp, Homo sapiens
tcaggacaaatgaaaacaatgacaaggtgaactgaaaaaaagactcccctcaatgcttggaacagagatagtatttttctccaaccacttgtttcattgttttggactctactctgatctacaaaacttcctgaagaagaagttgcctggatccaagccatagatggagacatgggagaaaccagcatatatagattcattgctagaccaaacccttccatgtaacataatattttaaattattactagtatttccttcaacagttctgacttcaaatgtcaatgttctttctttcaagtaggttgagatcaagtatatttatcattcagcctcacaagtagtgattattttacttttctctttgccttcacaattaatcagtaatgattctatagactttctgtcgtacacacctcttgtcaatataactttattgggacatattttacatatcatataattcacttatttcaagtgtacaatcaatacaaaagagtaaatttaccaagttgtgcaatcatcaatataaattagttttgtatttccccaataagatccctcatgcccatgaacttttaatctttgctccctcgctctgcctcaggcagacaatagttgtctctctgtctctatagatttgccttttctggacatttcatataaataaaatcacacattatgggtgaaaaaaaaaaaaaaaaaaaa

SEQ ID NO: 2271 - DNA, 399 bp, Homo sapiens
  misc_feature (1)...(399): n = A,T,C or G
ctgttacaatgtgaatattttgaaggaatcaataaaggaataagagctgagaaaaggattagagagacaacacggcccagggagcagcacaggatgcaccaaggaacttttgccggcagagctatggaaccatctagttgctggaaaacaagctcagggctttcattgattctacattatgctgggcatcgtggctcacacctgtaatcccagccttttgggaggctgaggcgagaggatcgcttgagcccgggaggccaaagctgcagtgagctatgattgtgccactgcactccaggctgggcagcagagcaacaccctgtctcaagaaaaaaaaaattctaaatgctttnttattctttaacaacctgtttgaatcaagatccaaataaaacccga

SEQ ID NO: 2272 - DNA, 234 bp, Homo sapiens
gacagtatatacattcaacaacaaccagagagtctattgtctgggaaaaagaagagcagatcaggtcatgctcctaaggaatcgttcatcctgcagcaaatgcaattatgtggtattcagtgacgacaatacatccaccaagatgagggcatggaatttggcaaaagaccttttccctaatctgtgaacttatttatgacaaaagtctgacagaattatataaataaaaccaga

SEQ ID NO: 2273 - DNA, 1018 bp, Homo sapiens
cctggccgatctcattttatttaaaagttacaatattttatgcatacagtagtgggcagaatgacctcccaaggatgttcacgttctaacccccaagatctacatggcaaaaaaaagggactttgtggatttaattagttaaggatcttgaggaaggaggattatcctggattatgcatggacccattataatcacaagtgtccttataaattatagtcggggggtttagagtcagataaaaggatgcgatagtggaagaaaaggctggagtgattggccatgaaccaaagaatgtaggtggcctctagaagctagcctaggtggggacagggattcttcctcagagcctccaaagaaacacagctattccaacaccttgattttagctcctccataagacccattgcagactttgacctcctaagttgcaaggtaatatatttattctgtttcaagccaagtctgtggtaattaggtacagcctcaatcagaaaccagtactccataaaaactactttttagggggttaactttattcctcttatgattcattttagcttcgatcttcctcatctttctcaccttcctcactgaacacctaagatcattcagaatcaaagataagcacaatatatttatggccttggtgtttaaagtggagctgaagattactgcaggtatctaaaataaatatttcatcttcaagtatattaaagtgtattttcaaaatatttgcaaccattattttaatgagagagaagcccttagaaaaactgaagtcctttcatacgatgaaaaactctttacgtcaaaaagtgcaagcatttaaaatgtttctgggtcaggcatggaagctcacacttgtaattccagcactttgggaggttgagacaggaggactgcttgaggccacgagtttcataccagcctgggcaacacagtgaaaccccatctatttattatagaaatattcaagggtgatttaatgccaggaaacataactgtgattcaccaaat

SEQ ID NO: 2274 - DNA, 913 bp, Homo sapiens
  misc_feature (1)...(913): n = A,T,C or G
gtggacatcatcacttcatcgacgggagactcagaggggccaagatgcttgtgtggaggcacggagctggcttggacccaggagtggtgacaccacaatgacttttgaagctaaattttccttgagaaagcaacacgctggtgtgaacggtggcctctctcctcaacggttggatctctgacatgtcaaacctgcagattcgtgggagaattgggagaacgatgaatctgacccgaacccgtgaggcttaaaaatatggtgttgtcacagcaaggatggcctcagcagacagtgatgaagatgcagggtctggagtcagaacatctgggtgtgaatccagcttgactgcttcttagttgcatggtgctggatgtgttatctcacctccatgagcctgagttttctcatatataaaatggaggtagagatagtgtattcgttcattttcacactgctagaaagaaatactcaagactgggtaatttataaaggaaagaggtttaatggactcacagttccacacggtttgggaggcctcaggaaacttacagtcatggcggaaggtgaaagggaagcaagcaccttcatcacatggtggcaggagtgacaagaacaaaggaagaacttctaaacacttacaaagccatcagatctcatgagaactcacttattatcataagaacagcatgggggaaactgcccccatgatccaatcacctccctccctccatatgggggattacaggtccctccctggacatgtggggattacaattcgagatgagatttgggtgggtacacagagccaaaccatatcagatagtatctcccctttcctcaaagaataaaancgtagcggcaaaatggcgtgttttcgcccttttttgtgtgcttctctgtctcaaaagtccgt

SEQ ID NO: 2275 - DNA, 553 bp, Homo sapiens
attaaatgagatgattcatgtagaaggccttgcagagtcctgacctcaagtggaactcaataaacggctatactccatgcaactaaagaaggaaattccagcctgattccatgctggctgctcagctgtccataggatgaaaattttttataaaaatgcaagtatccaaagttggtctggggaacatgaaaactaacatctatcaaattaaattgaacatttaagaatgagtgttgcctcctctgctttaaaagtgggccaaggttatcctgcttgcaaaagaaaaatacggaaaggaaagaacagtgacttttgcaaggggaaaaacctgaccaacattaaccttaaccaaggacaggaagatcactaatgggcatgcaactactcatgtactccacgaatatgatgttaatgatactacagcctttattagtttattcgccgaacactaattctcgcagttggaagatgacgaggacgccgagttgagaccaatatgcggaatcggacttgtgaggtggtgcgcgctccggtctcctagggtgattaatag

SEQ ID NO: 2276 - DNA, 702 bp, Homo sapiens
gggggggaaaaaaaggtttttttttggaacagggtcaaatttccagaaaagtttcacaaaggatacatgggggttttaatttcccccttattaagtttaaattcccttttttgttatcttttaactaggggccatttgtaaaaactaaggacccaacttggggttttgcggtgtaacctaacccttaaactttatttaaattaccccggttaaataaaatggcttttttccggcccagaattcatgccaggattttccacttacatttacgttgggatgtatccttaggcttttttggatctcagaataattcataaaatattttttattgttaataaacctgggcataattcacctgggcgaattttttattagtcttatccataattggggcccaatagggatgtcttcctatgattaaaacgaggacacttggattttgggagagagatattttaagagggtaaatttccttaatacgcttgtgaggggatccttgaccccttacttcatcttaaggacccttacttgcagggtcaaggagaactgaagtcaggtttacaccccgcttgaaagtcaggttctttctctacacatcttcttttttattgagaacaagataacccccgggtcattctttaagatgtagagtcacacttccctcccttatcggtgtaatttttacgtgtttggatgtttccg

SEQ ID NO: 2277 - DNA, 551 bp, Homo sapiens
agtattgttggatccgggctgccaggaagcagaatttgatgacagcttttgggtttgacttgccagtgagcacgtttggctgggtgtagggcttccgtggtgtagctggcccatggccttgaatttcttccagtgggcccactgcatttcccaaatggactcttgcaaagggcatcttacaagtcagagagtgtgtgtaagtgtacgtgcatgcacatgtagagaacagacctcctcttggatgtccggcctttaaaacgacatcaaatcatcctcgtcaccatctgcaaatgccttgagcactcagtatatgcaaagcaccgttctagaagttatgaggaatgcaacaaaatagagttccttccatggctttcagaaaattatagactcggttagggcagataaatcaataatatcccatttatatcagttctgggtttcttgggtgcatgcctttagaaatcaactctgggtaagctggattccctggggggagggaccggaaaggcctttttccagggggaccaaatgtatgtgtcccaaacggggct

SEQ ID NO: 2278 - DNA, 616 bp, Homo sapiens
tgacttctaacttacagccagcagccaaaaatgtgacagcctggccctgtgcatgaaggcattgctgtgtgcagaaatgcaccatctagatccctcagtgccacctctctccttcaatgatgagaacaagaccttctgaatcattcaccagagatccctgtttgaatgaaatgcccaatgggggcacaggttgtggcaactctcctaccagattcagcactcatgttaattagggcttcctaggcactgctacacttacggaggtctacctttaatctgtcattctcttttgcctgtggacatttgtcttgtgtctagaaaactgggcaatcttcccagcctcctccaagcaactagtctaatcagctttacccccccctgctagcttacttctgagctgctattgccctgggtttgatacacttcctctgctccatctgattctgatcacttctcttacttagcactgtagcttacattttcaggttggctactcagggttatgttgattgttggtcagtaactcccccaaccatgattggcatgttgggaaattgacttgagaagttggacttagtagttgttatctgaattaaataaacgtggatcggccagg

SEQ ID NO: 2279 - DNA, 901 bp, Homo sapiens
gtcaggccccgttcggagagattgccatggttctgagaaacgcatcatttggtgactggtcatcatgcaaacatccttgagcgcactcacacaacctggaggatgtagctcactggatgcccaggctacgtggagtagcccattgctctggggctacacacccatacatcgtgttcctgtgctgaatacactaggcaactgtgatacaatggagatcacagaaggccaacaaagaggcctggggcacgtcaacgtggtcctcatcggactggccaatggttccttcctaactcaaccaagggccactgcgccaccgcagctgtgggaccgtatctctggatgataagctgagtccaacacaaacacaacagtaagcctttctagcagaggatgctaggcagttgctcctggggctcctcaaggggccagcatgaaataccaatgggcaaaacacctttttcttctgagtctaccacgaggacaggtaactccagatgtcttctcttacccgctaactgacaccacgtaaggagcccaccaggccaggcagggcaccctggccccacagtgcttcctgcctggcgcacagaccctttggacaaaaacagcttcaagcacgtcccctgggaatcccccgtccgtcgttgaggctgttctttcatctcccagatgagacccgacctctccttccagagagaaggtcaagccccaagcagaactcgatcagtttttaaacccctagatagaggctcaaaggcaaatgaaatactgctgtcagaagaatttttaaacagctggtttgaaataccatgtaggatatgatttatctaccaaagagctcattctcttaaagtgtaaaaaaaaaaaaaaaaaaaaaaaaaaaaaaaaaaaaaaaaaaaaa

SEQ ID NO: 2280 - DNA, 1044 bp, Homo sapiens
atggagttttgctcttgttgcaggctggagtgcaatggcacaattttggatcactgtaacctctgccttccaggttcaagcgattctcctgcctcagcttcccgagcagctgggattacaggcacatgccaccatgcctggcaattttttttgtatttttagtagagacagagtttcaccatgttggccaggctgacctcgaactcctgacctcgggtgatccacccgccttggtatcccaaagtgctgggattacaggcgtgagccaccgcacctggcctaaaggctttttaaatggggatttttctttctctgacacaatgcaattactattgatcctggagttaacataacggtctccttgctgctccttgctaggggaagactattctcctatcctcctccttccaggttaggaaaacttatgtccttaaaattatacttccccttacccccttgtgatggtaaaatttacatgtaaccttgactgggccaagggttgcccagataattgatcaaacactaatctgtgtgtttctgtgagggtgtttttgtatgagactaacagttgaatcagtagattgagtaaagcagattgtcttctctaatgtgtgtgaacttcatccaatcatctgaagacctgactagaagaaaaaggctgatcttctcctgaataagagggaattcctcctgcctgactgccttcaaactgggacattggctttttcctgccttcgaacttctactgagacatcagctcttcctggatctcaagcgtgctggcctttggatgggaactacaccattggctctaagtggttctcaggccttcagactcaaactggaactacaccatcaactctcctgggtcttcagcttgctgcctacagattttggatcctgttagcttccagaatcatttgagtcaattttgtataatctctttctctatgtatattgctctctctctatacatacacacacacacaccctatttgctctgtttctccagagaaccctaactaataaacctcgatcggccag

SEQ ID NO: 2281 - DNA, 770 bp, Homo sapiens
catattgcagaggagaggctcagtacacagaaagaagagaactcttcagggcatcatccacagggtgctcacaaggctctgcgccccctggcccttctacaagcctcactcttatcctttgaagacccaggatttgaaccagctgatttctccttgattactgctcaatctcacaatccttcttatgcatgctagactataatcctaggtgattcaccgctgcactgtggacctgggtaatgacacagtctgtaaaaataaccgtcagcaaaccagaaagtgaggattcatcaaaatgtgccaggagaaaaagaagggcctcctttaagcccatttctattctctctcgctctgcctccgtatcctccacatccgtgcgggacctccagttgggctgttcccacgtacaaatgggaattcagaagcacagctactatgaacagcaagagcttgggactgaaaggctattattttaagttcagtaggaaagaaagtcatagactcagatccaaagaaatagaaaaaaaattctggcgataaaggcctacaccaattagttttgccagtcagggcaagatgggaaccaggagactgggacactgggaacccatgggctgtgtggggggctaaaccaccaattgaagaaaccacctggggtaggaaaaataaatattcaaccctttggttcaatatttaatagaatatgcctgctatacatctcaacttcaatacctgggattccttactactcctgaagggttctgattata

SEQ ID NO: 2282 - DNA, 744 bp, Homo sapiens
cagagcttggaaggaccctgtaggagctgcctagcagttcggatcacagaacactgttcccaagaggaccccttattctgatgttttgatggaaggagactacgcggggaggcattcccagagaccaagcttcctgctccatccgcttctgatggtgttccaggaaacacccgcaacaattgcgacaagctctaacatttgctgcagaattttgagttatagcaatgatttgaacaacctcaaatggccatcgatgtttgacttttaaaataaattttggaagatccatataatggaagattctgcaattgataaaaggaatgagatgcacttctatttactgaaaggaaatgcactagtatttcagtggtagcccagtaagaggctacacttagtaagaggatacactagatatccacttattgtcagtttgagagcctggtattgcctctaagaaacttgatcttttccccttgacaactccccctgcatctcaaatcaaaggtagatttttactaccttttttttttctttcttaaggcccacttattaaatgcccttggatgcttatctgagcttactaaccattctgggaaacaagaggcgacttacttcacttaggggggttccaggtagaaaaaagagagatgggggcgaacttcagggcttaattccttatctgggaggttggcaaatacacccttgagaggaatctggcctaattgccaccgcatttacaaacag

SEQ ID NO: 2283 - DNA, 773 bp, Homo sapiens
ctggccgatctacttttatttattttatatagttttagaaagacatcgtgctaaaatgtatgacatgtcatttaatgaaagaagaatgactggttaggaatgtgttgattggatttattatatattttctgtgacaaacctgacaatattaaacagtaggaatttgtatcatggactacaatttgtagataattactcatgcctttctccagattattggtctttgctacaaaatcatcgacactgactatttctttttcaaaagactcaaccatcactcccaggttaatatttaacaggtttccagtgactcatgtatctaaaatggcttaagagcattggagtctaaatttcattcaagaaaatgtaaatatgaagatcagtgccggtttgttaaatttaaatgcaactcgttcaagggttcagagacccaacacttctataatatgaccttagaaaacgcatacgatgtggacacggtgaatacggtagtgtatatgttacagctgggcggatttatcggagcgctggtagtcgggaggggctcggacatatcgtttgacggcgacctagggccgatgactatgattttcgccgccggaattttgctttcatccggctcctgtggctgttccgtgtgcatatacatgagcaggaacctgctttttaccgccgggctttagcctttgccacgatgttgatcgttggcgagggaaatgtccaaaaaaagctgacggggagcacggggttgagctgtttgttaatggggggat

SEQ ID NO: 2284 - DNA, 572 bp, Homo sapiens
ctggccgcatctgattttattatttttatttaaatttacaatcattgtatatgtgtactttgatacataaaatataagatacacctccgtatgcttatagtttatttacaacataaagctaacataattgaaaacaaataatattcaagttaacaacctgaatttagtgtgacagatgatgtttttcattttaaaatggtacggtactacccatggagccacactcctaatttcagcccaggggggctgctagatgctggtcaggactctgctttgtgatctagtaggaggtctttctttgtacagggtgctggcataccatttggctattgctcggtggagatgcatcaattatgtattagggctgcttttcttctcattagtcagaaacaattaaagtagaaggacttagtgcccaagccagcctaaacatagacataaaatcagcctctggaatcaaggtacagcccatggagatgaaaaatctggaaagaatcagcagaccccttaggatacatgggtgaactcccatgggcacgtggacttctgtttggaatcctgagtggattatt

SEQ ID NO: 2285 - DNA, 590 bp, Homo sapiens
  misc_feature (1)...(590): n = A,T,C or G
aagcttcccagaaacatccatcagcacccccaagaggaagatgtctgagcccccagagaatcagaggttttccacggggtagaaacatcgacaaggacttcggaaacacaccacttgaataccttcaaggtgaagctttttaaaagctacttttcttcttatttttgcaagaaagtaaagcaagagaaagaatatttgcctttgtctctgcttcatgacttttcatataatgtattagtgcttgttattattaaaatgtcttcctcacaactaaacctacagctaacatgtggcctttttgaaagatatcacaataaagctaaaatattttcatgaccttggggtaggcaaaaattttctataattggacacaaaagcactagctttaaatgaaaaagttgataaactgaactacatttaacatcattgagaaatgaaaaggcaaaatacagcgtggaagaagtcatttgcatgcattatctgccaaggacctatacctaaactgtgtaaagattccaatctttaaaagggccaaccctttataaaaaacattcaatgatcataatgntgaaatttgaaaaaaaaaaaaa

SEQ ID NO: 2286 - DNA, 745 bp, Homo sapiens
  misc_feature (1)...(745): n = A,T,C or G
ttttttttttttttttttcatattttcacatttattgatcatttgaatgtctttttataaagggtctgtgcacttttaaagattcttcttttttttactgttttgtaggaattctttacacagtttaggtataggtcctttggcagataaatgcattgcaaatgacttcttccacgctgtattttgccttttcattttctcaatgatgtttactggtggacagaacttnttaatgtagttcagtttatcaactttttcatttaaagctagtgctttttgtgtccaattatagaaaatttttgcctaccccaaggtcatgaaaatattttcctatgctttcttctataagctttattgtgatatctttcaaaaaggccacatgttagctgtaggtttagttgtgaggaagacattttaataataacaagcactaatacatgctagaactttaatcattatatgaaaagtcatgaagcagagacaaaggcaaatattctttctcttgctttactttcttgcaaaaataagaagaaaagtagcctaggaaaaagaaaaatttttaaaaagcttcaccttgaaggtattcaagtggtgtgtttccgaagtccttgtcgatgtttctaccccgtggaaaacctctggagatctccatgtattgattctctgggggctcagacatcttcctcttgggggtgctgatggatgtttctgggaagcttctgtagcggtggtaaataagagagtc

SEQ ID NO: 2287 - DNA, 817 bp, Homo sapiens
  misc_feature (1)...(817): n = A,T,C or G
agcttaccatctctgggaagttgaacagttaaacaagcaatggcagtatgtcatgagtaggacggcagagattcttcgagctcatctgatacatggagcgcccgctggatgacaggaattatacgtggtgaagaaactgaggctcagaacacttaagttgttgatcttgggtcccaaaggcatctaagaacatggagaaatctgggagacttttaagacctgccttttcttaacgcaagcctgagggaaattgtcatgctcacagtgttttgcccctgcagcggactttctcagaccagacttgtggaaaactactacagagcacactcttcaggaactgtggaaaaagcctaacctagtccagagccgaggcaaagtaattatacacaagctaaattcaaaaccagcgatgttttgaggtttttggtcccccatccccaacccccgagctctctcaactctgaaaaaccaaaaaacccattttctaataataggctttcttctatgatttctggattcaaggtaggtaagaaataggagagagataaatgattcagaggccccgaacaagatcatttggcctgtggttttgggaggatttaacagctggggagtgagaccttagaatccaggccacccttaattcctgcatgcagtttggcaagaccacaagtgcaatttatcctgaaaacatgaaagaatcttcctctttctactgccaactgggaccccagcaatggaaatgttgagaactgggtngatcttactgctcttccaatcgtgcttcctcagccatcaaaaagcaaataaagcccga

SEQ ID NO: 2288 - DNA, 594 bp, Homo sapiens
taaggaccccagcaatatcccagacagacatgacttctgtcctcatggagtttacagtttacagggaagaaggatgtcgagcaggtgattacacacagcatgcttgttacggagcaggaagtagtctgaactagtccttcaaaaggcaactcgacaaatgttgatataaaacgtgcaaagcctgggctgttcaaaaataagaagcaaaacaacagaagtttttggcagctcaaaagcctttgtatgccaacacaaaccataacatgaaactcacctggaaagtatgtgtgtcacagtcataacagagatcttttggtggaattcccctgccctacccaccagaattattagagaggaagaggaatacaaggcgtctttaaacaagggatgaatttgacaaatcaagatgagaaagcccatgtgcagtgataaacaatgcacaggactgttgcaggaagcgcatcaattatgactcatacatttaaaagatgtaattgtgagagaataacctataattgtgcatgtatcattaaaatggcaatacgcccatgtctacacatcactttaatataatattaatataataaacactga

SEQ ID NO: 2289 - DNA, 843 bp, Homo sapiens
agtgccagcattataagaagaaacgaacggagcaagaagaaactattgcttctttgcaaatggaagtctgtagattaaaaaaggaggaagaaggtcgcattgtcactcaaaacagagtgtttgcctatctgtgcaaaagagttcctcataccgtcttggatagacagtaattttgctacataaattgatatgtagctagagtcattgttgtgtttgtttgtttgttttacctgatattatcttgggggtggttataactcttataaactagaaaagcctctctctcctcctcttctgcattgtttttccctgctcatcctgttcttttttttttttttttttgttctagaggtcctttgaagaatggaattgaacatttactaaaaataacactaaacttttaaataaattcataattaatcagacatttctcaaaataactgatccttttagtgaagaatactattgagagatcgctgtatgggttttggggttgcttagttttattatgttattgattttaggaatttttaggggaaagaaccaggggactatatatttgtggagggaaaaaaaaacatcattgattttttttttttacctagcggaagtaagatagttttttattaaattctgatttacatgtgaactggggctttcctactgaaatcatccttaaaacaaattatactatttgctatacccaaaatcctaaaatgtgttcaattataaactagaatacctacatcggcctcctgatgagatttagttttgggccgttttctagtataaaattgccctgggtcgggccagaggattttaaaatctgaaaactgttcttgg

SEQ ID NO: 2290 - DNA, 490 bp, Homo sapiens
agaaaatacctggtaagccctaatggaaaccatctgttagaaaaagaaggagacagaatcgtggagctctgttgacttccctcgtcttaccagcaaagagaagaggtgtagtaattcttaaaaaggaagaaagaagagagatcaaagtgggagaaggaaaaataaaaagaaaaaggactaagcactttcttctttcctctgagagactgcggtggctctcccacctttccggagactcgtcagcacctgcctggtggacagcaccacatctttaaattctaaggttctaacccctttattcccaaattctggagttcactaacaaagtggttttcattctttaaaaaatgaaatgaaaccaaagagggacacacagagggcttccaaaataaaatgctagatcttaaattgggtgcttggtttatgaattattttgtattgatcaactttccattataaaataaatgaattaaaaataaaaaaaaaaaaa

SEQ ID NO: 2291 - DNA, 389 bp, Homo sapiens
tccgatcttcatgctaagatggactcttttacccatgtcttgaatctgggctggctctgtgatttgttttatcaagtcacttcaagaagtcatggtttcctagttccaagtctagacttcaagaggcccatgtgtttctattacacttactctctgtctctccatcctggccataagaacatgctggctgtagcttgctgaaggatgagaaacacatggagcagagctgagtcatcccactggacccagcagaagcctgaactgatcagtggactgtgagccatttctgagctatttggctgatgagcacagatgagcagagccaaccggctttaacatcctcgatgcatgaacaataaaggcttattgttgcatgaaaaaaaaaaaaa

SEQ ID NO: 2292 - DNA, 992 bp, Homo sapiens
agttggaattttctaatttatttgctgttcttcactgcattcattccttctttgctgccaaggtagcttgtttggaccctctatttttaggcaatcaagctactgcttctactgctgccagctctgctaccacgagcaaagcaaagtatacaacttgacatactgaactcttcattgacacaccccatgactgtataagcaggacacatttactcatcattttagaccctagagaaaccataacatcaccaagtcgacagtggaggcaaatcaaaatttcggcagaaaaagaaggtcatgtggaacctcaaaaacacttctattctggatgacatctgtgaaatatactacatgaacagaacagcttgttctcactcagttgctttgtaccatgctgaagcttgatcatgaactttgtctatgttgaatgctggatttaagaaaagcttgatttattactgagaaaaattaataatcctaacgataatttagaattactgctagaaatcagcagtgtggagaagctttaaaagcacaaggatgatcttgtgcttaactttttaaggtaagtgtagatgttcggatactaataacaaagattttgctactattaatattgctgtgctcataatttctccttatgaaattgctttattcatacttctaaaattgttctttattgtttattcttactaccgaatactttaaaatcataatgccacttatttgcacatttgaatttgcttttgaaaataaaatattataaatgttatatattttatacatgttaaaatgcagtgaaaagacaagaaatataaaatgtaaatatatttatttcatttttaattgttttggtggatgtttgtaaaatgtaaattaatatctgtgacaaaaatttgtcacttcattctttcagttcattaatgtactactaatgaaaccatacttttttaaatgaagcatactggaaaataaaaacagatcggccgaag

SEQ ID NO: 2293 - DNA, 1029 bp, Homo sapiens
gtctccatggtctgacactgtcagtaacaagaatgcacgttacggagaaagcatggctcagtggtatgagtaggggatgatgaaatttgagaaagactatatatctgaattttatccccgcctatcactagctgtgatcttggaagaattaacttctttaggccaatttccacaacaataaaatggttaaaattctttcatgtgtgttgcctctgccactgtggtgtgccctcatggacgcaggcatcccagcacccactagcaccctgctacagctgatggagcatacaccccacagcgctgcttctggcacatgcaaatgagaatgaatcatgctgccactgcactatgaaatgcttaggctgagaccacccatcagagtgcagtgaccagcagtttgggagcccgtggggccccctcccccagcccagtggatttctaaccttgaggagccagagaacaacattgagcctcaatccaagtccctctcagttaaagcatgcagtctaggagttgagagctgagcattactctcctaaaatcttccagaaatgaagccaatcagctggaatccaccttatatcacaatcaaaccctcaagatcatcgaataggataaaaggaaaaaaaatccaaaggttagcaacttaaaagattgaaggaatattcacccacaaagatgagaaagaaccatcgcaggaattctgacaactcaaaaggccagagtgccttctttcctgtaaatgatcataccacctctccaggaggagttctgaaccaggctgagaccccctaaaatgacagaaatagaattcagaatatggataaaaacaaagatcattgagctgcaggagtacattgaaacccaatccaagaaagctaagaatcacagtaaaacaatacaggagctgacaaacaaaatagccagtatataaagaataccctaccctgatagagttaaaaaacacactacaagaattttataatgcaatcacaagtattaatagtagaataaaccaagatcggccag

SEQ ID NO: 2294 - DNA, 840 bp, Homo sapiens
ctctctttaacataccaccgctacagcgttgaagacacaccaacatggtttggctgtatccccaccgaaattgcatcttgaattgtggctcccagaatccccatgtgttgtgggagggaccaagtgggaggtaattgaatcatgaggatgaaggcctgaatagaacaaatgattaatcctctcccaaataatggagaattctccaatggactgcctttgaacttcatctacaatattggcttttcctgcctgcgggaattcaacctggaacattgcctgtgcttgactccgcagctgctggcctaccctgtaaattggacttaccaacctctttaatcatgtgagccaattccttataataaatttctctctctctctctctctctctatatatatatatgtgtgtgtgtgtgtgtgtgtgtgcgcgcgcatgtatgatagtgtttctatttatttcaagaaacctgaccaatacagctaataaagactcctctgaatcatatattttttcctttgtatctcagcctcagaggttaatagggtgcatggagataacccttcagggaatttccaagggattataaccattttacagggccacccacattacaggcccttcaataaaattcatatcactggtttactcttggaaaagattgcccgatggaaataaataaaactttagcctccgtggagattctggtataatttttctttctatgtttcggtcaactggattaaaacttaatcacatctcccaagatttctgatggggacctgttctgttgggaggtaatttcatcataaatgcaaaaaatatttagtggttccagagtttgc

SEQ ID NO: 2295 - DNA, 1018 bp, Homo sapiens
aatttagcatagaaaggagaagaaccttaatttcatgacccatgggggatgtcaatgctgaccaacaagccaaaacttatgagtcaagagggatgacatgagacggagaccaaagaaaaagttttgaggaccatcagaaagcatggtctcatggaaaccaagacacgagcagaatgtcaggagcagcagacagaaggagaggaggtgccttgaatagaagaggacaatagatggctgggatcaccttcagcattgtagccaatggtctcaagccctgggacacaggcaggaagagcatttggtgggagtagcctcctacagcagagctcttggagccaggctggaggtcgaagagttctcagtcttctggtgctcgcaagaacacatcccttatgtttataggaaaatatctagatacatcttccatatgggaacacatggcattatcagagaaccaaggaaaattcataaatgtcttatttccaaccctttgtgtccatgttaccacaggcaataagtataacaatagaaatggatatttacttttattaacaccaactttaccatttcctcaaaagactcacagaagaaatgtctcctgtgtctcagtaccaagaatagttttgcttcttctaagcagctctttgcttttatatttgtgctgtgaatcatgggatcaatactttcctgctactaatcagaggaggttcaaatttgtgatctgcctctagcaagcatacattctgtagggaatgcatttcttatactatgcatttagggttctaacttcacaatttcactttaactttgttccaatatttcaaaatatctatcctgattttcttctaattcatttgggaaattgccttttttccctttttgctttgttgtttttgtcgtttgtatgtgtgtgttttacctggctgtaaccctctacctcatagtcatatcaaatcttttttaaaagtgccatggtaagaaaataataaggtacaataaaataaagatagatcggcca

SEQ ID NO: 2296 - DNA, 527 bp, Homo sapiens
gatggtgcagcaagaaggccctcaccaggtgtggcccctcagtcttggacttcccagcctccaaaactaagcctaagaagctgtgtaaagtaatctactaatccagccatggggactctatagcaccgccccacaaggccagcaccacactcagacagacttacttctccctgtctctgtgataaactccgttatactgtaacacattagaaaacccttggctcggccaggcatggtggctcatgcctgtaatcctagcactttgggaggccgaggcaggtggatcacgaggtcaagagatcgagaccatcctggccaacatggtgaaatcttgtctctactaaaaatagaaaaattagctgggtgtggtagcacgcacctgtagtcccagctacttgggaggctgaggcaggagaatggtgtgaacctgggaggcagagcttgcagtgagccgagattgtgtcactgcactccagcctggcaacaaagcgagacttctcagaaagaaataaagcgagatcggccag

SEQ ID NO: 2297 - DNA, 623 bp, Homo sapiens
cctggtatctgtgagctgatcctaatctgcatttctggccccatctttcctgctcctgtatatcccagatgttataggttgagttgtgtccctcctaaaattcatctgttgaagtcctaacccccagtacctcacaatgtaattattagaagatagcatctttaaagaggtgtacatgtgccatggtagtttgctgcaactatcaatccatcatctacgttttaagccctgcatgcatcagaaggaaacacgaggcaggcaaatgcatagaggaaagagcatgtgaggacacagtgggaaggtgccatctgccagccagggagcaagacctcagaaggaacgggagcaccttgatcttggacttctagcctccaaaactgatatgttccagtcgccagtggatgcctgaaacctatatatataatattgagccctgtatatactatgtttttcctgtacatgcatactatgatgaagtttaatttataaattaggcacagtaagagactaacaatgataattaataataaaatagaacagttagaaaagctatcacaatatactgtaataaaaattatgtgaatgtgaaaaaaaaaaaaaaaaaacaaaaaaaaaaaaaaaaa

SEQ ID NO: 2298 - DNA, 176 bp, Homo sapiens
catggtatattactttggtaggtaaacatatattgagtaacacagtatgcattttattttaaggattaatgacttgacaaaacctttatttatctgacttctaaccctgcttatattgatgtacattgttggtaaatctattctggttctgatttacaatgggaaaaaaaaaaaaa

SEQ ID NO: 2299 - DNA, 283 bp, Homo sapiens
atgcccactattcctactggggagaagcccagactgacaatatataaagagtatcaggtgtgtccacaaaaactatgaatgccagaggaaatactttctgaaagagagtcatggaagagacaaagtgttaaagagtttatagaattcatgggatggttttaggtcattataacataaaaattctgagattaaatgatagcacttttttttagttatgtgtaaataaaagatgcagaagcatatgaacaaggttcagctgttagtgattacaaaaaaggaaaat

SEQ ID NO: 2300 - DNA, 792 bp, Homo sapiens
atacatgcaatggatggagaccacatagctgatcgttttaatgcagaacaaaaatgatgaactggaagtgatagtttgctacctaaggaaagcgcactgaaaacaaattgactccaaatgagtacattaccaaaaaaatatctagagaaggtgtctaatgacttgaacccctttaaagaattcagaagggcaccactcacctattttggatgtttctttgtggagttccaagagccatggacagaatcttcttaggacacaactggagaagctggctattttgccaaggctttgactggaatggtgtgctttcctttaaggaatcaaacttgacttaagaagtcaataaaagccccttaaaaaactagcctcctacctttgtctacacagcccctgtacagggctcctgacctctggcagagtcgctgaaaactatgctgtgccttcataaagccctgtgagctgaagcaagacaactgaaacttcagaatataacagcaacctatttacataaataagccactttcatacctgcctactaatgtatggacttcagaggtatggggcctatatcaattttccaggattgttcttttggttattggggtttttctttcttcctccccctattttctctccattggatgtgagacttcacaacctttttaaaaataagattttctaataacttgggacctaactgtctaggaataaagcatcctacccatgagagagcagacaaaaccttggaccagagatttgttttcttctaaaatgctttctccaaatata

SEQ ID NO: 2301 - DNA, 627 bp, Homo sapiens
ccttcgatgaattggacgatgtccacccacatggtgagggcagatctttcttactccacccaccgatgcagatgtcaatctcttctggaagcactttcaagggcatacccagagctaaagcttgaccagcattagttggtaaatatgaaagcaccaagtatctacacaaggggagagacctcactgaaccaggaaaagaattaagagtaccttactatcattgcttcattcattcaacaaacatatattgagtttgttcattctgggtgatagactctcaatggaaaaaaaaagtcatctgtaataatttttaaatagatagcctatatttacctctaatgatattttcatttatttgtcttcctaaacttaactatcactgttgttctaaaagacctcataagaataagccttatttagtcttgccagagtaatttaaatctcaccaagcattggtgttccatagtaaagactttttatctgaaattattaaaaactttttatctgaaattagtaaaaaccattacattgaaggtaattgaaactacctcttagtgtcattttcgtgactgcacaatgccatctggaaaaatactacatttaaggaataaactctgttcgccaaaa

SEQ ID NO: 2302 - DNA, 511 bp, Homo sapiens
agagagggtctctgtcacctgtcctggagtgcagtggcacaatcatagctcacttcatcctggaactaccagccccaagcctcgcctcccaaagcactgttattatagtgtattttaaggcagaagatgaaccaggtatcacattattccatatccacaagccacaagtttttaaaatttgaactaaatacctgccaattatggattaatcactttaaccttcacagcattatttttcttttgaagaaagaaaaacttacaaaagggctccagtgatcctaaggttgttgaattcaatggaaacctttcagtagcacttgatacagcagatctccattcttctcttcattgtcaggatatcagccagtctgttttttcctcttgctgtctgttatggctcattatcatgccccttgctggatagtcctccagtagatttctaaatgctggaagtattgaaaatgaatgaataaataaataaatatttttttgaaaattaaaaaaaaaaaaa

SEQ ID NO: 2303 - DNA, 822 bp, Homo sapiens
cattgttgtgaaataataattcaaaaaagagcaaaggaggaggaggaggaagaaaggagtaaagaatcccaaaacaaagagaaaaaagaaaaagaaaaagaaggaacaaagaaaggaagaagggaaggaaggaaggaaggaaggaaggaaggaaggaaggaaggaaggaaggaaagaaggaaggaaaggaaaaagtaggaagaaggaaaaatacttcagtcataatccaggaatgttgattaaaacctgttaactggtatatttggtgggcaattttatcaattagttatgctatagaatatatccagtgtgtctcatctttcaccaatactacactgtcttgaatgttgaggtttaatagtaattctttgaaaacagttactgtgagtcttctcttgttttaattgttttgacaattctaatttcttttcctttgccatgcaaattagaaaatcaccttggcaattattcaagaaatgttggtcttgcaaggttgaatttggggataggttaaacttttttaacaatatttgactccctccatatgttgaggattgccgcttgtctttcttcctaattagattcttaccttttgactactcttataaactctcgacgtttataccgtattgtattcggacctttttgatttgacgtctagacgtacccactctcctattgagtcaaccgctcttactatcttctcgctccctcctcctatgtctctcacttttcacaccacacatcctccctccatcacttaatctcactctctttatctacaaccactcaatatatctaacatcatacgacgactatcat

SEQ ID NO: 2304 - DNA, 995 bp, Homo sapiens
ttattatgaagatttgtaactcatattgacgtggaattgagaaaatgctcaatttcaccgatgtgacagagttcattcttttggggctaacgagccgtcgggaatggcaagttctcttcttcatcgtttttcttgtggtctacattatcaccgtggtgggcaatatcggcatgatgttgttaatcaaggtcagtcctcagcttaacagccccatgtactttttcctcagtcacttgtcatttgttgatgtgtggttttcttccaatgtcacccctaaaatgttggaaaatctgttatcagataaaaaaaaacaatttcttatgctggctgtttagcacagtgtttcttcttcattgctcttgtccatgtggaaatttttattcttgctgcgattgcctttgatagatacacagtgattggaatcctttgctttatggcagcaaaatgtcaagggatgtctgtattcgactgattactttcccttacatttatggttttctgacgagtctgacagcaacattatggacttatggcttgtacttctgtggaaaaattgagatcaaccatttctactgtgcagatccacctctcatcaaaatggcctgtgccgggacctttgtaaaagaatatacaatgctcatacttgccggcatcaacttcacatattccctgactgtaattatcatctcttacttattcatcctcattgccattctgcgaatgcgctcagcagaaggaaggcagaaggccttttccacatgtgggtcccatctgacagctgtcatcatattctatggtactctgatcttcatgtatctcagacgtcccacagaggagtctgtggagcaggggaagatggtggctgtgttctataccacagtgatccccatgttgaatcccatgatctacagtctgaggaacaaggatgtgaaaaaggccatgatgaaagtgatcagcagatcatgttaaacaaaataaaatccgatgctggccag

SEQ ID NO: 2305 - DNA, 676 bp, Homo sapiens
atgctgaacgactctcttaattatcctgtacatggtgcctggaggcagcagacccaagacccagagcatgcaactcgacttggaagcaatccaacagagcagctgttcccaaatacctgtcatgagtggtctgaagcttctggaagtagtgaagtagggaagctgcagactgccaagaatcagagaatactttgaatgagataacttaaaaacattcacaatattggtggacaacccacccatcagcacacctagggtgcctcagttccttgcagatgctcacagtgttgactaagcgtgcaccgagtaagctctcactggaaggaacagtggtacagtgagaggaatgccaaccagctgcactgaagagaatgcaaacacaggaatctgccaaacctgccaaaaccctgcagaaaccggacaaggttgtcacagctggttataaacctgttgctatatgagaagaaaaagaaagaagagggaaagagggtgcaggctgataaaaccacgttttatccttgctatttgctgccttcgagaaacaccaaggtgacaacaattgcatcctgtgtgtgcctcaaggaattcttgaatgaaacgggggtttgaaatgtcagtgggcccccacaaagcccatggggctgagggcgagactgcattattcggcgacagcgag

SEQ ID NO: 2306 - DNA, 903 bp, Homo sapiens
  misc_feature (1)...(903): n = A,T,C or G
aattactttcaatttaaccaaaaaaaaggaaccttcgggcaacactgcttttatttccctggttcatactgtaaaagtgaatacttaaaaaaagatacgtagccctgtaactcctaccccttaccaaaaatagcccagcctcacataagtttagtgtcagcagatgactatgctcctgctatctcctgctgcatgaccaagggtcctcttgctcactcttggctgctgccggataatgtcagtctctgccttcagctccatgtgcttttgtggggaccactgacatttcaaacacccgtctcattcaagatttccttgaggcacacacaggttgcattgtgatgccaaccacatcctttatgttggaacactggtgtatctcgaaggcatcaaatagcaaggatnaaacgaggtctttatcagcctgcaccctctttccctctaatttctttttcttataatatgcaatcttacactgatgattaacaacacgcttataaccattctggacatccttagccggcttatgcaaggattatggcaggtcggcagaatactgtgttagcattactctgaatctcatagagttattaattgcgaggcaggaagtctattctattcttgaccactgttccttccatagcaagcttacttactgccccgttaacacaaccttgcgtactttgacctctgatcctttgacaatggactgtagcaccctgatgtggtagcggcgtgttgatcacaatatagtgattgatttatctccccatcacagatttaaccactctactcgctcgctttttgtaatcggatcctttgttcttaattgtcagaatttatacccaccgacagtattccgaaccacacacactgaactgtcctgttatttctcatggctct

SEQ ID NO: 2307 - DNA, 635 bp, Homo sapiens
cctaggtgctgaacgtgtcctccatgggtttcaaggttatcgtatgccctgaaattgggcaaggagctttaagagggaactttgagtttgccagagaaaactcaagatgtttctacatgaggaaaatggtttcagacatttgacttctttaatttttgcatactctttgtgatggttgttagcaaagacctagagtggttgtatggctatttgcaaaggctgagtgtgacttgatattggctcaacttgaaaactttgatatttgatgtttgtattcaaaattggaaacaaaggtgtttaaaaggatgatatatgattatggggtggcatataagactttgcagaacttacctgcacacttatatattttctgccagaatagttgtttgttttgatgttagcctgtgcttgtcatgtttatctccataccttctttggtttaaagtttattctaattaaaaccctaattagtaatatttgtatttactggtagcttagctgtctgagtgtaatctcattttgtttgttaattggtttgcattattagctcattttaaattgccaagaaaaatcctgaagacaagtgaacataattaaattggagcatgggtcacctaaaaaaaaaaaaaaaaaaa

SEQ ID NO: 2308 - DNA, 535 bp, Homo sapiens
gcacctaagatgcacctgcttcctctttgtcttccaccatgattgaatgtttcctgtggccttcccagaagccgatcagatgccagcatcatgcttcctgtacagcctgcagaactagccaatgcatgaagactgagatccagatttgatgttgcccgctgatggatggtggcatatatcctcaaagtgacgttccaacagtgaagtgagatttgcatctttgatcaatatccgttttttttaatctcttgcctcctttggaatagcagcaggtgtttgaaagatgtttctctagatgtcagggtaaagtttataagcatgacatgtaggcatttgctattgctaaatgaagccaactggtccagacataacccacaccttggtctacttagttccatgctttggccaataaccaaattcattttgtaccaaatctcaggaaaccatctgtccaaatcagaggttgctgtactgtaaacatcttcctgtgatctttgttaaaaataaaataccatcgaagacaaaaaaaaaaaaa

SEQ ID NO: 2309 - DNA, 863 bp, Homo sapiens
ctcaggtgtacatggtgcctggaggcagcagacccaagacccagagcatgcaactcgacttggaagcaatccaacagagcagctgttgtggctagtggaggttcccaaatacctgtcatgagtggtctgaagcttctggaagtagtgaagtagggaagctgcagactgccaagaatcagagaaagtctgagctgtcatttactttgaatgaggaacttaaaaacattcacaatattggtggacaacccacccatcagcacacctagggtgcctcagtttcttgtgcaagggctcagagggcagatgctcacagtgttgactaagcgtgcaccgagtaagctctcactggaaggaacagtggtacagtgagaggaatgccaaccagctgcaaattaaaactacatgagactgaagagaatgcaaacacaggaatctgccaaacctgccaaaaccctgcagaaaccggacaaaggttgacacaacttggttataaaccctggtgcttaatcatcaggggaatattggcatatgagaagaaaaagaaagaagagggaaagagggtgcaggctgataaagaccacgttttattcttgctatttggtggcttcgaaaaccccaggggtaccaaatagaggatggggtgggatcacaatgcaacttggggggcttcaggaaattttgacgcaaccggtgtttgaatgtctaagtgcccacaaagcacatggagcttaggcagagactgactatatccgaggagcgaaaggagcaaaggacctttgttatcggcatgaaatacggacatgcgatctgtgcctaaatttcgaaggtggtatctgggtagggtagagtcaggctttcttttt

SEQ ID NO: 2310 - DNA, 331 bp, Homo sapiens
agactctgtcacccaggaaagagtgcagtggcatgatcctagctcactgcagcctcgaactactgagctcaagcaatcctcccacctcagcctctggagtagctaggactacaggtgtgcaccatcctgcctagttaagtgttttatgttttgtagagatgggatcttacttcgttattccagctggtcttgaacaatgatcttcccaccttggcctcaagtgatcctcctgcctcagcctcccaaagcactgggattagagggatgagccaccacgcccagctcaggaatattttcaaaataaatcacttgcacatgaaaaaaaaaaaaa

SEQ ID NO: 2311 - DNA, 752 bp, Homo sapiens
atggagtttcactctgtcgccttggctggagtgcagtggcacaatctcagcataccgcaacctccatctcctgggttcaagcaattctcccacctcagcctcccaagtagctggtattgcaggaacatggcttagagagctgaggtgactgggccaaggccacactgctcatacacaggaaaactgggaataagactccggctgacctgacttcaggatttcaagctctttctcctgcaccacaagactgcaaaacttcaattaatcagaacattcaggggctgtgtcatggaaagggtttcaatatgatgcagaaatttgatgtgtgttgaatgtgaccagattctagtagatgcccagagaggttttaagtcattgattacatacctgacgtgaacctgttattgtcattactttcttcctcagcaagagggcacaggtaggtagctaatatgctgcataatgggttctttcagtatttctgagcatcaaaacagtgctcagtgaaaaatagatcatgcattgtttttcaaatcctaccttttatccatgggccctgaaaccatttatagcttccaaaatttagttttcatatagaaaagacataagggtctatgagtacaaattggccaggagaggaaaaacttccgaaggacaggggcccacaatttcctcgtatacgggtaaaggtgattattaaagggccactgcttattggcgcattagagttatcaaaagatcaaaacctcggc

SEQ ID NO: 2312 - DNA, 1007 bp, Homo sapiens
cccgcagctcccaagcacagaggcatgagtggggagaatgtcaccagggtcggcaccttcatcctggagggccttcccacggccccagggctgcaatacctgctctttctcctattcctgctcacctacctgtttgtactggtggagaacctggccatgatcctcatcgtctggagcaacacctgcctccacaggcccatgttctactttctgagctccatgtctttcctaaagatctgcgtacgttctgtggctccaacgtcttgaaccacttcttttgtgacatttcccccatcctcaagctggcctgcacggacttctccactgcagagctggtggatttcattctggccttcatcatcctgggagtttccactcctggccacgcgtggtgtcatatgcgcacatcaccctgactgacctgcgcatcccctgggacaccggatactggagagcctaaatcacctgcacctatcacctaaccgagttcaccgttttttataccatctagctctttatgtttgttcgttacaaccccatagctaaatggagaaattaagaaaaaatattagagattaacttattaaaaacaagagaataagaaacaaaaaataaacagaaaaccccatttctgcatcccctattgtcttaattaaacaatcaaaacagtagtagaccatatccttattcacccatcgtcctagtataataaggacgaagatataacaagagaaatcactgagaatacgaaaataaagtgattaatgttctaaattacacattttttcttattcgtccccccgttctcgttcgcaatcgaagataaagctagcaattgacctatttaaatatttgagcccaagataagtcattttccccacaacttccatatagaggtgcaatttattacagtagattaggctctaaagtcgacattttcttatctttaccaaatcgagagaaatctagaataatttgagaatgaagatagtaagaacacaagagtg

SEQ ID NO: 2313 - DNA, 357 bp, Homo sapiens
agtctttgaccgcaatggatcagaagccagaccagccagaatcctcagtactcaagagctttaagaccttatgccagagcccaatgttactccaaaaccactgagatttcaaactccggaatctatctctaccctttgtctgattgggaagtgctttgagactgcaagcctaggttctttacctcacatgtcccaatttgcctgggatagtgtcaatttaaaccatttgtcttggtgtttaaatgttatgatagtctgtttctcttatgtagtcaccttactgatgaacaaagtgctgtgcagacttaacccaggattctatttacccacaattgctaagtaataaattattctaaa

SEQ ID NO: 2314 - DNA, 441 bp, Homo sapiens
  misc_feature (1)...(441): n = A,T,C or G
agtctttggccgcatgtgcttagggatctcagnatcagaagccagaccagccagaatcctcagtactcaagagctttaagaccttatgccagagcccaatgttactccaaaaccttggcaagaaaggtgcactgagatttcaaactccggaatctatctctaccctttgtctgattgggaagtgctttgagactgcaagcctaggttctttgcctgcttctttccaggacctcacatgtcccaatttgcctgggatagtgtcaatttaaaccatttgtcttggtgtttaaatgttatgatagtctgtttctctcaaatttggataaaaaactatgtagtcaccttactgatgaacaaagtgctgtgcagacttaacccaggattctatttacccacaattgctaagtaataaattattctaaaatcttaaaaaaaaaaaaa

SEQ ID NO: 2315 - DNA, 655 bp, Homo sapiens
cctagaaagacactcttgtccagcagcaagcttcagagccaaatataagcacacctcataattcagagacctcgtgatgggtcctcagaagacaaatgaacagcagatgacggaaaggggcccttggcctgatctctcatgggagacagtgacctttcctgagttgaagatggtctgatgaggctttcccacacactgacactgctatgatatcatgattgaatttcacttttttctcccaccataatgtaatttctgggattcataaacaccccttactgttctgcattggattaatcatgatgtactgtctttttctcactatttacaaagtacagctccatgaataagtttctctccactggaatataacacatattttgggttctttgcctggactggtcatttctttcttttactaattgccgtgaaagaatgacatgaatggatgctgacgttaactctcccgcttaccagagataaagctggccctacacacacgttctcttatataagagtttattcattggcagaccctttgatagctggttcagtttgtaccctttatgaattctcatgaaagcgatcattcagttaaggtttttgaccatcttcaaaacatatttggttatcaaacctatctattcaagagacg

SEQ ID NO: 2316 - DNA, 980 bp, Homo sapiens
tggagaaagacactgaaggaattaaatcagcttgtccagcagcaagcttcagagccaaatattagcacacctcataattcagagacctcgtgatgggtcctcagaagacacacccagcagctgccaaatgaacagcagatgacggaaaggggcccttggcctgatctctcatgggagacagtgacctttcctgagttgaagatggtgaaatgccagaaggagctgatgaggctgtcccacacactgacactgctatgatatcatgattgaatttcacttttttctcccaccataatgtaatttctgggcagtgattggggtgttgattcataaacaccccttactgttctgcattggattaatcatgatgtactgtctttttctcactatttacaaagtacagcaccatgagaatccctgaattttagaataagtttctctccactggaatataacacatattttgggttctttgcctggactggtcatttctttcttttactaattgttgtgaaagaatgacagagatgtacaacatggtttttgaatggatgctgagtttaactctcccgcttaccagagataaagttggccatacacacacgtcttttatataagagtttattcattggcagacactttgatgatgacattgagttagatgaaatactggttccagtttgtagcacattatgaattttcatgtaaagtgatcattcaatttaaggtttctgcacacatcttacaaagcatatctgtttatcagagctcatttacttaagaggattaaaatgaaatctctcctcatgagccaagggtgaaatagctagtgtccgctcctaaatatgtgaactaatatgtttttccatgggcaagcaagattttgtttttctccaatttttcttcttcagaaggaaatgattaaaataccactcccacaaaaataaatatacattataaaactcaaaaaaaaaaaaaaa

SEQ ID NO: 2317 - DNA, 232 bp, Homo sapiens
catgtgtatcctcacgtgatcttcctgccaagatttttctccaatcaaaagtccatcttccactttctctttggaaaaagaatgcgtaacagtctctattccctttcactgacatctccccaagcccaactatcattttctgcctttaaaaaataactggaatttatataaatcaataccttggttcacagtatgcattaaaatatgtattggttgatcaaaaaaaaaaaaa

SEQ ID NO: 2318 - DNA, 282 bp, Homo sapiens
  misc_feature (1)...(282): n = A,T,C or G
tttccagtgtatcctcccctttncgctcctggtgatcttcctgccaaaatttttctccaatcaaaagtccatcttccacttttctctttgngaaaaaaaatgcgtaacagtctcactactgcccatcacctattccctttcactgacatctccccaagcccaactatcattttctgcctttaaaaaataactggaatttatataaatcaatccaacgcctatcatagaccttggttcacagtatgcattaaaatatgtattggttgatcaaaaaaaaaaaaa

SEQ ID NO: 2319 - DNA, 389 bp, Homo sapiens
atgttctgaagatactcctttgaagtcaatttccctgaccctggatccacagagccacctgcagatgtcacactgaaactttgctgttgacacagttctccttcggtttttgctttcatcaagaaaattcttcaaacagctgggtgatgccaatacatggagcccgctgggaagtacataaaaccagacttaattagtcagtcacatttagagtactttttcttctccatgacgactctaatcacgttagccatatttgaactggagccacacatgatgaacacaaatttatgtttaaatacaaatattagagaaagacaaataggttgacataattatgtggttgattaaaataaatgtgccacctcatcacctcaaaaaaaaaaaaa

SEQ ID NO: 2320 - DNA, 479 bp, Homo sapiens
ttcccgagtttctgaaacattggtcatcccagggaaaactcctttgaatcaatttccctgaccctggatccacagagccacctgcagatgtcacactgaaactttgctgttgacacaccacctgtttttccttgttctccttcggtttttgctttcatcaagaaaattcttcaaacagctgggtgatgccaatacatggagcccgctgggaagtacattcttgttccacactagaaaaccagacttaattagtcagtcacatttagagtactttttcttctccatgacgactctaatcacgttagccatatttgaactggaaaatagcagtgttttcagccacacatgatgaacacaaatttatgtttaaatacaaatattagagaaagacaaataggttgacataattatgtggttgattctcctgtggctagaaaaaaaaataaatgtgccacctcatcacctcaaaaaaaaaaaaa

SEQ ID NO: 2321 - DNA, 436 bp, Homo sapiens
  misc_feature (1)...(436): n = A,T,C or G
acacacacaaccaacaccccccaacaacctgtagtagaaacaaagngaatagcccaagaacacacagtatgacatcggcagagctgtgggcaacgactgcaatccctgacctggaatacagccagcaagccctgagaccacccaccatgccgttaagaagcccaagcaagcgaagacaccggataccagaaggacacgcgaaagacgaggatcctgattcaaaggccgaaccgacctaaaaacaaaagtgcagtagacacagctgtgcctctcatcctgagcatcctcgagaacaaagaaaggaactcaccaaagccccagactcagcctacaaatcaaagctgttatactggaaatatacacaaccgaaaaacaacctgccagaggaaacgcccgggcacacatgaatagaacatcaagaacaaaaaaaaaaaaa

SEQ ID NO: 2322 - DNA, 527 bp, Homo sapiens
  misc_feature (1)...(527): n = A,T,C or G
ggggggggccgcccgggacggaacgaaacgttttggnnggnnntgccggtaaagaattatgtctgggatataaaagaatgcccagaacacacatatggcattggcagcactgagggcaacttctgctatccctgtcttggtatccagtcaccatgataaaaaatgccactggccctggaaaccaccacacctatgccgtataagaaatgctccacagcaagatgaaagctcacgcgtcatactaggaatgaaatttgcaaattcacttcattgctttcaaaaggatttggattctcaggccgaattgtcctgaaatcaaaagtgcagttgacacagttttgcctctcatcctgagcatccttgtccaccattaaaatgtttctaacaatgaaaggaactcaccagagccccagactcagcctacaaatcaagctttatttttaaatattaaaacgaaaaaaatctgttagattgacttttacaaggaaataaagccaggttactgaatgaattcaaaaaaaaaaaaa

SEQ ID NO: 2323 - DNA, 198 bp, Homo sapiens
catgtctctggaaacagtccttcacctgactttaaaggacccttcagtttgtagaaggggctcagaaaaagagctgatgcaggtcttggcacgaagggacaaaaacaacctaagaggccaggaagtttattcctatgaaatgttgcttctccaaaggccatctcaactcgataaatctcttatataaaaaaaaaaaaa

SEQ ID NO: 2324 - DNA, 251 bp, Homo sapiens
  misc_feature (1)...(251): n = A,T,C or G
caggtctctggcaaaaatgtagaaaaaattatncagtccttcacctgactttaaaggacccttcagtttgtagaaggggctcagaaaaaagagctgatgcaggtcttggcactgtgccagtcatagatgaagggacaaaaacaacctaagaggccaggaagtttattcctatgaaatgttgcttctccaaaggccatctcaactcgattacacattttccaaataaaatctcttatataaaaaaaaaaaaa

SEQ ID NO: 2325 - DNA, 631 bp, Homo sapiens
  misc_feature (1)...(631): n = A,T,C or G
tacatccttaagtgcactggaccatgaagagtttgctatacttagcaaaaaaaaaaataacactcccaggggatgaaaaggcaggtctgtatgctgaaaatgctgacattccagacagatggatgtcttattgcaaagttcccctgaacaagcatcttaccctcagggtgtgattgactttgctacacagagcagcaagagtgacctcaattccatatccatcagtgagatttatgactaatgcattaaatgctaatggaatatacaatgaaaatcttataagagatatacacatgcgtgatgcatgcacacatgtatgtacatggatccaggaagaaaagccactggtgtatgaatcttcctgatccagaagtgtttgaaaattatgaggaaaaatgtattctaaaatcatggcctcatcttcattgaaaaattcttttaatgctctttgttgaagagaagtctgagtaggttggtttatgcataatcatttatggtggaccaaagtttatgtcctttacaccttgccaagctttcccggcttatttaatttaaggcccctcgatacacaaatcatattctaagaagaatcttatccctagggcaaaanatttctattgaaaagaaacgc

SEQ ID NO: 2326 - DNA, 850 bp, Homo sapiens
ttccaggaagcagtgaaggttgtacctactgcaaatatcattcgtgcacaggacacatttaatgcactggtccatgaagagtttgctatacttagcaaaaaaaaaatagcactcccagggctgtatccttactgatgatgaaaaggcaagtctgtatgctgaaaatgctgacattccacacagatggatgtcttatttaaaagttcccctgaacaagccatgaagaacagcattagctgaccctcagggtgtgattgactttgctacacagagcagcaggagtgacctcaattccatatccatcattgagatttatgactcaatagtaaaaagcaaaaagtgcattaaatgctaatggaatatacattgtaattcttattaggaaatattcacatgcatgatgcatgcacacatggatttcctggatatatttcattgtacctttgccaaaaaaaagagccctggttgtttaatctttctgatcccgaagtcgttagatatgagtgggaatatcgcttttaaaattatgggcttctctttcttctcgaggccggcatgatcattaaaaaatccctttatggttttatctcaggagcaatttctatcagcggcggcttattgacgcacccttgctgcgtttcctcgacgttgttgtgcgcgcccatcccatcagaagagaaccgtaacttccgcccgtctatcccatttttattttttttacacgccttctcctatcctccgttttttccttccccgtaccgatccttcttctctgcggcagcacgattttcttggggagggcccatttttttccactttttccttgtcgtcaagctggattctgtcgttg

SEQ ID NO: 2327 - DNA, 825 bp, Homo sapiens
tttttttttttttttttcttttccaatagaatttttatcagtccttatggtataagaattcttcttaagtaactatgatctgtgtatttgaaggtggccttaaaattaatgaagcctgggatagccctggaagaaatcccggtctctcttggatggctgtacaggaacataaaactttgctcaaccatcaggtgattatgcatgtgtccaacctactcagacttactcctcaacaaaaaacattaagagaatttttcaagatcctcacaagcatcaaaaggaaaatgaggccctgattttaaaatacattcttcctcaacattttcaaacacttcgggatcaggaagatacatacaccaggggctctttttcctggcaaagctacagtcgaatatataccatgtacatacatggtgtgcatgcctaataccatgtgaatataaattaaaaaaatcgagatgggataccacattaccctttaatgcttgttttgtttctaaaattgagtcacagatctcactgaagaaactggacttgtggtcaatctcctactacgaaaccaaagcgataccaccgtaaggccaagcgaagtgcttcttatggctagatatgggaactacgataaaacagccattgaactaaaatgcgcaatttcacctattgtccgcctttatgccatcaagtgcccgctctggaaagaatcattttgtgtatgacacccccctcgttagttgtgtcctgcgcgttttcaccacatcgtcaccgtcgtaacctgcccgatctcgctcgcatgggcgcacacctcctccgttgtagtgatgtggg

SEQ ID NO: 2328 - DNA, 319 bp, Homo sapiens
atatgcaggcttcctattgctctgagcagtacttattctacctgaacatagaggaaggaagcctagatggctggcagaggagcacagccccacgtgacccttctctgcccgacgacaatggaagagcaggcaccgtgagatcctgggctaaccacctcctccccgcagcacaacgcaacatcggttccccaccacccagcggagacctgaactcagtctgaggaaagtctgatgccgccatttctaacttaaacagtatttgcccctatgggcagggctttgaccctaataaaataacaccttaataaaaaaaaaaaaa

SEQ ID NO: 2329 - DNA, 388 bp, Homo sapiens
  misc_feature (1)...(388): n = A,T,C or G
tttcggtagcagcttcctcttttagcgcaaaggnaatgctctgagcagtacttattctacctgaacatagaggaaggaagcctagatggctggcagaggagcacagccccacgtgaagatttcagcacctgtcccttctctgcccgacgacaatggaagagcaggcaccgtgagatcctgggctaaccacctcctccccgcagcacaacgcaacatcctagctcccggtctgcggttccccaccacccagcggagacctgaactcagtctgaggaaagtctgatgccgccatttctaacttaaacagtatttgccccacttctaggtaataaacttatgggcagggctttgaccctaataaaataacaccttaataaaaaaaaaaaaa

SEQ ID NO: 2330 - DNA, 115 bp, Homo sapiens
agtgcctgtaaagctgctatgcagctcctgacgctaccagatcactttgggattcttgatagccgatttttaattaaataaatgtaattgcctgtttccaccaaaaaaaaaaaaa

SEQ ID NO: 2331 - DNA, 740 bp, Homo sapiens
  misc_feature (1)...(740): n = A,T,C or G
agcatcaagacaaaatgaagaacaggacaaagatgtccgctctcccggtttctattcaacattgtgaaggaggttctagccaaggcaattaggcaagaataagaaataaaaggcacccagcttggaaaggaagaaataaaaggcacccagcttggaaaggaagaaataaaagtatcctattagttgatgatgtgattttgcatatagaaaatcctaatgaatccactaagaaactatttgaactaataaacaagttcagcacggtttcagaatacaagatcaatatacaaagagaaactgtatttctttatagcagcaataagcaaacagaaaatgaaataaagaaaattctgtttacaatagcatcaaaaagaaaaaatgcacaggaataactttaacaaaagaggtacaaagcttgtatgctgaaacctacaaaacatcattgaaagaaattgaagattttaataaacggaaagatatcctatgttcacagatcaccccacgtaacattgttaagatggaaaaactcttcaaattgaactaagattctacacaatccctaacaaaaatcttggctgatttcttggcaaaaattggcaagctaatcctaaaactcatggcaatttaagaaactcagaatggtcaaacacaccttcccaaagaacaaagctgtagaatttacatttcccaattctaaaactcactacaaacctatagtaataaagaccgtatgcgnccag

SEQ ID NO: 2332 - DNA, 786 bp, Homo sapiens
agactgtgcatcacagcaatttaggagtgtcgctgctgcatcatgaatgctgagacatccttgtggacaccagctgaaatgaatcatggttccacagcgaatccagccatgctaccctgacacaggcctgatttaaatcaccactttcaccgagagggtccactgctgcccaatagcatccataaaagaatctgtcagaaattaaactctgtgtgtgttttgggggtgagggacagagagtgataccaagataagctaaataaagagcttctctgagatgattcaggtaaaaccgtattttaaggctgaacattgcagagccaaaaagcttcaccattgagaagctacccacgtggcaccaaaatgttcaataaggatacaaattacacatgaaagtctgacaactcctgaagacatggtagggaaaatcatttcatctaaacggagatggaaatttctcttttaatacatcattctacattcataaaaatacacatttgtgactactgagaactatttcaaaccttcgggtgaatcaataacctagtctataaagtactcttatggactacaatgctccgaggcatatattgaataatcttccacaataccttcattaagaaaaaaagtacaactttagaaaggctcacttctgaaccaccacctagcatgaaaatttcccgttggtcgaaccgtacattaattcgtggcaaagaaacgtctactactggcaaaagcatgcatatgagcagttttcaggattcgttagtttaagactggcagtag

SEQ ID NO: 2333 - DNA, 834 bp, Homo sapiens
acgaagtctcgctcttgtcccccaggctggcgtgcaatggcacgatctcggctcactgcaacctccgcctcccgggttcaagcgattctcctgcctcagcctcccaagtagctgggattacagactctcaacagctcagaggaagagactatgcctccattcaagtctgcatctccagtacctggcacctactcactgaatgaatgaatgagtctggtgtggctctacctccaaaacatatccagaattcatacagccactgtgcaccaccgcaccctccagggtccaagctcccgccatctctgacttggattaggatcatcaccttccacctgtattccctgctccaagtctatgctcaacacagcagctgcagcgaccctatcgaaattcaaaagccctccaatggcttccatctgccccagattaacagtgtccaagtccttacaacggcctggaaacccctgcaggatctggccaccccagttcagtcacctctctgatctagtctacccgatccatcctaaacttcttgctgtcctgaaacacaccaggcccacacctgccccactattgcgccttgtgcttactgtttctcctccagggaacactctgccccagagtcccacaccacctgcaccccttgggtgccactgtctcttccctgaccaccccactgagggctgaaatcatactcctacccgcccaccctggcacccactgcctttactttcctccacagcaccttctagcataatacataatctaacttatttcagtactggctgggccctcacccccggcagaacacagtccatgcgaatagggattttg

SEQ ID NO: 2334 - DNA, 183 bp, Homo sapiens
cctgtgatatagatggagaaaatttgagttgacatattggaccatgagaataaaaccatgtgttgaagatgacagaaatacgacacagaagcccaacaattatggaactgatttgcagcaaggaccaccttgaacttatttgaggaataaactatctttttattaatgtcaaaaaaaaaaaaa

SEQ ID NO: 2335 - DNA, 976 bp, Homo sapiens
tgatatgatggagaaaattggagttgacatattggaccatgagaataaaaccatgtgttgaagatgacagaaatatgacacagaagcccaacaattatggaactgatttgcagcaaggaccaccttgaacttatttgaggaataaactatctttttattaatgtctctattatttgtagtcatcctcactcagccaactccattatctattctaggcaactgaaaacaagattccaaaaagaaggaggttctatgaagaatgttgtattagcaaggttaatttaattaaatttaaagatttggaagttggaagataaagatatctctttggtcaacaaaaatgtagttttcaatcagtaaaatgcatgttgtgggaaattgaaatacttttatgtgacatatctatgtacaaaaacattaactagagactccagaaaatccacaatactttaaaagtagttatggtgtgatcataaagcaatctaataggtggtatagttttgagcaactgatagagagtaaaaaagaatgcatttaacctgatagtcttaaacattcttcaagctctttaaaagcaaaggttttcattccttacttaagagtccatcatggtacttaaatatgtcagtaatagtatttacacagccataatactgatttgtaaatatacttgagtggcatcataacacataataatttaaaaatgcagtccctgatgacagatttccttcaccccattatgtgttaaccgttcagagttttctaaaatctttctatatattagtgtttccatgtacaaaactgggttttaaaaatagaacctctttcaacattaacagatcaaagaaaatattaataccgtatgatcatctcaatagatacagaaaaataatccgaaaattcaatatgctttcatgataaaaattgtcaacaaattaggtgtagaaaacgtagtacaataaagcccgatcgcaag

SEQ ID NO: 2336 - DNA, 1146 bp, Homo sapiens
actgcccttgaatgtgagaaaatgagattactggccaagctgcatcagatgatgttggtggggagagaaagatccaaaatctcagaaggttgtcagagtggggacattctggaggaagagaggataaaggaagaaagaaagcaggagggagctggcaacagaattgacttactttctagtcatgtctgaaccttcgaagaaagaagacagatagaagaaggaatactaatgcttcaagaagtcccaggcagggaggaagttctgacaacctgaatgctgctgttcagaaggtctccctggaaggaaaaaatgccaacagcgtgtctaaccacaaagagagcagaagccttccaaaagctacagaagaagagacaaggttccctctctcaactcaagttaaagacacttccatcaaaaaggcatttctaaaggattttgcagtgatttattgagattttccccccatgaaaccccaaatcagaaggttttgatctattaaagcaatataaaacatggtgtcagtaaaatttctggtgaaatatttcctgaaactagctagtaatcaaaattcaaatgtcaccaaatggaggcgggggaatagtctacctgtgcacctcttgcactaatgtaactagaggttctttcctgtttataggggtacccaactctggaagtggtgtttgaatattagggtgtttgaggcccacagaatgaagtttaaactctgcttctgtgtataataattaaacatggggaagttattttacacctttgacattttcgcatttataaaataaggatgacaaaattcattaaatgagatggttgcatggattacataatatacattgccaagttatagcccagcgtttagccataccactcaatcaagtgcaggtggttaacttttattaatcaatttgtgttgtctaaatatttttttgttctataagacatgaaacaatgaatacagttatgtttgaaattattttatatgttgaaaatttttagccaatcccacatccttaattgacctgtgatatctaaaaaagaaaattgtctctttgtttaaaacaacaacaataaaataaaaagagatgcggcgactttttttttttttcttgttctttatgttatcccttctat

SEQ ID NO: 2337 - DNA, 902 bp, Homo sapiens
tgtgtacaaagaagtccgtctagccatctagaacagtggttcttgaagttcagtatgtataagaaacacctgggaccttgttacaattgcagactccagagagtttccctgagcttcagtagggctggagcaggatataggtgtctgcattttaaacaagcatcagaagtgagttcagatgccactcatctaaagaccatgaactcaaacaaatttacaagaaaaaacaaacaaccgcatcaaaaagtgggctaaggacatgaacagacacttctcaaaagaagacatttatgcagccaaaaaacacgtgaaaaaatgctcatcatcactggccatcagagaaatgcaaatcaaaactacaatgagataccatctcacaccagttagaatggcgatcattaaaaagtcaggaaacaacaggtgctggagaggatgtggagaaacaggaacactgttacactggttggtgggactgtaaactagttcaaccattgtggaagtcagtgtggcgattcctcagggatctagaactagaaataccatttgaccccgccatcccattactgggtatatacccaaaggattacaaatcatggctgctatagagacacatgcacatgtatggtaatagcgggacctattcacaataggcaaggacttggaaccaacccaaatgtcccacaccgactgtattaagaaaatgtggcacatatacggcgaggaatactatgcgggccataaaaaagatgagttcattgcctttgtggggacatggatgaaactgagaaccattgtgtctagcaaacctacggcggggacaaaacccaaccccggatggttttcgtcctaggtgggaattgacaatgggacccttggccccgagggggaactcccccccgggg

SEQ ID NO: 2338 - DNA, 883 bp, Homo sapiens
  misc_feature (1)...(883): n = A,T,C or G
atgggactgtctagtttcaggaaaacaagctcagggctcccatgagtctacaataagattacgaaggagaaatctggaaaggaatctacaaaggctgaaaaaattattcaaaacactcaacaaagggcagagactgtatttcaacctcaaatcttattaatttgcaaattcatgttcttattgattctactctttacagctaaagatttgcaacaactttctaaaatcatactgtaaatttacagtttctatcagattatcacaataatttacttattgtcaacttctctgaaatgtttactagtttcctactggctactggattacataaaataatcatccatgcattcatattcctatttgttggggctcaaaagataatactttaaagtatggtggtttggtatgctgagaactttgaactgtaggaccctggaagggccttagaagcaaagcctcttttctgacccttctttctcctgtttacctttctcccccaagctaggccttagaaactaggattcctcttccctgaggtgggtcacattntatggcatagagccagccataaaagcctaggatataactctaaccccacctttctgtgtaagtgcttcccctaaaaaaattttctgacctaccttgtgtgaaagtagatcataagaccctcattccagaaaggggttctgccttatacctacgatgaaggaggaccacacagagaagcccagaattcagacaggcctcaccaggcttcttcactaattctgtaactgtagaagcattcctttgggtccatcacatttcccacactgtgcactcttaccaattataggtaaactgacagggtcctcagtccatctgaagaaccgggccggaaatt

SEQ ID NO: 2339 - DNA, 633 bp, Homo sapiens
ttatgtggtggccctcattctccatgcatggagcagactctaggatctgcagttactgtatgatgagcccttctgagtattttgcttgggtggacagtttatgtgtcaggtatgtgtatttataattaaaatcaaatattattacataggctttgcacctggcgaggtaacattgagagtagttaatctctagactggaatccatctggaagaccactcaataacttgtgattagctggacctggtgatgcaagcctggagtcccagttacccggaggctgaggtgggaatatcgcttgagaccaggagtttgaggctacagtgagctgtgattgtaccactgcactccagcctgggtgacagtgcaagacctcatctcttaaaaaaaacaaacaactcaaaaaacctcatcattgagcacctatgatgtgccagcaactgtactcagtggtggggacttgacgacaaacaaaccagggatgggatccttgagcagtcaccatctgacaagtgactgggaaagatgaataatgcccttcaccaagattcttctctgatccacaaattcaattaccaatttatttgttcactgctcttaaacttaaatattttttagtaggtaataaagaccga

SEQ ID NO: 2340 - DNA, 511 bp, Homo sapiens
tatgctccaaccagcagcgcggaccgcaagtggagcccggcaattggaaagttgcaaatgcctggatgctacgttttgcatcttctttagatatccttgactcatacatcctgtctgggctaatgttgttttctgcttgcagtgtgtctggagtctcaacaagtgcccaagccaccctcaaagggtcactccttgtttcaagagcacttgtgcttgccttgacctctctgtcgctctctgattccacttaggaagctgcttagttccatttttcaactgaaaaattatcctctgcttcaggccactctgtcatactgttttgtgtagtgttttaaagctaatttgaactaggcaatgtcttagccttagatatagacagataattttccagatcagacaagctatagtaaagcttcaaagggaaaacttttattcctaaagagaatagaaaactcatctgtgttattcatattgtatttaagaaatgacccaagttgaaaataaatgacga

SEQ ID NO: 2341 - DNA, 890 bp, Homo sapiens
aggaagtgtaacttcctaactcacccgcattgggcttggccatgtgatacacttcagaaagtaaaatgagaatggatgtgacctctgccacctctgccttgaagctttggatgccatgtgggaatcagctgagaattttttgtgcctttgctgactgctggcaaagcaacataccccaggcagggcagttcattcagcctgggttctggcgtaagaagaaatgtgatcaactgttcagaccaacacaccatgtttagataacatgaacaagaaattaatgtgtgggcaagggactgagattctgagtttgttttttactgtagcagaagctaattcagggactatatgcttctttgtagcagaatacttatatttctgtacctagaccccccttcttaaaatgcatcttaaacagagatttcagaaatgaattataataaattgaagacttagcttgaagggtagaggattttaaaaaggagcgccctctttgaaatccacaccatggatcttatactttttccagaagactagtttttgaatgactgactatttgcattaatggttattcttgggcaccctttgtatttctagcctaattactttagaacatctttccttacattttggcgtcatttatggtcccttttcttttaggacctatacattcctggtccagtatcctgcaatttggattagagttgtttcgggaataaaacagtgaatgtgtgagtactcttgaacaacgatattaatcattttggtaagtggttatggtttaatccctcaacttagaacatgatgtcaccttgcttatctctttatttatgaaaatgggctctagggtggcctgagtcacattctaaagattggaaatatcatataacttg

SEQ ID NO: 2342 - DNA, 540 bp, Homo sapiens
atatatatatatagcaagtatacaactcagtgagcagagggatgactgactagaatgggaggcaggttgaagggacccaagatactttcctttcacagccttgtattatggtcatactggtaggtataaaatgataaggtggttttcatttgccttttcctaatggttagtgactgttcctcagtggccaggcctatacaaatctgccccaaagtcagaggaagctgagacgccaaagaaagggactggcaaatctagttctttagagagaaacatttaataggggacttatgtacagaagccacatctgtgtctctggcaggggtgagacaaggtggggggtttcccaaccatcacccccgggcccaggggctttccagacccagggcttacttactgggaaagggaaaataaatcttgggaccccaaactcattaagcccaaggggaaagttaagtcttgaaactgggtcaggcaagcctgcctccccttttgggtcctaaaaaagagggtggaaaatgataacctcaccgcttccct

SEQ ID NO: 2343 - DNA, 989 bp, Homo sapiens
  misc_feature (1)...(989): n = A,T,C or G
actgtcctccttggctaggaatttggaaaccaaataggagattagttcctctgcggtttttcacgtcaggggaaatgactcctgtcgtccagctgctggagctctgctcccataagctgcctggtaagagccccaggtatggcctgttctgctatgccttgccctcctatggggacactgcttctctcatctctcacggtgtcattcggatccagtcatctggcctgtttctacactctggacaccaaacacgacttgctggatggactgttttccatcattgtagctacagctgctcccaatatctgctccacagaattggtggttaatttctaggccactgcatctctcgatatgggcaacatgactactgccagaccgtctttccaaatatttaatttgccttggaataaaaagattttcacagcagagcaagacaaggcagataatacaaattttgttttatggctaaggaaacaggcttcaagtggtcaaattacttgcccaatgctacctcgattttaagcagtggagacaggttaaagctcagacattttgacaccttctctagtggtgttccatcatgtcaaaagggcaggaacaaagtttcaacattttcggtattccttcacaaacattataccacaactcattcataatatgtgctcaattaggccgggcacggtggctcacacctgtaatcccagcactttgggaggccaaggtgggcggatcacctgaggttgggagttcgaggccagcctgaccaacatggagaaacccccatctctactaaaaatacggaagtagccagcgtggtggcgcatgcctgtaatcccagctactcaggaggctgaagcaggagaattgcttgaacctgggaggcagaggttgtgttgagccaagatcatgccattgcactccagcctgngcaataagagtgaaactctgtctcaaaaaaaaataagaaggaaagaaataaagaccga

SEQ ID NO: 2344 - DNA, 467 bp, Homo sapiens
atgaaagccatttaccatgtattctctttgaagctgctacctggaagcttcatctacatgacaagaactttggcttccacaaccgcccaccttaacttaactcaagctgacttcacctattcaggaagagtttaactctttcagctgattgccaatcagaaaatctttgagtctgactggatgcggtggcttatgtctgtaatcccagcacttttggaggccaaggccggtggatcacctgaggtcaggagtttgagaccatcctggccaacatggcaaaatcccatctctactaaaaatacaaaaattagctgggtgtggtggtgcatacctgtaataccagctactcaggaggctgaggcaggagatttgcttatacccaggaggcggaggttgcagtgggctgagatcacaccattgcactccggcctgggtgacagaatgagacttcatcaaaaaaaaaaaaa

SEQ ID NO: 2345 - DNA, 551 bp, Homo sapiens
  misc_feature (1)...(551): n = A,T,C or G
agcaattttgatgtaatcagaggattatcttcagcatctcaaacacttgaactgtgcattcatttttagcacgtcaaccaaggtggcagatatttttgtcaaaaggcaaaatccaacttcagtacctctttgggattatatgtctggaacacataacagccaatttggaactatggtaatgatcttttgcatgtttacataagtgaaaatggattgactgggnataactttgaagtttgactntggtagcagtctcctgctttcttacacttagtaataacttactgtcattatgtaactaatttatataactaacataaagttaataatacccttacagttcatacgtcatttcataaaacttcacaagaggtaaatttttcattatatgtaaaatcttcaatgctgagacttagcagntaaaatttgtttaaaaattaggatcttttggcatatacctataattacactggggaacagaccaaaccacaatatgctaaaagttatcttttaaaagggggaccaattcctggcgtatggagcaacatgcg

SEQ ID NO: 2346 - DNA, 513 bp, Homo sapiens
gattccaaacaaaaatccacctacccatggggagttcacccatgtatcctaaggggtctgctgattctttccaaatttttcatctccatgggctggtacttgatttcagacgctgattttatgtttatggttaaggtgactttgggcctaaggccttctactgtaattgggttctgactagggagaaaaaaaccagacctaatacctaattgatgcatcttcaccgagccattagccaaatgggatgccatcacactgggcaaagaaagacttcgctactagagcacaagaggggggcctgaacaggtctaccaggacccatgggctgagaatacaagggtgggtccctgggtgcgcccgtgacgttttaagagaaatcatcctgtggcccactagatcacgggtctgacttcaatatatttgggttacaatatgccagcgtatggcgcaaaaactttagactagggggggagtttatatttatgtcaagacccgctccccacgacgggaact

SEQ ID NO: 2347 - DNA, 1224 bp, Homo sapiens
accaacaccacatggaagctgccaacgcttaaggcttgcaccctctgaagcaacggcctgagctgtcctttggcctcctttatccacagctggaatgcagggctggggtgctgggcaccatgtcccaaggatgcatacagcaggaaggcctggccctggcccagaaaaccattttccctcctaggtctccaggcctgtgataggaggtgctgctgtgaagacctctgacatgccctggaaacattttctccattgtcttggcaattaacatttggctcttctttacttatgcaaatttatgcagcaggcttgaatttctactcagaaaatggatttttatttttctattgcatcatcaggctgcaaattttccaaaattgtatgctttgcctcctcttgaacactttgccgcttagaaatttttttctgccagataccctaaatcatctctcaagttcaaagttccacagatctctaggggaggcatgaactgttgccagtctcattgcatagcaacagtgacctttaatcaagttcccaataagttccaaaactccatctgagaccacctcagcctggacttcattgtcagtatcactatgagcattttggtgtaagctattcaacaagtctctaggaagttccaagcttacccacatctttcttctgagccctctaagtctctaggaaattccaaactttcccaaatattactgtcttcttctgagcccaccagactcttccaaattctgcctgttacccagttccaaagtcacttccacattttcagatatatttatagcagcacccaactcgctgcagtaccaatttactatattagtttgttctcaccctgatataaggacatacctgagaccatgtaatttatgaaaagaaagaggtttaattgactcacagtttcgcatggcttgggaggcctcaggaaacttaccatcatggtgggagcatctcttcacagagtgggaggagagagaataagtgtcaagcaaagaggagaaaaccccttataaaaccataagatcttgtgagaactcactcactaccatgagaacagcatgggggtaactgcccccatgattcaattacctcccactgggtccctcttatgacatgtggggttatgggaactgtaactcaatatttgatttgggtagggactcagccaaaccatattagccaacaaataaacaccgatgctggcca

SEQ ID NO: 2348 - DNA, 882 bp, Homo sapiens
accaagtcgaattgatgcacaaaggatgcgttgaaagcctactgcgtgcttagaggaagccaaaactgtgaagaccacaagccaagaactttattgagctcttactggaaggggaaatttgggcacagaggccaacatagtgaagacacagtggaggatgtcatgagaagacggaggttgaaggatgcggctgcaagccaaggactgccaaggactgctggccacccccagaagccagcaagaggcaaggaagggcttttcccagagtctcagagggagcatggccctgctgacacctcgattccagacttctagcctccagaacagagagagtgaggctgattcacttactcaaattaatgttcacatcttgcctgactcatttaatgggaacagcgagttcatgtgccaatatgtgaactgaccctgaagacctttcaccaaaaaaatatggagagtctcttgttcttgagttaacgagcattggacaacaaccagcttttctttgactttctctgtttttcacagtgatgcctgctgatctctgtctagcattctgacaaagggattggcgagagcctcttcaggaagacagggaatgaagactcccagaaaggatgaagagaacactttaccatttctcaaaagtgattttacccaaccaactttgcagatgaggaggctcgcagatcagagtgggtaaatggcttggccaagttcgtccaggaatttattgcagaaccagggctgagccccatttgtccagatatccacttctctccttctaatttttcttcttcccaggtttttctctgtctctgctactatctgcctgattctttgctttttattccaaatatgtaaacctgcaataaacccaga

SEQ ID NO: 2349 - DNA, 375 bp, Homo sapiens
aaacaggatgtctgtggtcagaggttacctcttaggcagcttatttgacctctgaaggacctctagcttcattattatccaattttcacactaaatgacactcccactggtgccatgacacttgacaatcaccgtgaatcacctttttcggaagatgccaaaaaagaacaaaaaagaggactctccttgattccaagaaaatctccgtccctttccaagtaaaagcatgactattcttctgcttgttcttaatgccccataccttcattaaagataccctatatctgtaacttcccagttctcaggagccgagaagttgatttgcgagctatgctcccagttatccaattccacggccattggaataaaacctga

SEQ ID NO: 2350 - DNA, 226 bp, Homo sapiens
ttagtttttgagaaacctacatactgttttccataatgactgcactaatttacattcccaaagtgctggtattacaatcgtgagccaccacgcccaaccgccaacaaatgttttaagcaactacatttcagggtaattttttacacagcaatggaaaatgcattcaaaggataaatatgttacagtatgtttatgttatgacatactatataaaaacaaaaagaga

SEQ ID NO: 2351 - DNA, 769 bp, Homo sapiens
acagagcgagactccatctcagaaaacaacatcaacaaaaaaaacttcattcagagagaggactttgatattccggaggaaaagtggctacaacctgccaggactctttaaagggccgagtagggcgaaactccatgctcaccatttgatttgaggtttgaccatgtgacttgctttggcctgttgagtgtgtttaaaggacacatgccagtcctgatcctaggcgttccgaggttagcatgattccacatgtgctcgtgagccttaacctcatccatgggagcaagcctgggacctgtctgcagggagtaagagagacattgatgcatggaggcaagattggccctatctagtacaatgagctaacccctgctggcctgtagtactccctaccattcgaaagcccattaatgcactcgctttttaacgagaacaattgatgatgcggccctatccccttatatagaggtctacctcatgatccttgttgactggactcactgcgcttgaattataccgactatagttagccgttattcaccttctctagataggaaagtattccggtttttccaccaaattccttccaattcggtttgtcaatttcaagctactccatagattctctttatctctcgcaccctccgatcatgtccttataatgtctttcgtttatcttcccatcatcaacacgtgacaactatgtgcatcacctatacccttagttaaaccactgatataatatctatggatgtcttggagattaaag

SEQ ID NO: 2352 - DNA, 245 bp, Homo sapiens
atattaaaaacttccatgtttcaaagaccaccatcaagaaaaagaaaagaaaacctacagaagaaaatatttgtttccagatgccatatgcttaactgattgatcttaatgtagcctggtgatcacattctctctggaggtgattgatttaccatggaatgtggccctatctggcaataagtcatgaatgttaagaatgtggctggtgctggaaaaggtatcctcaccaattaaataaagagaga

SEQ ID NO: 2353 - DNA, 451 bp, Homo sapiens
taccatgatacccgatacttttgtcgcagggggacgatccttagagggaactgactctcttattaaccaccgctaacagggattaaagatggctgcattttctccgacacgcctcccatggacctaaggggcctgtaactgctttgaccaacagaagacaggggaagtgatgctgggccaggtcctggctcagaccctgagagactgcagcttcacttcctgtcatttggagccttgagcggccaggtgagaaggctgaccaccttgctgctagtgaagaggggccccggtgagcccagcctcacaacaggcggggaccgagctgtcaggggtgtgagaaaagctggtggacccttcagatgagctcagttgagtatttccaagtaacctcagtcaatgctacatgaagccaaagaattgcttgaattcctaacccacaaaataacaagat

SEQ ID NO: 2354 - DNA, 696 bp, Homo sapiens
ctgacaaacaccattttccgccacagctgctgtcagttcaaaagtttggctctggggtctgaagaccaaagtctgtccaaggctgatcaccttctgagaaagactcttaaattctgtgaagagtctccagcagaggagacattggtttaaaaaagcaagaagaatcaccacaatgcatgcccactccacattaccaagcctgcacaactcatgttaggggatgtctgctgctcctccagctttctcccctggcaaatacagtggtggtccctgagtccccattagggcccaacagcaggaccagtagcagcccctgtcagagaaaccacagccagttggggagagcgaactcatactataggcttgtttccatggcaacagatgctccctcctccctgcttctcggcaccagggaaggacaaggaaacccatgagaagacagtggcaactagggggaggaggaatggcagcaagtcccctttctttgaaacccaggcagctgctgccccacatgttgatggttacagctctcagtgaccttggacaagttattgccccagctctgaacttttgtttttatcatttaaaaaaataaataaaataaaaaagatcttagagattgagagagagatcaagcgagactgggcctagagatgatcccaataaagctatttcagctcaaaaaaaaaaaaaaaa

SEQ ID NO: 2355 - DNA, 764 bp, Homo sapiens
cagcagctgccttcaggaagtcactggactggaaatgaagatgctgaaaattcctgaccagactctctgaaacattttagctccatgacttcacagcattgcgcttgtttcctcacatagaaaatgaagggttcaggtctttaaagaactttctaggtctaaaaacagtcagtgaataatttatggaaatgcactggatgtgatttctcctactgctgctgttgttcatggacctgactggttttttctggacagtaaaagggcctcacacattgatgaacctttccccccatatccctgctactttctcaccatgctgccactgctgggtcacgcagaaaacaggggcactaggccgggggtggagattctgggtagtggatggtgtcatctgagttgatccacggcgcccagagttcatgcctcccgtgccatcagtatttctgccatgagctcattcacacagcattcattcactcacaatgttagcagcatatatatgtacagagacgatcacgaacattaaaatcccaaagcaaatggtatcactaaggattccaacacggagcagatggctcacacaaactacgaggtgtgaaggaggggttctctacaaagagactctctatgaagatgggggaagcccacaggatgctacgctggcctgaggctctaatagccgcgccggccccgcgaccaccactgaagggccccggcatgcgggttgatttgtagcaactcgaaaggggacccttcgacacgaa

SEQ ID NO: 2356 - DNA, 841 bp, Homo sapiens
  misc_feature (1)...(841): n = A,T,C or G
ctccctgtgagcagcctggccatggcttccagctcaggtctggccacacccgaaggctcttcctgaagctcctgtctttaccttggccatgtggaccacatcctgctgtgcagaagtccaggcctgcccaatgggcgactatgagtacttttccgtgtttccatttcctggcaacaggaagtgaggtgcaaggactcagccgtgccaggccaccctctccacacacacaactgccagagaaaagggttgcgcctggattcaacttcccatgggaaaaggcacggccagggtccccaggtgccagacagagggcctttgccaactgattgagccagggcaggcacgtggcctctgaatatctggcacctagtcgtagggtgccaggcaaccgaacccaaggtgcttattctcctgggcaaagccacccttccctatgaaagcagagatcctgggtgagtccctctagcagaacacgaccccatggtgtgtgcagctgtgccccagtccaagaacaactcaccacaagatgcagacagaagagaaagcctgtgccgacacacagggttttgaagacctagtcgggaaaaagaatttttgctattttgtggatcctgagtctctttcatgggcccctcaactcctctgctcagattcattaaccgggtggatattgaacagtcccttccttaaggaagtgctctgaaaaattgaccgtccaagcgcatgtgaaagtgcctaacaacatttctggcaccagggaaaatgccacatccacgaatttcttattattttgaagaaaaaatannccnccgggatgcgcccgtttcctttaaagggagta

SEQ ID NO: 2357 - DNA, 922 bp, Homo sapiens
ctccctgtgagcagcctggccatggcttccagctcaggtctggccacacccgaaggctcttcctgaagctcctgtctttaccttggccatgtggaccacatcctgacctgggaggaaaggacctaatatccaagctcagacgctatgggatgggcattttctaccccctgtctggaccagactagcaaaggctccctgcactagatgctggatgttcagagctgtgcagaagtccaggcctgcccaatgggcgactatgagtacttttccgtgtttccatttcctggcaacaggaagtgaggtgcaaggactcagccgtgccaggccaccctctccacacacacaactgccagagaaaagggttgcgcctggattcaacttcccatgggaaaaggcacggccagggtccccaggtgccagacagagggcctttgccaactgattgagccagggcaggcacgtggcctctgaatatctggcacctagtcgtagggtgccaggcaaccgaacccaaggtgcttattctcctgggcaaagccacccttccctatgaaagcagagatcctgggtgagtccctctagcggaacacgaccccatggtgtgtgcagctgtgccccagtccaagaacaactcaccacaagatgcagacagaagagaaagcctgtgcagacacacagggttttgaagacctagtcggaaaaaagaatatttgctattttgtgatcctgagtctctttcatggtccgctcaactcctctgctcagattcattaccgggtgataatgaacagtccctccctcagggagttgctctgaagattgcacgtcacagcgcatgtgaggtgcctaacaacattcctggcacatggaaaatgctcaatccaggaatagctaataattatgatgaaaaaataaagtaaga

SEQ ID NO: 2358 - DNA, 745 bp, Homo sapiens
tcctcccccttttacctccacatcttgccttccatcttgggatgacaagcaggaaggtccttgccagatgccagcaccttgatattggacttcccagcctccagaactgtgagattcttttctttaaacccattctggaacccccctatattgaagcccatcatcgagtctgtacctacaacgagaccaaacaggtgactgtcaagctgcccaactgtgccccgggagtcgaccccttctacacctatcccgtggccatccgctgtgactgcggagcctgctccactgccaccacggagtgtgagaccatctgaggccgctagctgctctctgcagacccacctgtgtgagcagcacatgcagttatacttcctggatgcaagactgtttaatttcgaccacacccatggaggaggttacctgtcgccccttaggtccagctcaggcaaaaggcccaaatgcagcctacttatgctaaaagttcaaaacaatattcgtgccttcaccaaaataatttctccagctcacatacctgcaaattaatttttctttgccttgagtcttggaacataatttgtgtatcacaatcctcccccaatttggacttataatatgctaatgatttaaacacatgggatgtaattaggatatggggctggaaagtctttaaattctcatgttctatttaacctctgatctccaaccggatttatgattaaagggctagaaatgaaaaaaaaaaaaa

SEQ ID NO: 2359 - DNA, 422 bp, Homo sapiens
ccttagagataactttgaacttcagctcccacgcctgagcggactgggactcaaggaactggaaatggtacaataacattactcctgatgatgcttttgctgctgttgctacccatgtgagagtaaagaagggaagttaaatcagtgctgctttccttgatggttccattgatccaaaagcccattgaagtcaataggatttcgtctttagcagaaatgctgcacttagattatctccataggaaagtacagaaaaaaaaaaactgatcgaaatagctgagttactttcaaaccaccagcctgctttatttttaaacatattagaagtttcactaatctttaaagtggattttgtacactgagagtaatacttataataataatataatgcaataaagaagagaaaactaaaaaaaaaaaaa

SEQ ID NO: 2360 - DNA, 429 bp, Homo sapiens
atggaaaagaaagcatttgacaacactgaatacactatcgtgataaaaattttaataaattgggtgtagaaggaatgtacctcaatgcagtaaaggtcatataagacagtcccacagctaacatcatacttgatgaggctgttgctacccatgtgagagtaaagaagggaagttaaatcagtgctgctttccttgatggttccattgatccaaaagcccattgaagtcaataggatttcgtctttagcagaaatgctgcacttagattatctccataggaaagtacagaaaaaaaaaactgatcgaaatagctgagttactttcaaaccaccagcctgctttatttttaaacatattagaagtttcactaatctttaaagtggattttgtacactgagagtaatacttataataaaaatagatcggccg

SEQ ID NO: 2361 - DNA, 434 bp, Homo sapiens
aaccaagctattcatgagtgatctcgcccgtgatccaaacacctcccaccaggcctcacctccaacactgggggctacatttcaatttgagatttgaagacaaacatccaaaccacatcaggctgttgctacccatgtgagagtaaagaagggaagttaaatcagtgctgctttccttgatggttccattgatccaaaagcccattgaagtcaataggatttcgtctttagcagaaatgctgcacttagattatctccataggaaagtacagaaaaaaaaaaactgatcgaaatagctgagttactttcaaaccaccagcctgctttatttttaaacatattagaagtttcactaatctttaaagtggattttgtacactgagagtaatacttataataataatataatgcattaaagaagaaaaaaaaaaaaa

SEQ ID NO: 2362 - DNA, 855 bp, Homo sapiens
aaaactccagacctcagtgccataaaacaagagcatctttattttggtcaagagaaactcggaactcaaagtcaaactatatgttttcttctccgacttgggtgttgaagggaagaaaaaccaacaaaaaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaaaatctcactcttgtcacccaggctggatggagtgcaatggagtgacctcggctcactgcaacctctgccgcccaggttcaaacttcacctgcttcagcctcctgagtcgctgggattacaggcgacctccaccatgcccagcaaatttttgtacttttagtagagacaggtttgtgccatgttggccaggctgatcttgaacttctgacctcaggtgatctgcccgccttggcctcccaaagtgctgggattacaggcctgagccaccacacccggcctcatttagtttttaaaggtagtgttgtagtaacaaataataactaaggaatacttttgaagcaaatttatggattatacatagcaaaaagttttatccagcatattaaaaaataacctaccatcaacaaaacacgatcggcca

SEQ ID NO: 2363 - DNA, 584 bp, Homo sapiens
aatcttgaatgaattgaggtcacattatccttgctcaggagcgatgagaagacatgaacacgcgcagacctgttgtactcaactgacactccactcacctgattacatgcagtagttcccaggtgctcctaagaaaaagcttcctgagaaatctcatagaaatccaccctcgaagcttaatttagcacttcaaaaaatgaaacgcctttaaacaactattcccttgcctgttcacataagtttcattgaaaacgtcaagcttacgcactgacaaagaaacatgattttcttcctatccatgttcatagtttaatcaacagtgtagaattaaaactgtatgcatatactccttagcaactgggaaggagttaaaaagttgctcttcttttctctatatatctgaatttttctaccagcttttgacctttacatatattgaccttcctcaaaatacagtataattatttaaaacaaattccagcttcattacaattctagctgaacttggaaaaaagcaagacacagatatctttttcaaatgccaaaatattccaagtgaaaagaaataaaatacgatgcggccg

SEQ ID NO: 2364 - DNA, 754 bp, Homo sapiens
actttcccaatttgagaactgaagagtcctgcatcctgggaaaccctttgcatctgaaacatcagaaatttggtcaacctaggaagaatgctacccactgaaaattgaaacggactggaattgaacaaggaaaacattagctgattgtgcacactatgtatgcgggaggagtaggttgcttgaatggagtcacaacgtcatggtaatctgctcctggcagaaactgcgatggatttggttagttttgactgagtttctgaatcagagtctgcagatgtggaagccacctctggagagaaagccaccgttgagaacaagcaatgacagctgtggcggttttacaaaaaagaaaaaggggcatcctggggaaaagctgagtgttgggaaaaatgctgaggcagggcttgtatgtctgacttaatgtaaaagagtcttggaacatgtcaggggtctggggtctaaaacctctcgtggcctttggaatatgtctagacttgctggctctttgcttctagcactcacagtctcatagattgattgtatcttaaactagaagaacatgtttcccattatctcaagtagcagaacatgttccatatgcctgaaagaaaatgctaaaccgtcacagctgtagatcatgcacttgacacaccagtttctttcaacccccactttcttaacacctgcttctttgttggatcacaataaatagggcgggctttcagaactcagggccttcgcagcctcattctag

SEQ ID NO: 2365 - DNA, 389 bp, Homo sapiens
ggatccagtagccactggcagaaacaaggagagaagaaaggagtaacgaatcagtgatggaacaggaaggaatcaactgagggaagcaaagggctgctgagtcacaagcatgacaggcaactagaatcagcccgggctccccagagctgctgctcatcctgaacactgcgggcttgctcagaatttcctggctgtcctttcagacttcgtgtgcatcgtgacaatacaccactctcacctaacggaatctaaggatgtcgctaccctgaaatagccaaatattccagttgaatctatttgttaaagcttagtcaaccagatttgtttctaaggagacactgacaataaaaataaaaatgaaaaacagaaaaacattaaaaaaaaaaaaa

SEQ ID NO: 2366 - DNA, 170 bp, Homo sapiens
gatcacatagagaaggacacattcttggattgaaccccaaaggatgttgaactcaacaaggatgtcagaactaaccccaccatattctgggaccacttgcttgctaagaactaaaagtcacttaaaccagttaaataaaagagagttgattttaaaaaaaaaaaaaaaaa

SEQ ID NO: 2367 - DNA, 530 bp, Homo sapiens
  misc_feature (1)...(530): n = A,T,C or G
gtgaaagaaatcttaggaagatcaggtgaccgcccctgggcacaacacagacctgcctcgtccagtcctctgcccacacctagagatgatgcacagagccaggcccggggaatccgcctgcagggtggcctccatgccccaggatttcacagaaggcatttcagctgcatcttcagggcctccctctcctcctggagcagcaggatctcctcgtctttcttctgaacctgtatctccagctcagacaggcagtgatcctgggcagaaaaccaagggcagcccccgtgggccatgcagccacacactcttcccctgacctgcctccagcccacccaggagagagcagatctggtgtcggggtaccccaaaaccccagggtcccagggatttcaagataggtactgcggtaaagagctagcactacacatctggagatcaagatgtgccagctctttactgcagccatgcctggcacctncagcgcctctgcacccatcctaagaacagatcctaaatcctcgtccgaggag

SEQ ID NO: 2368 - DNA, 845 bp, Homo sapiens
gtgcctcagctgcaacagggaagccctgggacaggaggatggagaaacaagcccagcaagagagaaaacgtggccaggatataaactacaagtgaaatgagagtcaagcaaccatcctgtccaatgatacccttggtcttggggcagtgaaggcaacatgatcctgactcatgctggaccatgggaaaagttaaagcagttcctgaggctgctccacacaaaaataaagtcaaatgtgcacaggtatggtggtttatacactgaatctagtacaattacactgatgttggtaggcactagggctattagcaaagaagaaaaaagatactggtgtaaaattaaaggtgttgagtgaactcttcttgttcacaggtggtattggaactatcaatgtgcacttaaggcttatttttggtccttctaaatatatggtggttcctctctctggtcggctaaaaaatctggaagcaatgaccacccagtgacaatgagcactcctttcgccccagattttattctctagatgccatttctggaaaaggaatcggggttctgtgaactagcagttgatcgcacgtatggaataggaaatgtataagatgagcttggtacaattaattggatcagacgacaatatgcacacctttgaaaactattggtgttatttcaaaaggagataaaagccaacttgaaggggcttcctctgactaaagatgggacagtttgtggatgtaggagaaaaatgattgcaataaagtggaacatatcaaataactaaaaatcaatgaataaaagtgagtcgcgccgaacttctagttctttttacttcatttagtaaatatagt

SEQ ID NO: 2369 - DNA, 800 bp, Homo sapiens
aacaattgctcttgaagtcctgagccaccatggaagaagtctgccaaccctgctttccagtgactgagttgcaagaatccttcaagatgccaaaaagatgaccccaaagtgagctttgtgtgtctccgagaccacataaagaagctctgagaccacatggagaagatcagcccggctaagcccacttttctggctgtccctgccaaggcacttggcatggcagtgaagctgtcttggattttccagacaaattatactgccagatgaataccagcatgtgatcttagttgacaccacatgaaacagaagaatttctcagctaagtcctccccaaattcctggcccaaaacatgatggtgtgtttttgtccactgttttggagtaactatttatgcagcaatagataacaagatcagatgtttaccagattgtaacagtttgattagactatttcctaagaatattaactttccttcgtttcaatgacatagtcaacatgcaattttcaatttgtagttgatatttaaatttcccatttaggaaaaagcttgatgttgaggacttgcactaaattttaggccaggtatagcctccatttttatggaaattattatgtatacagtataaggttattttttataggctatagtaacaattccttttttatctttttttattatttaattattgtttattatactttaagttctaggggacatgtgcacaacgggcaggtgtggtacatatgtatacatgtgcatggtggtttgtcgcccactaattaatcttaacatagggat

SEQ ID NO: 2370 - DNA, 401 bp, Homo sapiens
tacgcatgctgttgctgactgttgacacataccatcggctaagagcagtggctggctttgaaacagctccaccttccctgaatactctttcagcgtctctgacgtctaggccaagtttgtgtacttagctccatgacagcatcaagatacaaacaacaagaactgatggatttcagtacatcttctggggctcctgcctgtgggatacagcttgtctttgatgtcttaccctctacatccatgtctccttcctgtctgtgctgtggacttcaaactccagcatcagacatgaagacaacatcctgcagagattgctttaagcagctcccacagttataacaacatcatggccctatagcaaatatcataaaaatttttccacacctataaaaaaaaaaaaa

SEQ ID NO: 2371 - DNA, 967 bp, Homo sapiens
atgcagaaagaaatggaggatttgagagaaatttctgcagccctttcagtatggaagggctgaaaaatcaataggatctgcattttcaaaggagaaacatcaaaagaggtcaagggccaagtgtgcatctgggtagacttttctccttcctttaaaggaacacttggcctttgaactgcatggttttatactacaaaggttttggagttatccaaaatctttgaagctgaaagaggagttgcttaatactaaggactgaatatcctgaacaagtcactaaagcaggcaaaaccaaaggctttccatgaatccagaacaatggctttcatcctactgaccatgatgttgaaacacaactttgaaaatcaaaagtggagaaactaggaaacccttcaatatcaatgaagacaatgagacaagggacaaagaggactacaatcccctgcccacttgaagtggagtgtagcctcatgatgtgcttcggccagtggaatgtgagtggacgagaactatcgctttcaagtgcactctacaaagtgctgaagagacaatgaggaatagacagagtccttgcctccaggaagcacgattcagcaaaagaggcagaggaataaatcagctattgccaaacagcctggaaagtcataccaatagtacaatgaaaacagagagaggctgggcgtggtggctcactcctgtaatcctagcactttgggaggccgaggcaggtggattgcctgagctcaggagttcgagaccagcctgggcaacacggtgaaacctcatctctactaaaacaaaaaattagctgggcatggcggtgtgtgcctgtagtcctagctactcgggaggctgaggcaggagaattgcttgaacccgggaggtggaggttgcagtgagtcgagatcacactactgtactccagcctgggcgacagaggaagactccgtctacaaaaaaaaaaaaa

SEQ ID NO: 2372 - DNA, 906 bp, Homo sapiens
attaaaattcaacccaacaacaaaaagtctctggcgcatcagattatgtttgccttgaatgctcaataagatcaagaaacatggaaatttataaaactaaatgaaaattcattctatattcttgaatactataattcactgaattatgtatatagtaatatgtaagataatatataactcatgattttaagcttttccattttcttttctttttttttaagacggagtctcactctgtcgcccaggctggagtgctgtggcacgatctcggctcactgcaagctccgcctcccgggttcacgccattctcctgcctcagcctccccagtagctgggactacaggcaccagccaccgcgcccagctaattttttttatttttagtagagacggggtttcaccatattagccaggatggcctggatctcctgacctcgtgatccgcctgcctttgtctcccaaagtgctgggattacaggcgtgagccactgcacccagcttccattttcaaattgatagatatattcagtgcatttcccctaaaaattttcactgtgttttttgagtatttaaacaactattaataattcttaacttcgtacaaaaaaagtcaaaggccgaagaattgaaaacaaatctgtagaataaaaataataataataagatgtaaggaactgccgtacaccaatcaaaatccataatgttagccttcaagacagcatggggcaaatctcctgatagatgaaatagcccaaaggaaaaaaaatagaagtccagtaaatgactcagaattgagtcgatagacatttatggcagatggagcactgtacatcagtggggagacataaatacataggactggggcacttgctcttccaaattcttcatgactccctcttcattgagc

SEQ ID NO: 2373 - DNA, 922 bp, Homo sapiens
gggcgcactgggctggagcgggaggcaggacgtgaactctcaagaggctgtgtgcaagtttcagcaggagaggggggctgacctcacaccctcgcctaaaggacagtctgtctggggacagcctgagtggagtccacagcagcagagaagggacaccagttctgtccagcctaccagggcagtcacatcaacactgcaagcaacagctggtggcacctgcccagccaaggcacctcagctgaactagaatgcgggctttcccattctaagtgtaatagtggtctagagtaaagatgaagaaagtttgaaggaaggaagccacatacagaagtgagagaaccaccttgaagatagtttcatcctctgaagatggtttcattttcccttgagaaccccactcctccaaacggggaccttaaaactgtctctagagctgtgctgtccgtcagagagacaatgcaagtcacacatacaattttaaattttatagtagccatattaaaaaagttaaaaaaaaaacaggcaaaattaactctatttacttatttatttttgaaacagagtctcactctgttgcccagaatggcgtgcaatgatgtgatcttggctcactgcaacctccggctcctggggttaaggggattctcatgccttagcctcccaagtagctgggataacaggtgggtgtgaacaacgcccggttaatttttgtattaaccctaggtttcaccatggtgggccagctgggctccaactcttgaccaagaaacccaccacttgggctccaaagggcgggatacggcttgagccccagcctggccaattatttaatctttttaggtaacccatattccaaattaaaaatgtgctcacttaaatatcctgaaaaaaggcagcggccttccttagaagggaatcatac

SEQ ID NO: 2374 - DNA, 1071 bp, Homo sapiens
  misc_feature (1)...(1071): n = A,T,C or G
aaatttccggccgcatctgcatttattttatttttgttaagcgaaggggttcttttgttcttatttttgtcttcttatttgcctgaggggtgtgaactcaggagcatctggacctttccacacatcatttgttcgattactttcttgttcgtgacccaactaagctttttacgttttttttttctcaattctttacagaaaaaaaaaaaaaatcttgggagtactgatgaactttttttctcgtaatcacgggggggactccttcccctgaatcgctggtgcctacggagctttaaaagccctgcttttctctaggttcagaaaccaaggttattgacggctcacgttcgcaaacccttcccatatgttcttctatcagctggataaactgataagtaacaatgtgtgtgtgcacgcgcgcttaaattgcgtttagatttcagatacatcagaagagctaaggtctttggtcgacaccacttgctgacggctctttctccccttaaattggggacttgtgtccctcccttgcattggattcagaggagacacgcgagcagctgctcaggaaagagttttctttgntacacgctcactcgcgctgcatatctcctcatgtccactagaggtcactggcccctcgcggctcgcggtgctaccggccgcctcccgctcctgaagctcaaattagcgcgttaattaacacccgagtccatcaaggcgcgttcctcagtacagtactccagcagggcttatatagacaaaccaaacccagccaaatcaaacctccccaaatccaacatttcctgcatgtccaaaatgggagacaggcgcctgagtaacccggggcaaggtatagtgcaatcacgctttaacttttgttctgtggggcttgctaagttgctgtgaagataacattctctgcgagcgcaggttcggcggggcccggctccgttctccagctcttcaaggctgggcagcgtgagttttggcccccgcagcacactggtcctccgagcgagtttctccaacacggtcgctacggggaagaggggcgcaggtccacaccgt

SEQ ID NO: 2375 - DNA, 1148 bp, Homo sapiens
  misc_feature (1)...(1148): n = A,T,C or G
ccgtgccgaaacagttttatttcgtgccatgagtaggcaaatatgtttacaaatatttaaatatgcaagtacttttctacatattaatatgtagagaactattatatatctttcttgcaaaaagatatgcttctgtcacattatgagtatattctcattaaaacaataaaactgggccaggcacggtggctctagcctataatcccaacactttggtaggtgaggcatgatgatttatggggggggggatttcaagagtagcctaggcaacacagtgagactccatctctacaaaaaataaaaaaattacccaggtgtggngacatgcacctaccttgggaactctgctggccgctgacacctggtctcctggtcacactgggactggagggatacccaaggccttgcacaaggtggcaaacactggaagatacaaaaataccctctagagaggggaccaggccctgtcctctgagcaaaccatttctaatactccaaacaagttttctaagaggggaaaagtaactacgttattgaatttaatgcatttttcgtatgtctgcgaccagttttcttcaattgaaatggtgtcttagatcaacttaagaacagtatggttttcacacaaaaaggaatactcgtatattataaacacagatttttatctttttaaactaggaagactgcaccaaatagatatgaacattttctgtttgtaatagatccactatagcaatatctatatcgcattctttagctatatacaccaattgtttgctttcatgtgacttttttctaataatttctcttgcactatatagtagtgactctcacactgaacagataagctgtgtgttttatataacactgattatttcattccacatttagacagataaacctgaacatccaactatgggttcacatgtaaactttcagaaattttgttatgtctcatataataaatatagaattatgtcatagtatttaaaaacaatagccaccacttctaccagcccccaccaggggagagcctaaggctgtgagtctgttggagtgttgtcatgatttgttttttctccagaaacagaatgcttcagaaactgaccagtagcaccgatgtacaatcttgatcgcatgggccattt

SEQ ID NO: 2376 - DNA, 1084 bp, Homo sapiens
aacgaccgaaccaggttgtatgattcctgcccacactggggagagcaatctatggaggctactgagttgattactaatgccttccagaaacaccctcacagatatacccagaaatagtgtttaaccagatatttgggcatcccctgatccaatcaagtttatacataaaattaattatcagagtacagtataaaaattcacgatttttttcagaagacagtgaagtaaagaaaggagcagcaagatgacctcagcaaatttctgactacaagtacccgctggataactagacacacctgatattcatcaacagcttattcagcagtggattccacatcatagagagtgagcagcaagggatattcttggaagatttgaaatgaagaagagaaacaatggtcattttgtagttcacggacttattgcagatctgctgagtcacctctttgctgtgaagcagcagctgggcttgcaattgttccacttttctctggatctttcttcagtttctgcgaccaggacaaacatgtttcaaatgcaaacaagaagaaaagctgttgcagcaatctggatactcaaagtgaacagatgatgtgctccaagctaaagatctgaattgtgacctcttatttattggaccatggggttatatgcaaatgacacgcatagcttatgtacatgtatatgggggggtatgtatgtatgtaaatgcacacgggtatatgtatgtggagacacatgcactgacatatggcatgtataaaaggtagatatatcacgacggcccaggtctgtaatttctttattgtattgtttcttttctatttttggttaccggtttttttgtctgggttattggggacgttatatatgttattttgtaggcttctggcgttttcggcattctatttctctgtgttagtaggtgacattgtatcatatttgcaggccttttgcgctctctttataagtgtaaggtgcatttggtgcagtgtctgacgccgtgtcgttgttcgtctgtaagtgtgcgatattaatactaccatatgctggacggtttgtcgctgtgagagcacatggggag

SEQ ID NO: 2377 - DNA, 858 bp, Homo sapiens
tgggccacaggagactttcgtgggagacatggagggcagacatgaagtggcagccattttgcagcccaaccatgttgtcacttatctaggaagtattagaggccgtggacactaccaaaactgcctcaccttttcctagatactccttcagcttctttgactcctgagaccaggatgggtgtttagctccatgaagaaaagcccagcttctataggccacccacaccaccgaggtctaagacaagaactgatgtggtttcagtctgtcctgtgggctccaccttatttatgcttgtggggtccagcttgttcttgctccccctttctttacatctatctttccttctcacctacctgtcttgtagacttacaagttccatcatcagatgtgaagacagcagccttacagagactccccagttacataaagtcaaattattgtgataaattcctttgtgtatatcatatataatacgctataagacaatgtaaaaaaaataaaaataaatcacctccatccctaataatatgtattatgacaattaaaataataagttgaacggcttgttgttccgccctcgccgtctgtattaataaatgtttgttcgtggcgtcggcctgcttttggaggaggtaataaaaaaatccctataacaaaaccgcggtaatagtacggcttggaggagcacgatatcctctccagaggcgggttctcgttttcaccaatgtggcggtatccatgaaaacatttggaaataaggcgagattggtgtaatactaagagcgcggaggttgtatattttttaggcgccccactatataagtaaaaaaaaagatctatgatggggatgacccaat

SEQ ID NO: 2378 - DNA, 834 bp, Homo sapiens
  misc_feature (1)...(834): n = A,T,C or G
atccagcctctactactgtgcataaaacttgaagagttggaggccatgttcaccagcccaaaagatatacgtacacttgggatttttgagaaaactcaacagtctaaaagaatatatgaagacagaacctcaacctagaagaaatggacaaattcccagacacatcaaggaattcctagacaaactatcaaaactgtttcatgattagatagaaaatctgaacagatcaatataagtaaagagattaaagcagtaataaactctcccatcaaagaaaagctcaggacctgatggcttcactgctgaattctaccaaacgtttaaagaactaacaccaatgattctcaaactctttttaaaaattgaagatgagagaacacttccaaattcatatcacgaggccagcattaccctgatacgcaacgccagacaaagacactataagaaaaggcacttatggaccaatatccctgataaacatggatgtaaaaatcctcatcaaaatactagcaaatgaaattcaaccacaaatttaaaaaagcattcaccatgatcgagtgggatttatccctgggatgcaggaagtttcaacatacacaaatccataaacatgatacaccacatcaacaagatgaaggacaaaatctttataatctcaatagatgcaggaaaagcatttaacagaattcagcaccctttcatgatttaaaaaaactcaacaaaatatagaaggactgtaccccaaaacaataaagaccgatgcgcccaactttcttttttatattattnttttttttctttttctttttttnttttntttntttcttttttcct

SEQ ID NO: 2379 - DNA, 367 bp, Homo sapiens
agaaacaaaaacagaaacgaagatatccatgatacctaatgttacaaggagaagaaagcacttgtaatcacaagggtactgagaaaaggtaacagacacatttatatatgtggaaccaggaatctttctgatgactttcagaaagggtggacatacaaataaaaatcaaccttcttcttggtgaggatttgaccctggttccatattaacccaagagctgataagcacaaacctggagtccagtttttatgcaaatataacaactctgcttataccttgaattacttgtatgaagcggggaaaattttttactctctctgaacccataattaaaaaaaatctgtatgacttggataataaacccaga

SEQ ID NO: 2380 - DNA, 1055 bp, Homo sapiens
tttttggccatttgattgtgatgcatctgggtatggattttttgtgcatttatcccatttgagttttactgaacttcttaaatctagtgaactctttctactgatatatttttaaaagtttactgtggaacagccccaggcagatcattcaggaggtattccagaagaaggcgttatcagaggagatgacagcctcgtgtgtggtatttcccctaaagtccttatagtgaacaaggtgtggaggtggaagacagtgataatgataatcctgaccctgtgtaggcctaggctaacttgtgtgtttgtgtctgtgtttttaacaaaatagtttagaaagtaaaagataaatgaatttttaaaatagaaaaatgcttataggatgaggatataaagaaggaaagtatttttgtacagctgtataatgtgtttgttttttgagtgttattacaaaacagtcaaaaagttaaaaatatgtgtatgaagtaaaacatttacagtaatctattattgaaaaacatgtattttttaaatgtagtgtagcctaagtgtagagtgtttataaagtctacagtaatgtcctaggccttcacattcactcaccactcactcactgtctcactcagaacaacttccagtcctgcaagcttcatttatggtaggtgccctgtacaggtatactacttttatctttcatatcatatttttactgttcattttctagtttaaatatgtttagatatacaaatacttcccattgtgttaaaactgcctacagcattgagttcagtaacatgctgtacaggtttgtagtctagaagcaataggctaaaagcacttcactaataaacaattgctttcctacatatagcctgggtacgtagtaggctgtcttatctaagtttgtgtaagtacactcaatgatgttcacacaaccaaattgccaaaggatgcatttctcagaacatcctcccactgttaatcaatgtatgactgtaagaagcatatattgcattacatgtatgtcctttacacataataaagctgtatcggccagg

SEQ ID NO: 2381 - DNA, 776 bp, Homo sapiens
aagcagcagatcaaagagcaatgagactatgttaaacaagcaagcacagagccccagagcttcatgcttagtgatggcccaggatcccaccaagaacctcaaggtcaaactctgttttttctggtggtacctacaaaggaggaagctcaactcacggttttgcagagttttaactctttctcctgggcttccctgagctccctgtgagcatcttcctgttttaactcttcctttagcaccgagcactgtggagaaaagggcaacacagaaagaggccaacgttggccaggtagggttgtcgggggaaggaggggctccaaggccccatgtgagcccctgagagcatttcctgctgtttccatccagtcacgcactgagatcccaaaaggcatcccatggtgtctgacgggcacacaggatcccaaagctgttcctgcttctccactcaggaaatcagaggaataaagccactactctcatcttcaaaagccagcaatctaaaccacaaggaaaatccagctttggagagtctgtgctgaggaataaacactgatgttcttggagggccactaacgagcctggacggttctcactgctttatgcaattcactcctacaagacaccactgcccctgggagcggcggggaaaatggaccagccgttctggagggcaatttggcaacgggcattaagaacatatataatgggcctgctttttgacccaaaaattcttgttttagaatggattaagaccatgggttgggcaatcagcaagt

SEQ ID NO: 2382 - DNA, 764 bp, Homo sapiens
  misc_feature (1)...(764): n = A,T,C or G
aatcagaaatgagtatctgttgaatactttgttctggaggagaagacactgtggggattctgactgatgctggtggtaacaaagagaagaatggaaggtaaaggaagaaacccaaatgcgagaaacggcttcattcagctgtcctcaaacaactgctatatatatatatatataaaacttttttttttcttcccctaacggggactcttctttgagatggaggaagattttaccttgggatgcaaaggctgtttttaaatcttaatttaaatattacataaggtcgcaaggtcatttattggttccccaccccaggattcactctcccttctcatggtgttatagtgtacttcaattctgcacagagacagctacccctcctctccaggaagccagtgcacttacagcgagatgctggttccccagggcaggcacacgacctagattaagccgccaccggcacatcatagctgcccgaggggcacgtgaccccactgaagccaatgaaatgcgataggcttctgggactgaggcaaacacttctgctctactggaagctgaaggctggcaccgccattntctaccggggcacttagattctgcatgaaagccaaaatatggtgaaagacagccatataaggtgaaacatagagctctgaatccagccacatctgaaactatacttaccgccctgnacgtttcatctcacaagccaataaataagatgcggcccgttcctttatgaaggttattcatgatcctcc

SEQ ID NO: 2383 - DNA, 379 bp, Homo sapiens
tctcttatctaccaccgctacagcccgagacagtgatggagctgaggaggatgtagcattaacttcatatggtactcccattcagccgcagactgttgatcccacacaagagtgtttcatcccacaggctaaactaagcccccagcaagatgcaggaggagtataaatctacaggaaacacaagtggagaaaacccagcagaccgtcctgggtagcatagccctgatagcccacgggggcccacagagtcacgctgccaatgaagagtcagcatcccaccttctgtttcctaacccctccatccaccaggaccctccaccagaagaccaccattttgagcataattacaatcttgctggccaccctaaaaaaaaaaaaa

SEQ ID NO: 2384 - DNA, 958 bp, Homo sapiens
ggatggctttgccaggaaaagcccttcaatagcagcctggccaaagattctgggcaaataagttggctgggtccatgggcaatcaagattctgggacctgcaatcaaacttgctgctggcgtttgtaagtgtgccttctaccaggggctatgggctggctgtgagatacacaggctaccagcgggatgttacactcggtctactgactcacatgcatcttctccaagaacaccctcacagacacacctggagaagctcaagcattctaatcaaaatgaaaaccacctggaattctctttcagcagaagaggaatgggttccattcctattgaagcattgagaataaataaccctttaccagctacctgagtattccttaattcagtcaagtttcatccaaaatcaactgttgcaacttattctgaaatgttcaactagctttacattctttagattaggtcctgcttgttcatgatatattgtacttttgtatagagctagattttatttaaaatactgtgaagtttgtttgaggctgaggtgggagaatcaatgagcccaggaggttgagggtgtagtgagccgtgattgtgccaactgtgctataccctggtaacacagtgagaacctggctaaaatacgtaaataaacacatcaattcaatccattatattgtttaaatcaaatttctacattgtaccactaatacaagtccgagttggacacccatatctgtatatgcatatttaaatttgaattaaaaagccccaagtgcttaccaaactttaataatttcttgaggagaactacacacacaaagatgttgaatccctctaagaaggtagattaaaataaatgcatacattataggtgttatggaatgatataactaattggtttaggtgaccatactaaatgtaagttgaggatccagggaagattatattcattcaaaaaa

SEQ ID NO: 2385 - DNA, 462 bp, Homo sapiens
cctgaagagaatgtgtgttacaactgatgctgtggaatacatctgctctgccagtttcctccagacctgctagctccactgattatcttcacagctagtagctctgttttctcttggtgaagtatctcctggagcattgttcaccctcacgttgaaaatataaacactgctgccaaaagcaacttttggatatcacaagttttctctccagatctcaacaacagccttctgattgggttggacacactcatttaaggcaaatatgataatctgggtaagacgaaaaggaagactacaaagttgttctgtttctattaattcctatcatcataatttcttccaaacattaagtcttaattactgtgctttcacctttcttcaaatctacatctacaaggaatactacacctaagtaaaaagtaggattgggaagagaaggaatggaaaggaaataaaggtgga

SEQ ID NO: 2386 - DNA, 1134 bp, Homo sapiens
gttttaagctactgtgactctctctttaaccccgaccagctcacacatacagtcggctcaggcagacggcccaagacaagcctgtgccaaagaaatgctgatttagtctgacccagacaatctctactcccacatgtcacttctctgcagaactcttactagtatggcaaatactttaaaaatcatacaataaaagaaggcaaaacctcagtaatttgaggttcactttttttaaactctttccatgcattaaaataaattgaggccctgagctctggcgaaatgtttccgggtttttaattcccaccgcccccccaccccggaggcataaatagccacatacgcaattcaaagtactctatttgaactagtataggaaagatgttttctatagatattgcagataaatttgcaatgacttaaatatttatctgctaaagttgctgagtgcctccacaacaaaaccgaactcattttttgtgcacgatgggcatctgaatgctacctgatggtgatgatatagaaatactaattgctaagtaaaagtggatgtcttatctcagcatcaagggcgtctgtagagctgctgggggaggctctttagattactcaatctaacttctgacagcccattcaaaggatgagaaccggtgccttgaagctctcaatttaaactaggaatcctgtagtctagtctctagacttatctgacctaggcagaaatcatctcctagaggcttttcatggctgattttgtgatgttttacttgcactgaagatttattattccatgttttgagttagtgttatacagtgccattctatatattttccaaataaatgtttgtcttacagaagaaactgtttataccattctaatagggttgtttaataaggaaattttactcagttgggttttggattaaaaataaaagaacagcttttaagatacaatgtctaaatgattctcaataatgatctgtctatggtatagttactttttgtcctaaaataccttttctgtgaaatgtatggattgttttatgttgtgccaggcagatgtgtcataatttttaaaaataaaaccagagtcgccagaagccctttcttttttgtatgaatggttaaataata

SEQ ID NO: 2387 - DNA, 252 bp, Homo sapiens
aaaagaatgagcacagcagacctgaactactaccatcctctgaaaggcctgctttcaaggtttgttccagctggtatttgagaacttagatttcaagaggattctcatcattaactgataaaatcgactcactgtgcctaaactgtacaaacaatatggtatatgagcaacaccttttttcccttctgggagtctgaaattttgttctgtgttagatgcaggcctatgcgaacaacacctaataaaactcga

SEQ ID NO: 2388 - DNA, 856 bp, Homo sapiens
tcttttaagctagagtctgactcagagagaaagttccctgctttcaagatctcatgtgaagttaggttgggaaggagagcaagcagtgatgagttctatggaaactacctgccatgatctgcccaccagaggccaactgagacatactcttgacttggatctggggcagtggccctcagggctagctgaactggagttgatgacatttgaagatctgagatgtcaaggcagttagagtaaagaggctgccaggcggagtggagccatttattcattcattcaacacgtatttattgagccaggtctactatggcccagggaccaccagatactggaaaacagggcaaaatacactgataaaaataatgactttggtcatgcaaactgcaattatgctgttaatattagtgtggtagattaaatgtagccacaatttttttgcaaaaaatatcaagagatgaggcatttttccctatccctgagaccagtctcactttggggcttcctttggccaaagcgtgtggcaggagtaatgcttccggagtctaggcctcaagagtccttgtagcttctgttttattctcttggaacctggagatcataccataaagaagtctgagatgaaagaccatgaagacaaaggcccaggtgtcccagctgagcccaggcctcagaaaacttggagctgaatgcagccacttgagccagcacaggttagaactatctggccagctctcagaatcatgacaaatccagtcatactttggagatattgtgggtttgattccagaccaccacaataaagcaaatgtcacaataaagtgagtcgcagaaatttcttggtcctcatgtgaga

SEQ ID NO: 2389 - DNA, 755 bp, Homo sapiens
  misc_feature (1)...(755): n = A,T,C or G
tgtcaagagcctggacacacgggctggagttgaggtcccactggcatgggggagagctaccccaactcaccagtatcaccatgtcaacatatttgagttttgattttacttttgattttgctttatggaatgcaatattgtttaaaaccaggagccaaatgttagtcatggaagcatactggttcatcagagacatcataactgagggtttcagacagggaggaaaagaacccctcaggaacatgataaaattagatctaatttatgtgcactgttgagccatatattgaggtcaggagttgtgactgaactgcaccatttgtgaactgctattcattgtctcagaagtagtctgaaacattgcagctcaggcttcacagcattatttaattaggttatcttgagtagaactttctgagggaaaagaagagcactggaaattcattggaggtctaattaaccacagcttttgttttgccatacaattatcattgtaaaatatattctcacagctctccattataagaaatgttttgtccttgatgaacactgatgcaaaaatcctcaataaaatactggcaaaccgaatccagcagcacatcaaaaagcttatccaccatgatcaagtgggcctcatccttgggatgcaaggctggttcaacatatgaaaatcagtaaacataatccagcatacaaacagaaccaaagacaaaaaccgtatgatttncaaaataaatccagatgttgccctgagg

SEQ ID NO: 2390 - DNA, 763 bp, Homo sapiens
catgggatgctgtcacttgcctaaggctcaagatttgactctgaagagtgagtgattgagaatgaaattgagaggatgcccaggagaaccgcaaggtgtctaacatgatcaccatcactctattggtcaatatctaaactcaggcaactgaatcctgctttggcaagatgcccaaccagacagtctgaagggatatacacctacaaaacaatgaaatcctagataaaatggactttcagaatgtgctcactagactcagtaatgacagaaccctccataaacacaaagcaagctaaaacctatgagcaacaagcaagtgaggctgccctgaacgcaagcgtccattatgatgtggcaaaatggagatgaatctgaaactcccacattaacacaaccctcaaaagagactaaagtgattccacgtgagtggtaccccctggttttcagatgaatcaaatgccaaaactttctggaggaaaagattctacactttaggctttcaggatagccaatgaagaagaacaaccattatgagcttacaatcatggatcaccacatatgtgagaaaagaagtcgccacaataacacaagccactaacagattttgatccctgaggaattgagatattacaattattaaccacatgtacagaaatagctatgcatgacatgttcaaagaattacacatgggatcacaaaaccgggtatgccgcatacaaaatatatagttaactttgctctaggcgagctggcttacgcctg

SEQ ID NO: 2391 - DNA, 935 bp, Homo sapiens
ctacattgcttgagcccaggaattggaagctgcagtaagctatgattgtgccagtgtcctccagcctgggtaaaagtgacgaactgtttctaaaaaaaataaaaataaaataaaatttaaaaaacagtctcaacgataaatcttttaggcttttggagacttctaattatgaccaagatggtttaacagaaccagttttaccatcttttctaaaaaaattaagatactggagaaaatactcaaacaccagttctcaagacattgaacatcagacaacaaaagacaatgatccctgagacaggaaataaatgagagaagccctgtgaattgccctagcatacttcttggagaaaattttcaggttgcatgcaaggaggaggacaggacgtctcttagtctcccagagatgagaagatgaactaggcatccaagaatgccaaagtggctagagtttgcaggcagagtaccagagatgagacagcttcagaggaaatgataccagagaccagcctcccttgagcaaccaatgaatatataagtatatatgtgggtgtcaggaaactacttgatgccaaatacagagctatacaaaatgatttcagcaaataatcccacagttcacacaggactaggaattacgccagagtggaaagcctcagacttcatggagcactgagtactgtattcaaaaaggtttgcctcagtgtaggggcatatttagtcctagaggaatactgctgctctggtctaccccaactacacacacacaacaagctcaaagtaagacccaaaagatcctacagttttcaagtaactacatttaagaacaaagctcaataatatttataggaatacaaaatatccaacacccaacatgaaaaaattcacaactgtgtggatttcaatcaaaaaataaacccagagtgcgtcctgag

SEQ ID NO: 2392 - DNA, 678 bp, Homo sapiens
gtctgcaaacctgcatccacagctaggactccgaggggaccacaccaccgcccacctgcatctggggatgttgcagctgttttctctggaagtcagcccccaaccctggaaacacactcgctctccccaccccagccagtcacctccagccttgacgtttcccaccccttccatgaagactcacaggctgcctgccagaggggtgcatcgaccaccgccccccacctgcccatttccccgagaaactcagcatgctctgcctaaaaccctatcaaagttgggaggaaaagaacccagccgtcttgggcctgagtcatgccacttcctcatttcagaaaccccaagccctggcgggggggggttccacagggacggtgcctccgcattgacacccttgacaggccgggcactcctgcgtgtcttgtcaggacttcctgaactcctgccatcctgaaatcctatcaggatgttggctggataacatcacacctggacttgcacctccccactcttttctctccatctactctttcaaaaatcagcctcgctatctgccttagcctccgcatcagcaattatacccgtaaatcataggtacgatgtgaaaaagctacgtcttctcccagctctcaaaaaaacccagactcattaagatgaaataaaccccgatcggccgaa

SEQ ID NO: 2393 - DNA, 481 bp, Homo sapiens
atcacagctcatgcctatgactgtatgacaagccacccttttgactggctgacagaggacaaagtaatcccaggatggatcggcttcatatgttaatataaattgaatatggattgctggggcattacttccttgcacaggagcatccctggaacaaagtggtgagaaaaactcttcccaaactacagtttggctggcatacctaatcatttgttttgtgtagaaggggaagtggttcgtgataagactacatataaaatcaccgggagatctggatgctgactctgacagccaagtacagaaagcttgaaaagatcgccttaattctatcagagcatgcattttgtggtcccgtgctgcataccaagctttcaggattagttttggaggtggctgcggtgactccatcttcccccagtgtgctctctttgcccttccttaggcttatggaattaaaaataaagagagatgtggcctgaag

SEQ ID NO: 2394 - DNA, 642 bp, Homo sapiens
  misc_feature (1)...(642): n = A,T,C or G
cttctttgtaccaccgctacagcaggacagagtgacccagaagagcagagaggccagtggttcctagcccctcgcacacagcatgtgctcattgaaaactgtgagtgaatggagagtggatggagccatggacacttggacagatggatggatggttgcacagatggatggttggttgtcagcataaagaaatgcctgttaacggggcctctgatgcttttggttatcctccagtaggaaggattatggatgatccgttttacttgccttgaactctgggtggcttagcacacattcttggaaacaaagacccatggataccctcatgagatgacccagaaagtcaggactttccagagggagaaggctgaagaaacactgagccataaagctcagaagatcccaggctgcaaagccatcgactatctgaaggaggccggccccctttactgcaggcactgctggctctgagtgtgtctgtgcctgctggctgattccctgtgtgtcagacccgggacacatcacctcggggtgagaatgtgtaacatcttcgtgtgtgggtgtagcaactgcagtgggaacatgtctgaatgactttgcacagttctgcatggcagataaatacangagtcgcccaacgac

SEQ ID NO: 2395 - DNA, 562 bp, Homo sapiens
ctagctgaacgacttcttaatttccccgctcagggtctcgctccatcactcaagctggaatgcagcagcacgatcgtggctcactgcaacctgcacctcccgggctcaagagatcctcccacctcacatcctgagtagctgggactacaggcacacaccatcatgcctggctaatatttgtattttttgtagagatggagtttccccatgttggccaggctgttctcaaacttctggactcaagcaattcacccacctgtgccttccaaagtgctgcaattacaggcatgagccatcatgcttggcttactccttttttttttttaaacaatcagtttaacttctgaaatgttcatattaatcctgatgctgctaaaaattgtatttctagagaaactcacattggcacttcaaaatggatatttttgtaacctttaccagaatacaacaaagcttcagaacaccactgaatgtcacagtgaattcgtatggatggagagctgcctgggaattaaggctcagatcccaggttcgtagaaaataaagctagagtcggcccgag

SEQ ID NO: 2396 - DNA, 817 bp, Homo sapiens
ttcggccgatcgccatttattcaaaaaacttacactgagtgtcaaatgagtgccttgcattgtgctagaatactggacctattcagcacccaggtcagatctcacagaagtcttgatggagattttctgtggttagagaggacttgtaccttctggccacctatggtctagtacgtacatatggcttcagggaggaatgaataagatttggtttattatggagtagaaattattaggtcaaaccacgtgtcaaaatccagaatggatggtgtcttcagaatccatgtgaactttccacagcagtttttctcaatgttgactggacgtcaaagtcttcgatgtgtgtgtcaggaggtaccagtccatgagtggggaactgcagtgatcttaaactcacttgtgattcatcaattcagaaacaaataaacagatgtcacagtatttttctaaccaagacagcgaaaaatgggacacttcctcaaatgagcagtacctaattaaagacccttaatattactgaaaaaaaaagtataagttttggccgggtgctttggctttatgcctgtagtcccagcactcagagaggccaaggcgggcagatctcctcaggtcaggagtctgagaccagcctggccaacatggtgaacctcagtctttactaaaaagacaaatcaattaaccgggtatggtggtgtgtgcctgtaatctcatctactcggagtctgaggcaagagaatcgcttgatcctggtaggcggaggttgtagtgagctgagatcgcaccacagcactccagcctgggcgacagagcgggccat

SEQ ID NO: 2397 - DNA, 315 bp, Homo sapiens
ctcgaatgctgccttttcctaaacatccatggcccaccccaccccctcaacctttgcctatgaagacccccagactcagccggcagagaggagaagcagctggatactggggactacagccggacattggagagaagtggcttgacttcagagggacagcttgacagtgtaacttggaggagagtccagctggagatggccggacttgaggggaagattatctgctcgtcccctttccagctcccctttccactgagagccactttccctggcaataaaatctctcgcatttaccatccttgaaaaaaaaaaaaa

SEQ ID NO: 2398 - DNA, 555 bp, Homo sapiens
tccaggtatatctttgtcagcagcatgaaaatggactaatacagtcacaaacacatagaacttagcaattgatgaaacttacacatacaggacctctgaccaatgaaggttgaaaacaatgggtatgcatgataaagaaaagaagctttaataaccagaatagattcactgagaataattcaagaatatcactcgtttgcctgaggaaaattcacatcttaattactttgaggaaatctccaagtgcactgacattatcaataggctaggggaagaatgttttatagaaaaaagaaacatctaaaaaaaagaagaagaacatgaaagaaaggatttacacaccctagaaaatgagagtaatgcttcctgagaaaatctaagcaaagatgaaggatacagacagaagtcctgagctctgattttaactctgtcccttaatagctcactgaacctgcttttctcatccacgaaacagaaagaaaacactgtctcttcagcatgtcctataggacttggggatgaataaaatcaaaaacatgaaatggctttgcaatt

SEQ ID NO: 2399 - DNA, 372 bp, Homo sapiens
  misc_feature (1)...(372): n = A,T,C or G
cttgagatggaagagttgcactatgttgaccaggctggttttgaacccttggcctcaagcgatccttcctcttcggcctcccaaagtgttggatttacagatgtgagccgccctgcccagacagcaaaactttatttaaactactaattcaaagaatactttaaacaagtgagtcctttccttccaatctaagtatggagtacaatggaacagtagagctgcactgaagacaagacttcttgggctaccatttttctggaagtttctacaaagtctgttatttatcattcggacagactgtgacagatgccattttaattcaataatatgattaaataaaggtttactgattgtttcanaaaaaaaaaaaaa

SEQ ID NO: 2400 - DNA, 140 bp, Homo sapiens
ctacacaatatatgatttcacagcaggttgaataaagaagcggatatgagaatctagttatcttctattatgtcagacattaatttgcaaaaatataaaactcctctcaataaattttttgttttggaaaaaaaaaaaaa

SEQ ID NO: 2401 - DNA, 861 bp, Homo sapiens
acacctgctcaaagtcacagagaggttaaacaacttgcctgagataacgaaactttaaacaagtgagtcctttccttccaatctaagtatggagtacaatggaacagtagagctgcactgaagacaagacttcttgggctaccatttttctggaagtttctacaaagtctgttatttatcattcggacagactgtgacaaatgccattttaattcaatgatatgattaaataaaggtttactgattgtttcatttcctgtatagttctataatttgatataatcccatgtggggttttttttgcttttgttgcttatgcttttggtgtcatgcccagaggaatgtcattgaggtttccctctgtttttccccagtaattctttgggttcaggtcttatgtttacatctttattacattttgaggggttttttttgtatatggtatcagataaaggtccaatttcattcctttgtatgtgaatattcatttttccaaacaccttttattgaatagattattctttttccattgtacgtttcttgacatccatgtgaaagggctctctattgtattctatttgtctttatgtctatttttatgtgattaccatgccattttgattactgtaactttgaaatatattttgaaatcagggagtgaggcttcccattttgatctttttactcaaaattgctttggctatttaagatcatttggggtccaatatgaattttaagattgttttttctattgtggaaagaatgccattgggatttaggagggattgcttgactctgtaatctctttgggagataaacatttaacaattaattcttccattaaaaaggatgcattctatt

SEQ ID NO: 2402 - DNA, 275 bp, Homo sapiens
atcctttgatggaagaagcctctttgtcgttaccctggctgattcagcattcccatatttgaaatgggaagaagtttcatgtccattctggcttcatgtggttggaagaggaagccccatgaatatttttatggatgccccagtgctgttgagtgcctatcaacaccaccacgagcttggccacttcacatcaacagcagatttaatttgggatctctaaacactatttgtggttgtgtagacagaaagaatttttctaataaaataaaaccgga

SEQ ID NO: 2403 - DNA, 1144 bp, Homo sapiens
actgtatcgagttacaaagtcaccagcaatgaatgaaagtagctgatgccccacatcctcaccagagtgagtttcatcactaagacaaagcaaaacagccggaagcagtgactcatgcctgtaatctccacactttgggaggccggcgagggcggatcacttgagctcaggagtttgagaccatcctgggcatcagacctcatgtctacaacggaaaaaagacatttagccaagcgtgttggtgtgtacctgcagttctagctccttgggaggctgaggtgttagaatggcttcagcccgggaggttgaggctgcagtgagctgagccgtgatcgtcccgctgcactccagcctggatgtcagagtgagaccctgtctcaaaaaaaaaagaaaaaaggcaaaaacttgatattttgataggcttaaattttagcctcattattttattgtatttggcgtttctttttattattagtgatgtttaacattttcccatgtttttactatcttttgtgaaaatattttattcactttaagtcttggcattgttgtttacttgctactccttttgaaaaccaacttactgaagtgaaattcacctaatgtaaattaaccatttaaaatgatcaattcagtggcattgagtacattcacaatgttgtgcaaccaacccctatatttagtttcagaacattgtcatcctcctccaaggtacccactgagcagtttctatttacccctttccttgatccctggaaaccattaacctactttacttttttatgcgtttgagaactatttatttcatataacggaatcggaccctatgggacattgtgtgcctgactccttcactaaacatattgattttgtaggtttatcctttttgatttatttctaaatacttttttacttattatggtttaattatgtctccatttaatagttttacgcccatgtgtcctgacgttagatcgatgatatatagacttagcgcgagtttgcaactatcacctctacataacatttcccccctcatacgttaatctatcggtattgagccactctatacactaattgtcttttgtttatccccacatgacttatagtgatgtcaactgttatccttaaaatgttttcaatg

SEQ ID NO: 2404 - DNA, 774 bp, Homo sapiens
aagggatatctctctacagctatcacagctggggatatgctgggtcacaacttaagccagcactgctctgagtctcacccaagcctttcagcaagtacttcctgggtaccacggctgattattcaagacccaagggctttttagtcagcagatgatgaattctgccaggactgggttcttcccttcaaggctgcaagtcccttctggcccatggcgtgtttagaaaagtcatccagaagttagggcctagaatggtggtctcgcagttctgccccatgtcctaacctactgtagctgagctagtatccgagttacaagacatcgccctccttattcttccttcatccctcctcaagcagagaaaaggagtctcccagagctgtgggctgcactgcctggggttgggggaggtgcaacacaaagactcttggccaccctggctggtatctcattagattgtgtgcaccccaagtccactggctccaagctatgcacaggacccgggatctgcccaggatttgcagtctttgtggcctaggctgcctttcaggttcatttagaaacccagaccatcttaagttatggcggagggacttgccagaactcagattccaactgctgggatggaccatttgcctctggccacagctggcttaaagggtccctctgggacccctggctgagttcttgcccatggtggattctggctggacaaggcagctctgggttccaatcccaagtccccaatccttgggcttttcttccccaagcaag

SEQ ID NO: 2405 - DNA, 920 bp, Homo sapiens
acctgtgagagtagccacagaggctgaatcctttaaatccataggagaagagctgcccaaggcctttggagcccaccagtgtgtgctggatgtaggacatgaagtcaaaggagattagtttggattattaagatttaataattgcccttctggattatggacttgcaaggggactgtagcctctttcttttagttgatttatttcatttggaataagactatttagtcaatgcttatcccttcattatatcttggaagtaactaacgtgtttataatttttcaggctcttaggcagaaaggactagctttgtcttagacgagactttgaactttgcacttttgagttaatggtggaatgagttaagatattgggggactgttgagaagagtgattgtattttactatgtgagaagaacatgaaatttggaggggcaagggttagaataatatggttttggatctgtgtctcaaacaaatctcatgtctaattgtaatcctcgatgttggaggtggggcctggtgggaggtgattggatcatgggggtggagttcttaaaaatggtttatcaccatccctcattggtactccatagtgaatgaattatcaagagatctggttgtttaaaagtgtgtagtgagaggtgaagccacgctgtgcttctgagtcgggtggggacttagagaacttttgtgtctagctaaaggattgtaaatgcagtaatcagtgctctgtatctagctaaaggattgtaacgcagcagtcagcattctgtaaaaatgcaccaatcagcactctgtaaaatggaccaatcagcactctgtaaaatggaccaatcagcaggatgtgggtggggccaaataagggaataaaagctggccacacgagccaacagcggcaacccacttcaagtccttttt

SEQ ID NO: 2406 - DNA, 859 bp, Homo sapiens
  misc_feature (1)...(859): n = A,T,C or G
acttgagtcccaacaagacagcctacattacagaaggtgcagataacaggagaaaaatcaaggtgctattaccagctgatacaggaagaaggagaacaagaaagatcaggagaaagagatggaggcacaggaggaacaggtggaagaaaaaggggaggaggagaaggagaaggagaagaaaaaaaagaaaaagaaaaaagcacttgtaatgggctaagtaattttcaggcatcactaaattatatttaatcctcattagaaaatgatattattattgtaacttaaaatgataattagtgttgtaatattcactatatgctagaaatgttctaaggaatttacatgtgttaattgaatgtaattttgcaataataagtaggtactattgttattctcaatgctgtagtcatcataatgctatattgcacagtattcattaaaagtgtagactctgaactttctccataggacgagagaaataagcaggcattcccaggcatgacttttctttctattatgtaatcttatctttcttattgnctcaatctttgcagggggtcactgttcatttattcccctagaatgtaaaaacccaaagactgtgtgactgcatcagacttattgaattgttgagctaccaaagagaaataatattggtgcgggccgcttccctttaagagggttatttatagacctcgctccttgacttgtggcctagtcgttggctgggggaacggtttcagttcctaattggggattccgttatcacttattaggggattcgaggaataaattttacaaaggcgcaaaggcgaaacctaaaggcgcgtgctgtttttcctccgttcccccctaaaga

SEQ ID NO: 2407 - DNA, 303 bp, Homo sapiens
tcatagtcagagagcccggcaccacatccgagtccatctttacctgtcaaagatggcttcctttcatgtctcagggcataattcattcagaaattgaactttatcttcaaggtgaggattactgaaaccatcagtagaagaaagtacaagatgattttgttacatctggacatcatggaacactattccccagttttcctcagaacatcccctttgatatttatcttttattattggatttatagtattcctcacagtgaaataaaaacatatgtaaagctgtgtcttagaaaaaaaaaaaaa

SEQ ID NO: 2408 - DNA, 781 bp, Homo sapiens
gctaaggtaactgactctcttctttaaccaccgctccagattgctcctgtgtttcatagatgggaaatcatactgatgactcaaccatatatagcattattttgctggttcatgctacctcagcggaaagtaacaaggctaattatttttctctgcatgataaaaatctattacatttattgagaagcctaccagtcgatagacacatatttatttcaggatattttagctcctaaaatactatcaatgacattgacctttagctggattgcaagaacagaatacgcacaactcattttttcccagtttcataattttgacatccatatattttttttagacaagcttaggctgcctttgcttggctatgatagatattttagaatatctctgactcatgaatataaatagttgtgcaaaaataaatttcataaaaccagagctggtaacaaaaatcacctagagatcaacaactctgaaagaatctagtgtcacattccttggtatgtcagattaaactaacatgtgccagtcaatattgctacactgcgacccttgatgcctcctaagcaaaactattaagtccaacattctctcctgtaagcacttatctgtaaggatggctaacatgtcctctgaagcagatattgaaactgattggacaataggtagataccagacagggggccttggggctgacctttagaaataggggggagaaaatcttaatctgcaacacaatgcccgtccttttaaaccctatcattttcattcccatgtg

SEQ ID NO: 2409 - DNA, 659 bp, Homo sapiens
  misc_feature (1)...(659): n = A,T,C or G
acaatgcaatgcaatgacatcatttcattatatggaatgttggaaatatgcaaatagaaccactgcagaaagaagcttggtcaggacagcacagcaggaaacagattcaacatccttgtctccgacctgtgtttgcctatgatattgaggtctgatcctaccagcaccaaaagagtgaaactactcctgctagaagatggtgtgactggccttccaagttcaggctcatcacatctcctgcaccataaaagcttccagcattctctttccacctggcctctctccactctagtctttctggaactatcttcccaacaaaacttgactgccttggggaaatcatagtctaagaagcacttaattcttgtatagcctgcttcctacccaagggacataagatgctgagaccttgttaattatttttgctggtaatcactatttttggcttttttccccctcccttgactatatagtcttgtttcccctccttatatgcctcttctctaatgtcatgctacaactctacgttatagcgtagtcatttgattctcctctttccccacacccactgngtttataaagaaaagtataagggggtagtggggagttattattagtgtctgctgggaggggacanacacaacttacaatatttcttg

SEQ ID NO: 2410 - DNA, 1391 bp, Homo sapiens
acaatgcaatgcaatgacatcatttcattatatggaatgttggaaatatgcaaatagaaaggtcagcagaagaaaccactgcagaaagaagcttggtcaggacagcacagcaggaaacagattcaacatccttgtctccgacctgtgtttgcctatgaacccatcctattcaccatattgaggtctgatcctaccagcaccaaaagagtgaaactactcctgctagaagatggtgtgactggccttccaagttcaggctacaagttcctcaggactcatcacatctcctgcaccataaaagcttccagcattctctttccacctggcctctctccactctagtctttctggaactatcttcccaacaaatttgatatattttcaaaaacttgactgccttggggaaatcatagtctaagaagcacttaattcttgtatagcctgcttcctacccaagggacataagatgctgagaccttctcagtagagtgaaggataagttaattatttttgctggtaatcactatttttggcttttttccccctcccttgactatatagtcttgtttcccctccttatatgcctcttctctaatgtcatgctcctccattcatctacatctattacaactctacgttatagcatagtcatttgattctcctctttccccacacccactgggtttataaagaaaagtatagggggtagtgggagttatgattagtgtctgctgggaggggagtagtaacttcttctagagatctttgcagacacaatctatacaactatttcttgtgtcttttcatttcattttcaaagctgaatttcattttggtttaacctttgatcccaccccaaatctaatcttggaattcgatgttcccataatctccatggggccatgggaaggaacctgttgccaaagtgattggatcatggggacaatttccccccatgctggtttttcatgatagtgaatgagttctcgcaagatctggtagctttacaaaaggcttccaccttcgcttggcactcattctctctcccaccgccctgtgagtaggtggcttctgccatgattgtaaacttcctgagacctccccagccatgtggaactgtgagtcaattaaccgtgagtcactcttttatatataaattacccagtcttgggtagttcttcatagcagtgtgagaatggactaatacacattttacaggtatttgtattttcattactcactaatctcatgtaagattagaatggatataactctgttccttagggtagaccttctcgaagtatttgtagtagagaatcagtttttcccctaacctattatagactaatattttattaaaatcgaaaaataaataactaaaagaataaaat

SEQ ID NO: 2411 - DNA, 264 bp, Homo sapiens
ctccatgttaggtgctggagatacagtgatgaacaagatattcaaggtacctgcctacctggagtttacagtctaattgagggacacaggaaggaagctgtactgaccatttatctttcactgctgctcaacaatttaaaaaattcctgtctgtgagactctgtctcaaaaaatgaataaataaaattaaaagaaagaatacatgtaaaatgcttagcacacaataaacacacaagtattggttccctttcaaaaaaaaaaaaa

SEQ ID NO: 2412 - DNA, 931 bp, Homo sapiens
  misc_feature (1)...(931): n = A,T,C or G
aacatctgtggcagctggtgatgtttgggacaacagagaggtcatctatggaaatgcgctgcaagtatgttcttagagcaactgttggaccatgaggatgggatgtcgaggtctagaggaaggatacacaagggtcgttcctcacctcaccccaacaggggagactcaccaagactccaggcttacctctcccagccaagcctggaacaaaggcaggatttaagaccagggggctcctgcattccttggctcatggctgcctgacaccgactctgcatccacagtcacatctcttctgactctcaccttcacgccttatgaatatgttgggcccacctggataatccacggaagtctccccaagaaaagattcttaaccacatctgcagagtcccatgtaaaataatcgtttcagcttaacagtgaatcattgtttagtataagaggacccaaatattgcatggggcatacttatactaaaaatttgtcattgtttatgtgatatttgaatttaatcagacattgtgtatttttatttgctaaatctggaaacccttgaggaaatcacagaaatagtctggaagcatctggaaaagaaggtactttgagggagctaatgtcctacaatgaagccattagacagttttgcttgtgcaatttacattatacaggattcatcagttttataaattacattcatagtttcctgaacactttatttccacattaatatttttctgatcttaattgtattgtcttctgtaacataggcttttctgcattttgaaatttgcccagttttacccagatactaaatacatatttcaaaaatgtgattccaacgaacgatatccacgttgattttttttattttcataaagcaaaataaagacacncacctgttgccttttaaaaaaaaaaaaaaaaaaaa

SEQ ID NO: 2413 - DNA, 764 bp, Homo sapiens
  misc_feature (1)...(764): n = A,T,C or G
ggggggagaggaaattgggagactgcccacagagcctcagccctgcgattgctactacatgtactgcagaaggttggagcaaacatctgctgctccctgcactgatcttatgagcagtactcactgcanaggttgtgctgatgctgagaaggctgccctcagtctgtgcatgcatgtagtgcatcagacgaccaggtttcagggtccacgtggattaccataaacaatgcatgtcaagttaaagcagtggcagtaggttgggtttggttcaagcccagttcagaagcacagatagaaaaggagaggcctctggcaaaatcaatctccccaggtggactgactgggtgggatcagaaagccatcatcaccaagtcattatggtagttgtattcacaatttccgtggcttgcttgaatgaattatatttgctccatgagtaacacagaatacactgccatgttttcaccccagatgtgtaattaaatcatcctattctctcagtcatctacttcctatgcttaaaaacaaaaaggtggctgcactttataagatcagcttggggctttccaaggagtctataattttaaagcatttaatccttacaaattcgcagtatccaaggaaatccctgaaccagataatgtgagaatctctacgaacaccgatgctcttggaagcatatcctccacatataaaagaacaaattcaatgatgtcaggctatcagtctttaataaatttaaaaataaaggacgatgctggccg

SEQ ID NO: 2414 - DNA, 790 bp, Homo sapiens
gctgagtgactctcttataaccaccgctcaggtctggggaccccagaaatgctgcatttctaataaggaggtgagtggtgctgatgcagctggtttgaggacccattttgaatgtcaggtcttgaaggttggcagccaggctgcgtctttcttgaactgtgtgagcatggagccatcgacctcaagcctactccccacttagtcaacagaaggcttggttttcaacctctgcccaaagggaacaccccaccgaattcctgtttccagtctgagaagtaaatattccatttctgccaagatgcccaccaaccagtgcatgccaagactatgaggcaccatgaatccctggctggctcacatgaaggcaaatccccttcaggaccaggaaggcccaggctactttgtccaaaggtggtccagttccagatactcaggtttacagctcattcctccctctgagattgaccaaccatgattcttcagggccagatgttggagcatatgagacctgccaccacaccttgtggcccacggcagcacaagacagcattcctttacactctctgttggggaaaatggccaagtcctcatagtccacagagaggcgatttcaagccacttgagtcttaacttggaccttctccctcccgcatcccatccatgtccttgtccgaaaaagcccaaggtttttttttaaggatctcaggacttaaaagcttaatttgacaaccaactacttaaaacagagtaaggctgaattgtactcaaggccaaggcaactcagtactgt

SEQ ID NO: 2415 - DNA, 540 bp, Homo sapiens
  misc_feature (1)...(540): n = A,T,C or G
ttcatacagattctgcttccagtcatggcagagtagctcccttcagaccaactttcctgcagacaagtatgagcttgtctggagaattaaaaagcaagaagattctcaagtagggaagaaggtcagcacttcaaagaaggtaatgatactggaaaagaaggtaactgttccttgaagagacaggctgtaacttggcccacatcaccagctgactgtgatgctcaagagtcggacattcacaagaagcatatgctctgccaaaacgagaattaacaaaaaaaacgacttacatatgggatggaggaaactggagccatcacgagaaagtgacagaggataactccaagataaggtaacttgtccaaggtctctgtgaaaaatgcatatttgggccaggtgcagtggctcatgcctgtaatctaacactatgggaggccaagatgggaggatcaccttacgccagttcaagaccagcctgngcaacatagcaagataccatctctacaaaaataaaaaatttaaattaaaaataaagaatga

SEQ ID NO: 2416 - DNA, 164 bp, Homo sapiens
aaacaggtaacatggcagttttttaaggatagaggagtaaatggaaacttttgggaaacagggggagcatccttgctcaggaacataacccgtttcctgaattcactgaattcactgaaaacagccgtcccccaatccaaagaagtttttcctgtcctaaaaca

SEQ ID NO: 2417 - DNA, 216 bp, Homo sapiens
tttttttttttttagttttgcacagaatataggtaaagcatgaacgggcattttaacagaagaatcacagtaccgctcacttctaaggcagtatttgtttcaggctttgcgaccaatcagcagttttcacactcagtcctggattcggtctctgctattttacacccaggcaagggcactgaggacagcacttgcaagcctctcttaggtaaattc

SEQ ID NO: 2418 - DNA, 698 bp, Homo sapiens
atgaagagcacctttctctgaagcaatctatcactcacaacaatttagtggattatatcttaataaaccaaaatgtacatttacaaataatgtatttttcttcctgactgattcctccagaatttggaaactctgattgagtatcttaatttcatggcaatgtaagtatttgtataagtctgattaaaaacaaagaaaattgggatattaaaactaatagtaactattataggattactgtgagttttaaaaagaaaaaatatataatgcatttaaaacaatctctgagtttagtaagtactcaataaagtttattttattcttatttttatttgtattgttttatttttatcagttctctgttagcaattatcccaacagatccaatgctgtactcaaaacaccaaccaggcatgaacacctgtcaggtcccagcccagcctgcccaagcctttgctccccactctgccctatcccttccaaaaatggatcaagaaattctactttgatggtgctagcaactttagccaaagctgaaattatttgaatatcctggctattccttgtgtaaatatatatagactgttatgaaaatgattcatgaacttttcaattccattgtcagaatatttcctcatgtttaaagattatgtgactagaatgttcaatgataatataataaatgctgatgcggccgg

SEQ ID NO: 2419 - DNA, 557 bp, Homo sapiens
tttgacccattaatgattgaaagcaaaaaagcagcaactgtggtgttaatgcttaattctccagaagaggaaattttggctaaagcatgtgaagccatttataaatttgctttaaaaggtcatcattgggaatccagatgtaaaccagagtgtttctggaagttactatatctttttgagtggatggtgtagaatcctgggtcaaatttcagggagatattggattgtgcatctatggcagcatgaatcccattcagtcttacggagtcattatacatcatctggctgtcacgtgtatctaattatgtgttatctctttttgcatgacatgaagaaataggcatgtatttcatatgaaatcaatacagaaataattttaagtctgatgttttatactagtagtattttctaaaattaaaaaaaaaatgataggactttggtttctggccatgacggaccactctactgcctgtaacaatgaatgaaacagacccaatatgtgaaagtagagtagacttactctattggtggaaacaatgaagaaaataaacagagat

SEQ ID NO: 2420 - DNA, 310 bp, Homo sapiens
cctctgtgtctccttttccgtcagcttagggctcagaccaacgctttaccaatgcaaccgggacaaacctggcaactggactgtcttggacaaactggaaacacaagttctagaacatctgaagcaattgtggtgaggccacttgacatgtcaccaaccccagagagcaaagagctctctgccttttcttccttcctctcagattacgcctttgaaataagacctgactgttaaaacttcatgagcttatcaatatatccaagccactccaacacttaaaaaataaaaccccatgacaaaaaaaaaaaaa

SEQ ID NO: 2421 - DNA, 815 bp, Homo sapiens
  misc_feature (1)...(815): n = A,T,C or G
atggagaagcagtggtttagagtttaggtaactggcccaaggaagaagcatggttactgagatccgaagccacgctctgcagcctccagcactcagatttgaaatagcacagaagagtggacacacagtgaggtcaagccacaaggataacactaacatactgaggctcctaatacatcttgcattcataccatcatttttggtttaaggcagcacagagcaaatgtccacagatgaataccaagatggccccgcctggtttcaacagcaaaacactcttgggccctttcaagcatgtattcagtttaaaagatgagaagatgataactcagagtttaaggagccagcacaagtcacagcttggaagtgatggaggcttccaggatgagcaccgacttgggtctatctggcctcttcatcatggtgctattgggcttctaaaccctagatttttaggaaagcatagtatacaattatacagacacattttcattgactgggctaattcctaattgtgggatatttatgtaattaccatttttgatattgattttaaaaatgttttgttggtgattatcatatatgtccgtagtgatttccatttgatacatcctgattctaaataatgagcattntttcaagttcctgtggcatgctgccatgcagagttctaaaatgtaccaattcacctacagtccagcagtgtatgaaagaatgtattggccagacccttaccttttctgatcttcatattattatttctaaaagaattcaaaaatttggatttacttaattccacagtggtcttatttttt

SEQ ID NO: 2422 - DNA, 633 bp, Homo sapiens
gcagtgacgatggaagaaaaaggcaagacttcactttgggaggctgaggcgggcagatcacgaggtcaggagatcgagaccatcctggctaacacagtgaaaccccatctctactaaaaatacaaaaaattggctaggcgtggtggcagacacctggagtcccagcgactcaggaggctgaagcaggagaatggtgtgaacccgggaggcggagcttgcagtgagccaggctcgcgccactacactccagcctgggcgacagagcaagactccatttcaaaaaaaaaaggcaccacttgatgaggatttctagagtaaaatatatttttaaacatgggggctagaaactggaacagcactttataatattaataaatgttgagcatacaagacgtagagaggtttggttaagaggctgtgagaacatatctgttcatgctaaatatgtaattctgaaagtattttattactttgaacctcaatttttcaaggtaaagtagccatacatattcatctcaaaggattattaaacttatggaaaaagtaaatcagaaaatgcatgtaaagtaatcaagaatagtttaagtggaagccaattaagtggaaggtattgaataaatggcgatgcggcca

SEQ ID NO: 2423 - DNA, 773 bp, Homo sapiens
cctgcagcgtacaatcctgttttaaggaaatcttgccccatacccttatttgtgaaagcatcaaagcgctttgaagagtccaaagagattactccaggcccagcaacatatgaggtctcacagtttggaggatagaatgggaaaatgctgattgcaagttatttccgacatccttgaacttacctgttttggtatcaggatgatgctggcctcataaaagagggaggattccctctttttctattgattggaatagtttcagaaggaatggtaccagctcctccttgtaactctggtagaattcggctgtgaatccgtctgctcctggactttttttgctcagtccatttttaaggcatactgttctgaagagaacatttaatgtaactctgccaaattctttcttgattgatagagaaatcactcctactctagaacaaaaagccaaacaaaaacaccaaggaggcaaaatataatctactaaatgatatagtccaaaggtaatatctattaatataaacgtaagctgacagttctctcacaaaaaagtacttccatgttgataatgtcctccatcagctgctcacaggaacataattgctcttctaacatctagagataaaaaatacgttcttatataatatttgtttttttcagaaaatgtttcctgttacaaaagcagtatgtatatatattcattgcattctttctaagcgtgtactactgatgcatccatataaaatataatgaggaataaaagccgatcggccagg

SEQ ID NO: 2424 - DNA, 369 bp, Homo sapiens
cccactatgaggaattccaggccacatggataggctttcctgtaggtgctctgattgacagctccaaatgaggtcccagctaccaaacatcacttccccactgactacagtaaggatgtaagaaacaccccatagagttgatacaatcaagtttccttctgccggaatgccaaaggatttgagaagaatgatgccaggacaccagattttcaaacaagcatctatcagccatggtatttttcagttaaacaatatatgtgaaaaatttaaacattttctggaactcaatagcttttatcgccagaaaatcggtaccaacagcacctatttcacagtgtgctgcacacaaaaaacattcaatactatgat

SEQ ID NO: 2425 - DNA, 552 bp, Homo sapiens
  misc_feature (1)...(552): n = A,T,C or G
taagcccactatgaggaattccaggccacatggagaggctttcctgtacgtgctctgattgacagctccaaatgaggtcccagctaagggccagcattaaccaccaaacatcacttccccactgactacagtaaggatgtaagaaacaccccatagagttgatacaatcaagtttccttctgccggaatgtcagcatctggaatggcaccaaaggatttgagaagaatgatgccaggacaccagattttcaaacaagcatctatcagccatggtatttttcagttaaacaatatatgtgtaagaggctttagctatcaaaaaatttaaacattttctggaactcaatagcttttatcgccagaaaatcggtaccaacagcacctatttcacagtgtgctgcacacaaaaaacattcaatagatataatattgttcaataactagaggtggcagctagaatttttaacctgggaagaaagctgaatataattcaaccgttacattttgaattcttctatataaaactgtgtcctcantttaaaaaaaaaaaaa

SEQ ID NO: 2426 - DNA, 485 bp, Homo sapiens
agggcctagaagaatgcctgatctagaagatgcccagtggattcttattgaaggaatgtccagtgggtgttaaggctgaagatgtattaatagcaacacaggataaggcccggctgttcctgtttggaccactttctccagccgaatccatggttcctctcacctcctccaggcctttgctcaccccagcctcttccctgactgggtgcctcccatcggaaccctccctggggaacccgtcccacagtgatggagcgccttatacccgctttctgctttcttttttttacaaagcactcctactcatcaaacacattaactactgtgcttatttggttcgcttctttcccttccagaatgtaagctctacgagagcagggttttcagtcctttcggtttactgacacaccccccatgcccaacacagagccttgtacatatttgttgaatggattaaaaccagaataaccacaaaaaaaaaaaaa

SEQ ID NO: 2427 - DNA, 578 bp, Homo sapiens
cgaaaagtaaaacctcataaaataaaatgaccaacgcggtcttcagggctaactacatgcctgttctagaagatgcccagtggattcttattgaaggaatgtccagtgggtgttaagggtgaggctcagggaattaagcaccttgttctgggtcacggctgaagatgtattaatagcaacacaggataaggcccggctgttcctgtttggaccactttctccagccgaatccatggttcctctcacctcctccaggcctttgctcaccccagcctcttccctgactgggtgcctcccatcggaaccctccctggggaacccgtcccacagtgatggagcgccttatacccgctttctgctttcttttttttacaaagcactcctactcatcaaacacattaactactgtgcttatttggtttgcttctttcccttccagaatgtaagctctacgagagcagggttttcagtcctttcggtttactgacacaccccccatgcccaacacagagccttgtacatatttgttgaatggattaaaaacagaataaccataatcatagctaaaaaaaaaaaaa

SEQ ID NO: 2428 - DNA, 595 bp, Homo sapiens
caggattgagcgtggctccttctcagaagcggattcctgaaaggccctgcccttcaggggacatggatggggccaccagctgctgggcaaagagaggacagccaggaagcaagtgacgaagcctgcaagaaggccagggaggaacaggaaggaccagctgaagatgtattaatagcaacacaggataaggcccggctgttcctgtttggaccactttctccagccgaatccatggttcctctcacctcctccaggcctttgctcaccccagcctcttccctgactgggtgcctcccatcggaaccctccctggggaacccgtcccacagtgatggagcgccttatacccgctttctgctttcttttttttacaaagcactcctactcatcaaacacattaactactgtgcttatttggtttgcttctttcccttccagaatgtaagctctacgagagcagggttttcagtcctttcggtttactgacacaccccccatgcccaacacagagccttgtacatatttgttgaatggattaaaaacagaataaccataatcataaaaaaaaaaaaaaaaaatggcctcgttggcctca

SEQ ID NO: 2429 - DNA, 590 bp, Homo sapiens
gcctagggtccacaggatgaagtttccttctggggctacatctttctcaggctttgcatgtcactttgataatatgctgactaaaaacatacactccatcaatttcagtaagttggcagtgaatttctttagcagaatcgcttttcacattcaaatataaaataagtgtgggttctcatgcattcatgcgaaatacttattttaaactaaaagcatataaaatcatagtacagataatataatttaaaggtatatcaaaataactgtactgttagtataaacaaaccaaataaactaatttataaggaaatattttcagactcagctcttctgagaaattagctaaatttaccagcagttcttatcagagtgaataaaccttagacagattacaatgaacttcactgaagtttgtttttaatttttatattctgcttttcagaaattaactttggaaattacatatgagaaatggttaattttaaagatgattttactttgcacaagtatattactaaaggaattactttaagaacaggtttcattgcaaatttgagaataaaacaaagaaattctcaaaaaaaaaaaaa

SEQ ID NO: 2430 - DNA, 117 bp, Homo sapiens
ttcctgaggaactgaaatatgaaatctgtcaagtcacatacagagatcctgtagatcattcaactgcccatcccaaatcatccaataaaatatgatgcttctctaaaaaaaaaaaaa

SEQ ID NO: 2431 - DNA, 536 bp, Homo sapiens
agagaaaaagaaagacagaaacttcacagttgggaaaagaaaatacctcatggatatgggttttattgcaagctatgcatctgacttaaagatgttaatgctgaattcgcccaccaagatcaaaactcctacaaaactcttccagctgcagcatttatggctccaggtcttgtttcagaaagtgaggaatatgttccaggattatgatcttatttctctttcttgcctgttgtaagcataaccatagtctgctcttttaatgctatgaaaatgttcagttggcattgtttttcccacaaccatggaaacacctgcttccaaattaatttataatctattttacacctatggctgcaagccatagtctagtttattttttaaggaattttggtaaagcatataagaaagtgtataatgtctgcttcttctctttttttggtcctcatgacataacgttggcttttacacatttcgttttatgtccagctttttaagatgctaataatatgtaaagatatgtgatatgttggaaaaaa

SEQ ID NO: 2432 - DNA, 641 bp, Homo sapiens
cttagggattccagatgatggcacgtggtagaaccatctccttttaaagatgaaagccaactgccacgttttgagttgctccaggaaaggcttttgtggtaaggaactgagaaatctctggccaacaggcagcaagaagctgaaaccatcagtccaacaacctgaaaggaattgggtcccaccaacaatcacctgaacgaggttagaaatggagtctccttcagttgagccttctgatgagaccaatgccccagccaacagcttgaccacaacctcaggagagaccccgagacacaggtggtcagataacctgaactcagattactgaaccacagaaactgagagataatgtttactgtgttaagccattaattttgagttaatttcttatgcaacaatatgtaactggtacaacagtgttttctggtatttcactggttaccagacaaagataattgttttaaaagtgtaattttccccctctcaaacttagccatacattaatgcctctaaacaagttacctacatatgaaaataacttctgctctttactgaattaaggataatgaactgtttaccctccattaaaaatcaattaaggaacggcaaaaaaaaaaaaaaaatggcgcttgatggcctca

SEQ ID NO: 2433 - DNA, 177 bp, Homo sapiens
ctagataaatatttgatatgatatgaatattgacaagcttacaagccaaggtaaagctgccaaagaaggaaaactccagggaccaaggagtctgggaggaaccagctaaagactttcatgacaatgtaccaggaaaactagtttgaaataaaagttttcttagtaaaaaaaaaaaaa

SEQ ID NO: 2434 - DNA, 992 bp, Homo sapiens
cctagctttccacagcatgaattccatggatgtggttttccagcagtttcagccagttcctccctaagaagccaatgcacaggattcagcggaggccagcggaaacgtccctctcctagagaagtgctgcttcatcaggacttgcggctctcagcaacatcaaccttcttatcactgtaatctggaagagcacatgctgttctcgatgatgttggcaacgggctttatgagaaaatgtcatggaagttgtcctttccagttatagctaaaccaccagggtcaaattttattttgcactcaagatccacagatgaatactcttgcaaagcctgcaatatccagagataaagtgctttatgctctgaatcgtgcaattcagaagggaagcacaatgagggagtagttctaagaggggtattaatcggactgcttaggttcttgtcttagcttcaacatttaccagatctgcaaaagtattttaatcttcgttcttcagttttcctttctgtaacataggcaataatgtgcttcccttgtaggacttgggaattaaataagaaaacatataagaagcacagtgcctggcattttctgagctcttaatgaatgctggctttgtcatggagtttattattgcccacatttatggtggcagaaaatgttggttggctgccctacagacgtttcctgctgctctgtcttccttgtaatcaaagcgctaattttgtatatttatctgggaaccacatgctgatgaattttgattgaactaactgcttgctaataagtggctctcctatttatgagtattcagggcatggcacaacttacctaaagggagacctggtcatgtgacttgctgtggccagtgaaatatgagatgcttgacaccacaaacaatgacattcatgctacatgtctgtcgcattgccttctgttgagactttcaataaaaatcaatgagcttttcacttcaaaaaaaaaaaaaaaaa

SEQ ID NO: 2435 - DNA, 441 bp, Homo sapiens
ctagggctcaacgcctggaagaagccttaggacgtgggggaaatgtctaacgtggagtccacctgctgagcaggaccgggtgtgaaggaagaagctttgttctgattcctcatggcccagccacccctcgcctgagctgagcctggccacagggcccgcctgcaggaagggctggcccatggcttcacactgggctcaggctgcgctaagagccccgggtgaggacctccaagcccaggaagcctcagttggccaaagtgctagatgcgtgtggtctgcttttatccccgcttccctcagagcttgcattttccaaattcaagagaggctccaccttcaagaagaccggcctgtccctgttatctatgtgtccccctaccatatctccctttgttctgcagagcggtacgcataaaaagcttttggggaaaaaaaaaaaaa

SEQ ID NO: 2436 - DNA, 600 bp, Homo sapiens
cacagcagacacataagagccgcatatctggtgaacctgattagtaacgcaatccaccacacagtcttcaggagcattacttctgctgaatttgaactttcatctctcagctgacaaccattctcatatcaaccatcttacctgctgatactgccaatttcagcagcatcgccctcttaaggactatttgtacaagcctttaaatatttcattgcattttagcccttattaatttataaccatggatggaaaatggaaaattaaagtgctgatatgagtcatagtcataagaaacataggtctcataagccgggcgcagtggctcacgactgtaatcccagcactttgggaggccaaggcgggtggatacctgaggtcaggagtttgagaccagcctggccaacatggtgaaaccccatctctactaaaaatacaaaaattagccaagcgtggtgatgcacgtctgtaatcccagctgctcagtaggctgaggcgggagaatcggttgaacccaggaagcagaggttgcgatgagccaagattgcatcactgcactccagcctcggcgacaagagtgaaactgtctcaaaaaaaaaaaaa

SEQ ID NO: 2437 - DNA, 771 bp, Homo sapiens
acactggaaccagacatgaacaacttcatgcataatgaaacttcaactaagcaagttctctgaactcaaagatttctcgcaaattaggcatgtcctaggaatccactcttgataaagctaatgctgagttgccttagacagtcgagcctgtgcatttgagggttttgacatggctgagtgctgaatttgtgattttaaatgtaagttctggttattttaagctattcctgtctctttgatggcactgtaatgaaagaaactcagagttttttttattctctcattagtgtttctagcaaaaataaaaaatactcatttgtgaaaattttccattacctaatatatcctttccataaaagggtcagtttaatgaaagtattcatcagtatacaaagagtagaagctaactacccagcttaaatcctcattaaccaaaaattacttaggttttcccatttcccatgaaatcaacatacaattcatctgttgatggatgggcagcaccaaaccattaacaacaaactcttgaactctatgatccctgaccgcattgtctccagcaggaaggacctatctgggaatacctaaaaattcccccaaaggccaagatcttaaaatacacactaacactggttttgaaatggggacttttgaaccattcctttggttaaaggaagggttttagaatcccataaaagttcgaatttcaacagtgggaaaaatgtatgcccctaatcttaaataaaggatctcccccgaagtatcccccca

SEQ ID NO: 2438 - DNA, 598 bp, Homo sapiens
agaggtctcactttttcaccgagttaccaaggatggtcttgatctcctgacctcgtgatctgcccgcctcagcctcccaaagtcaccttgctctttttatatacattttcttctttggttttagtctccttatataaatattcacatatgaaatgttttattattcataaaataattcattcacagtatataaaacctcatatttaaatactataattcaaataaaataacaatatgactttttgttacacaaattacatggaagtaattgactttttttttacaagcctcataaataggttgatttatttaaatgtgaagtttgctttattgaaattttatttgcaacatatcttaatatagttaaagtgaatgtatgcatatctttctatacattaaaatgtttatggatttttctacttataattgagtttagcatacatgaaactgtgttaattctttttttaagggcctgagcagtagtaagtatgtattttctttgcttttgattttgaaataatttattgttgccaactgaaaataacatggacccattttcttatgataaataaaatctgtgttactaaaaaaaaaaaaa

SEQ ID NO: 2439 - DNA, 1042 bp, Homo sapiens
cgagggagcggtgcggttgcaaaaaatatcaagaagaaagaaagagacctttaggcgcactcctcctgcgcattaaactcaccatcttcctgagcccagctatcaccagacacctgcaggtgagctcactgcagagcttggcgtcgtggtgctgcgcacagccctcttgagcacacaggtgtcagcaccagtcctataaaagctccagctcggcctttagactcatccgcatgacggcatacggtgcatgccaagctagcctctgacctcacttgcaacgctatttgttcatgctcttctcgcaatataatgcagcgctttgttctgccgtgaaaacagaaaaaaacgagactcatctctagcctcggtaatcaaaaaccttaggccaaactggtagatcgcatccatcaatagataaatggacacagctgagagttgcacagagaataccaaaaggtcgggtataaccaagtcgtggcttcgttcgtgtagctattaaaatccctcgaagagtctcgtcgctacatacccccgaaactatctaacattgacagtaccaacgaaaacagagtaccacccgggcccctcagtcagcgccagcagacggcgcgagaggctcctcgcgagacccactctacccttcaatgccgagcggttacatttcagtgaaccccccgcatgatctgacctcagataggactgaggagcagaccggctgggagcaaagccggaatcccgctcccctcaagggagcgaaaatacaagggatattccacatgagtcgcggcgggacacgcccaagcataaaaacacttcgtaccataaggcgccagccaaaagggccaagaaactcgatataaaagaaccagggatgatcaggagggaagtccctcaggacgacggacccacacgtcacaacatcacaaaaagtatgacgctccaagcccgggagtgggggaagacgcgcacacgccctattaaaaattctctgcccttcgcccacgagcaagcaacctcgccagcgcttctagctagcgccgcg

SEQ ID NO: 2440 - DNA, 161 bp, Homo sapiens
cctgagatggcagtgaggaagagctcacatgtcatggccataccacctccatttggtgttagaacagatttcaaattcctttgttttgtctttattccatggtgctttttccataagtggtggtttctattaaatccataaaacagtcaaaaaaaaaaaaa

SEQ ID NO: 2441 - DNA, 823 bp, Homo sapiens
cttggatctataccgctggacatgaatgctctgctggacccgtacttcgttgatctcatttgatgacggcgtttacacccagctagctcgcagagagtcgctgggacgctaccactgatagaccagattggccggcatctaagcttgacatcaggaacattctgccatatctactaggccccgtgatattgtccaagcaagacagtgttctatcaacatggatcgccatggctatgactgatgagctggggcccttaactgacatcatctgcttcagtgagatgctgctactttgtgaacactctttttgcgccatacactttgagacactcttgtgagtccgatgcgcttgtcatcactctgcctacatccatgattccttatcttgcggactctcctagaccatacttattctgtgcactgagctttattaatgcactcaaaggctgggcctcggtcaccttcgaggaagagctatagcggccgatatgctctgaggaggggtagtccacgatccgccctcattgactaggtggactcgatgattctggtttagttagcggtatcacctcattcataggctgcaatacacttgtcctcagtactagggggccgcggccccacatatcctctgagcaacggggcagcccacggccgaaaccccctacagggcccttctgttgcgccttacctatgctccgaccccttgctgacttttcactataggaagccccccccttacgtgcttactcccctcgggggctttaaagatacggggcgagaccccctgggaacttctctctgccctcccctgcccccagct

SEQ ID NO: 2442 - DNA, 435 bp, Homo sapiens
ctggctatatatgaaggaaaccaataatatgctcaaaatgtacttccttgacatatttcaagatggtcattcagagaagctaaaaacacaggaatagctgaaaagctgtcccacgtagaagagatttgcctgcagaagaaattaacaacagaaacatacaggcattctctgaagtccctctttggtctaggaaagattatctcatagaaaaagaagacaaaaggtctgactgagaaactgttaccacagactgccatatttcctttctgagagctgctacatgtgaccttttctgtccataacaagaccacctttgctccatgcctttcctccacttctccatcctgtaacttctcttgtcattctccaagtccatacttattctgtaaactctggatgattaaaaaaaaaaaaaaaatggcctcgttggcctca

SEQ ID NO: 2443 - DNA, 208 bp, Homo sapiens
ctaggtcatttatatttgaagcttcagatcttcggtcaaaacaatcaaagaatttgaagttattcataaattgataattcaatttatgaaccagtctctttgtcttcctttacttttctacttgaattttggttattttcattgcatatttacttctccactaagacgcctgaaagaagaggaataaaggctgaattcaatctgaaaa

SEQ ID NO: 2444 - DNA, 228 bp, Homo sapiens
cagatgtcagaagagtttgaaacctcagatttgtgaaggtttaagcaaggaaactatgcaagagtatcaccatgtggtggaatactgaaatggaaaaagtatggaccttggacttgggaagttggtaagggttgtcagaccctctacaaatattcaggaaattgatacagtaatttactaaaatccactcactgaataaaagtttgctgaacaaaaaaaaaaaaaaaa

SEQ ID NO: 2445 - DNA, 256 bp, Homo sapiens
agtagcccaaaagattgctgcttctaaatttcttccaacctgcagcagatgagatctgtggaacatcagacatctcaatgagaagtgaaaatatcatcaatcatagcttcagctctcaaaggttgttaacgttagaagatactggatgaagaggcaccagaactccttgtacatttctttgcaacttcctttgaatctataattatcacaaaataaaaagttaaaaataaaaaaaaaaaagagaaaaaaaaaaaaa

SEQ ID NO: 2446 - DNA, 145 bp, Homo sapiens
ctagagcccaaggaagtcactgaaatctagatatagcaaaatggtagctcaacaccagatgcaattatttaataataaactctaaatttgtttgcccccttaataaaactctatattccaatattcaaaattaaaaaaaaaaaaa

SEQ ID NO: 2447 - DNA, 813 bp, Homo sapiens
ccttagaggtgcaatgaatcggggttagtcagtcttgctcaggagcgaagagaagacatgaacacgctccaggacctgcctgtactgggcttgacactcgactcaccggactacatgcatgtagattccatgcgcaactaaaaaaaagcttgctgacgagatcttatcaaaatccacgcctatacgcttaagatgagactcttcaaaaaatcgagacgcctttaaacacctattgccttgcctgttcaccatatgtagcattgaactcgcaaagcttacgcactgacgaacatacatgatcttgttcctatccatgtccatatcttaatcaactgtggataagtaaatctggatgcatatactccttaacaactaggaaggagttatgaagaggctcttctattctctatatatcggaaaatttctaccaccttttgaccttatacatacattgacctgtctcaaacaacagaatatttatttaaaactgattccagtcttgttacaatgagtactgaacttggaaaatagctagacacagatttctttttcaaatgccaaattattgcacttgtaaggatctacattggatgcattgttcccttgtggaattagcaaaggaaaaaacaagatggcctatgctggactaaatggtggtaactctgtagcggggtgcctttagggaggtgtgccttatgggccctccctactggactccttggaccgtcctctttcgtggggagaacgtatgaccttactctattgtttggtcccgtacgcacacagtgggggatgcgccttagattacttgcg

SEQ ID NO: 2448 - DNA, 659 bp, Homo sapiens
cctagaagaccagcatatgcccaccctcaaagtaagccattttggcataaggattattttgagctgaagatatttgcgatttaccagatggcagaaagaagcctttcttggagcttcccttaactgactaaaagcagaaacttctgagaaatgtggactaccataaatcccatctcccagggaagttttatggccatgaagaagatgggaaggggaaaacaaggagaagaagaagaaaaaaatgagaaggaaaaaataaagtaaagcagtgacgggaagaggagggagagagaaaagagaacatttcttgtcattttaattttttaaaataatcttcagttaaaaggatgataacttactgttattcagttctgacctgaatataagcccagagttagaagcttgaaaaatccaaacaacaatgtaattttgataaggaccttaaaaagccattgaaaaaaatatgataaattatccccttgcaataatatagctttggtttctggagaattgtttctacagttgattttcgtaatagatgaactcatttggagctatttttctcttcctctctttgctgaaactccagtttaaaagaaaaaactttcagtcaaactcattaaaagtaacacttttgtaaaaaaaaaaaaaaaaaaaaa

SEQ ID NO: 2449 - DNA, 549 bp, Homo sapiens
ctggatatgagagaagaggagagaacaaagtgaaatctgataaaagaaggcagaaaagagcagtgaaggggaacccagccaggcagagatgggcaacatggtgatatttggggaaaacaaggagaagaagaagaaaaaaatgagaaggaaaaaataaagtaaagcagtgacgggaagaggagggagagaggaaagagaacatttcttgtcattttaattttttaaaataatcttcagttaaaaggatgataacttactgttattcagttctgacctgaatataagcccagagttagaagcttgaaaaatccaaacaacaatgtaattttgataaggaccttaaaaagccattgaaaaaaatatgataaattatccccttgcaataatatagctttggtttctggagaattgtttctacagttgattttcgtaatagatgaactcatttggagctatttttctcttcctctctttgctgaaactccagtttaaaagaaaaaactttcagtcaaactcattaaaagtaacacttttgtaaaaaaaaaaaaa

SEQ ID NO: 2450 - DNA, 288 bp, Homo sapiens
ctagttatcgaaattgcctggtttcagtctgatgatatggtgaattatgttgcttgacctccaagtgttgaagaccatccattactaaaatcaatcattttgtcataataagttactctatgcatttactcctagactccctctgttaatgttttcttaagggttttggtacctatatctatgagtgataaaggctgtaaatgtcatttcttctgtcacctttgcttggttttgacattaggctaaggctgacctaataaaatgtgtagtatgtgaaaaaaaaaaaaa

SEQ ID NO: 2451 - DNA, 439 bp, Homo sapiens
gctggtctacacaatcgacacatctgttagtatggcagaaggcccattcaaaaattggaatactgaagtcaaaagatataagtgccaaacataggtgtggttttagagtacatctacacaaatatattgttttccttacttatatggttttcttatttcttcctctagttactatagtatcttatccttaattgttttgacatttgcctcctaaaattttagatctacaatgtttaaaattatgtagtttcagccatatttaaacttaggtttacagagaaataattacatagaaattaaatgaattaataaaataattgtgatttaatatgtaaatgaactctaagctttgttcataatgatgaaaaaatgtatttggtcatatctacaaacatgatgaaataaaatatatgtaacgataaaaaaaaaaaaaaaaaaa

SEQ ID NO: 2452 - DNA, 283 bp, Homo sapiens
cctgaggaactctgctgagttcgttatttcaaacagtgacagacgttaaaggaatcaaaagagtaattcatcaaagtagaatgagtttaccagagtggttttctgttgttcataatcaagaatactgacaagaatactgacatgacagctccttttcactttccttctgtgcatggaagtagcctgagttcttcaccagaagaagatgatggtgctatgcttcttgtacagcctaaagaagtacaagccaaataaacctattttctttataaaaaaaaaaaaa

SEQ ID NO: 2453 - DNA, 315 bp, Homo sapiens
cctaggatgatcacaagctacaggtttagtttaaggcaaggtgctatcattattgcttcattaatcaaggaaagaaattctggactcattggtcagcttctgatagcatgaagaacacaaaaaattacctattttctaaaacatctatttgcgtatcttaattgtgctttatgcccccgctgctgtgtgtggtagaatgtttcagttgtcttttatatcttctctataatttgtaggatgtgatgcttagattataaagcagattaatgtttatatctgtgaaataaagaatacttttgtgtaaaaaaaaaaaaa

SEQ ID NO: 2454 - DNA, 465 bp, Homo sapiens
ccctaggggtactactaaactgtgtctacctctatctctggtcctacacacagcagaatcaagtaacactctctggagtacgtcgatccggagctgctctaatgatcagttgaaaacatgacgaaaagtttatattggcctaaataaaaaaatacttctgaggagactgatccaaaaacgggcccatcaggtacaaaggatatctatcatctccactccatcttttgacattgtgaatactaaggaatctatggcagagtggcagctggaaaaagaacacacgactcattgatcctggaatcaaatcttgacacctggcgattctccatcatgatgatgaacagttaattgacagaataccctagctgatcaacagtgatggagtctgactataaataatgagtatgcgtaataaaggaaaatatcttccaactaaaaaccttaactggcctcgacggccttaga

SEQ ID NO: 2455 - DNA, 752 bp, Homo sapiens
aggaaacctggattagaagcatgtgctgctctcagacctggcctacagagaagaactgacacagacttccttagatgtgttgtcttcctgtcactggtgcattccttatcaatgtgaatccaaaattcttatcaagttatcttcaatctatgcaaggaaaatatttatcccaaaggaggattttcagaagatgacacatgaggggcattcatcacagtcaagtcttttgttttgaaatacggaatctgcatacctactgctttccaagttttgcaaaaaaaaaaataagaaaaaagaaaaatgctctgagaattatctaattcatttttgcataaagaatttccattttctatttttccgttgtctaattcacttgcataaagaattttctttttcatgtttcaattcacatctaacaaatgttatcatactttttcaaatactctttatttcattcactgtaattccaattgacttagttaataatcttacatgtgtaaaccatcctcagcctttaaataaggttcttgttctgggattaaagaaaaattttaatcaatcaattaattactaattgcattgtgcatttagcacctactgcctctgaattttttaactgaaaatatacctactcttatattggtattttagcggttatttttaaagtcggctaatgacaatccaaattatgatgttttaatccggttgttctctaatttaagaacttaaggagaggaatgacttggaacccc

SEQ ID NO: 2456 - DNA, 916 bp, Homo sapiens
  misc_feature (1)...(916): n = A,T,C or G
aagcatcatacaccatctttcactagaaaaaaaagcaagccgtaaaaaagagccaaatacgcaattttaaatgtcctactagccgtatgaagaaataaaaaaagagaaataggggagattaattataatgtgtaatgaagaaagttactctgtggactggcggagatgctaaagacacaaaatgaaaagaagagaagaatatgaagttggtgacccactgaagttgattacatctgaagttactgtcactgaatttttaaattatgtatgatgataaatttccattttgctcaaactccttgatagaggactttatgttacagccaaaagcagtctaattgatacagagagatcaaatatgcactggaattatgtcagaggaagtattgtgtagtgattaagattgtgagtttttgcatcatttggcagtagcttcatgtgtatgactttgtcaattattaaattataaaataaatttggagtggaagtgagggagaggagtagaaggaagaaaaaatatcaattctttcgcatgtagagaagcagaaataatgtgcaaattatcaggagaaattctgaagacatcataagaaaaataacacaaataaaaagtcatcttgaagtgatgatgtaaagaatataaaatcagtgttaaaaattaaaggaaacatatccaaaatattgatatatgtataaaggaaaactcacatttgcaagtttgaaagataaggatttcaaaatatagaacacacttggcaaatgattcagtttatgttttctacaagagacatatctaaaacaaagagaaaagtcaaaagttagaaacatggggagatgcanacagacatgttagatataccaacaacaaccacagctattgccatgacaatatcagctacaaagcaactgggatcac

SEQ ID NO: 2457 - DNA, 271 bp, Homo sapiens
cctaggggagacgactgagacactttgcgaataagagacttgcccaaggtcatacagccaggctggaatgtagaagtggatttttggccacgtggatgaggaattgaagcagtcagttctgatctagagatggaaggcgcctgctgaggacagcagggctgcttggcaccctgggtccctgaatggctctgtggagcactgcctgatggcccaccctggactgttgcctgagacagaaataaacttttatcttgtttcaaaaaaaaaaaaa

SEQ ID NO: 2458 - DNA, 763 bp, Homo sapiens
  misc_feature (1)...(763): n = A,T,C or G
cctaggtactcaacagtctttccaattcattctccaaaccacaatgatggtagtctctttaaaaagatcaccagcaaattcgacggaacctgtacacctttaggatttatcttcccaactagtcctctccagactcacttgctcatcccctctgcaaacactatcacagagacacacccaaaaatagtgctttctcagttttccaggtatttcttaattcagccaagttgacacataaaattaataatcacacattgccttagtatgaaaacttaatcaaaataaaaaattcagttgttcctcagatgcaccagtctcatttcaagtcctcaacagcaacatcagctagtgatcactgtattggacagtacagatcctagaacanaccaccctataggacagcacaggttttagaacaaaccacanaatagacatagtaacatggtattctaagttataaaattttaaaccaagaatcatcttgggttgtttgaacgctatttcacttaaggcatggctaaaacaatagagcttgcaatgtatgtgccctagattcaaagacagacatcctcctccaatgggacgaggatgctcacagtccttttgctaaaggtattaaaagaataatcattttaaaaagtgtgacagtccaatgcggggcagatcctttttcaagtacctcctatgacagtcctaacttaggtctacaaatattttgccaggattattattaaatgatccattaaaatcaaaaaaaaaaaaa

SEQ ID NO: 2459 - DNA, 413 bp, Homo sapiens
cctggtgtgctctgcttaagttcttctgtcctgctgcctacttccactccaccgttgaaagaactaaaaaaaaaatctgaatgaaactgctgataaaaaaaaaatgctagacaagaagtggcaaagatggagaaaagttcagatatcacacaagacggagaaggaaactcaatggagagaatctgaaaataaaatagtcattcagctttatgtttctactttgagttagtattaaaactgagtatatacagatatgatatttgttatagtgaaaatattttggccggccatggtggctcaggcttgtaatcctaacactttgggaggccgaggcaggagtatcacatgagccctaaagttcaagaccagcctgggcaacatagggaaaccttgcttctacaaaaaaaaaaaaa

SEQ ID NO: 2460 - DNA, 156 bp, Homo sapiens
cctaggaaaagaaatgctgagagatactgggattcccaaagaagatgctgcagaagatattttccacattaaagaacatttgatctgttccaccagtagatgaaccattagcagaagcaatcattatcagagccagtaaaaggaaaaaaaaaaaaa

SEQ ID NO: 2461 - DNA, 635 bp, Homo sapiens
ctaggaaaagaaatgctgagagaactgggattcccaaagaagatgctgcagaagatattttccacattaaagaacatttgatctgttccaccagtagatgaaccattagcagaagcaatcattatcagagccagtaaaaggaaataaagaaatgaggcttggtttttaaagtgaccacattgcttctaagtcgaggtgaaagtgctgacagtgaatttatcagaattccaggtggaatcctccagagtcacctttcaatcataactgtcatcctcagagaaaaagcttttgttgaagaaaaatttgtacaaacattgaataatcacattgatatggtaacaatttaacaatacattcaataagaatgaatgttacagtgggtcactttttccctgctttttatcaaacctttgtattttcctcagattttacaagtaataaatcctcattgtagaacatttgagaaagatataaataagaaaataaaagcagtgcataagactttctctgagcaatggccactattaatatgctgattcatttcataaatgtatatatttataatcacacactcatttgtgctttagttatatagttgaaatttatatttgaatgtaatgtcaaaaaaaaaaaaa

SEQ ID NO: 2462 - DNA, 355 bp, Homo sapiens
cttcagcggagcaaaatatgtggaatgcaaatttgaagatcctattggaacaatgcaacatttggaaatcttctccaataaaatctcctcttatctctacaatcagaataaatccttcagcgttgggaagacaaaatcacttctcatctgtgcctaagcatggaagtgctcttaaagcacttttacccttctctcttttctagtttttatcatggttctcctagtattccaggctggaaactgttaattatatttaacttttcagcctcctctgtctccattatataatgaattaccaagttcaataaatttttcttgctcaaaaaaaaaaaaaaaaatggcctcgttggcctca

SEQ ID NO: 2463 - DNA, 409 bp, Homo sapiens
ccccacgtgatgactaactaggtaaaaaggccaacaaaaaagaagctagggtctcactctgtcacccattctagagtgcagtggcatgatctcggctcactgcaacctccacctcccggattcaagtgattctcctgcctcagtttcctgagtagttgggactacagttgcagaccattgaggcttagaccgctgaatcacattcatcgtactgacgccctgctttaagatcttctgtgcctccctactgtcttcaaacggaagttcaagttcctgagcatcccacaaacaaggcaattcatgaacagccccattgctaatgtcctctctcaccagccttctgacaccacacagaggccctcaaattcaaatgtactaaattatgagcatttctccaaaaaaaaaaaaa

SEQ ID NO: 2464 - DNA, 237 bp, Homo sapiens
ctaggagcctcgacaagcctggatttgcccactggaggatgagaagacgcttgaagcagagtccagaacacagagaagagtccaattaagatcagcaaagctgcctaaccaacccacacctacctacccatagagaaatggatgagctctaccaagcccagttcaccccagtggaaatgactacccatctgcatatgcaaagctgaataaatgcttatcacttgaaaaaaaaaaaaa

SEQ ID NO: 2465 - DNA, 167 bp, Homo sapiens
cctaggcgtacacttggaaatattgtaggttcagttccagaccactacaataaaccttctgccatgggatgatgcatcaagaagacccttaccagatgccagtcttggacttcccagcctctgttactgtgacaaataaatttttgtttattagaaaaaaaaaaaaa

SEQ ID NO: 2466 - DNA, 225 bp, Homo sapiens
cactgggaaatgacctactgctactgtaattcacttgggatgtctgtatatgtgttataataatatgtttttttcactctccaaatatttataagagtttcaggggagttcagaatggcaaaatcaccatcttaaactagaaacattttatgttgaaagagggcttaaaatatgtgatacttttcaacataaattatattaattatattaaaaaaaaaaaaaaaa

SEQ ID NO: 2467 - DNA, 353 bp, Homo sapiens
ataaccttgggaattcccagagtgacaggaaagtctttgttattcacggtgggctacttggatgacaggccatagagaatgacgacaaatacatggaagcagaaccatcccagccatcagaacttgaagcagacagcaaggctgcccactgcccactgatttcagccaagatcagctggtactcacctgacttaaagatgcttgaagtgactgtcctcattctgtgttttgagagagtctattgcacaacaattgctgattggcatagatcctgaacacttaaaaacaggttgctgatttcagattcacttaacatttctgaaataaaaaattgtatgtcaaaaaaaaaaaaa

SEQ ID NO: 2468 - DNA, 281 bp, Homo sapiens
cctacgggatcgcctgggcttttttctcagctgtgttccttatttgctgcctcattctctcacatgtaaaatgaagataagctaaatagccatctccttggttaaaacagtgctaagcgcatcataaagacatgtgtgtacacaacatgaaggtggccatctgcaagccaaaaagagagcctttaccagaacctgaccattgctggcaccccaatcctggatgatccagcctctagaactatgagaaataaatttctgctgttcaagcaaaaaaaaaaaaa

SEQ ID NO: 2469 - DNA, 283 bp, Homo sapiens
  misc_feature (1)...(283): n = A,T,C or G
cacgcctttcctgactttaacggatcaactggcacagctggcaccacccagatggataaactggcgtcacctgatcttgtggcccccacccaggaactgactcagcacacgaggacagcttcagttccctgtggcttcatctctgacctgaccagtcagcacccctggctcactggcttctccccacccaccaagttgtccttaaaaacccctancccggaatgctcggggacactgattcgagtaataatagaactccggtattccgcgaaaaaaaaaaaaa

SEQ ID NO: 2470 - DNA, 411 bp, Homo sapiens
cctaggtccagcgcactccctgccctctgactttaggctgggccacgtgacttactttggccaatggaatatttgtgactaagatgcaatgcaaggcttgaaaaacatttatgtgattgggctttgcactcctgcacttttgtcaactctagctggcaacacgatgagaagatcccaggaagggtgtaagaggctcagggagcagagcccgctccacctcattacgtaccaataccacctcagccacgctgaaaactcacgagcaagaaggaagtgcttatttctatctgccttatttttgtagttgttacgcagcaatattatggcaagagttaacagatatacaacttaaatttcaaaaaatagggaatttaataaattgcaacacatcacatagtaaaaaaaaaaaaa

SEQ ID NO: 2471 - DNA, 416 bp, Homo sapiens
ccgtttctcatgtttaaacggctccacccaatcctagaggaacaccagacccacatgagacctctatcagcagaactgctggtgaaaatgtgaggaatgtctctgtccttccctgactcatcagacctcaggatgaccttccttcctgacacagccctcctgcgcaagtaactcaccatcttcctgtgcccagctatcaccagacacctgcaggtgagctcactgcaagcttggcgtcgtggtgctgcgcacagccctcttcagcacacagtgtcagcaccgtcctataaaatctccagccggcctttgtttctttgcagtcggcatcgctcatgcaggctgccctgtctccttgcaacctatttttctactttctccaataaatcagcctttttctgcctacaaaaaaaaaaaaa

SEQ ID NO: 2472 - DNA, 115 bp, Homo sapiens
cctgagcccaacgaagtcactgaaagtctagatatagcaaaatggtagctcaacaccagatgcaattatttaataataaactctaaatttgtttgcccccttaaaaaaaaaaaaa

SEQ ID NO: 2473 - DNA, 371 bp, Homo sapiens
ccttactctgcagaagatggactggtagacagaaagaaggcagagagaccaggtcagaaataactgtaagaaatgatgagacctggaccaaggcacagccaaaggttgagaaggaatgactgggaaaaccatctaggaagtaaaactgatagtaccacatgactgcttagatatgggggaatgaaacaaaaagggtgacttagaacagcttccagatgtctgacactccaccaggaaaatgcactattcgacaacatgaagaatatgaacaagtatcttctatgaaactgtttattaaaaatacattcacatgtatatgcaataaaaactctggaccagttatgtagatacatgttggaaaaaaaaaaaaa

SEQ ID NO: 2474 - DNA, 350 bp, Homo sapiens
agatgtctggctgttcgcctctagtagcaatggtataagaacagagaacgccttgagtgggaaacctgttcatttgcttatccagaagaggacactcattagaaccaaccatgctggcaccctcatcttggacttttaggatctagaactgtgagaaaatattagtaagtgtctgttgtttaagccactcagtcaatggtattttgttatggcatccctagaagaccaatacagtggataaataccctaacaccctcagcattcagctgggacaattttgaggcatgctcaatacattttgcagcatttcctggtggaattctccagttgctcagagaaaaaaaaaaaaa

SEQ ID NO: 2475 - DNA, 362 bp, Homo sapiens
ctaggtttcactcaagaaagccttccactgctttaaaaacaaaacaaaaggcatcggaaaaccacctgctatgaatgaagctagagagggaatgtccttcttgtaaagaaggacaccatcaactgggccagtcccctttatttcactcgctgagatttcaagggcaactgaagagatccactgaactccatggagagccaatcttcactctcctctgtggtgaatctgagattggttgttgttgttcttaatcccagatgtaatagtataaatctaagatttttaactggcacaagtggtttctttcccagttagagatttaaagatcagaaaataaatatgttgactgaaaaaaaaaaaaa

SEQ ID NO: 2476 - DNA, 436 bp, Homo sapiens
ttcaggttgatcccaggagaaaacattctactcctcaacatgggtcttgcctgattcatttaccaactatgacaagctcgtggcacagaggaaaatggacataaggtagcggtaacaggctggcgactgtggcttttacacattgcttcacacaaccctgtccaggagttttacacactcactaaacaaacagaagacaccatccaattcactggagccccgttggataaatacggaaagaatgtgggagctatgtcatgaaccacaatggttttgtgttctgtgtaatttgaagacgagattcctttgctgtgtgtcacctcccatattaccactgtcgcccaacatttcataaccatcaactctttgccagtgcccacatgcaaagatgggtttgtattaaaaaataaatgagaacagcacaaaaaaaaaaaaa

SEQ ID NO: 2477 - DNA, 793 bp, Homo sapiens
  misc_feature (1)...(793): n = A,T,C or G
cttagatctgatcagaacctgaattctcctaattttcttcaatatttggctgcaactctccaactaagagcaaaaactgccctgtgcttgccgccttagaagatgaagctagacaacttgatataaatttcaagagacaagtctcatacccgaaaaaagaaggacaagtcttgtgccacacagaaagttcaccaatccacctgataccatagcagagaattcaaactgcaagccaagagaagttgatggcttcatgctataggcagcgtttcccaagacactccatcaaaatgagactcttgcccctcttaatttttcctttcttatgcttacctttttctttggcaagataatgatgtaattcagatttcacaatcagcagcttctgctcataacttaaaagaacatgacctcttaggtatctattgtttaaataaaaaaaagtctacgcttccactaatactacatgttatacttgggtaaattcctctggggaagttgaggcccatatccacagaattttttaaatgggtcacacagtaacaacagatgtcatctaattctcaatggtcatttgctttattcaattgtttgtctttaagactggattcatggctcanaaccattatacaaacttggatttaccatattactattaattttattttatatttttgtttttaaaacttgtacctgttgcttgttaaattctgcagaagtacaactcctaacagaataatgctggcccagtgctttgagattgtggccaaaatactaatggataagacaaact

SEQ ID NO: 2478 - DNA, 253 bp, Homo sapiens
ctaggaaccccaggcttcactgggaagcagagcagcaaagaaggagagaagagaagaagcagcttaacatcagtgagaagcagcttgacttcagagggacggcttgatggcggaatctcagagagagttcagctggggacggccagactccaggagaagatcacattcccactccattccctttccagctctccatcccactgacagccactttcatcagcaataaaatctcctgaatttaccatcttcaaaa

SEQ ID NO: 2479 - DNA, 367 bp, Homo sapiens
ctagcctcatgcggagcaagagaggtcgtaaacaagtcaaccaccaaaaagaaggcaaaggaagcaaagcaggatgcaccaagcaactccgacgtgtcaggtgccatgccaggtgcattgtgcaggtcccctcactggcttcttgcttgagccctaccgagttcattcctgctttgccaccttctagctggatgaccttgacaagcaagtcgcctcgactctgagcttttatatccttggctacaaaatggaactctattggctactattgttatgagcattccatgagctagtgtatgtaaagcacccacctggcacatagtagacataaaataaaatctggctgttataaagaaaaaaaaaaaaa

SEQ ID NO: 2480 - DNA, 165 bp, Homo sapiens
ctaggcataccttggaaatattgtaggttcagttccagaccactacaataaaccttctgccatgggatgatgcatcaagaagacccttaccagatgccagtcttggacttcccagcctctgttactgtgacaaataaatttttgtttattagaaaaaaaaaaaaa

SEQ ID NO: 2481 - DNA, 232 bp, Homo sapiens
cctagtgagaacagccaaaagagatcaagacataaatttgcgatccagaagaaaacacatgggaaacacacagagaagggagaaagaaaatagaaggaaagtcaagttcaccaagcattaacagaaaataagaccacaaatgaggcaagactcgaataaagaaggtggctcacaaaaaattcttcttacatgtaataaaagcttctaacttcatggctcaaaaaaaaaaaaa

SEQ ID NO: 2482 - DNA, 358 bp, Homo sapiens
ccctaggactatcgatgaaaatgcaaatcaaccaacactgagtatttacaatcaagacgttgactctggtaggagctgcaattgatagaaagatgtataaaataggaattattaccaacgaagaggagaatatggcccaatacccataatgtctatacccggaacagagaaaattctgctcctgccctccccactttgagtctcatacaagttgaactgttttgcaatgaaaacaaaagagcaattgagaattcatctgtatcaagagaatataagctctcagatgagcttttgaaaatacttcactttatgaattaattaattaattaaaaacttcaaacaaaaaaaaaaaaaaaaa

SEQ ID NO: 2483 - DNA, 312 bp, Homo sapiens
cagccatgaaacctgggaaggtgactctctgaccttctccctcccctctctcctgaagagcctcctgggagagcatcctggcttgtcctacatctgggaggaaagcacgtgacatgaggacaccaagaggaatgtgaacagcctcccctgtctatttccattagaccattccctttgtcctccagtccaattttgcacaaccgtccaaaaaatacagactccctgtttatttgcatcatttctgaaggctcgtgtgtcatgtaaaatttatattaaataaatttctatgtttttctgttaaaaaaaaaaaaa

SEQ ID NO: 2484 - DNA, 180 bp, Homo sapiens
ctagtttacattcaggttggtggagaggaaagaagattgaagagtaatcctccagcaattattagccatgataaggccatatcttgcaggaagacaatgaagaccagaaagtgagatcctaagctgatgattccatgtagtaatgagtcaaattaaatgatgaaaataaaaaaaaaaaaa

SEQ ID NO: 2485 - DNA, 298 bp, Homo sapiens
cttgaataaccttgaatgtcaccagtacatcagtcatctgcaggctgagtggagggctggtcttcactgcttgattcataccctgtgatagagatggccaagtttgccagagtagaagctgccatggagataacctgccctggtaactctgcccctgtaaaagaagcatccattttcaaaactctttaaagtaggaaataatggctgcaaatttaaacacagtccaacattttcaacaacaacaaaataaaatggttactactgaaaaaaaaaaaaaaaaatggcctcgttggcctca

SEQ ID NO: 2486 - DNA, 198 bp, Homo sapiens
tagaatcctgtagactggccactctgccaactccctgcaggaggcctccagggagcaccagacctgctgctccctcaagttccctgggatttttactaagaatcacttgtgtctggtctcaaatatgtttatgacatttgtatttgttattgtaattttgtattttaattaaatattatgtaatcaaaaaaaaaaaaa

SEQ ID NO: 2487 - DNA, 295 bp, Homo sapiens
ttagttccacattagatggatattcaacataatcatatggaaggataagcaacaacacaagggagaagagaatcacttggatttgccaactgttcaacagcacggcctggttttatctgcagatgtcacccatcccacctcccactgttggaaaccagtgggaacagagagacttcctaagagaagtgcctttggataatgtcatagaatcttgaatctaagaatcttaaataatccagattaaaagcaacattaaatattaaaaaaaagaaaaaaaatgtcctcgttggcctca

SEQ ID NO: 2488 - DNA, 522 bp, Homo sapiens
cagagatggggtttcgcctgttgtccagctggcctcgaattcttgggctcaaaccatctgcccacactggcctcccaaggtgctggggagaggggatgagatggccaggcttcccaaagccaggaagccagagtgtctggaagatcatgtggcctctgtgaagcccctgcatcgtccgtgtaccaggaggagaagcagaggaatgtacaggcaaaccctgccctcgacagaggtgccgggctggaagggaaagagcatgttgccactgggtcaggacttctgtttccagctttgaagagttcctggcaaacgctttgtgaagtcattaatcttcggggcaaatctaaatgtcttgcacagctggatgcggtggctcacgcctgtaatcccagccctttgggaggcagaggcaggcggatcacttcagtctaggagtttgcaaccagcctgggcaacatagtgagaccctgtctctataaaaatgaataataaaaaaagaaatctgaaataaaaaaaaaaaaa

SEQ ID NO: 2489 - DNA, 200 bp, Homo sapiens
cctcacacttgacaaaggagatcaaaatgaaaatggagcatttattttttcccccaatgaaaaatggaaacaccagcatccaagaagccactggatatatatgctttgcaagtaaagtcgtatcctagattctttttaaattagttttggaaatttgaaaattttaaataaaaaagtacaaacacttaaaaaaaaaaaaa

SEQ ID NO: 2490 - DNA, 251 bp, Homo sapiens
cctgccggggactttaggatccagttgctgctagcatattctatgctgaataaccatgaggatagacacagcccagtactcaattcttcaaggtatacatattggacactttcttctacagtacctgtaagtttatttttgtctacaaactataattttgtgttttgattttgtcatctcagtttttcatgtatgtgtatgcatgcatgcaaaataaaaagaaatagatgatgcatgcaaaaaaaaaaaaa

SEQ ID NO: 2491 - DNA, 643 bp, Homo sapiens
acggatccccctacttggaaggaacatcttttaagaaagggaaaatacagagtttgacattataagagcaaaaacaggtgaggtgcagtagttcacgcttgtaattctagcactttgagagcctgagcataggaattcgagaccagcctgggcaacatgatgagaccctgactctacaaaaagtttaaaaatcagcaatgtggtggcatatccttgtgatcccagctcctcaggaggctgaggtgggtggattgctttaggctgggaggtagaggctgcagtgagccgtgattgcaccacagcacccctgcctgggcaatagagtgagaccctgtcaaaagaaagagagagagagagaacgaagataattttaattcatatagacagaaatactctctcacacacatacttccagttttatatttctcacataatagaacctccaaagccaggttaggtatcgggaatgcttgatttagtggtttgatggttttaaacacaaagttccttgcatttcccctgtctattgtcctaagttactcatttttgccatgagccttactcttctcaagccttccacgatggttgacagagaacttgtctggatacaactgtatctagaggaaaaaaaaaaaaaaaaaaa

SEQ ID NO: 2492 - DNA, 667 bp, Homo sapiens
gttggggacgctttaggatccagtagataaactcttcaagagaagaaccaagtcttaacactgctttctacattcagaattctttataaagcaaattataaacaaactgtgctttaaactacgctactgaggaaggctattaaccattttcatgctcacccctcataactgggaggaggaaagcctccaataatgggctgctgctttagtgaaagcatcaggaattagctcagtaagtcaagtttcactttgtgtgaacatctccatctaaagacttttgacacacattcagtctgtttataaaatgcatacatacaacttattatttgatgaccaaaattttcacagatcttctagttctaaactatcaagtttaaactatcaagctatcaagatggccctgggaaaaggcagctttcagtgatgtattttgagaggacactggtagggctcaatcacaaactgtcactgctcagcctctgtgacatgttaactaaatgacaacgtggaggtgctctgcattgtcctgaaagctaccttagaaagacctataaagtgcagcaagtcccacctgctcacgaagctgaagcaggatgatcacttgaggccaggaattggagaccagcctgaccaacatggcaagtccccgtctttaaaaaaaaaaaaa

SEQ ID NO: 2493 - DNA, 574 bp, Homo sapiens
atcccggatcctgatattattgaagattgaagaaatcccagacttccaggctgagaaaatgaaaatgaatgagaccccctgattgatatggaagaatcaaattgtaagagtcagaggaaaaagaaccatgtatctcaaagggacatgattggttgctctggaaattgtgtaactctaccatgacagagctcgcagcataagttggaggcataaatccccatgaagaaaggatttttacagttgtgaaaatgagtaagtgcatcaaacatagtccacactcaataaatatttattagaataaactgaatgaaaagcagtggataaaaaataaacaaaagcagggagctaaggaaagagccttagaagatcccctcagctgtcaaccagaaacctacaagtaatatgaaaagtggaaggaggcaaaaaagtcacgtacagtgttaagaaaagccagttaggtaatatttaaaagacatgatcattactgtcaatgaaaagaactattataaggaaattgagttatgcctggttgtggaaaaaaatcttttaaatgttctctggaaaaaaaaaaaaa

SEQ ID NO: 2494 - DNA, 252 bp, Homo sapiens
cagaaggatccagctccagaatttcctatgttctcttctcattttctttcttttatttgttttactgtttgccacctattttttctctatcctgctgaaaacctctacttgttctcttctctactcttcctcttccacatcctgatacctaatatgaattttcatacttaaaactgctacactttttaaacaattttgtattgccagtgtttacatataaaaatcgcattttgtcttgtaaaaaaaaaaaaa

SEQ ID NO: 2495 - DNA, 448 bp, Homo sapiens
ttcaagctttaccattttctccatttttattaaaagatgagatgagatccagaattttccgaagcgcttccctgaaaagaaattgatttctactagaaaatattgtctcttcaactctaaaggatatagtgtctgatattttaaacgccacatgtggattttcccctccctcccttctgcattataactggtatacatttattctgtggcaaaatgctgtatttaataggaatgtctaagatgcctacgtgattgttccaataagcttaattgaacaaaagaaagctttactgtgaactcttcttgttaaagcaactgattgtggaataaaacataatgctatactcttccattctcaatcaaaaaggcagctccctaaaagcagcactggaaactcaccaagaaaaaaataaaattgtttaaatagtaaaaaaaaaaaaaaaaaaaa

SEQ ID NO: 2496 - DNA, 610 bp, Homo sapiens
atcctttgcccattttttaattgggtttgtttttgttcttgttgagttgtaagagtttttgtatattctagagactagacccttatcatatgtatgacttgcaaatattttctcccattctgtagtttgtcatttcactttcttgataatatcctttgatacacaaatgtcttaattttgataaaggccaatttatctattttttcttttgtcatttagacttttgctgtcatatctaaaaattcttttgtcaagtccaaaatcatgaagattaactcttaggttttattctgaaaggtttatgggtttagtacttatatttatgttgttgatcccatttgagtaaacttttatatatggcatgagacaggggtccaatttcactcttttgcacatggaaatcacagtggtgccagtctcaactgttgaaaagactattccttccccattgactgtaattggcactcatcaaaaattaattggcatagatgtatgggtttatttctagactcttaattctatttcgtttgtctatatgcctatatttatgccagcaccacactgttttgattactatagctttgtaataaattttaaattgggaatgtga

SEQ ID NO: 2497 - DNA, 787 bp, Homo sapiens
cccggggatccagattatatcaggatttaaaactgaagccaaacttgttggactggaaccagtcagcacctactctatccgtgtatctgcgttcaccaaagttggaaatggcaatcaatttagtaatgtagtaaaattcacaacccaagaatcaggttagatacagtttttgagcctaaaatgtttctttttatatttaacacctttcttttccttttcttagtttatatgataaagtatcattacttaagagtctactcaaagggaaattgcatttcagtgctttacgtttagtcttggtcttgtgtgaaatcatatgctgtatgtgtgtttatacatatattttcacacatggtttttccttttgaacagaggaagttgaaataaaatagtagtttgggaacaaaatagccttctagatatctgtgaaaattacctaattcttagaactctttgagacagctggggaaaaagggggaaatgaactagcagtcacttttaacgggctgatttatatttttaatgaaacaatatctataattttcttttaagaagattagttgtgacatttggagagcatgagtcattgcataagccccctatgttcccatcatcccatctttaccatgtggcggaaacttgaatatcattggtcttattcatcaacagcttacctgctgtgtcacacatgtagtatacatgacatatccttgcctttgggtgcacactgaatagtttttatttaggacctatttaatgatggcttaaaaatgtactttccctcttc

SEQ ID NO: 2498 - DNA, 177 bp, Homo sapiens
ctcgagagaaaatcatgtgaagaattgcaaaatggaaaagaaaagtcaccttcaactctctcctctgtgaagaaactgtgagtccagggaaattttttgtatgcaacactgtgctggcctggggaggagaaaaagcatcaaattaaaactgttcttttatcctgaaaaaaaaaaaaa

SEQ ID NO: 2499 - DNA, 770 bp, Homo sapiens
gtaaacttggaagcaaccatgatgccgatatccttcagcaagtgaacaaataaattaactgtggtacgtcctgacaatggaatattattcagcactaaaaagagatgtgctatcaagccatgaaaagccatggaggaaacttaaatgcatattactaagtgatagaagccaatctgaagaggttacatactctgtattccaagtatatgacatctggaaatgacaaaactatggacaccataaaaagatcagtggttaccaggggttggggattgggggatggatacctggagcacagaggatttttaaggcagtgaaactagtctatatgacactataaaaatggatatgtgtcattatacatttgtcaaagctcataggatgtacaacagcaatagcaaactctaatgtaaactggggactttgagtgattatgatagggcaacataggttcatcgggctgttaacaaatggacccctttgatggaactataaaaatgtgacaacttgaattctgcttaatggacttcctttccttgctaaagcccttctgtcttgcttgctttctacctttcttgtttttcgggttgggtcttgcatactaaagacaactctttgcgaagttgtactacatgaaaaatccccaggattgggaactgagggattagaaattatttggatggttcttatttgactttatggcaatttttgaaaacccttaaaaggaactctcctttggaggggccgtatttctagaaatacttcattgg

SEQ ID NO: 2500 - DNA, 727 bp, Homo sapiens
tttttttttttttttttttatgaaatctatgaaagtttatttttctcaagtgattgtgtcatgaagtacttgtcaaggaggaactgagctcaaataaacaataataataataacaaacatttatatggcttttattatgtaacaaggacttttgtaagtgctttatgtatattaactcatttaatcctggcaaaaatcccatgaggcatagttcctatttttatctccattttacagataaggaaaacgaaacttgcccaaaagttaaatagcttctctccagaacagaaaatgaaaaactgtgagaaattaggactcagacttttagaaagaccttccatgtaattggatgaatgatttgtctttctatgcctatttcagctgtagaaaattatgatgtcttctataaaaatcacatttatgaaatatgcaacatgtttgctaagcaacaaaaaggaaatatgtaatatttccactccctttaaagccttgcagtattggagatcactgttcttcaatgatggcatgatgtgggacttctaagaaagttttgcaaagtcttctcatcaaaactctcttgtggtaaaatatcaaatccaaaagtaggtctagtttgagtgagaataagttgtatacttttcttaaaaatttgacccttgtctagtctatgactatgttcattgacaacaaattaagttcctctggagccttttattatttatttaat

SEQ ID NO: 2501 - DNA, 446 bp, Homo sapiens
cagggatgagctttgctttaggtgtgagtcagcctattgccatgcctcttaagacatctgcttacatcattttcactgaagctcctctgtccaaagcaaaagcaagacaccttacctaaccaagtccaaggtcaatgaagcatggaattatactctgcctgaaccttgaagaagaagggaatgaatatttgctgaataggagtttaatccttcacagtgctgaagctcagagtggagaacattttcaacagcataactcagaagagttgtcttttatctgaaacttgttctaactataatgaagatgcctgagaaatcccaaattgttttttttttttcattgctcttcccaaaatatccttctttaatttttaatgagatcaaaaagcgttttgcattattaaccaataaaatccaagagtgtttttaaggcaaaaaaaaaaaaa

SEQ ID NO: 2502 - DNA, 826 bp, Homo sapiens
tatgccttgcctcacactctactgaagactctctaggacaaagacttataactcttagtgccttcagcatctatccagtgttctacacataatttcaattatgatcaatgtgattcttgccaagaacctagtctcttgtgcctcactttccttcctcctatgtaaaagaggaataacagttacactttaaagggttgttgtgaagattaaatcacataatgcaggtgaaatgcctggtacccagtccacctcatgcactgtgctaattgattctacacggcctttaattatgaaacaaaataacatttccacactctataaatttttaaagaagctgctgacataaacatgtttgctgcataagccaaaacttattaccttgaggctgtggagtaagaaagtcacactccagtcaagcgagaccacaaacccaccagaaggaagaaactccggacacatctgaacatctgaaggaacaaactccggacaccccatcttttaaaaactggaacactcaccattgaaggggcccgcaccttccatcctttgaagtccggcaaagaccaacgaaccccccgtggaagggaacccctttcccaaacaccttttcggcaccccaccaaggggactacccccccagcagagcgaaggccccaaagccacaaaaaggctttacaaatggcacccccccatgaacctccaccaaccaccttctaccgtgagacccccgcgaccgccccctcggccctttaaccgcttcaaaaagtttccctttagaagacacttacaccggagggcccctttttctgcccacatcaatagaaga

SEQ ID NO: 2503 - DNA, 433 bp, Homo sapiens
ctagttctggaggctgggaagtctcaaaaccgagctgccagcattttgtggtcaagtgagagccgtcttattttgttcaacagcaggaacaaatgttgtatcctcacatattgaacatggaagagcaagagagctaaatatggagttaaacttcttttataagggtctcaatcacatttgcaagggggcagttcacatggcctaatcatgtcttaaagccttcacctcttaatattatcacattggcagcacctgaatttcgaagggggacatattcaaaccatagcacatacctagagatgtatacgattgctgatactagtaggtaactataaaaagatgtgactatgaaatttaaaaatatgtgactagatataactttataaaagatgtgactattaaaaaaaaaaaaaaaatggcctcgttggcctca

SEQ ID NO: 2504 - DNA, 172 bp, Homo sapiens
tctggtgaaactgtgaacagtgcttctgtggagtacttcaagaatgtataacactgaaggaagaaagaagatatgcttcagctgtaattatattcaatattgttatggaaagttttttctccttaaatgtaaatgatcaagaataaagttaatctatggaaaaaaaaaaaaa

SEQ ID NO: 2505 - DNA, 157 bp, Homo sapiens
gcctctgttgagttgttcaagaatgtataacactgaaggaagaaagaagatatgcttcagctgtaattatattcaatattgttatggaaagttttttctccttaaatgtaaatgatcaagaataaagttaatctatggacaatgaaaaaaaaaaaaa

SEQ ID NO: 2506 - DNA, 770 bp, Homo sapiens
aaaatagtttgcctgtggagtccaagagaggagcatatctatcgaaatggtaattgaaagataaactggaaacatcacctgtatgaaaaatagtggatggctctgttaacgaaacaggcatgctggtgacaacaggcaacaaatctaatctaatctaatctaatctaatctaatctaatctaatctgtttctccataatgagcagcaatcatacaacccactaaatgactgctgttgcttgtcactgaagatgtccatattttactgggacataacatttcttcttggcatgaagagaatggattaagcaaatgaataaaagctatggttctactttaccagcacaaatggacaaatccaaaataaataactgttacagcaactatgctaaccgtattaattaaaatatgcaaggtatactcattctcattttcataaaaggaaatcctaaacgctcaatttaaagtatgtttcctcactatttgtaggaacttctagtcctagaattcttggtccacctttccccaagattgtattcatttgttaaatatgagacaccaccaaaattgtaatgatgccacaatgggagagttaatgaagcaaaaaaatattaaatgagtcaactattattaaagaagaggccacttcctattccataattagaaatcaaagagtctggctggctatttatcatcaaaaaccttttattggtataaaaaagtccacacataagcagctgtttaaataaccactcaggccatagtttactc

SEQ ID NO: 2507 - DNA, 576 bp, Homo sapiens
tgataacgaattgccttgtagtctgactggcaatctctggacctggatgacacagctttattctttgttgaataagagacaggggagactatgtaaacaaaaaaaattatttgccgtggagtccaagagaggagcatatctatcgaaatggtaattgaaagagaaactggaaacatcacctgtatgaaaaatagtggatggctctgttaacgaaacaggcatgctggtgacaacaggcaacaaatctaatctaatctaatctaatctaatctaatctaatctaatctaatctgtttctccataataagcagcaatcatacaacccactaaatgactgctgttgcttgtcactgaagatgtccatattttactgggacataacatttcttcttggcatgaagagaatggattaagcaaatgaataaaagctatggttctactttaccagcacaaatggacaaatccaaaataaataactgttacagcaactatgctaaccgtattaattaaaatatgcaaggtatactcattctcattttcataaaaggaaatcctaaacgctcaaaaaaaaaaaaa

SEQ ID NO: 2508 - DNA, 436 bp, Homo sapiens
aacttctcacttactttgttgcccaacctggagtacagtggtgattcacaggagtgatcacagcacactgcaacttcaaacttctggcctcaagcagtcttccctcctcagtctccaaaatagttgggactgcaggtgtgaaccatgcttggctcccgatgttaatttcttagttttgataagtgtactaagattatataagatgtcagcattagaagaatttgggtgaagcgcttatgggaactctgtactatctttacaacacttctgtaaatctaaagttatttcaaaataaaatttaaaaacaataaacaaaaaaatcaactttaagcccaaagcctaaaatttcttgggctctgcttttgtggctcatcttgaatgggaaagaaatgctcatttaatattaaaaacctgcagtagaccaaaaaaaaaaaaa

SEQ ID NO: 2509 - DNA, 459 bp, Homo sapiens
ttgtggtgtaacgtcaaccatatcttaaagggacccacgttctggtaattggaaaatggcatatgaagaccacaacctgaccactaaaggtgctgaagctgacctgacccttgtttctgttcctatagagtggataaactatgaaatatgcgtttttaaaaactttaaatacattttttctcctggtgtttgaagaaaacaaagtgaattattttgattaagaattttttttattattattattcgaaatcgcgtaaatgttaaaaaacactaggtgtatttgttatggaaagataaaaactgtaaacaagaaaataatttgtctctttactgataaaactttcagggtgtattaagatggtaaatacattataaactaacattgccttattaaaatagtaatacagtaaatgatgaaaaattaaagctgtggaaagttttacactaaaaaaaaaaaaa

SEQ ID NO: 2510 - DNA, 452 bp, Homo sapiens
atttgttgctgttctccttcccaacatcatctcagatgaagattatccttcattatttatttttgaaaccgtctaaagaaactcatgaataacctgatgaaaatgatgatttgattaataatctcatgcagaagatatttgcatagaaatcacaaagctacttcttacacccgtgtatcttcaattttctacttatccactggctgaaaacaaaatgacagtgctgtctgtcacatatgcagtccttttcttcttgcctggtaataatctagaaagatgatggcatttgacttttaaaaggaaaaaggcccaatctgagcattgtgctatattttctttgtgaagaatttgatgtaatatcctccctcatctgcggctctctgtgactctgtgctctttataaatcagtgtttgaaaataaaacacacagtctagaatgaaaaaaaaaaaaa

SEQ ID NO: 2511 - DNA, 605 bp, Homo sapiens
taggaagctttcccttctcctgaatgccatggtatagctgaaatcgatagtgctttctgaaagatttggtggaactcacatgtgggagtgcccacagaagagatgccagaaggtgcagaaaccatcttacaaatgaggatgaaagacacattctacagacagtagtgctggaagacaaggcgaggttcctgaagatattatggagctgttgcacgagcactggaccacctacatgcagatttctgttatgagataaatatacctcttatttgttaacaatccactagtgaggttttattagttgaaactgaatgaaatcctaaatgataaaattgttaataactaaggccacacgatttaatttattatccaaaccaggacaatgggaataaatggatggcatgtagcaggtataaactaggatgataggttactctagtagtaactaactagaaaacatatgagaactaaaaaataaagatcctctctaatagctatatgtaaaaataagtaaaataataaatttaaccaccacaaaatgttcaagaactttatggaaaaaaaaataaaacttgctaaagggcataaaaggaaaaaaaaaaaaa

SEQ ID NO: 2512 - DNA, 752 bp, Homo sapiens
  misc_feature (1)...(752): n = A,T,C or G
tcttaggcttgacgggcaaaggtttttagaatcactgatgcaactaatgaagcaaaggacaatgtgaaatacttgtatacacttgaaaaatgttgtgaccctttgtacagcagtgatcccctatccatgatggatgctattcctacacttataaatgcaattaaaatgatctatagtatctctcattactataatacctctgagaagatcacatctctgtttgtaaaggtgacaaatcagattatatctgcatgtaaagcctatattaccaataatggaaccgcttccatctggaaccagccacaggatgttgttgaagaaaaaatactatctgcgattaaactgaaacaggaataccagctctgctttcacaagacaaaacaaaagcttaaacaaaatccaaatgcaaaacaatttgattttagcgagatgtatatttttggaaaattcgaaacttttcaccgacgccttgccaagataatagacatgtttacaaccctcaagacgtattcagtcctgcaagattccacaattgaagggctggaagacatggccactaaataccagtgcattgtggcaaccataaagaaaaaggaatactattgactagaccagcggaaaatgcatttcgaccaagantaccaagagttttgcaggcatactaatgagcttgtggaggttggatacaaagatcctgctgaaaacaaagaaaaatgtcctaaaaatcttagccgtggaaattgaggcccttt

SEQ ID NO: 2513 - DNA, 189 bp, Homo sapiens
cctagtgaaatagctctggaaaagtttcacattaggttctttaagattactggcacatttctttcttgaattagattctgcgtgaaaggatcacaaagaaagatttaacttggcagtggagaagatttccatcctgaagtgcaagattaaaataattaaaacagcccattaaacctaaaaaaaaaaaaa

SEQ ID NO: 2514 - DNA, 230 bp, Homo sapiens
ctaggaggaaatagctaatgcaacaagccttcctctcacaaaaggaagccatttacataactctgagcttctgaaggaagacacaaagtgagatgaatgaatttaaaatttcctcaacttgctgtcaagaaaggagctggaagcaaagccaaggatctcagttttcattcctgtttatacttctggcttattaaaacatccatgagcaacccaaaagaaaaaaaaaaaaa

SEQ ID NO: 2515 - DNA, 827 bp, Homo sapiens
ggtcaaaaagttccaccgtttaggccaggaagacagatttttttttattgaaacaagattcaatgtgggaaaggcctttattcatccatcttataggtggttagtagagaaattttggtatacagtgacattttgattacttaagttcatttttttaaattaaattttttcctcacattttttaaggactatcacattagaatcacaaaacttatttccttaacttttttttctttttaaatttcctctacagtataaacatcaactactgtgcagctgctttggaaaactttggatgagcaaacaaaagccacttatttcctacttgctcttacagcttataatatagtataataatatcatgtctattttctttttccatttcattatacaatgacaccattgtttttatacaataagaaacataatactatgctgtgcatttttccttctagaaggctagtagaatataaatgttatttaacaatgaaaagaattgtcttaagaaaaaaagtcttttacattttctgtgaccacaatcataaaagaaaagcaatgtagttacagcagccattaaagagatttttcccttttactttagatttttgtaacaaagaataaagacacgctcttagcacactttagaatgtattctgatattctgtatttaataggtatatcttgctttatccatttatcttttgtgttgtcctgtaagaaggcataatgtactgtattcagcctgttgtgagtagcataaaaccaggaaggcagaggtcccaggatgctgaaatataaaacatgtaatctcagtaaaaaaaaaaaaa

SEQ ID NO: 2516 - DNA, 727 bp, Homo sapiens
cctacaggtggcactgttgcaatgaggctgtttcttctagagaggtcagcatcaagaagaatcagcaaatttcaaccttacagtatatttaattcaaggatcagattttttaaaattaccttaacaagtgatgaaattattttcacctgtaataggacaaaccaatttcatgtgttgcactgaggacctgccaccttatgtggtgtttttgccaaaaatgcatgacctgaatctaaccctgaagaaacatcagacaaatgtaaagtgaaggacattctactaaataattgaccagtactcttcaaaaatatgaaatttaggaagacagagaacggttaaggaatcattccagattaaataacagaaaagagacataataactaaatgttatacataatccatgattggatcctaaaccaagaatttttaccctggacaggacattattgaaacaatttacaaaatttaaatgtgcattatagattaggtagtagtattgtatcagtatctgctttcctgattttatgctgtggttatgtaagagaatgccctggatcttaggaaatgcaactggaactacctagagataaagggtatgatgaaatcatgtcttcaaagtattctcatatgtttaagaaaaaaatatgctttgcatatattgtatattttgtatagactgaaattatgtcaaaataaaaataaaaatccccaaaaaaaaaaaaaaaaa

SEQ ID NO: 2517 - DNA, 388 bp, Homo sapiens
ctagacacttcctgagtacataaatattcatgagtgcaaatcaaatgttgcagttatcatccaaattaaaagattcaacaccccttcagaagaaaatatgctgtgaaaatatactttttaaagtttagttccttcgatgtagaagataaagcttcaaaagagaattgaaatttatggaacttaattttttgtttgtattcagcagagaacaaagaaaccaagactgattctaaatgtccctgtttctagaaaggaataaaatttgcttctgtcaccacttcaggcgagcctctcacaaccccccaactgcacactccatcaagaaagcccggagttgaaatttttacaaagaataataaaacaaaattactaaagaaaaaaaaaaaaa

SEQ ID NO: 2518 - DNA, 340 bp, Homo sapiens
ctaggtacataagaagtggtaaagcctgggataatatctaaggatttcgactccagggctgtgcactaaccactgcgctgtgtctcctctttcatgtggagtattcatcatctcacaaatgctggagctgttttgaagacatcaagtttgctacattctcagtggaaatttttaccatcctaccccattcaccctgctacagagaagaaaaacaacgcctccagtgcaggtgaagaggcactgtgtctactgactaaaatccttcatatgttgaataagtcctctaaaaacacttaataataaaatttcataaatgttagataatacaaaaaaaaaaaaa

SEQ ID NO: 2519 - DNA, 323 bp, Homo sapiens
ctaggtgccatgctgtgagctgctccagggacaggcccatgtggcaaggaatggacctcaaccaagaaccctcagaactgaatccctccaacaaaaaagagagagagcttggaagcaaatccttccctaagcagatccttccccagtcaagccttaagatgagaatgcagccccagccaacacctggactgtggcctatgagaggccccaaagcagaggacctaactaagccacacctggatcccaacctacagaaatcatgagttaataaatgttgtttcaagccaccaaaaaaaaaaaaaaaaatggcctcgttggcctca

SEQ ID NO: 2520 - DNA, 311 bp, Homo sapiens
ctggtgaagaccggtcggaagttcatctttgaaccagaaagctggacctcaccagacactgaatctggcggtgccttcatcttgaactttccagcctccaaataggtgaaaaataaatttctgttgtttataagctattctgtttaaattatttgattattgcagcccaaatagatgaagccaaaaagttatattagcccctttctttggagaaaaaattatattatcgttgttgtatttgttattctatatttattacatacatgtaatatccagataataaacatgttcaaaatgtaaaaaaaaaaaaa

SEQ ID NO: 2521 - DNA, 564 bp, Homo sapiens
  misc_feature (1)...(564): n = A,T,C or G
tgcggctggcaggtgtgtctcagaaaaagctgtcttcagcaaggcagaagcagaggatcttctagaagatttgcactatcagcttggtattcagntctctagcttgaaatgatttcagtgcctaccagggtggtccagagttggtgactattatggcatggttacccagggccagagaggtgaggtttaatgagaaagaagatagatgaaaatgactcctcctcctgctttcactgctgcagcaactcaggcctgcagaatgaaggagctggacttggagatctctctcacctctgaagttgttctgataggtggaagaagacaactctcagataagacttaagactttggacttgacactggaatgagttcacagagtgagagctggtggtttaagaaagcctggcatctcccttgatccctttctcttcatgtgatatgccctgttgccttctgccatgactggaagcttccagtggcctcgccaagaacagatgccagaactatgtttcctgtacagcctgtagaaccatgccaaataaacctctggcctcgttggcctca

SEQ ID NO: 2522 - DNA, 428 bp, Homo sapiens
gttttgtgaactgaagaacactttaaatgtcaaactgtactgcggagtattgaaattgcaagttatcatcaaaggaagctgtaagcatcatgactcagtgatgtattttctctgtatttaccattttaaaccaaatttagtgttctctctgaaggacaatctaaataaagtagttgtaaattaatttataataatgaataaatattcaaacaattattttgattggttttatccagcagaaactgagaaaatttaatcttacatgacattgggatgctatattatttgacatgaaacaaatattttaaaccacacttttaaatggtgtatattgcactaccttttaaaaaaaagaaatagaagttttgaataagaaatattccttttgtctatgaaataaattaaaatgcttttcaaaaaaaaaaaaa

SEQ ID NO: 2523 - DNA, 132 bp, Homo sapiens
aggcgctatcatcaagaacaaaaatctataaaagagatgatgtgatgtattcagtgtttataccttaatcttatttgggtttactcttatggtaaaagcaaaaaaaaaaaaaaaatggcctcgttggcctca

SEQ ID NO: 2524 - DNA, 346 bp, Homo sapiens
ctttggtctacctgtttctaatggtatcaggctatcccaagaattgtttggctcattgcatccatgtggattcccacacccctggtggaagcagttccagcacaaatagaaaagacgtgcaaatctgaatttccacttcctttgcaaggaaatgagaactaccagggtgtcctctgttaggcacaggtcccatttctaaccccctatgtctcctggagcctacccagtgtgccatgtgtaaaagatggtgttagtgggacctgggtggctcatttcataataaatgacaaatgctttgtttttcttctttcaaaaaaaaaaaaaaaaaatggcctcgttggcctca

SEQ ID NO: 2525 - DNA, 490 bp, Homo sapiens
tttaaggcaaagtcttcagaaagaaagaagaaaagaaaaaaagaaagagagagaaagaaaaagaaagaaagaagaaagaaaaagaaagaaagaaagaaagaaagaaagaaagaaagaaagaaagaaagaaagaaagaaaaagaaagagggagagagaaaaggacaacgacagagatctgtaaatgaccacaattgattaaactcttcggggagagagataataactctgccctgcaagtgtttcttctgcccaatctcatcccctttttggagaaagaaattgtcccccaagattgtcccattttgtcctaaggctggggctggcctggagagagcctctgaaggcttatcatgaagctacttcctttaggatacggcaccatgatcactgtggcaaaacccacctttattttctccattaggtaacatcacagagaaaaaaaaagatctcatgggaaaaaaaaaaaaaaaaatggcctcgttggcctca

SEQ ID NO: 2526 - DNA, 325 bp, Homo sapiens
ccttgaatcctggatgtgactatcattgttgtgaggacgctgggaaaacatcctacatgtgaacatcctgctgtggtcctgctggctccctccagcgatgctgggtggacagaggggtgttggcactgggactggctgctctgggcatgatcatgatcaccttgatatatgagggtccctggcctcatactccataatgctatacagtttgctaaatggtctttcataaacacattacaaatgcctattgtgaccacttagttgatggggaaagccgggcagaaaactgacctatagctgagattgggccctttttggcctacat

SEQ ID NO: 2527 - DNA, 386 bp, Homo sapiens
cttaggctacctcctgctcactctgccctgatacactgaatcaggaactgtctccatcacccagaactcccggaaccaagcactcagcccgacacgtcatacttattaaaaacacggaggtcgtgagtggatttccacgtattgttctagatgatggagaggcctgaagagtgaggagtggggaagaaatgtcatcgctgttttcacctgcacccttgtttcagagaagtgaataggggggcatctctggtcaacaaaatgataatagtagcagcaacaataatattctctttttttgagcacttcttatgtgccaagtactttatgtatgcattatcataattaagtctttcaacaataccataaatcatataaaaaaaaaaaaa

SEQ ID NO: 2528 - DNA, 540 bp, Homo sapiens
ctagctgtccactgaactctctgcatttcactggaaaggagatatttttcacagcagagccttaatgaaatccaaaacaagatgggtctcaaccaaggcaaccaaggagacctgattacaggggacctgtgaacttcatgttagagaaagataaggaaatactgaaaatgatttgtaatttttctctttattttaaatatttattaagatgaattgaatacaatactccattgctgtttaaatcaatgttaatgttctttaacaattcactgacatgtactttccatacgtaatataccagaaaacaacacacaaaaaattgtttcttatttattccaagaaaattttaaacacttagcatttaaaataagaaagccaacaaccaagttgcaaggctttatttaatgtttgtatgtgaagatagaaataactataggaaaatcagtatttgaaatgagaggttatttatgtggcatgcactgatgttgtcaggaagtgatctttcaataaaatgcctacatcattttaaaaaaaaaaaaa

SEQ ID NO: 2529 - DNA, 844 bp, Homo sapiens
gacctatcgagggtcaacagtagaagccagaagacttgttaagaagctatggaagtaatccagcagtgatcagctgccaaaacaaaggaatagaaatggaagagttagaggcagtgttatgctagagctgtcccttagcgagctgattttaaagcttgaaatcggccatggatgaattcttggcctgaaaaaggggaatcaaaagacgtgctttcctgtgcttcagctgcaatgtctatttctcaagacgctgaaaaagatgatttagagttttatgattaatggaagggaggaatctactctaaagaaattggataatactataaataagaaataaaaattatttgacaaaagctatcttccccttagggattatatgtactactgatttaccttactgtatcttattcaacagaacgttttcaaatagtatcatattgccagttacattgtggtatcattttgagacaaatcatttggggttattaatataaagaattggacagtttaaatgtagatgtgataagctattttaaaattcaaaattgttacagcttttcaactcaaaatgaagaagccaatgacgcatcttacagaataacttatatactgcattggctagagaagcacatacaatagctgagagactaataaagccttatatggttgacattgttaatacctactggtgaaaagttagtaaagtaaatcatgacactgacactttccaatgacacagtaacttgccacattaaaagatttagctgcaatcatgggagctgagttaatatctgcagagttgtacttttgccttgcgaaatctacaggcttggctttatttgct

SEQ ID NO: 2530 - DNA, 396 bp, Homo sapiens
cactcaccctggcagaagccagcagagcaagcagatagatgaggacattcagcaataatatggagcggtccatgtgtggagaagctgaggccacccgcccccggccttgtatgtaagccacctttcagatctggttgagtcttgagatgactggagctctagtggacagcttgactgcaatctcatgagcggtcctgagcagggaccacccagctgtgctgctgccaaattcctgacccaagaatccatgtgatatgataaatgtttgttgttgtttcatgctgctaattcattatgcagcaatagataatgaatacaacaggtgattttgatgcaggtgctctgaacacattttgtgaaatggactcagccaataaaagcactgagaacctaaaa

SEQ ID NO: 2531 - DNA, 790 bp, Homo sapiens
ccctggtatacagtagaatggcatttccccgcctgcttggaaaatgacactagtgatgaaaatgacacttgctttggccaattaaacttacatgggcagaagcattaagcgccagtgacagcttcatcatcctaccttctcctctgccccatgaccttctagatggtgaggcttctaatggcctgcgtatcagagtgagaacatgaagcagagaatccaggaacctcttgattggacacgtggtttccaaggcttacaaaaatacccacactgcatctgactctgaaactgctttctcagcagatttgtacctcccactgatgagagccacttgatttcatatgggttttgccatgtatgccgttgtttaacacaagacaaagtgtttgctttccaaatactgatgtctaaaaattttgaacttcagaaacacacgcttaagagcacttttgcagtgaacgttaatgttttaatgtttcactgacaccagcttaagaagattaatgtggaagcaatggtctgccaccaatttcatctaattattcttacagttggttggaaggaaagggtgattaataagcaccaagatgacactacatgttactcgtgataaagtaaccaacgatacataaaaaaccttttcttgtgaagaaaatggagctaataaatcttttatttttggtcccatttggtaaaatgacacatactggtccttggtcaaagacccatctgtcaataaattataggcagtcttactagaaataaatctattgtttctttgagatacaca

SEQ ID NO: 2532 - DNA, 1172 bp, Homo sapiens
ccctaggagaagaacactgaaccattctgtagaatacagaggatcctacagggaactcaagctaacataaaatattgcacctgtctctaaaatacttaaatgactatttacagatcagaaaattgaaaacaataaacaaagcaggaagtagtctctctctatatatatacacaagggtcttgggccatttttgctgagaccctggaacaggggtaaattgcaatcagattgtggactggcatcagaatggcaagattggtaaaaagaaacagacacagccaatataaattgaggatgggagcagtggagtccaggatcaagttgctgaagcaatgggcttgaacataacgtatctgccttctcttgattgtccctattcttcaggagtctgtgtcaaaggctgtgagctccagcagcctccccagaggtaataacgatgtagtggttggtggtggctacactcaggtagaccacaggttgtgtcttatgaagactccataccccttctggtaacaaacaagcctttgtgtagaactgttttcccatggcttagaaagttctgactcttttctctctcttgcaccagagtggggaaaaactgggaaaagctcacaaaagtttgcctggggtacagtaagtagccagtggattattactgacccaagcagggccaatcaaaatgctccgaagtcattgctggaaccatcaagaggaatgtgattttgatttccttgggcttgtcagccagaagaatgaagagagcaggaacttcttgtctccatcttggccaccacttgagggcagccttctggagaacaagactggttcaacttctgggtcccacggagctcctggactgccagctacatgtcatgaaatttgctttactttgtgaatatgtcatctgaaactaaaggagccctaactcagaaaattaaaacagctttattcacaacagctacataaccttgatattcactttaccttctatgtttcatgcaacttcctcttctttaactagtttgctactagttttgaggaaggatttctgctttgctcctatcgtctggctatgatgtgaccattgaccctgtcctatatttaaatctaaatttgtaagccaagtgtcttaagttttaataataaaaggaaagggactaaaaaaaaaaaaa

SEQ ID NO: 2533 - DNA, 837 bp, Homo sapiens
aggcaatcctgctgaggatctctattttccctcatcgtaaacaatctgtctcttctccccatccctgcttgctgttctctggagtatggtgcctgacatgacaccagacagcccaccaggagtcttcttgaatccatggatcttagtagagaagcgggtgttcaaaccaggctggctggggaagtagacccagtcattctctcagcaatgaggactggctagagacagcctgagtccaacatggacttcttttggttcctaaaggaggaacatttgaatcacagaagcaagcaactggaagacaggttagaaatcattattccaacacttcctcaatataaaatctggcatgacaatttcctaagtttcaactaattttttatggtcatgaaataaacaagaattgtcactgaagaacagagaaaaaataaggttcataaaccccttaaaaattacccttgatggacagcatggtataaaagatacttctttcctgccacctactacctgtgtgacctggtacaagtggcctagcttccctgagccctattctactcctttctaaaaggaccacgatgaaaaccctgcggtgaggccaaaaaccacgcgctttcaccaaggcctcactgcatgcttccctagcggtacttcttcccggaactcaaacatcgcctaagacagcctcctgtgtttcccattcctacacatgacaatttacgcaagaccaccccttgtgcgggatgcgcttcccagaatacagccaatctcacccttccgcgaccaaacccttcgcctgaccaccagggccaacaggaaacctacactcgatcccttctg

SEQ ID NO: 2534 - DNA, 207 bp, Homo sapiens
tggaggggccaactacatgttttaatcagagcccacagctgcccacacccactgcagagtgagctactctccaccaaccctgcagccctgaagtttctgtgaccactgaagaggcctgttttcagacttagggtcaaagtgtgggtgacctccaacacctactgtaatgaaggaatagatgtcaatagaagcctaaaaaaaaaaaaa

SEQ ID NO: 2535 - DNA, 196 bp, Homo sapiens
agattaacggtccttctaaaatagaaaactgaatgaagactctgttatttcatttgcaaagcttattgaagcacatatttatgaaattagacatggagaagtgaaccaccaccacctgctcaaccaccacgagaattttttattatttcgagataaaagaaaataaattaatatgcatgtggtaaaaaaaaaaaaa

SEQ ID NO: 2536 - DNA, 335 bp, Homo sapiens
cgagggtctcattctgtcccccagcagctgaagtcagtggggcaaccatggctcactgcggcctcaacctccctggctcaagcaattctccaaaggagaagctccttagagaaaggattgatccctcaagaatgaagaggagatgattgagcagagataagggaggtaaagtttgcagatgaagacaatacagaagttaaaaagcaacaaaagaaacagttctgctgatatttttgcactactggatccaaccaagcctttagttaactttctccttaatgttttagatatgtgagctaataaattttgagtttcatgccttaaaaaaaaaaaaa

SEQ ID NO: 2537 - DNA, 405 bp, Homo sapiens
ctggagtgaagattgggacatgcgtgggtacataaagatggccaaagaccagcataacaactgcagaatcgccatgttggccagccttcctattgtgtgagctgatggatggtgaagaggaaggacttgactggggatggcacatacatgggaggaattcatctgaaatctaccagcccctgccatgtgggatgcaccctggaatcactgaaaaatcaagtgtgatttgaattctgtgacgctttcataatggtaaatgttaccactattttgattactgctataaccagctttgcattattgattcactgaatgactttagattttttttttgctttaaaaggatggaaaaaattttacctgtttaaataaaacttaacttcacttggaaaaaaaaaaaaaaaa

SEQ ID NO: 2538 - DNA, 487 bp, Homo sapiens
ttccaaatcggtgtttctctaaaggatttcctgggatttttagccaaaactacatcatctacacattataaaataatgtttacctccccttttccaatttctatacatttaaattcttccatctaattgcattggccagtaccaccaatagaatgctaaataattatagtgaacataggcatacttttttgtttgtaactttagtgggtcttgtatttccaaattaagcatgatgatgatttgggggtcagatagatatattttatcatgtggagaaaaatctccatctattctttaattaaatatctttatcaaaaattgaataaatttgtcaacatttcagcatctatgaaagaaatcacaagattctttttcttagatgaattaatagtatgaatttatattaatagatttactgatattgaatcacccttcccttaataaaataaacatgaaatgtatattctcttaaaaaaaaaaaaaaaaa

SEQ ID NO: 2539 - DNA, 603 bp, Homo sapiens
aagccagtcctcgactcatttaaacatgtgtactcaccaatgtcaaagacctctcaaatgatgtgtaatagtaaccagagaagggaaagagttagtaatctttggaagatttattaaaagaaggccacatagccaagaaaacaactagcctgctggagagaggtcctacaaagataaagaagccatggagaatggaagaaaaaaaagagagaatagtccagccagcttccaaccattccagacgtccaaactgaggtgtcagacagcaccaaaataaactgatgctagcttgttataccatatctgaagaggctctaattgaggcactaagaaaaataagacatcagtttgaaaagtgtcactaacagagcaacatgaattctgctaaaattgaagcaagaataagcatcaaatttatgatgaagcttgggtggaagaacagtgaaaacattgatgtttaatgaaaagtttatggggacaatgtcccaaagaaatcagcagtttacaaatgaataacttgttttaagaaggaatgagatgttgctgaagacgaagtctgcagtggcagaccacccgcactgatttgtaagaaaaaaaaaaaaa

SEQ ID NO: 2540 - DNA, 339 bp, Homo sapiens
ctgtcgcactgtgactcatctaattgtctttacttacatgataaaattgaaacttgggagcctggaatgaagcaaatgaagccataagggcaaggccctgatgcaatagaactggtgtccttgtgagaataggaagatgccaggagtgtgatgcacaggagaaggaccatgtgagaatgcagcaagaaggcagccatctgcaagccaaggaaagagacctcaggagatactaactgtgctgacaccttgatcttggactttccagcctccagaacagtgagaaaataaatttctgatgtttaagccaaaaaaaaaaaaaaaatggcctcgttggcctca

SEQ ID NO: 2541 - DNA, 328 bp, Homo sapiens
cccaccacttctagcaaaagctgtgggcagtttggctcccgcctgcaattccaatgtttcaggaggccgaggcaagattatcattgaggttatgacgttcaagacaagcctgggaaacataacttaaaagagctctacttgccagctcctgcattatacataaatagaaaggaagaaagatgagctaaagatcctggaaagtagaaaatccaattgttattctggattctaaacattacctgtgtggccttggataaacttgaatcttttcatatataaaacaaaggaagttgaattaaattatttctaacccacaaaaaaaaaaaaa

SEQ ID NO: 2542 - DNA, 586 bp, Homo sapiens
cttgaaaggaacgcaaagagatgtatgatggacaagttcagaggttgggaatgacaggcagaagtgagaatctctgcgtggattctgctcctgccactgagaaggactgagggaggcgaacagcacatggaaaaacaggccaagacttcatggaatgtggaacatcccacaacagggacctggtgcagctgaacacaggagttcagccctagaggtctagtttactatttataactattgagtcttcatttttgtttgttcatttgttttcatgggattaagcttggtaaagtcatgtaaacgacaagaggcagacttttcttctatttggctaggaaattacagcagttcagctgtttcctctctttgttcttatgactcttgcttgatttattaaagttgcagagtcaaaagaataatagattttaatacacatcaggctgaatcttactatttttgctatagaggccatgctgtaaaaaagccttgttaaatttgtttctcagcactatttgtatgccataactgtttttctaacctaaataaacttggtagcgattatcaaatacaaaaaaaaaaaaaaaaa

SEQ ID NO: 2543 - DNA, 194 bp, Homo sapiens
atagaaaaacgcaaatcttcagctgctccatgtataacgattttaactgctgggccattcttgtgagtcagtaaagcagggacaggactttgtgatgcatcatttccaaggagctctattttgatattttgacctagcatccttgtctaacaccaatgaaacgaaaagctacaagttctttaaaaaaaaaaaaa

SEQ ID NO: 2544 - DNA, 550 bp, Homo sapiens
aaaaacgaaaatcttcagcctttccatgtataacgattttaactgctgggccattcttgtgagtcagtaaagcagggacaggactttgtgatgcatcatttccaaggagctctattttgatactttgacctagcatccttgtttaacaccaatgaagcgaaaagctacaagttctttcttctgtgacgccttattactgcattcagatattaaaggtacagaattcaaagcaaatagagaatatatatggtttacagtcactgggatatcaatcattccacatctatggtaatgactgagatcaaatctacaagtggaagaattcacttcttattatgtaatcatcattaaaagtgattacagtaaaaaaaaaagttggggaagcagattataacaccaataaatcaattctctttaagacagttattatctgtaaactattcctaagtcctatatgacaggcagataatctatattattcttatacgtttataagaatacttaaaagattaaaaaagttttaatagactccaaaaaaaaaaaaaaaaaa

SEQ ID NO: 2545 - DNA, 789 bp, Homo sapiens
cttgggttcacctgacatcctttctgggaccctatgaatgagaccctaccaatatgaggtaccgtgaggaacatggacaagtaccacatggagccccttcttttagaaattgacattatctatttgatagattttagatatttagacaagtaaaacactaatctgcaaaaaacgcaaacgcagttcaagaaaatagcacaatatgtggcaacaaaggtgtaattaaatatctaagtgatttcacaggagatcaggattgcttctgtctagcagagtaagataaatctgcttggaagggatggaatctgaaatgggagtctaaacccgaaaactttcttacaccgctatgtcagagagaagatggagagaaggtgcacattataaaatgatggtccagtccatgttcagatgtagtgaggtatttgttgtttgtggtacagcaaatatgcaagtttgtttactcaacaagaaactgatttctggagtgttctaatgcaagaaagcatctttcttattttttaaataattattatgtttcaaattgctgagaaataccctctggaagctttttttctgcacaatagcaccattctaaatattaatagaaatcttttatggtggtgggggaaggttacacattttatttttaggtaagcttacgtatattgaagtatactttgcacagagaagtcttgcaaatataaattcaatatattcaatttttacaatggaaaacacctatgaaccagcatcaaaataaaatcaaaccttacaagagaagcttgaatt

SEQ ID NO: 2546 - DNA, 790 bp, Homo sapiens
ctcttgtttgcccaggctggagtgcaatggcgcgatctcagaccactgcaacctctgcctcctgggttcaagcaattctcaacctttgttagatgcataataaattgtaaaaattttctcccattctgtaggttgtctgtttactctgttgatagtttcttttgtagtgcaaaagccctttagtttaattagatctcattggtcaattgtatgctttcttcttaacccatgtatacttcagtctctcaacatatttatgcaatttcttctgcctaaaatgcttttttattttccctacaatttatcataatcttaaccatccctcaggaataaatattaactttgggaagcccaaaaaaaagaaagtaaaagaaaatacaaaaaagaaaatcggagtggttatgggacatcaatcagagtccgtcataagtgcaaagagcggtaatcggctcttcttattcgccttgagcgttgaatgcttagcatgttataccactttggcctatttcctgttggggcggatgaagttagttacgatttttctgatatgctaactttttatcgtatggcgcatcgtttatgagatgatttgatcccgccttcggtatttctactcaatcgtttaacctttttaccgtgtagtacgctcctctttgccgcgatcagctagagaagtatttattatcacacccctcctattatctccttctcattctctaacgcaccgttctcttgtgtgcacgattgtagctttatgatttttcctcagttcattcacctccgtatatct

SEQ ID NO: 2547 - DNA, 843 bp, Homo sapiens
tcgaactcattatatacaaagaaatcacatattcaccttcctcctcgttgctctaccaagacctacactggacttccccagcagaaggaaattggtgcggtggaatcggggagcagggttcgaaagcacaggcaaaaggcgctcacaggaagcaagatccacgctggccacacaaactgtatctttccctttggaacgctggtacatctcatccatgtcaagtgactccccaatgaggaagcaggaacacagaggtgaagtgacttactgaatgcctaagagaacttatggagaaataaaaataatagttgctttcaaaaagagaatgtacagtattagaaagaagactaggaaaagaaaccagcaacactcaatgattttatgaagccaaatgtcttcaaataattttcttctagtctataatgtaagaatgttaaaaccgtgtccctcaaggttgcaatatgacattgcatgtgtaaattgtatgtataattacaacataatggaaatgaatacactacacatttctctcactttcaaaggttggatttgcaccaactatttttggcctccaaatagaatgaacttcacatccagaatttccttgatcattaattatatcaacaggcttaagaaaaactccttattaacccagaaatccatgtttggactacctgaattcctatgtctgcttaagggcatggtttccccaacttaggatagggaaaaaatgtctatccttccataacattgttcacctaatgcttgccgagcgttctcctgatacgtaagcggtcatacaacctttgttggccaagatatagcttttgagcgacttgatcg

SEQ ID NO: 2548 - DNA, 224 bp, Homo sapiens
tctccgtggactagggccctcccctcatcgggagcctcccaggcactcagcgtctcctggcctagggccctcgcctcagagtggcagctgtctagccctttgttcacacaaaaatgcgaccactactctacggcagagcttcctccagccagggctttagagtctccttcccttacttgtttgcaataaaaattaaaactctttaacgtgcaaaaaaaaaaaaa

SEQ ID NO: 2549 - DNA, 487 bp, Homo sapiens
tccccctgaatataaagttatggaaatgaatgatagaaccaacctgaggaaattaatcagcaagcctgggaatacaatttcggtctccttaacaatattccaacttaattgaaaacaaggacagttagaacatcatctaacaacacagggacactatcagaagaagaccacgaaaggttatgccctttggagtcaatattgaggttctctatcacactggaaagaaacagacctcagacaacggattactaaccacacttcactgaaagcaccatcagagaaacatgtgacaaagacatggagatcaatgtgctactctggaatatctctgcatttccccaagactgtcctgaaagaccagcaatggagaatagttgtaccaggagtggagtggtcagatgtgtctgtctttgtcatacattgctagcaattttggttgtttctcaataaacatttttaaaatttattttccctaaaaaaaaaaaaa

SEQ ID NO: 2550 - DNA, 715 bp, Homo sapiens
ctgatcagataagtccatattgcttcttggtccatactgggggtttgattctcttgggttcctgaggaaaataggctccctggcccagtaactgctgatgacctcaaactctttccatcgttggagtgcggtcaacatcagcagttgatgaaactgaaagtcaacatttcactttagcttgtcctggaactaaactgagaagacgtctttggaactggtcacacaaagagaagtatcccggtgtgaggtcagatgcatgcacatttctcagtgatgtgactacacactgtgaactctgagactgatgctttctccatagtgaggaaaaagaccttgttgaaaaatgccagagtactatcttggaaccccagagtattcgcatgactcaaatatcaagggctgttttttttttctccccaaaatggcttagaaaacaaaatgtatggatctgattgtctcgtatacaaaggcatgttagagtttgtaacctgtgtaaatgctgtaattaaacccttgtttttacatggattcattatgttaaattcttcagtaattactgacattttctttaatgtgtacatgtggcgaacataagaatatgattagattgagttaaaagtgtaagcagtaatgagcatattatgggtctccctttgcctttggtcactctaagcttcttgacaataaagcttgactttttataaaaaaaaaaaaa

SEQ ID NO: 2551 - DNA, 433 bp, Homo sapiens
  misc_feature (1)...(433): n = A,T,C or G
ctgggggatcaaggttgatcactagagnagacttcagaccagtaccaaccaggagacagcaccagacgaatctgcataataaactgtactaaacagcatctatctaccataccatagccttcccagaacttgctgcccctgaagactcaaagtccttttcctttgccctgtcacttcactacaaattgtactgttctttgttgaagacattatggggtcctcagccaagaacttatgaaaaccagaggaaaaattatttcccacgccaacaacatcataaggatgttcccatgccttttagaacattttgaatacccaattcttaagagtatatagcatttaataatttggctctacggtaatttatttaaccaagccctaattttgaatgtttaagttgtctccaatatatttgtaaataaaaaaaaaaaaa

SEQ ID NO: 2552 - DNA, 563 bp, Homo sapiens
ctgggggatcaaggttgatcaccagagatgacttcagaccagtaccaaccaggagacagcaccagacgaatctgcataataaactgtactaaacagcatctatctaccataccatagccttcccagaacttgctgcccctgaagactcaaagtccttttcctttgccctgtcacttcactacaaattgtactgttctttgttgaagacattatgtaagctgaaattctaagccacttctttgagatttactcattttccctgggtatctcctatgtatacatgagatatacatgttaataacttctgtttgtttttctcttgttaatctatcttctgttacagggggtcctcagccaagaacttatgaaaaccagaggaaaaattatttcccacgccaacaacatcataaggatgttcccatgccttttagaacattttgaatacccaattcttaagagtatatagcatttaataatttggctctacggtaatttatttaaccaagccctaattttgaatgtttaagttgtctccaatatatttgtaaataaaaaaaaaaaaa

SEQ ID NO: 2553 - DNA, 594 bp, Homo sapiens
ctgaagggtctcgtctgtcttcaggctggagtacagtggtgtgatcacagctttccaccctcctgctctcaagcaatcctcccatctcagtatgaagcaccacccaccatccacctctcaccctcgcccccaagtagctgggactacaggcatgtccagctcacatttttaaaaaaattttttgtagagacaacgtcttactacattgcctaggctggtctggaactcttgggctcaagcaatcctcccgccttggccccccaaactctcaggattataggtatgagaaactgcgcccggcctccaaattagacttgtacaactgagatcaccccaaactaacaaaccaggattttgaaaatcaatgtgtaaactgaagactcatatttcacaattatcctaaaatagtgtttcaaaaagttataaaaatatcgtaagacaatattagactatgattttaatagattttgataagactcttctttacctctgcattctaaattaatgtaaataatttcgtctaccaggccatttcattcatgattttagagataataaatctaaattttccttttcaaaaaaaaaaaaaaaaaa

SEQ ID NO: 2554 - DNA, 834 bp, Homo sapiens
acaccaggtgttgctataacctctagaaagaaggaaaaatctcaggtctcgcttgtctccagctggagtcagtggtgtgatcacagctttccaccctcctgctctcaagcaatcctcccgccttggccccccaaactctcaggattataggtatgagaaactgcgcccggcctccaaattagacttgtacaactgagatcaccccaaactaacaaaccaggattttgaaaatcaatgtgtaaactgaagactcatatttcacaattatcctagaatagtgtttcaaaaagttataaaaatatcgtaagacaatattagactatgattttaatagattctgataagactcttctttacctctgcattctaaattaatgttaataatttcgtctaccaggccatttcattcatgattttagagataataaatctaaattttccttttcattttattagtcctttctacgttcattatatttagctgcaaagacatatatggctttaatcaagttttgattttgttttcaacagcatcctaatgatattcaaaatggtattaaattgagcaccatgccaacactctggcaagtaataaggcttcgcaggttcccattttgagtcataagcggtaacctgaaatggattatcctaaaccttcatttaaagaatggcaatgtggaaggtgggtgataaggtacataagcatttgttatgccattcactctactattgtgtatattagaaacttttcataacaaaatatttaaagaacatatttcagattattttacccaaaaaggtattaaatactttataacaaaaaaaaaaaaaaaa

SEQ ID NO: 2555 - DNA, 426 bp, Homo sapiens
cccaagacttacaggtgcaaatgaaaataactacttcgccacttatttaaggaagagagaagaaaggaatcatagcacagagaatatattatttctccaagccagccaacaccacaaatagaggaaacttttccatctgatggaatgacaacttcagtcaattctcccatggggaaaaatgctttttatgaacactgttccttccaattcagctccatttcacagtgcatgattatcttccattttattgtcaccaaggcaccatagaaaacaaatagaataaagacaaccattattaacaggtaatagatgtttttcttgcagttttagtggtaaattaaactttaatggcatctgttcacaatgaaaaatgtaaccaccttagtgataaatatgctttaatttcaaatgtcaaaaaaaaaaaaa

SEQ ID NO: 2556 - DNA, 357 bp, Homo sapiens
ctagtgcccggaggcagtgtccatccatagactgcatttctcagcctccttgcaacgagccagggccatgtggatagttctcatcagtggaatgtgagaggaaatgagatgtattctctcaagaccaagaagattaagaagccttctctgcttgttctttctccatccttcatcctgcacgcagaggacatggaaaccctacagctgggttaaccctactggttaaccctacccagattaaaggagcttgggttcctgaatcacctcatggaaggctgccaccagtcaggaacacctgcactgttaagtgaatgagaaataaacttttactgtgtttagccaccaaaaaaaaaaaaa

SEQ ID NO: 2557 - DNA, 789 bp, Homo sapiens
ctcaggtaacagaatgaagaaactacaaagaatattgagcaggaagcatcacagaagtgagaggaaaaccaggaaaagatggctcatggaagcaaagaaaacaaaaaaaaattgaatcaggacagtaactttggtcaatggtgttaattgctgctgaaaactcaagttaaattgacacaaaaaacgtccattggatttattaggaaagacttgagcataactgatgtatactcgtttgtgttttgctacctaaggtaccaaggttaacaaaattaaatggctgaactatagggaattggtggggaagcattcttagaagttacattttccttttcaaatacttcttttacttatttcccatgtcatgatttggtttactgtaaaagcataatttaagaattccaaagagagtttagagtaccaaattacatatctactttatttctttatcttattattgatactgtactataactgttattagtacagaggcccacaagattgcatggtgacttttagaaaatacaagcaagcatatttttggctcgggaatttttcagtctttctaatttccaaagagttattgatgatttgaggtttgttcctatcagaagcagatcgtctaatttttctctaattatcttattatggaatagtagttgtaaagaaacattattaactgtgtttgacttgtgctttgtttttctggattgttttaaacgtttcttcttgtttagacatgaatcctctaaaaagcaggtagtaaaaccagagactttccttgaatgg

SEQ ID NO: 2558 - DNA, 870 bp, Homo sapiens
ctgattctctcacctctgttttttactgaagtagttgtaagagtgacattgggtaccatttccacccaacagatgcaggaaatactggaaatcttttaacaaaatctgtactgcagagatttccttctgaatttcgcaaacttcagcaattcacataaatgaaaattcaaaacaaaacaaagcgaaaactttttggcattaacccgtgagttacagagtgagattttaaaagaaagagagagagaagaaggaaggaaggaagggagggaagagagagaagaaggaaggaaggaaggaagagaaattggaaagactgacaatgtattcttcagcacggccaggttccatgccaccactggactctgtacatggactcatgatctgttttaataatctgggatttaccttcattgttgagtactctgctatgccttcagacttttctccagagtgaaaaatgaattacgatgatccagacaagagctactgatatgctgactcggctccataaaaatcactcagtttagtaaaacaattatttcctagcccaatatagacaaaataatttccttgttagttgtctagagttgtattatttttttaaccagttgtgagcaacatccttttagacatattaccttatgtgattgacgtggaatttcaacaacacttttatgagtatgctgccaatttgcacctatttcaatagatttttccagcaacatgtaggcatgaatgtgctcatggcctttctttaatgattaattgaaaggttctaaagtcttttttcaagactagccaaccctatatcataacatgacttccatgacaaaatgtactttactatactctgtcttaaaaaaaaaaaaa

SEQ ID NO: 2559 - DNA, 299 bp, Homo sapiens
attagcgtcattcagcttgctgcctttgctggggaagtgcccactcaggacagctgaggagacggagccacggaggttgacataggaggtgatggaacagccagttttcctgctgagcccatccgtatagacagccggcatgcattgatgtgtctctctcccagcttcaacccctgtctgcagagctggagtctccgactgttcccgcatgtcccttctctgttgttacctgcagtccagacaaaaatggcatagtaaaataaaagttgagagaatgcaaaaactgaaaaaaaaaaaaa

SEQ ID NO: 2560 - DNA, 135 bp, Homo sapiens
ccaaatgcgcggaataaatttttatttggaggaaaacccttacttgggaaataaaattctctccaaaaaatttcatctgaaggaaagaggggacccatcttcaaagcccactgaaatcaaagggaaatctgtttt

SEQ ID NO: 2561 - DNA, 424 bp, Homo sapiens
tttgcagatagaatgttgtcaatgtcagcctcgacaattgaaatatccacataaattactaagtggtgaagctgtacgtagcaggctcctttcaagtacagggtttaaaggtttccactgtaggaatgatgcacaaattgcaagaggaagcgtgcatggactggaggatgcattatatctcatcacttatttggagacagccgctgtcaacacaattgtatagacaatattattcttcagtaaataaaaacacaccgtcacaaaatatcaccacacattttcccctgaacattagtaaacatggcagtttgctctgccactgtttgcaagtttactctgtggagaaaaacactaaatatctcctgctggttgcatttgccgggagaaaataaaattttctacttttgaattaaaaaaaaaaaaa

SEQ ID NO: 2562 - DNA, 543 bp, Homo sapiens
accaagggtcggagttataacgactccctaaagggcgcccagatttaaaggcctgcctgattgaatgtaagaagcattaccttcataggacaatttctgaattaaacacttaaaataagtggatgcttctttcttctcttcctgtttcctgctgacatgaatggaggcacagtggctgaaactggaaccacctcactgaatccagacatgaattctacagattgatgagaataaggctgttctaccattcctgacttttgaagatatcttattttgacagactcaaagatctagattgcaaaaacctggaaccatttgtcatgtaatgcaatctccagttcccctgcaccatcaggaagtggatggaaaaatggggcaaacttcccaatacccagagggtaataagtaaaaggccagaatgagcagagatgaaaaccatattataagcagatcttgctgtatttcttggggagcaaatctcaattcctgcctaagagaatcaaataaagtctatgaataggtaaaaaaaaaaaaaaaaaaaaa

SEQ ID NO: 2563 - DNA, 752 bp, Homo sapiens
ttttttttttttttttgagttttgtggacattttaattttagaaaaatgtcattgtaagtgaataacaattttctccgaaataagcagctttccttagaagttagcttgggactgattgatgtgagtccccgagagatagcccttttgctgaatcagacagatctttcatctatctctaaaaagtaccatctactccaggaaacctggcagtttctactacctttatctgcattgctttgcttgtgacagtcctttgcatatatgatggcctttttcagtgctttctaaagctatttttaatacaaatgaaggatttgaatttaaactaaaatccagctgcacgcattattattaaagataatttcgttgtggagaaaatctaatcagtagatatttttattgatgttaatgtgccaattctcagacaataggagtacatctttttttataaagaaatcattttaaaattgatcctaatttcagaaaccttaaaatatgaaaacaacattttagagttaagggtttagctaattaaatgttttccaaatttaatcttagtgtttcttcaatagggagacactggtatatcttaaaaagagccctggactaggaggcagaagatctgagtgaaatcctgattcagacacttataggctgtatgactttgcgtaggtcatttaacctttggagactcctcgtaattggcgagccgcaaacgacccgagcgcggccataagttagaggggggagg

SEQ ID NO: 2564 - DNA, 240 bp, Homo sapiens
ccttgaggcaacgtcttgctttgttgcccaggctgctggccttgaactccaggcttcaagcaatcatcccatcttggccttccaaaatgtggggattacaggcagcattttggaaggtgacctggataggcctagatcttattgtttaatatacagaaacaatcatttttttaatcatgcaacctgtaaattatgtaaatctctattaaatgatatcatatgtcattaaaaaaaaaaaaa

SEQ ID NO: 2565 - DNA, 244 bp, Homo sapiens
agacatgaaggcagtgaagggaagggtgcgggaaagccaaagagagagctcagtgtttctcaatgcaattgtaaagcttgcctatgctgcagccaccctgtgacctaggtgggaaatatagcggcactttgaagatgacaggacagaaagatgaaaagcagtgtcttcaatgacatcaatgagcttctgaccccaccctgcaactgcctacctatggctagtcttgttctgtgagacaataaca

SEQ ID NO: 2566 - DNA, 961 bp, Homo sapiens
tttttttttttttttttaaatttaatttttatttataattagcacacggtattgtacatattcatagggtacaatatgatggttcaatgcatgtatagatagtgtaatggaatccagccattctattactgggtatatccaaaggaaatgaaattggtaggtctagcagacatctgcacacccatgtttattgcagcacaattcacaataacccatatattgtataaacctaaatgcccatctaatgatgaatggattaagaaaatatcatacatatacacaatgaaatacgattcatctacaaaatagattgaaatcctgtcatttgcagcaacatgggtaaatctggaggacacgaaataagccaggcacaagaagacgaacactgtatcatctcactcatatgttgaatataacctgttacttcttaggcaataaataaatggagattttttttttttacttacagctttgatagagcatcgatgttgagccattgaaaaatctgatggagcagaaagtttaatactaaatctaacctctggcagatatttaggacaaaacacccagggttctcgagctactttggtctcatagtggaattatagagattattctacgttcttgaaaaagggatttcagatgtcattcttcctttctttgtctgatatagaaagttataagccaggtatggtggctcatgcctgtaatcccagcactttgggagacagaggtcggcggatcacgaggtcaagagattgaggctatcctggccaacacggtgaaactccgtctccactaaaaatacaaaaattagctgggcgtggtggctagtgcctgtagtcccagctactcaggaggctgagacaggagaatctcttgaacctgggaggcagaggttgtagtgagctgaggtcaggccattgcactccgacaaggtgacagagagagactccatcag

SEQ ID NO: 2567 - DNA, 669 bp, Homo sapiens
accctctacagcaacactgcttcaccagacaccatttatagtctacaaagtgacacacatctatcaagtgtgaagaaaggttttctgcagagctgtgtcacacctgatcacctgtgcactaaatagcaaatttattccaagaccagcaacgtgaagccatctgacaacctgaagccatctgagatactggaaagagcatcagaaaattcgaacagaactgccatccaagtagaaatcactggaccatactattcacctaattacttctatttactatttccgtctctatttactacttaaaagaagtatgagttaaaaatgtaaaataaagctgcaatttttaattatgaaaataaaacttgttaaatgacatgcatttaaactctgaggcaataagttattattacccatataggtttactcatctatatagaattgtcatagtgagattatctttccaatattgattgattccaattatgttgagctttaaaaataaagaattatttctattatagggcatgaccaccatagcctggtttctttctcccaatctcacaagacaaagacaagaaaaattgaatatacatttctaaaatgtctcttaaagtcaaatgacaatgacgaaagacaggacactctcctttgaaaatttacaatacaactttt

SEQ ID NO: 2568 - DNA, 464 bp, Homo sapiens
acaaatagacgtctcactctgttgcccaggctggagtgcagtggtgcgattacagctcactggagccttgacctgggctcaaacaatcctcctatctcagcctcccgagtagttggaagtacagatgcacaccaccacatctaggtaattaatctgaagaatacgactgggagacttcttggcagtagcatgagctgtctgaggttcttaaccttcttgtgtacagaaaagaccagtgttgttcaaatgactttacacttcaattaagctgggggaaaaactgattagcataatgaagaacaaagcctaaagcttgctttaaccaacacaaaccatttgaatctctaagcatttcataggattccacagcacaagatgtgaaacttcatctgaatttcatcaaagaaaacctcaggttgggaatgcagcaccaataaaactttaacaacttaaaaaaaaaaaaa

SEQ ID NO: 2569 - DNA, 467 bp, Homo sapiens
ttcctccatgttttcttacttctttctgtttttgttcctacttgtctttctaaggcggagagcacattcttagctgaatcttattatggttccaaaataggaaaagcacaatcgaagaggagagagaattttcccaagcacatttaattttaatcttttttgtttcagactttcaaccactactggtgaccacatcctatcattgatgagtctatgtctattacaactttgtatattatatcagtgttctcttttctggaagagagaagcggcaaaaagcatccttggaattctcttgacagtgatgacacattactgaatatatggatgattgtaccttgtgaactaatatttgcaatgaggttttattttaattcattgtatagattaatagcatctttcagtcagggactatgcatattttttaaaaaataaatatgaaaaacgtgacactaaaaaaaaaaaaa

SEQ ID NO: 2570 - DNA, 325 bp, Homo sapiens
ctagatggattttctccatgttcccaggctggtctggaactcctgacctcaagtgatccccacctgcctcggcctcccaaagggctgggattacaggcatgagccaccacgcccggctgattaccacgttccttcgatgtctcattaaaagtgtttcaggagccttcgtgtctcacatttttaaagccaggaagtattttagttggctatataacataaatgtaagagagccaaatcctaagaatatgtgatcctttcttatcttcgttgagaaacctttaaaatgtctaaatagtacaataaatcgatggcctcgttggcctca

SEQ ID NO: 2571 - DNA, 272 bp, Homo sapiens
caggtaatacatttaccactttgggaagcttaggagggagcatcgcttaagaccaggagttcaagaccagcctgggcatcatattgatgtctcttctaaaagcactactaatgcaataaaatgtattctcgttgaaaattacatctgcagagaataaaacaggaaaaatctgctgtcttttcacactcaattgtttatcttctgatctgattcatcttgccattgtatgttgcatataagttgtaataaactaaaatttaaaaaaaaaaaaa

SEQ ID NO: 2572 - DNA, 204 bp, Homo sapiens
gcttaaagccatccctcactgatccctgctagcagatgaatatatcggaaggtgatgagtacgaaggagcttggctgccagccaggcggtgtcggaaaaggatgggaattatgttgttgtgaacctaaagctgctccaggaaagtctatcgaaaagttaaaaacatttaaataaacaaataaaaggatggcctcgttggcctca

SEQ ID NO: 2573 - DNA, 308 bp, Homo sapiens
tataggatcaatcacagataatacaccagcattaggaatgaagatttcctggagctctagccacactccgctccctctgctccctgctagagaacccacgggctgctgtttttccagccaccattcagttggagaatacaggcttgcactagggtaagctcaagaacatatcatgagaaaactgccagacttaaaggagaaactctgaagcataaacctggtgtgatttctgtggctaatacaaaggttgtaattttatggaaaagttgtaaaaataaaagagaggcttttctttaaaaaaaaaaaaa

SEQ ID NO: 2574 - DNA, 561 bp, Homo sapiens
tcagaaccaggaccttctgccttggcctcctacctgcatgagtggctggccactcttagcatccactgcccaccctctgtggccacaggcgattctgctaatctgagccatctgtgcatcttgatcacaaggaagataccaccctaagcctccaaggccagttggccaaacagagatttggccactcctccaggaagaggtttctcactatgtcagacgcatctctgtcagaagcccttgcaaacagtcaaaccattttgtactatcatttctgatacgcagctcaagaggcaccatgggtacaatcacatctgacataatatagctgctagaacacttggcctggcagttttagaaagggactttcatgattaaaacactctttctcagggcagcatctgcgatgccacctacatcttttgcctgagggattcccagagggtcaatatcacctccttttcccttcttttgctaactcagtgaagaaagagcaaagatgagtgagtcagagcttgggataaattattacacatatgtctgtgcatgtttgcatctgagaat

SEQ ID NO: 2575 - DNA, 777 bp, Homo sapiens
cagaaccaagctcctccccctggggttcctgaagcagaaaactctaggcagtggggtttggtcctgttcttcaccctagacctcggggactgaaaggatcctgctccttttcatcccacgtggaggcccagggcaccgcaggaagaagtgggaaacgaggacgtcctggctctgctacccacagatggctgaccccatggtttcctcaactgtagaacggcagtctctcccactgtgtgcctcacagagcttcgtggaagacatgcacaaaacgaggtgtgcaaagcatgaactagcccaaagataagaggaagcacctcatctaccatgaaaggcattaacattcggtccctgctacaggttaacctgctcattctgaccatcccggccaagtgcacacctctccccaacctggagtcgctccagccctgtcatcctgcccaggactccaggagtcctttctagaactctcctcacaacatccagccatattacgcaaccattactaaccaccaagaaaatagtgctaatgacaatatcacaaagcagtgcccactggacttgctctcacctcagggccttttgcacctgttgttcctgctgcctgaaatgccctattcctgaatatctacctgacttgatcccttgtctcttcttgcgattgtttttcatgtcattgaaccactgcctggcccattttttaatcctcacccctctccccatccttccttctatccttccttttttcatctctaattatttcccctccctcgacgc

SEQ ID NO: 2576 - DNA, 348 bp, Homo sapiens
ctagccgtgacactgatgagtttgctgtatcaacctgtaaggagaagctctctccggatggctatgggaatgaaagaatccgacttctactctcacacagccaccgtgaaagtcctggagtaaaatgtgctgtgtacagaagagagagaaggaagcaggctggcatgttcactgggctggtgttacgacagagaacctgacagtcactggccagttatcacttcagattacaaatcacacagagcatctgcctgttttcaatcacaagagaacaaaaccaaaatctataaagatattctgaaaatatgacagaatttgacaaataaaagcatggcctcgttggcctca

SEQ ID NO: 2577 - DNA, 414 bp, Homo sapiens
gctaggtcactgcctcctttttgtcagtagatggagcctaagccaaggtttgccttggctctagcaaatgatcagatgtgtgcccatctggaatagccctctcacgcaaaaactcaagactggaaaagttggattacacctttaaatcgcttgtttgttttaggacagtttaatagcagttagctatcttctaggatgaaggagaatatcttattgttgtcttttgacatgaggaacaacttgacttggcaaggaattcttttctttttgtgtttaaagtacaaaatatttgagaagacaagtgtttaagagaaaaataagcctgattatagttcactttacaaaactgatttattttgccattatgtgtttcttctttcctcttaaaataaaaagctggcctcgttggcctca

SEQ ID NO: 2578 - DNA, 274 bp, Homo sapiens
agaactgctcctaactcctcaagaatgcaagcatcactctttccaggaatacatctatacgtctgcacgagcatagaaaaacatctgctgtgaagacacacttgaactgtaaacagtggttaccctttgaggctgggaatgacaaggaggtgagagaagactccacgttgtgctttataatatattgttttggttttttgaaaacagtattaattttgtaataaatgatgctgaaataaaggaaaacagtaaagtcttggcctcgttggcctca

SEQ ID NO: 2579 - DNA, 769 bp, Homo sapiens
ggtagagtacacaaatcatctcataattcgtaaaaaatccgaaaggaccctgtatggccaaaataatcttgaagaagatgaaaaaagttgaagaatgcacacttcctaatttcgacttaccagtattctacagtaatcattgtggaactattaatagcatacagacatattagactaacagaatggaatagagggccccaaaataaatgccagcatatatggtcaaacgatttttaacaagggtggaaagaccattttatggggaaaataacaatctttccagcaaatgaagttaggaaaactggatatccacatgcaaaagaataagctggacccttaccttacacaatatacaaaacttaactcaaagacctaaaactataaaacctttaaaaagcacaggggaaaagcttcatgatattgaatttggcaatgacttcttggatacgacaaaaaatacttacaataacaacaaaaaatgataaattatacttcattgacgttaacaacttttgtttatcaaaggatattatcaatagagtgcaaaggcaacttacaaaacgggagaaaatactttcaaatcatatatctgaaaaagattaatatcctgattctataaaaattcctatgattcaacaacaaataatctaacaagttggccaaaaaatgtgcacacgacttgaatagatagttcttcaaagaagagaaaatcttggtcaagaagcaaataaaaagatgctcagtatcagtaatcattagggaaatgcaa

SEQ ID NO: 2580 - DNA, 776 bp, Homo sapiens
ctacgctttcttcttgctgttgcctcatgaaaaaaagatgtttgcttccccttctgccataattgcaagtttcctgaggcctgctcaaccatgctgaactgattttagaaatattcctgtagaagaaaagcagcaacatgaattgaagctatgcccactgaacttctccctttaaattcaataaaatattaaatttcattgcacaaattttgtgatcgtattaaagaaaaatgtgtttttatgtctctatatatgcatacatatattttgttacatatgcagagggttttctgtactgacattttcctactgctgatattttcatctgtgtggcaaaaatttaggttaaagataacagctcctttgtttgtatacatctgtgtaatactggagtaagcactgcttgcatttggtatagttgttttgataaaatgctggtttgacttgctataacaatgttcaagatttttacaactattcatcggtgaaacttttctattgattcctactttttactctgttatcatattttgataaacatattaattttgtaaaattattggaaagtttttatgtgatttccacaagctaaacaatttacaaaatagtgaatttctattatttgtaggaaagacacctgttatattgtcttagttgagattagcatactttttaaagattattttcatagctgttaaattttgatatgaataatggtaacatattccatgttttgtaaaataatttaagcacttttctttgaaatgtgtatgggt

SEQ ID NO: 2581 - DNA, 337 bp, Homo sapiens
ctaggttgacaagtggagtgcaaatcataactagagaactacagaaaaataaagcaatagagcaatggagcttattgcaattacagacacttgggaagaatatatacagactaagctgctaacatttgttatctcataaggtggaatgagaaaggactcgcacatattgggattggatttttaaaaaataaccatactacttttctattaagaataaatgtaatagttcttaaataataataatttggctttactttcacacttaccaaactgacaaaaaatttctggtctgcctgtcagttgattcttgaataaatacctggcctcgttggcctca

SEQ ID NO: 2582 - DNA, 520 bp, Homo sapiens
ctagggtaccagcatgcagtttacagcatcggtgtgttaatgagctgcagaccacataaatttcaataggataatgatggttcccaaatatatccttagagacagagttttgctatgtcgtcccggctggtctctaactcctgggctcaaggacatttgactgccttggtctcccccaaagcgctgggattacaggcgccatgggctaacttgctggagagccacatggagagactgtatggaaaaaccacagggagagggagaagccttgagatcacatggaagagaactgaggaattgagctgacaatgagaattgaggtcccagcctatggtcccagttgtgtgttccagccagcatccagttgtttgaactgcctctatactagtaaacaagtaattaattaatacaagtaaatgaaaacaagtaataaagtaattaatacaagtattaagtgagtgaaaaaaaacatttacccacagaattgtgagcaaataaagtggtggcctcgttggcctca

SEQ ID NO: 2583 - DNA, 147 bp, Homo sapiens
ctgagacagattttgtatgagggtaagcaacaagaaatgtcctcttggaaaacactgagtgctaagaaggccccatgaatgattttactgataaaaagaaagaagaggtttttaaaacaccagccaagccaatttctctccctcact

SEQ ID NO: 2584 - DNA, 795 bp, Homo sapiens
ccctaggctggtgaagacttgttcacagatcagcatcagtctgaagaatatagaaaccattgctctggccagtgcttctcaaccacgcagataatataataatatttgtaagcactctcgagtagaagagtgaggatgctcatcaccaaagacagcaggcttaagagtctgaccaccccaagactctgcctcgccaccccaaagagaagacctttaatatttccacacatctggaatccatacctgttgcaaatctctgtattagaaacccaacccagtccatgatacatggattcttgttagtgttcatctcagaagtatgccttttccttacattgagttaggactacatcttcctctggggacttttgtcctctaactgcagtaatactgaaacaacttaagaggacaaagaccaaatcgttttcaagccccatgaagcatttcaaaagttctactcacaacaggccccggtgtgtgatgttccccttcctgtgtccatgtgttctcattgttcaattcccacccatgagtgagaacatgcggtgtttggttttttgtccttgcaatagtttgctgagaatgatagtttccagcttcatccatgtccctacaaaggacatgaactcatcattttttatggctgcatagtatggcatgggagcctatgtgccacagagtggggagggatagcattagggagaggacctaatgctaaatgacaaggtaatgggtgcatcacaccaacatgggacatgtatactgatgtaacaaacctggacattgtgcacatgg

SEQ ID NO: 2585 - DNA, 461 bp, Homo sapiens
gttccccaaaggcagaggaacttccattaacatatctaagctggggaaggacattttacctttaaatgaaatttggagtattagattcatatattggactagagaatcatttttaaattctttttaaagttacctttaccatagtactattaacaatttttttaaaaattataaaatttcttgagcttttattcaacagcaggaaagatattagcccatattagcaggattaaagagatagtatgaaagaaaataatagagttttataattctatattttcatattaagaatattgtttcagtgagactgtagaacagaatttagtggatattgttaaaatggatttagtctcgcgcaacgacagaagtttgtatcttgttttgtttattgatgtatcccaatagcctaaaatgcattggacataaatacccccaataaagatttgggctcgttggcctca

SEQ ID NO: 2586 - DNA, 224 bp, Homo sapiens
gctagtattgacgagcacaaaagttttctgctgtctttggaaacttgtctgcaaacagctcaaaagagatgcggcccaaggactcaccgtcgacagagatgtggaagaacacggtggggttgaccatggctggtaatacagagctcccgacggcagcatctgcaaagcactcagtgaatgtttatggaataaagtggagtcctgttccctcaaaaaaaaaaaaa

SEQ ID NO: 2587 - DNA, 193 bp, Homo sapiens
ctggattaccaccccatctggcccacggatgcagccagacgaggtgtggacacatggttcggaggaatttcagaagttaagctgctgctccagaagtcgaatgcctgccctcagggcatcccacgcactctttgttacatccttaagagcaatttaaaagagatcaaataaagctgtggcctcgttggcctca

SEQ ID NO: 2588 - DNA, 561 bp, Homo sapiens
tatactgcttctctgccatgcatatttcacttgctttgtgcttcttttaatgatgtttacttgaacttaaagagaaacacattatcaacatcgtaatttttagttgcgtgttagcataattagacaattcaggtgatactagcctgcagtctaagtcatatttacaatttaaaaactgataaataattagaaaatcaaccaagtgatacttcatattgtcatgtatgtctgcctttttctacagggtcctctgctcatgtccatcctttcttgtgactgaggacagtgagggcaaagctgcccaaacgcatcactaatgaccagatgcaaacatgcttgttgaatgattcattttcaagaaaagttacatgcttgacctctctcttccaattacatgtgggcttcattttatttctgtttttactggctaatggaacttaaattggaaaacctgtgaccctattaacctgctctttaagtattaacttggtatctggttactgtctttccttcattaaacctaaaatcaatgggggtaaagcccttttttttaattcaaat

SEQ ID NO: 2589 - DNA, 837 bp, Homo sapiens
ctagaggctttgctcttcagagatcttcaaattttacataggaatcatgtttttcccgggatgtcaaagataaactggagtttcaatcttgctatcttaacaagaacagagggagaacaaagaataaaacaagaaaataaagctgactatattaaaagaacagagactatggaaatgatgttagacaaaaaacaaattccagcaattttcttatttgagttcaaaatgggtcataaagcagtgaagacaacttgccacatcaacaacacatttggctcaggaactgctaacaaatgtacagtgcagtggtggttcaaattttgcaaaggagacaagagccttgaagatgaggagcatagtggctggccatcagaagttgacaaagaccaaatgaaagcaattatcgaagctgattctcttacaactactcaagaagttgccgaagaactcaatgtcgatctttctacagtagtttggcatttgaagcaaacaggaaaggtgaaacagctggataactgggtgcctcatgagttgagcgaaaataaaaaaaatcgtcgttttaaagtgtcatcttctcttactctacacaacaacaaacgaaccattttttgatcggattgtgatgtgcgacaaaaagtggattttatatgacagctggcgatgaccagctcagtggctggaccgagaagatccaaagcgcttcccaaactcaaacttggtgactgtttggtgggctggtgcccgttctgatccaatacatctttatgaatgctggtgaaataattacattttgagaaatatgctcagcaaatctatgaggtgcaccaaataccgcat

SEQ ID NO: 2590 - DNA, 614 bp, Homo sapiens
taggaatatgcttcaatgtgaggagtcttctgaaatgatttacaaattagtagaaaaaataaacagaacatatatggatacaaatatatatggatataacacatatgtgtgaaaaaatacagacggggtttcaccgtgttagccaggatggtctccatctcctgacctcgtgatccacccgcctcggcctcccaaagtgctatgattacaggcgtgagccaccgcgccccaccttcagttctttttgtacacctgagtcatcaatctgtttgaattgtggttcttaaatagataaggcattatttctcaaattattctctttttgtcactaaatattaaatatttcattcctgaagtatttaaataaagcaactttacatatttctatcaattgttgacattcaaatcagtaatttcttaattttttttggctagaaaatttctgaattctatattctaatgaaaaaataaaatattactttgcattttgtttgttttaatattgtcagtagaatgtagaactttgaaatgccaaaatatgttaatgttagacttcctagtggttaataagaattatatttggatgacatagatgcttgccatagactactttg

SEQ ID NO: 2591 - DNA, 783 bp, Homo sapiens
agacaatgatcttccttgatcttaaagctgaaaaaagtggcatgattttctcctactgtaaactattcctcaagcagatgacactctttctttgagctgccaagtttgagatcagtaagcagttatatcataagggcaatcatggaggtcttcatagaaatgaattgagcagatacctatgaaacttgaaaaagcaatgtgaaatctaggggaagaactttatagagggaacagcaatttgagattatttctcttgtgagtctaaatcgaaagagaggtcaaataacatttgtgaggaaggatatatcctctcatgggcctaaaagtaaataggtttttcccccccgaccaggtagcttaatttgtaaaaggacaaattttgatctgatattatagagggaaaaatacgtgttgctcttgaacttaagaagatgaacaacaacaaaataagcaataataataagcaacaacaaaaaagcaataatataaactacttatattctagaaggtagaaggctaccctttaaatcacccaaaacccagagacattaaaactatacacaaatgattactgtaaaataggctcccttacatgggctgccatcttgtggtacaggagaaaagtgttattattttgactgtattaatgactactaccccccgttctgagttgaccacatctggggtcctgggagaaaaaaggatgccttataactgatctttaagattaaatacctttgaattaaattaacattgcgtgcagcaacttaagaggtgtagtta

SEQ ID NO: 2592 - DNA, 761 bp, Homo sapiens
atggagctggagccattatcctcaacaaacaaacacagatgctgtagatgcggcaaggaagacagctattagccatggctccaaagtacttatgagatcagactcacaattaacatgtgaacaaataggcttttttctttggatgttaaaatctctgcaatggaatgcctgacaacttaattagatctgcagacagtcctgaagacaaatctggtacttcttggagcgatggaactcacatttatagagcttgggacttgaaaatacatgggattactcatacattctcatggtttctgccaataatcaaatattcattaataaaaatgtatacttttcatgaattttatgtgggtcatacttatagattttgctcacatttattaaagttgatagatagatagataatatatataatagcactgtacatttgcagattttttgtttttttcttttagaattttcctttttctctggtatttaattttatacgttctgttttatcaaaatcttaattgccctaattcactatctatagaattaaaaaataaatgcaatggtattctgtgttttcaaattttggttataattttgttaaaaattaaattaaatgtaaaggtaaataaaattagttgttttatttatattttcaaaacagtatttttgccaaaatattcaaaatcacattttaaagttaaaatatataaattccaactaaataaccaaataaaattaaataaataattttaaaaaaaaaaaaa

SEQ ID NO: 2593 - DNA, 424 bp, Homo sapiens
ttctgcaggtcagaagtccaaaatcacgaagtcctaaagtcaagatgttggcagccctggttctttctggaaactcagaggggagaatcagctcccttgcttttctcccagcttctaggggcctcggtcaatctctgcctgttttcagattgcctcctctgaccctgacgctcctgcctccctcttaggaagccttttgtgatgacattggactcacctggatagcccaggcgccactccccaccgcaaggcccttcgcttaatcagacctgcaaagaccttgtaccacacaaaacaacgctggcagggcatgaggatgtgggtgtaattggggaattattatttagtcttccacgccatcatcctttacaaataaataaattaggacaaagaaactaataaaaaactggcctcgttggcctca

SEQ ID NO: 2594 - DNA, 283 bp, Homo sapiens
ttctggaggccagaagtatgcagtcaagatacacagcaggaccatgctgtctctggaggatctgggagactgtgttctatgcctttctcttagcctctggtgttgctggcaagccttgacattcctgaacttgtcaatacatcactctaatctctgactccattgtcacaagatgtcctcccctgtgtgtgtgtcttttgctgtgccttactagagcatgttgatccccatctgtttccttgctctgctaagcaataaaacttgaaaatgaaaaaaaaaaaaa

SEQ ID NO: 2595 - DNA, 453 bp, Homo sapiens
acaggtttgattcttaatcgaagagctgcataaaagctatagctgaagtccatggggaccacgggaattgaagaaacttggagagataaaagtagaagttggcggtctacaatccagaagagagtcctcatcagaacttaaccatgctggcacccggatttcagacttccagtctctagaattaggagaaataaatttctgttgtgtctaagccactcaaaccaaggctgctgccaagaggaaatgaatggtgtctttgagatattcacaaacatccggtgcggatggggaagctcactttgagagccagcgtttattctattttctgtatttgatccattctcaacaaaggccgttcccaaccctatctttcacagtgtctttctgctgcaccagatgttggaataaatctatatttctttatcaaataaaagtatggcctcgttggcctca

SEQ ID NO: 2596 - DNA, 308 bp, Homo sapiens
ttggctccctgcccaggattgaacacagaaggctctgagaagcaccagaagttctaccataagcttctgaagtcagctgacaaccactgagtcctctgggaagtcagaactctgtgtaattgcccaaatctcctccaggcctagctagacttgacttcagtgactagtggttcatttgctcaatctgtctgatagctcaccaggggaaaacaggcttttcatcacttgtaaaatgagaaacatcacattttaaaacaatatatataataaaactcctctagtctctttgaatgttaaaaaaaaaaaaa

SEQ ID NO: 2597 - DNA, 361 bp, Homo sapiens
ccggtggagatggtggtggtgagatgcagggagatggagagaaaaatgggagcaccacctttctttacaaagccaaaagctacatccccattgacctagatgtcataagagttttttttccccaaagggcaccatgatggagaatcggctttcccaaggacacacatacctttgtcacaccaagcaccaccttgtcctcagactgttcttgtactggctttgtttacaagccagattttttttaaaatgagaaaaatcaaatgttcacttaagaagtgaaatttgaataaaattacagtttcaggcaaagcctatattatttttaaaatcagcgaatagagcaatggcctcgttggcctca

SEQ ID NO: 2598 - DNA, 491 bp, Homo sapiens
ttgccgagcacgccctgggtctgcaaagaactcagccagctccacacccagacgctaaacacatctccactggacatctgaccgctaccaaaaaggattcacttgacattttgttgtgtgattgcaaaatgtatttacttatttatttgctaactgaaagacaaattgtttcttgaatacgatgggcctcctaggataaatttggcctattatacacttagtcaagtccattttcttttaattatttggtttgcattctcacggaaaataaatctagtgcacaaacagcaagtcttaaaaagatccttgccatctgatataaagcaagctggcaggaacaatatttacaaagcgcccatattatggccatgtggtagcacatccaagaaattggttattatattcaaattgttatttgatgatgatggtgatgattttcataatacttattgcactgaatcaacatctctccaatatgaaaaaaaaaaaaa

SEQ ID NO: 2599 - DNA, 473 bp, Homo sapiens
cctaggatcccactcctggatctcacttttaatcatcatgtgtcctcaggctcctctgtggcagtttctcagtcttttcttatttttgatgaccttgacaattttgaggagttctggtcagctcctgtgtgtgttttctgcgatggccgcaactgcaactttccagagacatgttcttgggcagctggaggaagatggaagtgcatgggagtctatcccactctaaaccctaccccagtggcccttagccactgaccgactgctacaggaataaaaacacagtttatttgcttcaagttgggataaactccaaggcagaatttatactgcagagctcccctgtgggatcaggtttaagctgagactctgcctcaaatcccacccgcactttcctccttgcctacccctgtcctgctcccccactcccttactggctgcccctccttaataaagcactggcctcgttggcctca

SEQ ID NO: 2600 - DNA, 625 bp, Homo sapiens
attatcccataagactgcaaggcatgcaatcataaagtttaattcacagatctcagccacagaagctaagagaatagaagaaatgatttttcttcccctacatctaccacaggacatcttttgagatagactcaggaaattttgaattcatggaagccagactgaaactaatttatagcttgcaacaaaatgaagaggagatttcatattttttttccttttcactaatcatgactgactccaggttctactctccattatcgatgactatgtaaccctttctcttcctttggaccatagaaattaacctatgcttcccatcttgctaactccctatggacaacttcatcttttatttttacccttttcctatcttagcaacttcagtacctaataaaacaatgctccattagacctttccagtagttgtaattatctaaataggtaatcttaaaattgatttagctaataaatgtagatgactaaaagtatccttttcagttttatgaaaactgaaacttgaaaagctaaaatttttacattttgagaacgaatgtctgtattctatgatcaaattaaaactatatgcattctaaaagttgattttttagcctttttaagacaa

SEQ ID NO: 2601 - DNA, 255 bp, Homo sapiens
ttaaaggtaactattataatatcaattataaagaagaaaaaaactcactggaaccctcctgtgactacaagactaggaagctgtgagcccatgagactgtgagactttgagaccacaagcttataaagctgcaaggtgacagcatcccaagatctcctgcttcgtagcctcattccagcctctgcttgcacaggcaaattccatttaataaaatactggcctcgttggcctcagcggtggagctctgcggccgga

SEQ ID NO: 2602 - DNA, 478 bp, Homo sapiens
ccaggtcattttgataccaaaaaaaaaaatagcttgaaagcagcacggcaaatagttcctgtggcttattactgttttattggaatgaagtggatcttggcccatttcttttcatttatttgaactaaaaattaggtctctcatttgttttactgctttcatttttgagagaagaaaatgatgaatgcatccatgaattttttcagcaaagaatggcaataagaattcttcactgcccaacatatatccattgtatttctaactccctttttcgctgttggattaaaatttgcttttatgaatatgaataccgccatttccttctaaaaaaaattgttctgttttctttgttctattttctcggctcagctgaccttgtactttaaatatgatggtgacttcattcaaataatgttacaaaagctaaaatggaaaatgaaaataaaaactgtaaaaagaaaattgaaaaaaaaaaaaa

SEQ ID NO: 2603 - DNA, 360 bp, Homo sapiens
aagaaaaagaagagaaggaggaagaaaaagaagaggaggaggaggaagaagaggaggaagaatcagattcctaaggtatctgcaatcagattcatgaaaaagactctaacaagtactcttaaatacaaatttctaataacttcaatattaatggactaaatacaaattttccaaaactccaatgcaaaaattaataaatctgcaaaactgctaatcaagataaaaccaaaaaattagttacatgagattaaataacataaaagtaatgtttttatgacttttatttaaaagtttatttggaattaaagtatttggctggctaaaacaaatacattttttaaaaccttaaaaaaaaaaaaa

SEQ ID NO: 2604 - DNA, 222 bp, Homo sapiens
tttcaaatttattaacttaccatattatataacagaaagatgtctggcttaaatagctaacgacgacccatgattcaaagccaaagaggaaaacaaagaagtgaagaattggaattcaaacctttggaaaagcagaacaagtctaacacccacttctgcatgttcaaacttgattaaattcattatatattttagaataaaatcttggcctcgttggcctca

SEQ ID NO: 2605 - DNA, 243 bp, Homo sapiens
gctagggaaaaccaacacctcatgtagtgaaggactgaagctcctcttgggctggtattcctgaggcagaacacaggtccctcaccccgatgcccacgaccactcagtaacaacatctaccaccattcggaggcaagacaaactgcatgagtaacccagcacagccactcagatgtcacttcttcctggtgaagaagcagaaccctagattcacaaaataaacagttggcctcgttggcctca

SEQ ID NO: 2606 - DNA, 769 bp, Homo sapiens
gagaacaaaaaagaatgggaggctgttggactcccaaaattctactggcacaaagtaggatgatgaaagtactcagtggcatacctatgctgccttacataagaagaggattactcaagggcaggaacaagagaccagaggatggagacagacccatgaagaattaaattaagacccttgaaacctaataaaggaactctggctggagttttaccagctggatttgatgactactttgtaccagtgatcctttttatcttctactcccccatgttttgaactagaatgtcttttgctgttatcctatgtccaccccaccatctaatgttaggtgtgttagaagcagatagtactttcaaagatcacagatacagaagaattatgccctaggaagtgtacttattggattacatccaggagccttatctacactagggtctgggttaaatggtgacctttggaccctaagctgatactatattggtatgggattcttgggaatatcggtaggtagcaaaatacttgattcttggaggatattattactgtgggcctagggccatttttgcttcagatcctaagcgtatttcattataacccatccaattcccttactaaattgtggttggtacctgttgctagtttttactcatcgatttgattaaatctgctgggttaaaaaaaagaaagatgttgtctttttttaaccacatccccttgtgttaaataaaactagggttatgttactatataatggaagctattgggt

SEQ ID NO: 2607 - DNA, 290 bp, Homo sapiens
gcctaggtgccacggccacagcagtccctactgctgaagtgaagagatggccagcatccaccccaagatgcttcattctcttctccatcctggaatacagatgtgatgcctggatctcaagtagctatttggggctgtgaggtgatccactgaggttggtggaggagcaaaattataccagaggcctgggtctctgttgactacagaacttccaaaacagccctggattaactacctgcagactgtttttgtcgcaaaagagaaataaatatctggcctcgttggcctca

SEQ ID NO: 2608 - DNA, 664 bp, Homo sapiens
  misc_feature (1)...(664): n = A,T,C or G
ctgctatgactcaatgtggcctgtggctgccctatgggacagtgcggatagcatattgccataattgcaggaagctctattggacatcactgcttgcaggctagaagctgtcttcgaggaataaggagtcttattgtgaagatatgatgctcagaaatgggacagccattttacagctgagaaaagaagacaccaacaccctaagaatagctaaatgaagagttagaaagagcctgggtccttggtgacatcactgagactttacaaccaaatgcccacttttggactcatgttttgtgagataattaaatatccttttgtttaagtccctgttctgttacttgcaactgaaatcattcctaattggcaataggaacagcagagagtttgagaaagaaatagagatgggagattcagctattccatgtatagaaaagtgagtaggatagtcaaaactcagaaccaacccagtaatcttcagtgatactacagatttgattaaaccacttatttcagatctgaaagcattgcatgtatatatcttttctcttaaaataaacctaggtcctcgttggctaaagcggtggagtgctgcggccgagtgtgacaattttgttgacnnnnncttatattaattttaataaaaatataataaatataaaaa

SEQ ID NO: 2609 - DNA, 576 bp, Homo sapiens
agggagcaggtgagcccagacaggcctgatagaagtcagtctgactcttccttgaccactttaagccccagtagccggcccagatcctcccacgattcttgctgcctcccgaactgcagtgtgagcaaatgagataagtacaaaatattcctacaccactggctccatgctctcctcatattcaatcatgaagactaatgaaccagagatgattacggtggtaaagatccaaatgcagatttttgctgtccttactaatgagagaaaaatatagtagaccattggcctaaaggctccagatgcgattcctttgtaacttagagtgcattaaaaaagcttcagtcagcaagataagttaatttttttatgacctttataaactcttttagcctgtatctcgggagcttcttaaagattaaattttaaaaaatccttttagctcaggccaacacagcatctgagtcttttttgcttccaaggctacatccaaaatctataaaaaaattctgttcatgacaattattgtcaaagtaatgattagctaacatgtcatttttagtttttactgttcttgcc

SEQ ID NO: 2610 - DNA, 185 bp, Homo sapiens
cctggtgctagaatggctggaatctgtcctgaactcttggcatcttctgatactcaacgatggagcacggcgtgaacatcatcctgctgcccaaacaatattgtctagactatgggtagctaaaaaatctatttgcaattaataataaagaaataaaaacaaagttctgattaaaaaaaaaaaaa

SEQ ID NO: 2611 - DNA, 791 bp, Homo sapiens
aggcattgattgaccttctaccatgaactttggagaagccctgtgcgtggatggatctccaggacctatagcccaaacgccatgctttcgcctgtaccttcaggaactctccagccagactctggaagatcacaagctccattccctttcttggacatccacatgttggctgttgctgtgtctccctaaagcagacagcatgcctggtgaggagattactgctgctctctgctggactccatgccaccagctcttctgcctgataagataattctggaccgcagtagttatgagtagtacttcttctaaggaaaggcaatgtgaagttcctggcaagtgccagccacagtgctgttctgaagaaattctcattggaacaccttcagttacaaattaagagatataactttgtaatagtgatacctatagattgagataggaaaataaaaccatttgaaattctcatcccatttttttttagacagagtttcactcttgttgcccaggctggaatgcaatggcacgatgttggctcactgcaacctccaccttctgagttcaagtgattctcctgcctcagcctcccgagtagctaggattacaggcgtgtgtcaccacgcctggctaatttttgtattttttttttagtaaagacaggggttcaccatcttggccaggctggtctcgaacacttgacctcatgatccacccacctcggccttccaaagtgctggcattacaggcatgagccactgcacccagcccttttgactttttgattgagccccatc

SEQ ID NO: 2612 - DNA, 529 bp, Homo sapiens
gctggtggccatagaaaaaaatggactttacttgggaaaccaaactttcttctcaaatacaacctggtgacatatttgagttgcccagatccaccatgtggaaatcactacccagtaatttaacatacataggggaatacaaaatcaaaaatccagatagcaataaccaagtcccatggcattattggaaactcttcattcagctgtgcttaaatctgtctaccactgaaaatatcaactagaaatgctgaaaaattgcctcagcatgtgagtacattgttttttcaacaggatcaaactttcaaattcacttattttaaagagtgtttctttcacgtatactagaaatatttcttatctctaaatcagaaatgcataaaggacatgtgttgacttaattaattgtattttgtgccttaaacaagaataatctatgagattacaaagtgatgataaaaacatttgaaagcctgttaatttgaacacaatgatgtactaatcttcatttgtttcccatgctacttcacta

SEQ ID NO: 2613 - DNA, 760 bp, Homo sapiens
aaaaataaaaaaggaaagcaaaaagaaaaaagaagaaaaaagaagatgaaaaaagcaactgggagtggatgaggtcttttccctgacaagtctacacctatggtctttcgtgacccatggcaaatgcagatggaagatttctgtgagtgctttgggagccaaattgcatggaggtcccacaaatttgggagttaggaacaaatcccaggaaattctagaacccattaaacacatttaagagtggttatattgaacagtaattgataacagcagaaaataagaaagttaaaccatagtttatctttcatgggtgtttcttgtaatttttctatacatacatgatctaggtaaatataatgattagaaactttaacaaactttgtacttaattaacattttattgtttgaaaaatcatatctcattggtgaaaaaattgtctagacctgcgtccagaagaagtgtggatgaagaggctcttgcatgggccctgctaggagttgctgacctgcttgtccatgtcagggtggacaggcctttcacgtgctaacccagtcaagccttaagaagaaaacaaaaccacagacacatcatctggcacttaagaagagactcgtgctccacgtatgtctattgcgggactgttcacaacaacaaaaacctggaaccaaccaaaatgtccacccaaatgtttatagactggattaagaaaatgtggcacattatggaatagtttgcactcacaaaaaggatgattcatgt

SEQ ID NO: 2614 - DNA, 572 bp, Homo sapiens
cataggtttcctcctgttctgtggatttctcgtaccatgccagtctaaatgcttgttattgaaaccagaacagccaacatgataatattggtcttcattctcttggaaaagaattgacagaagatactcaaataatgtgtgattagtattacaaaaagtgttacaaaaatgtgataagtgttacgaaggaagtacatcatgcctgagattaaagtaggaagtctttattgctatattatcctaaaatcaaattttatctcattattttgaaagtaataacaatgttaactcatggaattctacttatcttactattaaagttgtaattgctcatgcataactagtataatcattattagtcaggactttatagcaccccacattcatcatatttaaaagaattgccatgtaactataaaaatgtgacaactaggaaagtgtaggatagtagtataaggttagaaaatgaagatattttaggacttcgtgacactacctcaatggaaggtatattaaagttcgtaacatctctatttaatacaagcaaattattatatataaaaaaaaaaaaa

SEQ ID NO: 2615 - DNA, 771 bp, Homo sapiens
atgagagcccaaagatgaaaacaaaagaggagcccagcatcagaagcgttggggagcacatgttcacttcagcactgctggtctcgttgaccagggagcacccccagagagaaggctgcagcccccagagtgacctgtgtacatacctgtcttcacagctggaaagaacttaatgcatctatgtaaactgattaagaattacaaatcacaacgatgaaaccatcaatgagattcctttaataagttccacatatattttcgaggccatatattgtttctctcataaatgtaagcatgcaagcatttaagatacattttgaagtaagtcacacattcatgattttaaaaaatgaatacaaacaatgtaagtttatcttgattcaagaacacactcacaaacacatatatttcaccattaactatctttagattgcaccaattgaaacaaaaggccaacccaagaggttttgaaaatgctgtagtagtaacttaacatcaggaagctgggaatatgggaatccaatctgctgcacatctgtctgggataaaagatgagcagaccactattagctaccatttattgaccatacgctccatgccataccctttatatccatgatctctcttaatcctcatgacactcctgagggggaaacgggtgtcgtcctcaaatgccgaggcctaagaatattagcgaccttttcagattcccttcttttaagtgggataacccatgaaaggccgtctcagaggttttgatttcctagaaca

SEQ ID NO: 2616 - DNA, 793 bp, Homo sapiens
gctgggaagctcaacgtcaaggagcacacatttcttcttactggtggaaactttctgcacagtcctgaggcagcacagggcaacacacggacttctggttgctgctgctatttcaaacactgtcaaggacctccattataatcagccacctcctgctgaggacttctcccctcaaaccagcactcaattcatccagacaagacttttagctgagacatctgtggtctacaatggaatgaaaccagaatcaacaatctggttaaactgcacagcctgtctcatttatatatggttattttggtgcacatttgagctttctttgatttgcaaagtgaaaatgccaactttttgattattaatatatttcaattattttataataagaagaaattatgtatgtgctatttatgggctaataaaaatctcagctgaggtgaaaagatgagcaactggacagattaaactgaaactttctttttaaaaagtttaattgcatgtatttaagatgtacaacatgatatacatcgagataataaaatgggtactgcagtcaaccaattaacatattcctcctctcacatagttaacccctttttatgtggccagggcacctataatctactctttagccttaaacatccaagtccatacccgatcgattatcaactatagtcctcatttgggacattagatctctgcacttgtacacccttcctatcctggtctttagggacctctgaccaacattcccattactttacctatgcacttccaatccttgagaccactgcgt

SEQ ID NO: 2617 - DNA, 790 bp, Homo sapiens
ctttggacctccatcagtgttgtacaggaagattaagggctgatatggttgccttttttaccaatcaatcacagaaaatattcagtccttcatcataaagtatgatctaaagacttttggaacattattaagattaaatgaagccgtaagggtgagtccctaatctgacaggattggtatcatcacaggaagacaaaaagacaccagagagttcccttgctccccttgcatgatgcaacaaggaaagtgcatgtgaggacacagcaagaagacagccatctactgaagtaaaaaattaaaaaaatataacaaaataatagcataaataataattataattacaataaaaaagtaacaatagctcataaaataaactgctatattaaccaaggctaaaaaatttaaatagccccccccaaaattaaagttaaaaaacatattaactgtctctcccaaaaaaaacattaaccatatctgccctccatacatattgtaaactcctatttctttcttccctcgggttccaaggtcacaaaacaaataagcataagcggcaaaccaaattttcccggaaatataagacatattaccaaaatatcacagcagcctttattctcacttctataaagctgcttcctacttacataatgcctgcctcaaaatctttaaaaactcgtttctttatttaagctaattttcaaacactgtcactaactgatgtccccttaataacacttggctcattgcctcacggtggaactctgcgccccttcctttatgaggttataat

SEQ ID NO: 2618 - DNA, 1314 bp, Homo sapiens
tagggagagcagcctgggaattgaatcttcctttgcctgctccacctggagtgctaagtctatacgaagaacaccccttggagcaataacacccaaatacctgaaatgtgaagatgacaagcatgagtatcctctccttttgtgcctgaatttcctgctttaatcagaaaaaaatacttttaaaaagtgcaggcaatgttctttcagggttctcaagcaagaaaaacatccctttgcccatgttgcttccacaccatgcagctaatctttgatgacacagagtaacattttaccaatctcaataacacctgccctattgaagtccctgcattgacagacctgtctgaagccagacttcaaaacctcagcaatatcctgactgaggtctcctctctctgagacattagtaggctctgtgaagcgagtgctgccctcttaccgcatgactctgtcctgtttgctggttgtgcaagtataatttgggaagccagaattcacaggagaaacttcaaaccttctacctatgggaaattaggatgttctattcgatggatgtgcagttatgtactgcattggttgttctttgtggaggagacgagtgccaggcacctttattcagccatattgaagcccctcccatccattaatactatgcaagatggaaaattcttaaatgttttaaatgaaggctgaagagaaccagtaaagaaagatttaaagtatgaaggagcaataatatgcccccaccaatgtcttttcctactaaactcatcaaaacaagtcacagagaaacaatgggcaaaatgtattcactttttaaaaatcttcacttaatacatggttttgttgcagtgttcttttatataggaagtcaaatttgtaacttttaaaaataaatgagatttttgtttatttgttgtctcgaaaacgtttacaaaactcactgaaagcataaacaaagattttttttgtacatttaaaataattttagaaaaactatcacatatgcctaggacatacatttactatgaatcacagcttatatgtacagcaaatgtacaatccttttaatttgtcttcagttaatctgacctttctaatctccctagttttcatacactagaaataaaaataacttttgggtcttacctttattaagatctgatgaagacttgtcctccttggaatagtaacagtctcttacatcccagttaaccaaattccagactttggcctccaatatcaaggatcccccaagtggagaagagatgttaacaagcaaacagtggagtcagaagacactgggccagagat

SEQ ID NO: 2619 - DNA, 632 bp, Homo sapiens
gaaagatggaccgtgtgtgaattataagagctctgtttctaaagtgattcaactatacttgcacagaattccaaaagctctactgtttattactcttcattactaatacagcctttgattgtaagcaggctgtcctttgtgaataacaatcacagatacagacatcttcagacagttcaagtcgtgtgcttcaatcaaactctagtcggaaaagaactttcagagcaaggctgcttccacagtactgacaaaatctgctatatatcacataacattgcatggtgcactcactcaaactttatgtttccctgttttataaattcttaagagcactgcatggctcacaaaaatctaatactggcactctctatgttggcgattactgaatggaaatatgcatatttagcttgaaagaaagaagggtaatattttccttgcaatttattcaccatttcctttatataacctgaaatcatgagctttgtgacacattggaaaagaaatactttattatagaaaatataactagatagtaatgagttttaaagcagagtattgaccatgtataatggttctcacagatatgaaatgaaaaaatccgaaaaataaaagtaaatctcttaaaaataaaa

SEQ ID NO: 2620 - DNA, 792 bp, Homo sapiens
  misc_feature (1)...(792): n = A,T,C or G
cagataaacaagagcctggcacccagcatgggtcatttccagcacaagtatcataacatgacttagagcacacctgtctcacagagatccctggtccgagaaaggaagataagtagaaacatgaagggtaagacaagtctccctgagcctcaaaaatcagaatgaatggcctcagcccatcccaaaccaagatgaggagaaattcaggagactggtgagtaaagagaccttctccatgtactgtcataaagaactgaaaaacttcctgctacaatactttacaaatacatcttagactgtgtctggacttttttccgaggacacctagcaggcaatcctgaactcttgtgagtttacattcacaagaatagactcctgatcttcagagttcggagaatttaaacatttaaaaaattcttattaaaaatagatacaataaaagataaaatatgataaatattttaaataaataatataatttggttttaaaaaattgtaattatcaagagctggaaggtctgatagcaaaaatggaaataaaagccactgttgtaaaataaacaggattggtcatgatttaacctagggggtctgaagttgtaaatatgaataataaaggagtaatatagcattactcacaagcaatatgttaaaatatcaattgtcatactgtatacacatcgtttataaggggaagattcaaaatataaagccatagaattttaaaagcattgagaaaactgaggcanaccctaatanaaagctattgatataataacagatatatattcc

SEQ ID NO: 2621 - DNA, 130 bp, Homo sapiens
ttttgtctttttgtgaaagaatacatttattgtgagcagatgtgcactgtaagccatgttgaaggagttccttaattaaaaatggaagtagggattccttatggcttccttcagcaggctgcacaaacat

SEQ ID NO: 2622 - DNA, 396 bp, Homo sapiens
  misc_feature (1)...(396): n = A,T,C or G
ctagatgaagaactactgaggcaccttgagttgaagaaacttgctcaagttcccacaatcagcaattgacagagcagcaatctgggaccacggcactcaagagcatcccatgccttcaccactatgttatcctgtctttaagaacactgttgaccgtgaaatagaaaaagcaattggttgtttgtgctattaacatctaaggggtgtatacattttactgggacattctgcatttctaattctgtgtttctaatctgaaaactgaataaacatgccctcatccccaccctcacctacctcccctaaaaagcatacgtatcttagagctcaatgcatttggctagaatatctaataaagaacctatgagagtccaacacaggtnaaaaaaaaaaaaa

SEQ ID NO: 2623 - DNA, 666 bp, Homo sapiens
  misc_feature (1)...(666): n = A,T,C or G
agtgtgatgcaagatacacatggaggagatatctcacatgctcttgaccattggatccccagaaacctcactaaagtagaaatttcctgaaatgtggggtggttgaaatatatcttactaagacataaaagtgctttattacttcctgcacattctatccaatcctcaaatgtcctcaaagttttttgtcaaataccaaggcaatcatgacttttacagacttgtgacagagagcaggagaattgacagaggcacaacaagagggagtgtaaaagtaaacagtttctgatggtcagaggagaaagcattgaccgggaattaatcatttaatttttatttgaagtattttatgagccactctcttatattcaaggttaacttttcactctacaatgctgtcattacttgaatcttaagtaggaaactattgctcttagtacaaattcagtaaaatctgcctttgtgtaatgatgaataaagtatgtattagataaacatttacaaataataataataatgaaaaagtgcacagctctgtacctgtgggcagtgggggagctaagtacaatgatgaacttcttttagagaaaatntgaaatggatcaacatcaggagaatatatagaatctgtatataaactagctaagattttgaaaaaaaaaaaaa

SEQ ID NO: 2624 - DNA, 850 bp, Homo sapiens
aattctcctcttatttccaccaccattgcaccccaaccaccaacttagtggatgcagcaacagcaactcttgcctccaccatgcgaggagatatctcaacatgctcttgaccattggatccccagaaacctcactaaagtagaaatttcctgaaatgtggggtttatctcccatcctctggttgaaatatatcttactaagacataaaagtgctttattacttcctgcacattctatccaatcctcaaatgtcctcaaagttgtggaccacaatagtgttttgtcaaataccaaggcaatcatgacttttacagacttgtgacagagagcaggagaattgacagaggcacaacaagagggagtaatattcattctgccaggtaaaagtaaacagtttctgatggtcagaggagaaagcattgaccgggaattaatcatttaatttttatttgaagtattttatgagccaattacatcacttcttagactctcttatattcaaggttaacttttcactctacaatgctgtcattacttgaatcttaagtaggaaactattgctcttagtacaaattcagtaaagaaagagtttatcaaattccatctgcctttgtgtaatgatgaataaagtatgtattagataaacatttacaaataaaaataataatgaaaaagtgcacagctctgtacctgtgggcagtgggggagaaaggggtgtggaggagaaagctaagttacaatgatgaacttctttttagagaaaatttgaaaatggattcaacatcaaggagaattatatagaatctgttatataaaactagcttaagattttgaaaaaaaaaaaaaaaaa

SEQ ID NO: 2625 - DNA, 977 bp, Homo sapiens
tgcaagatacagcaactcatcctccaccatggaggagatatctcaacatgctcttgaccattggatccccagaaacctcactaaagtagaaatttcctgaaatgtggggtttatctcccatcctctggttgaaatatatcttactaagacataaaagtgctttattacttcctgcacattctatccaatcctcaaatgtcctcaaagttgtggaccacaatagtgttttgtcaaataccaaggcaatcatgacttttacagacctgtgacagagagcaggagaattgacagaggcacaacaagagggagtaatattcattctgccagatgttccctgtgtccatatgctgtctcggccaagctgtgatgtacaagtcatacaagtgccatgatgtacaatgatgagcaggacagacatggtccctgacctcagggagctccctgtgaaaggacaacaggagaaacaaacttgatttgggacttgaaaaaaattaatttagccattgagctcaaaataagtaacacaagagttcctccctggatgtattattttaaaacctaaattcggacttgagtagttcatccagtaaaatttggcatatcttcatccttcaataaccatctttcaaagaaagagttctaaaatggctttgtcccattaagactgatccagggctaggtataatcttgagaatactgagatcaaactctgtaataagctaagatcacaagagatgccagtattttacaatccccacctattcttttttgtttataaatatgacttaattttttatatttctctaatataattttatgatatcatccaatgaacttaatgctcacctcaactggatcaactgaaaatagctatcttttaaataatcacatttgtcgaaacaattgaagaacattaccataagtaagttcacaattgtacatattgaatcatgacaccaataaacccggatcggccg

SEQ ID NO: 2626 - DNA, 841 bp, Homo sapiens
agatggtgtttcaccatgttggccaagttggtcttcaactcctgacctcaagtgatctgcctgcctggacctccgaaagtgctgggattacaggcatgagccaccaccatgcccagccaaaaagctccatctttaaagagtttctctcctctctttgtctgatctaaaatatgcatcttttgttaggtcgctgcttctcatatagtatcgtgagcatttgctaattttaacatagcccatgctcactggacgaggcctgctagaaaatgccaggtttagctatgtaattattgaagtatataatggagatgcttcactgtgtaactattggagtatataattggagatgcttcaagatcagtattgttccctttctgtaaaataattttcacatgcatcactgagggctctgttgttttaaatacgaagcagggagcttaccaaaaaagaacccaggaatctggtgttgatgtttctcagattctagcatgacttacctgtgacacatgtttacatgcatttatttctttctttttggattttaagaacagtctgaaaatggcagcatctcaaattctttgggtcaaatttgcaatctgaatcagtatattctcaacaaataatgaagagtgaacacatttagtagcacggctactgcttcttccaccctgcagttcactaatctaaaaaataaatacattacataaatcataaacaaatttaaaaaatatttttataaaaaagttattaaattaaataataaaattttaaaaatgtaaagtccaaataggagcaggaatatgaggatttaataagaactataaaatgctcaaataaatca

SEQ ID NO: 2627 - DNA, 493 bp, Homo sapiens
ctttcagactaccttctcatccttcttggctctgatgaattaagctgccacatggcacagtccagtggcaagaaaatgagggcaaccaataggcagcaatgaactgaggctttcaatgatagaggcaaggaactgaatcctaccaacaaccacatgaccttgaaagaggatccttccctgtttgagcttcaggcaaagaagatttgaatctgagacactgtaaaacttgaagcagagtttacaatctgtgcttgaggatcccaaagacaccattcaacacatctcactatcctctaacaaggactgccctgtgacacatctgaaagagaagcaacaattttattcagactcttcatggactggccctctatttgggcaactacataatatgtagatctttgatatcatatctgagaacaaaattttgtcagctgtgcaggaaccaaattatcctgggatatagtaaaataaaccactggcctcgttggcctca

SEQ ID NO: 2628 - DNA, 576 bp, Homo sapiens
ctagatatggatctataacagatgaataaactgggacccaagcaccatcaagacagcacaacatggagcagaatggagattcagtagccatacctggggcttctttgcattgaccttccaattgggccactctgcctctaagaaaatggaccgtgaccccctagaatggctgtttctcacaagtgaattactgtgaactttttctgagaataaaaacaatatgagtagtattttttcttttcatttgttacttaataaaagaaatgatatttagggcaatattaccattacctatgcacttcctgaattatgtctctttcctttatttttgtttgtaaaacaattaatatcttcttaaaccacacgtcttcattagagatgctttataagtgaattgtgttccattaccttgaaccacagtaataattataaattaggaatacttcaaccagaaagaaatgactcatacatttgttttcatctgtaacatttattcaacagcttgataattgcaatatatacagtggtatgtggaaaatatttattaaaagacataatagaaaaaaaaaaaaaaaa

SEQ ID NO: 2629 - DNA, 335 bp, Homo sapiens
agagtccatgtgggagagaaacaacccagcaggactggacgggttgtgaccatcgctgccttccaccttccctttccgactcgaggacaccaagtcagaggctcagccgcctgccgaagtctcccagctactgaaagatggcacgggaggtggagccctgatgcctccaggtcgctacccccaactcctgcaggacccccaacaaaggcagtgttctgtcccccaggcaccccaccctacgccatcagccatggtctcgtctgcatccatctagaaaatattcatttacacaagtggagcaggaatatatttttgttacaaactaatcaaataat

SEQ ID NO: 2630 - DNA, 812 bp, Homo sapiens
ctttaggccagaactaagaggaggtaagaaaatggacaaagacaaacatacagaaaggaccaatgctatggatattatgaacagcaacctcaatttctgtcatgactacaaggaatggacagcattaataaaatgtaaccttgtcattatttaatgacaacattaagaatctatcaacatgatttaacagatctatatgttaaaggagaaaaagatatgtggatgctatcaatagtagctgaaaagcattttcagaaatctgtaagtagaggaaatgtattcatatgtttctatgttctagaatagatattttgactagacaaaagttgaaatcttgtgtcttatgtttttatttaaatgatagactcaatacgtaagtagtcacaagacatatgatattgtctggatctgtgtctctgctcaaatctcatgttgaattggaatccccagcgttggaggtagggcctgctgggaagcgattgaatcattgggggggatccttcataaatattttagcaccatccctttggtgctgttctcgtgatagaggtcctacaagaactggttggtcaaaaagggagagggacctccacctcctcttgtctttggtcatggtaagatgtatctcgctccccctttggcttccacccctgaacatatgttttcctgtaggcctcgcttcgaaagcttagatagctgagcgccatccctatctgcaggcgtgggtagacctgttaaaacattaaaacgtttttcgttctggaattataaaaaagcagaaaaaggccctctctcggcctctacaagggaac

SEQ ID NO: 2631 - DNA, 271 bp, Homo sapiens
ctgccaatgtttggaccagcccagtgatccctcactcacaagaacttctatcggacttagcttatccctcagaagaccctggacaccaccaaaggtcatcagcacaatcttgatggatgtctaagaattgaagattgatttttgcctaatgacaataaagtcatcactaagttaaatatctataaattaaatatctattaaatatgtattaaatatatagtaaatatttaattgaatattaaatgcatgtatattctgaaaaaaaaaaaaa

SEQ ID NO: 2632 - DNA, 891 bp, Homo sapiens
aactgaattttaagtattaattagagattacgatgacagcgacgaagggctgatgtagccacaggcacatccatgtaagaggtgccatactccagaacttgctgggacaccacagaggaaattcaatgtcttggtctggatttggggagctatagctggactttagatataaatttgggagtttccagcatgtataaatggaacttaatgtcatgaaaccaatattaaatcatgtgttcatgagaacacaaagggattgagttattaaatctaaaacattgtttttaaaaagaaagaaacccatacacacagctcataagttcaatatcaaagacatcgcacaaaaaacttctgtggttcggcctcttttggcctaagatggggaagtttattcggcccatttccttttagggggggtatatttcaaaaccatgactaatcgaaatctctaaactcagctctcagaatgtgcccaacgcttttttccttccttaaaaggcggggatacctggtttccctcgaaatccggggcgaacctaggaaaaacgttgaaaactaatgaccgtttattggctggtatctgttatttggccggtacgtttggtgttttatcaggtgttccgcccccctcgctaccattcataaactcttcctttgaaaataatagggcataaacccacatggattcttaaaaataccaagtcattactcctctaaactcttccctgattccctttatttataaagccattgacagttacgtataaatctatccatcttttctttataaaaaccatgcgattcgtaaatggcgacacttcagaacaccggtattgtagcgaaaccctaacaactggtctcgttctaagcatccttaaaacatcgctacac

SEQ ID NO: 2633 - DNA, 1068 bp, Homo sapiens
ttcaggatccaacattcagcactggcacaagacaacattaaccagagacgtctactctcctgaccaatgaggtgcagactccagggcaatgcttcaccacaactcttacctgatgtactcaaagacgattgcatccagatgccatcaacaaaagtctgagttttgcccttgccagtaccagagatggataatgcttcactgtgtagggaggatttgaatggcgaagagcctggataggagaaaagacaagttaattaacctgtcaaatcattctgttcagagaacataaattcaaaggaaattgcataatgaaataacatttccattttcttggtttttttttgtattctgattcattgttcaagaggtacctacaaattagtatggttttggcaaagatcagatataatgtctgaggaattttgcaatgtaaaacaagttatatgattcttaaatttgtatgtgcttaggactaacaggaaatgtaattctgatcctttacaatggttactagatagatatcaaatactagaacatatatgaaaaatgtttataataggcgtaaaaaaattaaagacctctgtaatgtaaaagaagatgtttaaaaagttatttacatttactaaattacactcttaataacaatgcagaatttattttaaatataattatgtttcaaatttctaatcctttagctaaaggattagcaagctatggtccactgcctgtttttgtaaataaagttttattgaaacacaacttctctctttgtttacttgttgttgacggctgcttttgtgcaacaacagcaaggctgagtagttgtaatacactgcatgtttctcaaagcataaaatacatattatccgacctctttacagaaaatatttgcggacccctgctttagaccattacttgaatcagatgtaaaatatgtcaaaatctccataaaacatcatagcaaaattaacactgaaaaatcgccaaaattaagtaaatgttttatgaaataaaatatatgttttatgaaataaaataagttattaatttaaaaaaaaaaaaaaaaaa

SEQ ID NO: 2634 - DNA, 358 bp, Homo sapiens
atcactcgggagaaagtccagcatgcaattggaaattcaaggctgctcatcagtggagtagcaagtctgaaaacatttgtcaactctgcttgatctttccacatacctcatcggccaatggaaattgcctctcttaggacttgtgccgggaagcatgagcaaccaaagtcagctgaaaggtcagtccgaggatcctgggactcacaaaaaaagggacagcaagaaattcctggaagaactctctcaaaattaaaaacatttggattctaagctctgaacaatacttgggaatctgaaatcctgggcacaactccccaaataaattctctgaaataaacctctggcctcgttggcctca

SEQ ID NO: 2635 - DNA, 530 bp, Homo sapiens
actttatacacagttgacccttgaacagcacaacaggactgcagttgtgcacttctatgtagattctgttcaacaaagcaccgatggaaaatacagcatttacaagatgagaaacccgagtacacagaggatcaatctttggtataacacgagttccacaaggctaactgtggcatttgggatagaattctgggagacattgaaatactattcaagaggatccttattaggaaaaaacaaaagttggggaaacactggataagttgtcccattgaagttgcatatctataaaatggtttaaataaaagaataaatggtgaaaatatctttttctatttattgcaaaactacagctggacttctccagtgtatcctcgaagtttttttttaattttgtttcatcaataagaatcatcaaagtgaagatgcatcaactaaaaagaaaactgtgttgctccataaagcagtttaaaacagtaatggattccagaaaattaataaacttaattttaaatttaaaaaaaaaaaaa

SEQ ID NO: 2636 - DNA, 531 bp, Homo sapiens
tgagcttgtcatttggagatccaggctgagaaggttgagcggagaggagactgacacacagcttcgaagctctgcctgcaagtgaagcacagaactgtcacccacatttgcttggccacctaacttcaaaggagcaaggaaatgcaattttaccacaagcctggaaaggaagaagaacatatatgtttttagtagtactaatgattagactgcctataattaaacactgaattttcttttaatctttctacaatcatgcgtagtgctacgatgaatattttcacataatgtttcctgttatttctatagaacaaattcccaataatggaattactggatcaagaatatgaatattataatgacccaatacatattacctattgcttttcaatattatagtaaataaaaatcttattctgccaggagccacttgttatttatctttatatctccagtcctaccagtgtcccagggtacagccaatgaaatcttcactaataaataagacattacattccaaaaaaaaaaaaa

SEQ ID NO: 2637 - DNA, 286 bp, Homo sapiens
caggtaagctgcatgagtacaaagactttcggatattatccacagcacatataatggagagagaatgacattccttggattgaagctggtattgatgaaactgatgcacattaccacctccccaggagctggaagaactcacccataggagaagtataaaagcaatgaaagcacctgctctgagccagagaggaagctgcctgaaaatagaagctctgtttgtttccttagctatgtcatcctaacgacttaataaaaagcttctaagcaaacaaaaaaaaaaaaa

SEQ ID NO: 2638 - DNA, 339 bp, Homo sapiens
ctagcaatgatcattcagctggacgtgtcagaaggtttttggagaaaagttatgaaattattatcttcaagagttggaaaattaaacttactagtaggcatggtagaattttctgaatgtaaatgttcatttgtgatttggagagatattttgaaagtgggccccattaggaaagttttattattttgggcattgatttattaggtgcatgtacagataatgcaaataagtaatatggtattaatatgtgtattatgttattgatattttatttattaaaggtgaagttttgtttcattttggtgaattaaaacatatttaaatataaaaaaaaaaaaa

SEQ ID NO: 2639 - DNA, 498 bp, Homo sapiens
tcttttggccaccaggcaaatcctcagatgaaggaagactgcagtagaagcgatgagcagtgtcctttctgcatggctggaccaagattagagtcaaagtcactgtatcttctactattttcttcttgatttgcatccagaattgtctctgtactaactagattttaattaaaaggaagtggaatagtaagatataaatttccacttataaaattagcatataggtgggagtattacagttttcatgaaaagcaatttgagagactgttaagaacttaaaagatgaacatagatacctatcctaaggaaataattagagagaccaattaacatatcgacagggctatttattattctgaataattgaaaaactaaatgtacaatgtccaatattagatgaatgaataaattatagcatactaatataattacagtatactcagataatgagctaatatgaattcattaaaataatactttaaaataaaaaaaaaaaaa

SEQ ID NO: 2640 - DNA, 352 bp, Homo sapiens
caggtgaagaaactgaagcacagaaaagttaagttgcttgctcaagctcccaggggagatccaggcttggacagtctgatggagaaactttgctgataccaccatgctgtactgtccttcatgtatgggcacacataggcgatacaggtctgagtcaagaaaatttgacatcacttcctaaacacacacactctcctttttctccccaaataaagcatctataaatgaatgttgtttctgtggttagacgtgtttggagaattttatctgcagaatcttccaaactgaacattgtctgatatttacttagaagaaataaaaacttccatgaactgagtgaaaaaaaaaaaaa

SEQ ID NO: 2641 - DNA, 470 bp, Homo sapiens
ctagtgtgaacttgccactcccccatcaaatctggacaggcttctgacccttacaaccagtaggacatggcagaagttatactgtgcagctaccaaggctaaatcataaaagatttatgctgagacacactcacttttaattctctactcaccactatgaaaggtgaccaccctgaagccaccatattgtgaggaaatccaggccacatgtacatgctccagttaacagcccagctaacatcccagtcaagagccagcatcaactacccatcatgtgagtgaagacacctccagatgattccagtcctttgccttcaagtcacccctggctggcaattcttcccaactcatgtcctagtagccattgtggagcaaaaacaaagtcatccctggtgtgccctgtctcaattactgacccatggtatctgtgagcctaataaagtagttgttttaaatcaaaaaaaaaaaaa

SEQ ID NO: 2642 - DNA, 897 bp, Homo sapiens
tagtttcccttggatttccagttctgaagattggacagtctctaatgcccatacttctactaataatattcaaagcaaccactttgtaaacatcttctaccttataagtcccttcagccatctcagcagaagccaaaaatgaagggatcaccttggaaagatccatggacatgcctcttatctaatgaagtaaagccctgtgacatacacaagacactcacagagttgttgagaatttcatatcaccagaaacactgccagattagactgaaagggctagagagagatgtgatgtgagaaggacttaatcagctgttgctggctttgaagatgaagaggtggtacacaaaggcattctttggcctttagaagctgagtgcaaccttcaacctagagtagcacaagaaaataaggagctcagtcctataaccacagaaactgacttctgccaataacccaaatgagtcggagaatgattttcccatagagtctcaagaaagaaatataacctaacaatacctcgattttagtctggtaatgtccatactgaacgtctgacctacagaactatgtttttacagagctgttgtcataagacacaatgtgcgtgataatttgttatggcagtgatgtagtttgggtgtttgtcccttctgaatctcatgtcgaaatgtaatccccaatgttgtaggtgaggccaggtcaaggtaattggctcatgggggcagatccctcatacatgacagcaccatccccatggtaataagtgaacctccctcagttagttaatgtgagatctggttgtttaaaagagtatcctaccgtcaggcctctgagcccaagctaagccatccagatgtcctgaagcaactgaagatccaaaaaaaaaaaaaaaaa

SEQ ID NO: 2643 - DNA, 494 bp, Homo sapiens
tagaatactagcaagaatcaccaaatattccagagacagaagataagaatgctgctagtgtccccaagtacaaaagaaatctaagatcaatttcagaaatcgagatgttaatggaaattaaacaaaacaaaaataaatcaagatgattataaactaaagaaaaatttaaaacttgcccaaagtttggaaacctgaaatgtgagactttaaccctaatatcaagttggacattttggaaaagaagcttctcaagacatttctcaagcaaaaaattacttttaatgttgatcctttaattaacaaaagcagctaagattcaatcagaagggaatttggatccattgactacttccagtctgacacgtaagcactcatcccaaagaatcttcagctccaggatctggtggatacttggtttacaagtttatgtaattacttttccatttcttaaaaattaaaaataaaaagatgtgaagtttccaaaaaaaaaaaaa

SEQ ID NO: 2644 - DNA, 202 bp, Homo sapiens
ctgctctgcatacaaaaccagactacagtaaagggacacttggtctgttcacaaaaataatcgtcatcactatttctctctggcactacctagagaaagaattgccagtcagcgatctggatctcacatctagatttaatcccatggaagacaacatgaaaagcttcttaataaatgagataagacctgaaaaaaaaaaaaa

SEQ ID NO: 2645 - DNA, 813 bp, Homo sapiens
cagattagactgaaaactcatcgtgaaggaccatgtcttatccatcttgtatcccaagttcttagtacagtgctggatgtaaaaggaagaaaaactccaaagcaaaggatagagaagttagaagtcctggcagcgatcaatatggatccacctctctattttcaagagcattaaattcagttaaaaactaaaaacaaaaatactgccaagggattgagacggtaaagtaacatcatgcctgatagaataaactatcaagacagcatgaacaaacccaactgaaatggaacaagcaagcttaacacaagtcaaagaagctctctagagtgttaaaatgaaaatacaactaaacagaaccaaaactgctattcatgggaatagcaaatgaagaattttcttcagaatctacacggataacttctatgagattattcaaaatgtggaaatttttttcagaatttttgtttccaaatggaatttaatacatttcatgaaacaaatgaaattttatcagaaataaaacatttaaattaccaaaagcctagcctccttaggaaggctgttttaggaagacatgggtagaaatattttcatcaaagccctgatcatcttccctttttgaggtgaaatcactctactctgctggaaacctacatttagttatttataaaccagtattaaatgtatattgtttccaatctctatgtaggaaaaatatccccacattcattcccattttactattgaactgtataaactttcaaaaatctaatgaaaagaaaaacatcaccctttctgctaaaaaaaaaaaaa

SEQ ID NO: 2646 - DNA, 249 bp, Homo sapiens
ctaggaaactgaagatcagaaatgtggcctgctcatggtgaccagatcacaaggtccttttgaatccccttgcctcagcagcaattgcaccaagcacacattatttgataaaaagcaagaagacggccacttgcaagccaggaagagagccctcaccagaaaccaaactggccagcaccttgatcttggacttcccagcctccaaaactgtgagaaataaatgtctgtttaaccacaaaaaaaaaaaaa

SEQ ID NO: 2647 - DNA, 617 bp, Homo sapiens
gcccaggatggaatgcagtggtgtgatcttggctcaccgcaacttccacctcccaggttcaagcaattctcctgcctcagcctccgagcagctgggattacaggtgcccaccaccacttttttctttttcagtcagtaaattatcccatcatgctgccagcccaagataatatatgaagaaaaaaaggtggaaacaacagacatgtttatatattcagaaaagaaaaggagattatgctttgctttcataattaaaactgaatgtcacatttgcatgtaatatgtttttaattttatggtttttattcttgttccaccaatttattgataaaaagtatcaacctcacagaaagtatttagatgcattttcgtatctataacctcattgtacatgtcattttcttatgggtcttctggaaaattttcaaaaatgcttgtgctaccaaaaatgaaatgctatgttaaagcagggagtaaaatcccttactggaatgtgtgcacttacactatttaactttttgttgaccttatctaagactttggattaaattcaaagtggatgttgaaaaaaaaaatataaaaatggcctccgttgggctcaacagggggaagcttta

SEQ ID NO: 2648 - DNA, 135 bp, Homo sapiens
ggtattggagtaagagatctttgattccagaagacttccattggaggaattgctgggcaacttaaaaatgctaaaatctcagtttcttctctattaaacaaagatcaacttggttgattgggaaaaaaaaaaaaa

SEQ ID NO: 2649 - DNA, 324 bp, Homo sapiens
cctgagctcagttcctggccaatagatctctttaacaactcctccaagtgatcaactcaggattcaggctctttccattgtgtgttccaccatctcgaaggccttctcttcctgccatgtggttgaaggagcaaagaagatcacacagagacttttaatggccatgcctggaagtgctatacgtcacttccactcactttccatctgtagagctcagtgacacagtccacccacactccaggagctactgggaaatatatgtcttcctgtgtgcccaggaaaaaaataaaatagtttggtgaactcaaaaaaaaaaaaaaaaaa

SEQ ID NO: 2650 - DNA, 186 bp, Homo sapiens
cctgatagctcggaaagttcctgtacccagttggacttgccgcgaaaaccattaatctggcctttcagagaaaatcttcagaagaatgtatttgcaagatgaattatgaggatttaggatttgccctcaaatttctctttcaggctgctcttcaaataaatatttccccatccaaaaaaaaaaaaa

SEQ ID NO: 2651 - DNA, 553 bp, Homo sapiens
ctggacatcccaaatcaagctgttggcagcgttggtttcctcagaggctgtgagagaaggagctgtttcaggcctctctgcttggctcgcaggtggccaacttgatgttcacgtagcattctccctaaaacaatgaagcaaaccatgcaattatttcgatttcttggtgcaaacaaatactgctctgcagacaaagagcaaaatgcaactgaagcagaaccatcagctaccaggcaacactaatatgaaattgtttaaaatattgttcatcagcgacatctaactgtagcagataaagactgtttaaggatatgtgaacaatgcacagaagttcaagttgttttaaattcaaccttataaaacatgagtttatacatgaaagtaatatagtcttgtttgataaaggcactttttcaaaaagtatgaattttctcacattcattgtgcgtgcgcgtgcgtgtgtgtgaggttttgtcacctgcctgaaaatcttttgtctttcatgcatttaataaacaggacttattttacaatgaaaaaaaaaaaaaaaaaa

SEQ ID NO: 2652 - DNA, 416 bp, Homo sapiens
ctaggtctacacgcctgtgatgttaggggctgctgtgaaggtttctgacatgccctggagacattttccccattgtcttggcagagcccagaaaacacatgcgttttgaagagaggaggaagagaaatgatcagacttatagtgtgttgctgccacagagcataaaactggggaagccctgggaaccacagaagatggaaggaggaagagaggaatggtggcaagcctctaccagcttcccaggccaagtctgatttgatataaaaatgtctgctagtagtctcaattgattcctatttttctgtcaataactttgtatttatggagttttgaagtgaatacttcccgttttttctgtagttggtagttaacttgagaaaaaaataaatctagcctttgttttaaaaaaaaaaaaa

SEQ ID NO: 2653 - DNA, 676 bp, Homo sapiens
  misc_feature (1)...(676): n = A,T,C or G
atactgtggaggattcacaacagcctgggctccagagttggacactcaccaccagactgggaagtacagcctgggctccagagtccaccactcatccgggcctcatgaagcttcggtgcggtctgggaccctatctctttttgaacgagctgtttggcatgaggtccagtcaggagggccaaggaacacaaaaaggtcaacctgtttttgtgattgtctgttgtttttcaataactaatgtacaggaatagattgaaatagagatttatgaatgcctcaaggggctcaaacaacctgttccaggacttggtgactattgtttgtgttcatgtttaattgagttcaaatttaatatttggtgagtttgtattactatgttttactgtctcatgaataaaatcctaaaataaaagccacaaaatctttgtgtttaggtgtgcctacacatatgttgtatctatatggtaaaacctgatgtagtcagtagaattcccttaagaaattctattcagattggctagataagtgaatgctcatataaattgttaaatatataagttcatgtgacttaaataaatctttgataaatatgctagttntaaattctgttgataaataaaaatagaaatgtctttagaattgtcaacatatatttttgactgaagttaccgattaa

SEQ ID NO: 2654 - DNA, 1236 bp, Homo sapiens
  misc_feature (1)...(1236): n = A,T,C or G
actgggaagtaacagcctgggctccagagtccaccactcatccgtgcacagatgaggagcggcctcatgaagcttcggtgcggtctgggaccctatctctttttgtaacgagctgtttggcatgaggtccagtcaggagggcccttcgcaactgggctcaaggaacacaaaaaggtcaacctgtttttgtgattgtctgttgtttttcaataactaatgtacaggaatagattgaaatagagatttttctgaaacagcgctggatgaatgcctcaaggggctcaaacaacctgttccaggacttggtgactattgtttgtgttcatgtttaattgagttcaaatttaatatttaacttttcctccacaatgggtgagtttgtattactatgttttactgtctcatgaataaaatcctaaaataaaagccacaaaatctttgtgtttaggtgtgcctacacatatgtacatttattattttctgtgttgtatctatatggtaaaacctgatgtagtcagtagaattcccttaagaaattctattcagattggctagataagtgaatgctcatataaattgttaaaatatatagtaactaacccaaatgcattttagttcatgtgacttaaataaatctttgataaatatgctagatttaattctgctgataaaacaaaaatacaaatgtcttcagaattgtcagcatatatacttgactgagaggtaccgatgagacagttttatattagaatctgctaaatgctttaaggggtcaggatattacacacaaattttagcactgactatctaggccaaatatgaattgatggctttgaatcttgtgatatataaacaaatatatggttgtacattaaatgtaaatgtatataaaaagccttaaaatatcttattgtttgtgattaatcctaaaatccaattatcgnagtagacctggatgatttttattctcttttttcctatacaacagcctttctgatattcattcccggagagtacacggagtaaaagttctagacagggattcgctcctcatttatgagagatgatnnccatataagcccggtaattatagcagtatctaatgattcataaataaacatccaagttatcatgtgtgttcctacagatgctttgtcttcaatcctccccatgaggccaatccccagggcgtcggaaggccccggggaccccgttgagattagtgggcctgaaggt

SEQ ID NO: 2655 - DNA, 200 bp, Homo sapiens
catgacatgactttccaccatgattgtgaggcctccccagccatgtggaactgtcattggctagaccctgccgccagccccacttacctgcaaatttttccatatgcttggaaggagaggagaagcacctatgtgtgagcactagccatctctactaaaatcgattaaaataaaaaaaaaaaatggcctcagtggcctca

SEQ ID NO: 2656 - DNA, 233 bp, Homo sapiens
tttccagccaagaatttgctcctcttaaccttccactgtattgtgaggcctccccagccatgtcggaactgtcattggctagaccctgccgccagccccacttacctgcaaagaactgtgcaatgtcatttttccatatgcttggaaggagaggagaagcacctatgtgtgagcactagccatctctactaaaatcgattaaaataaaactatattctataaaaaaaaaaaaa

SEQ ID NO: 2657 - DNA, 663 bp, Homo sapiens
agtgttaagtagcattatgtgagtggagatggggtacctgtgcacctggactcatcaagctggatacccatgcagccggaataaccatcacactgcagctggggcgatgatgcacacaccaaagctccattataacaggttttgttggctgcacaaaatagaagagagtaatgctcggttttcttgttccactgaattctcacatcaaactatcacactacagtgaattatattactctggattttttctagactgatattctgactaatattccaggtggattaacttagaactgtctgatacacctaccacatttgcctgaataatcacttcacagatgtgcattcttctcacctcaacattcatatcttgaaaccctaacccgcaccaggactgtatttacagataggagctttaagaaggttacagaggttatgataagaggacatacaggaaaggctacttgaatacacagcatgaaggcatccatctgtaagccaaggagagaggcctcatgaaacaccaaacctgcctacacgtggatcttggataaaacaaattcctggagtctatctaacaaaaataaaaaaatggcctccttgtcctcatccgcagagctctggggcggttacctttagagaaggtgatacctgagcctaagg

SEQ ID NO: 2658 - DNA, 848 bp, Homo sapiens
tttttttttttttagctagaacaaccattaaatttattatcgaccacttgtggaggctccaagcccaagatcaacgtgtcggcaagttaaggtgtctactaaggcctctctacttggcttacacatggctgtcttcttgctgggtcttcacggatcctttcctgactgacatagaatccctgaggttcctcattatccataacccatgttaccttcataaacctcctatctgtaaatacagtcctgtagaaggttacgggatacaagatatcaatgtcgaggtgaggacacaatctattccctaaaaatgcacatatgcgaagccaactcatccgcctatgtagcttttctttcacacaaattgaaataaatacattagaaatatattcgcaaaagagctgagcttcaaaatatcacacccagaaaaatccaggaggatagacttaacatgataatagtgtcaagaaaggaaaatccgttaggacaattgataacccgccaggcatcgcagacgattatttatctatataatcgacactacaaataatgagacactgaggtctagaaaggggcacccacgaacaacggtcaaccggtcccccagagccctatgaaatatgaaacccctaaatataccccctgtgtctcaactccagaccacgccccaagtagcacgacaagcgcgaaagctatgaccgagagaccgacctatagtcaattgagataaaaacacactatcgttaacaataagatcaaatacccatagctaacacgataaagaacacataggcgcaactagcagaaaaagaaaccactcaatacatatggcgaacgcgatagagacaagg

SEQ ID NO: 2659 - DNA, 623 bp, Homo sapiens
ctgtcatcagaggagccattagagagtcttcaccaagactgaaaatataagtgagagtacatcttgaagtgctactgcagaggaggaagaaaagtagattcgtgtgtgaaattctacctaccaaatgacgtgataacgagtcatactgcggtggatcggcatgcaccctgtcccccttcttacctcccagaattacctcagtatcatagcgtaggtgctttggagaaaactgactcctcctagcaataagtcttcagttgctttaagctttaagcacattctttcagtcctctgatcactgtcatttgtccaggggtgggcatggactttagtggtaccaaaaaaaatctcgcattcctatttgaaatgctgagacagaagtacaggctctcactttctctgcagttggcagagagggaatgtggtctcgattgcttctggcaaacattgtgcagtcatgttggaaaggggacttgaaatgaagcgaagattccagaaaacagaacaaaccaaaagaaatggtgaccactataactggcaactgtggagcctgccctatctctggacattcagttactggggctaataaagcctggtttactttgtaaaaaaaaaaaaaaaaa

SEQ ID NO: 2660 - DNA, 1212 bp, Homo sapiens
tggcggggggttcttaccaaaaaaaacgggggggggtcatacaataaggaccacattaatgaagcattaagcagaggaacgaaagaaagtagcgtcataatatgtcatatttaaaaaccatacagccaaatgcaagaacaacatgcagattgggctttttgtttttgacaacatatggtatatctgttgcccgtaggaaaaacaccacagggtcaaggtgggactgtggcgagtaaaatgttgagttacgagcacaccctactggtttggtgtgagatgccaataaaagccaataaaaggtttcataggtgttttaaggtgtgtgtgtgtgtgtgtgtgtgtgtgtgcgtgtgtaattatgaacatagcgaaacatacagtattctgcagttttaatattataccaaaaagaagagtgatatgtatattggatagatgagagataaatagacgtatttgaacagaatgaaatccttttctaaagtttatgaatgccttgatatgccttatttcccctttttactatttttaaggctcttttaactctctccactctcatttagtttctgaagacttggcatcccaaggaagactcttttgaagtcaatttccctgaccctggatccacagagccacctgcagatgtcacactgaaactttgctgttgacacaccacctgtttttccttgttctccttcggtttttgctttcatcaagaaaattcttcaaacagctgggtgatgccaatacatggagcccgctgggaagtacattcttgttccacactagaaaaccagacttaattagtcagtcacatttagagtactttttcttctccatgacgactctaatcacgttagccatatttgaactggaaaatagcagtgttttcagccacacatgatgaacacaaatttatgtttaaatacaaatattagagaaagacaaataggttgacataattatgtggttgattctcctgtggctagaaaaaaaaataaatgtgccacctcatcacctcagtcttcctcactgagacctgttatctagaaaggggatattctaggggatcacaatggcgaattagtgagtttggggagtattcttttgttttgctttcttttttcactcaggaagagtgaataaaaccacgtgggctatttttatgtcatgacttaaatacatcttcatcgccaagcaaaaaaaaaaaaa

SEQ ID NO: 2661 - DNA, 509 bp, Homo sapiens
cagaatgtccaggtctcaacttcaatcaaaagaagccaaaagtaaacagtcaacaatgggtccaaatcagtggcaaatactctagaaatcaagacagaaaccctctctcctccacctcttcccagagtgccagaacggggccagacttgcaagtcctaggaggaggagcccttcctttcaggatatttgccaagcattcttgtctctctgaattgtaactggtatcgttttgggcacaggaaggacatagaagggttaagtaatgtgccagatgtaacagaatagggaaaaaataagttatctttctggaatttgatctgcagtaaaagccagtctggtggaggctgtgcctgtccttttttctttcagtagtagggtttttaacccaattatccagacttttttttcagctctttgttttattttacttgtacaattagtcctcaagttgatttgaaaacaacaacaaaaaacaaaatgtaactttgaaaaacagaaaaaaaaaaaaa

SEQ ID NO: 2662 - DNA, 336 bp, Homo sapiens
cctgactatcttattatcccgcgcgttatcgagttccagccagcgccccgccgcccgcgagcatattgccattatggacaagatatcaaccaatgactgaagattgctatcaaattgaaatatggaggagtagcaaagaatttttaaaagaattctatcacatgtgtaatgaaacaagtaacgaagtttaaagcagctatatccatgagttattaattttggcaattataatgttacatgcactgacaattcttattttctgtatctactgatctttgttacaaacaaaaaatggaaacagataaatgaaaatgatgcaccagaaaaaaaaaaaaa

SEQ ID NO: 2663 - DNA, 674 bp, Homo sapiens
atgggtcttgctctgtcgcgcaggctgagtgcagcggtgccatcttgtactcattgcaacctaaagatcctcttatctcagccccccaagtagcggggactacaggcacatgccaccacaccccactaatttgtgtgtattctgccatagttgccaaactggtctggaactcctgagctcaagcgatccaccctgcttggactcccgaagggcgggattaaacgtctgtttacaagaactaaacatgtttatctctccaaatgaaaatgaaacccttaacaccctaatattcacctagagatgacagtcatatgcgttatatatgcattatcactcggtggacacttcactgtgttatagatgtaatgggggtcccggagatcactaatctattgcatctggaagccttatcccctggaggggaaattataggtatcgtactaattacggacagaatcttaatataatgcctggaacttagacgccagcattcggcccggacctaaatatctagctatgctccggccacacgcagagttgaccagaaagcctcccattaatgacagtgggaaaactccacaggcttcatagtgccaacctggctcctatgtctccagccagctgtaaaaaaacccaacctttaatgtgcgaaacaggagggcgttatttcccag

SEQ ID NO: 2664 - DNA, 918 bp, Homo sapiens
acctagcgaggcgctcgctcttacgcgcagctgatgacagggtgccatcttgtatcattgtcacctctggctcctacgatcaaaagatcctcttatctcagccccccacttggcggtgactacaggcacgtgccaccgcaccccactaatttgggtgtattctctagagacggggtttagccatgttgcccaaactgggctggaactaccgagctcaagctgccaccctgcttggacttccgagcgcgggatttaacgtctgagccacagagtgcctgtgtaccggacataatatctcttttttctttattgtgaatcaaccttttatgcgcttagatgtgccgcggggatgaccggtgtgtagcggatagatattttggtctcctcttgccttattcctcgtgtgcactttcgtgtgcagtattttgttcgggggtcgtggcggatgaacggcccttcgtttgtttggggaaagatataccttgtttttttctcctccgagcgattctggatgtgggttttgcgtgtggagctatttaactcaagttggatccctttctcccgcgtttaccttcctggtgtcctacgtaagtattattagttctcttgggttttggcgtagtgtgagttttttttgtacattgttattgttgttttgaggatttgccggctggtttgtcatcatattcgttatcgttcattatattaagtttattcgcactcctcggatagcagccagtgctttggggggctttgtttcttattacggggtatttactagggcttgtccattgtgttgtccgtcttatgatggtcggagtccggatgttgtgttgtgtaggacggtgtgcgggtactttttcgtagggcccgaagaacgagctgcgttagagtgaggcgctaataggtttggggggg

SEQ ID NO: 2665 - DNA, 209 bp, Homo sapiens
aaaactgtgcccacaaaactcctgattggctcaatgttataaagaatacacgatgaaattttccagaggctacacaatatatgatttcacagcaggttgaataaagaagcggatatgagaatctagttatcttctattatgccagacattaatttgcaaaaatataaaactcctctcaataaattttttgttttggaaaaaaaaaaaaa

SEQ ID NO: 2666 - DNA, 685 bp, Homo sapiens
  misc_feature (1)...(685): n = A,T,C or G
catgtctgacaaacacattttcggtccagctgctgccagttcaaaagtttggctctggggtctcgaggctgatcaccttctgagaaagactcttaaattctgtgaagagtctccagcagaggagacattggtttaaaaaagcaacatgcccactccacattaccaagcctgcacaactcatgttaggggatgtctgctgctcctccagctttctcccctggcaagtatccccattatggcccaacagcaggaccggtagcagcccctgtcggagaaaccacagccagttggggagagcgaactcatactatagggatgctccctcctccctgcttctcggcaccagggaaggacaaggaaacccatgagaagacagtggcaactacggggaggaggaatggcagcacccaggcactgctgccccacatgttgatggttacagctctcagtgaccttggacaagttatgccccacctctgaactttgtttttatcatttaaaaaaaaaaattgaaagaaaaaagcagcgagctgggccagagatgattccataaagctatttcaactctgaaanaaacattagaataagggaaaccgatacatttaagaagggggcgagcgccncgggggggtcctcttaaacagaaatggcctttttgcgccccacggggaattttcggcccttt

SEQ ID NO: 2667 - DNA, 987 bp, Homo sapiens
  misc_feature (1)...(987): n = A,T,C or G
gcagggggggccgccagggggcagacaagtttagttttaggnnnngnngtggctagtcctgaacaacctttttgcggcccatctgctgtcagttcaaagattggctctggggctctgaaaaccaaagtctgtccaaggctgatcaccttactgagaaagactcttaaattctgtgaagagtctccagcagatgaaacattggtttaaaaaagcaagaacaatcaccacaacgcatgagcactccacattaccaaacctgcacaactcatgttaggggatgtttggttgttcttcaactttattccccggcaaggacaagggggggcccttgagccccattaaggccccacagcaagacaccggacaagccccggcggaaaaaccaccggccggtgggggaaacgaacctattcataaggctggtttcctgggaacaaaagcctccttcctccttcttcttgggccccaggaatggacagggaaacccttaaaaaaccggggccacttagggggaagaagaaaggacaagagatccctttttttgaaaccccaggcacttgtggcccccatgttggtggggtccggctttaatgaccctggacaaggtattcccccacgtctgacctttggtttattctttaaaaaaaaaattatttaaaagaatccagacattttgaaaagaaccagccgactgggccacaaaaaaaccaataagcctttttagcctccgcccgaaaagtatataaattgtgaaaaatataacgaaaaaagtaaaacctcccggccctctcagttgagacgccggggaagcgcacacaaaaaacaaagtggttcctggggctcccccggggggcctgtggggctttcctttgtgggggggaaataaaaaacacctatatacattttgtttgggggttggttgggggggcgggtgtttcctttagggggggggtggtttttccaaacacggaaacccacgaaaaacag

SEQ ID NO: 2668 - DNA, 220 bp, Homo sapiens
cagtataattgaagattcacttgcatttttaagaaataataaagagacatcctatcttgaaagctagagacatccaaaccaagaataagaaataggaaagaagaaaaagaggacaaatttgatggacacagatcttgattttgagtttatctttttctttatttcctatgttcttgggaaaaaaatattaaaagtttcagaaaccggaaaaaaaaaaaaa

SEQ ID NO: 2669 - DNA, 478 bp, Homo sapiens
cagatggagtttcactcttgttgcccaggctggagtgcagtggcatgatcctggctcagtgcagcttccacctcctggattcaagtaattctcctgcctcagcctcccaagtagctgggattctcctgcctcagcctcctgagtagctggcatgtaccaccacaccaggctaattttatatttttagtagagacagggtccctccatgttggtgaggctggtcttgaactcccaacctcaggtgatccacccaccttggcctcccaaagtgctgggattacaggtgtgagccactgcaccgggccaattaaaatttcatatgcatatccgtgtgtgttcatggatattccattctctaccaaatttattttataatatagaacacatttattaatggaggtaaatgaaaacaagccataatatcaaactgggtcttggggaaaataaaagtttttttttttaactaaaaaaaaaaaaa

SEQ ID NO: 2670 - DNA, 583 bp, Homo sapiens
catggtcttgctctgtcgcgcaggctgagtgtagcggtgccatcttgtctcattgcaacctctggctcctaggatcaaaagatcctcttatctcagccccccaagtagcggggactacaggcacatgccaccacaccccactaatttgtgtgtattttctagagatggggtttagccatgttgcccaaactggtctggaactcctgagctcaagcaatccaccctccttggactcccgaagtgcgggattaaacgcatgagccacaaagcctggccctgtagtaattttattcatcctctcattttgctctgcatttcacacaaagccacgcccacaaaacacaaacagacagttccacatccctctcccaaccccacatgtaaattaagataacaaagctttgttgttgaaaatcactgtctagaattacacagaaatgattctgcttctgtctggatccctgagcagtctgtcactggaaaatccatacagtttatatcattagcaaaaatgaattagttcacattcagttttgaaattctaataaatctatgcaataattacaaaacaaaaaaaaaaaaa

SEQ ID NO: 2671 - DNA, 167 bp, Homo sapiens
ccctgtgagtactcgctaccaattgtttcattctcgtcctcgctattccctttgttcctggatttttaccactcatgctaatcctgtatttattcttaaaaacaggaattgactaacaataaagaacaaggtgcccaacatccgagcctcagacaaaaaaaaaaaaa

SEQ ID NO: 2672 - DNA, 451 bp, Homo sapiens
ctgaacagggcctcactccattgcccaaggtggagtgcattggcacgaccatagatcactgcagcttcaggttcctgggctcaagagatcctcctgccccagaccctcagctgcaagttgtaatggaaagcgcacctctctggaactcgggagtcttggatcctacacatgattctatgcataaatagaaatgaaattagcttcctggatactaagctagtattaatcaggtgattctaattaaaatcactctgctagctaaacactattcagcaagattttggttaccccaagaacattctgagacaattgtatctataattgataagacttgacaataatctttcttcctgaagtgtgttgttaactttttggttgactcttagcaaagtacatagcatatagtaggcattcaataaatgttcattcattttttgcaaaaaaaaaaaaa

SEQ ID NO: 2673 - DNA, 112 bp, Homo sapiens
tctcttcttgaactatagcagctcctgacgctaccagatcactttgggattcttgatagccgatttttaattaaataaatgtaattgcctgtttccaccaaaaaaaaaaaaa

SEQ ID NO: 2674 - DNA, 547 bp, Homo sapiens
tagagtctacagatttcactgaatcagatgactgaattgaacttgagatgtgatccaaaaaagaaagcttctgtaaaattcctgaaagctctttggcagcgcatttcactgtagtgggcatctacacatctgagaaaattttgataatgggaacatgaaaggggatgatagagaaacaatgacactcagcagaagtaaaagctcttaacacctttcatttcagctttatgaagtgaaaagtacaatacatactcccaagatcattctgtcctttactggtaaacgacacttggtgccaataaatctatggagaaattatcaacttttgttcctacatcatacaaaaatatagatttccccataatgtgacaatcatattttttcaaaaaaaaattaatgatgcattgcatggtagcaattagacctagaaaagacaacgtgaacttggtgaaatacaaggaacaagatgacacaaacaaatccttttgaatatttggtgtatattctacccaataaacacacatatcctcccctaaaaaaaaaaaaa

SEQ ID NO: 2675 - DNA, 254 bp, Homo sapiens
ctggacaaatggaaggaaagatttttggaagcagcttcttgtgtccgacccgctgtgatcagctgctactcccaggtctggggttagatggctttgtgactttccttctctggatggcattttgctttcctctgtaaaatggtgtgatgaatgagatgacctctaagcctctttccatgtctgtcactggactgtcctcttatgtagccatttaagttttctaattaaaaaaattaaatttaaaaaaaaaaaaa

SEQ ID NO: 2676 - DNA, 818 bp, Homo sapiens
  misc_feature (1)...(818): n = A,T,C or G
ttataggtgactgtcttatgtgtctagccttacggatatttggttacaaggaatgggaaacaactcaagtcaaattaaacaaaaatagaaggcatcaaatgcaagtcaaaggaagaaagctacaaaaccaattcaataacatctgaagcctgagaggaaaatgaaagacaagaggctgtggctgcagctgtgtctgctgacaacaggataaaaatggttgcattgagagtgagctgcattttcaccaggcagagcacactgggagctaatgtgtttcttggaaatcaaaagaggactccaagaatagaagcttttaagaggactggctggagagtcaaagaagatccattagcttctggaccactgaaaacctaagggctgatggtggggcagggtaagtggccggcagcagggagacattttctgtatctaggatggtatagaaaagacccccactggacagatctacaaagaacaactaaagagtctcatggtagaacaggtcagctctggacatcattcaaatccaggggagcctcttatactggattgcaattgtgttgggcatgtacaatggtgttctttttctctaatggcttctttcttctggtcagtctctggaaggggtgaaagagtgagaaatagttgccagcaagtgtagaaaagagatgtggaaaganagaacggcgaaacagaattgcatttctcccacgtttcaaatgtaggttatccggggttaatgtagggcccacctgacgaggcaaagattttttcctttgttgggagtttgaaagaactaacctcctacctgaatggaa

SEQ ID NO: 2677 - DNA, 376 bp, Homo sapiens
ctttgattaggaaacaaaaagaagcaagaaggaaccaaatctggattgtaatgtggatgcctaatgatttcccactgaaacatttacaaaattgcctgtctgatgagaggaatgaggaggagcattgtcgtggtgaaggactctgatgaagcttttccaggtgcattgaagattctgactactgaaaacagaaaatacaaaaagattaatgggcctgttgccagaggattcactgccgacagacatgagctgcctgttgctgtttagtatctctgcatcttcctgaaggctgagttttattatttgactcctcatatccctttaatcaataggctgcacataaaataaaatctactgaatctcaaaaaaaaaaaaa

SEQ ID NO: 2678 - DNA, 200 bp, Homo sapiens
cctaggacttaacattgcaatggattggttgtgaaatgccatgtgtaaagtcatgccttcctgctacactgcatgcttcctgaaggaaggggctctgatggtcttcatcatcactgtaactgtctccagtgtccacttacaactcacctcctcagtgaacgcttgttgagtaaataaatggataaagaaaaaaaaaaaaa

SEQ ID NO: 2679 - DNA, 784 bp, Homo sapiens
ctggctgttcctgtgcacaatgttcctaaaatggccagcccctcttcagatcatttgcagggatgggagagactgcagattgtagccacagctgtttataaatggagtgtaatgaaatccaatctttcattccgatgtgtgggagccaagggctggaacatggtgccccaggagcctgggccagactgggtcagaccatggtcagcactaggaatgaactgccgaggactcatgaatccgttaatgctctccatagagaaagaagataggagccacatgagtatgtgcaaataccgaccacagagagaaatccatagcatttcctttgcttttagagaaaaattttctacaaagattttaccatttttttttaatttgggagaaaattttaagccaagaaatcctgtgattccaatatgaaggttaaagggagctttgactgtatttgagtagttaagcataacaaaaatgaccaggctaagtaagttttgactttcgattgcctgattttattccttggaatttagttaagcacttttagtgaagtattgattcttgtgtatatcttgtgttatgtatgtgttttaccttcttctaaagaaatcagtacttgttatccaacagcattctaactttctactaggtttatttggctgaatggaaactgtctatcatcttcttattggggcttaaggaactaattatctcttgagctcttagctcctgctggtattcctttagaagacagatttcctggttccccagtaagaagtttcccctgagg

SEQ ID NO: 2680 - DNA, 320 bp, Homo sapiens
cctagaaaatggagacttaaggaataaagaagttttccccatgatggcatgaggaaaagccacacagtcctctggtgggaaccattagaggaagggactaacattgttctcccctgggtctcttctttgaggcagggagaagaccctggaacatctgcaggtgcagagaaatgccaccactggatcaagtgtttgtcctgtgatatggagaccactgagacagctttacaattgtgtgctagtcaagtgtagaatcaaaaccctttctgtagtttctgtttgagaaaataaaaaagttctggagatgaaaaaaaaaaaaa

SEQ ID NO: 2681 - DNA, 371 bp, Homo sapiens
cagaaaaatggagacttaaggaagaatgaagttttccccatgatggcatgaagaaaagccacacagtcctctggtgggaaccattagaggaagggactaacattgttctcccctgagtctcttctttgaggcagggagaagaccctggaacatctgcaggtgcagagaaatgccaccactggatcaagtgtttgtcctgtgatatggagaccactgaaacagctttacaattgtgtgctagtcaagtgtagaatcaaaaccctttctgtagtttctgtttgagaaaataaaaaagttctggagatggatggttgtacaatgtgaatgtatttaacattgaacaatacaattaaagacggtaaaatagcaaa

SEQ ID NO: 2682 - DNA, 700 bp, Homo sapiens
taatgaaattaaatataagtataaaatttttaaaatttttttaataacagaaagcatgcagtggccttttctctttttaatgtatggcagacagatcttcagatgtaaagtttgaaagcaatgaagtatgttatatgcaaaggaacacaatagagacaaggttaccttgctcttgtacttctgatgcccaagccggaacttcacgtagggatcgctcaacccgttggaatccatggccttgaggtctctcccttcaatcaaggtgatgctgactattcctctccaaagatgcgattttctgtgtaggtctgataggcgtaaactttgggtctgaaacttttggcaaatgaaaattgagttaggttactgtgttttaaacccaaaaacctcattttggcgttaccttttctcctgttatgattcttcaaaaaataaaggatcggcaattataatttttttaactaaaaataattatgaattatttattaattataaaattaataaattatgaaattatcatttcatgataaattcgttgtgtaaaagagttgagtgttcaaaatacagtctagcttttcaattcttaagattacaagatgtagatacttcaagaatatcagagaatatttgcatgtgtgccaaataggcttatgccaaaatatgtatacaataaatgttagaaatatcaaaaaaaaaaaaa

SEQ ID NO: 2683 - DNA, 362 bp, Homo sapiens
caggacgaggtgttcgtgacgggtgcgcggggagggtgtcagtggggggggggcggcgggcttcactggggatctgcggcaaaatgcttgagttgagcatcactggaaggaagactcagttaaaagaaaaaaagaaatcattgttacatttaagaagatggacatggcatgatttgatacagattggcatgataagccagtccaaatagcacacagaaaagagcaaattgctgtctacatttgactgtgtcctggaagagtaactgagtgtaatatcttctgagaaatataaataaagacgtgtagttacactattgcttaaaacatgcaaaaaaaaaaaaaaaatggcctcgttggcctca

SEQ ID NO: 2684 - DNA, 745 bp, Homo sapiens
cacgacaagagttggccgagtaccaccacgatatcacattccaggcgggggtctaggtgctccctctgttgcacattctgagatgatgtggtgcaatctcggcccactgcaacctcagcctcctggggtcaagcgatgggggtgtctcagccaatttctttggccaattttgaacggtttctatttcttttattgtgtcaacattaaaagttatcatttctaagtggacttaaaacaccatgattttttacaaagcctgagtaaaaatggttataaaagaacaattttagcgggagtagaggacatttccgggagaatataatgttgagtctgcttaatgaaattagtaatatttggtttagtttttcactttttgttctttttttaaaaaacttgtttttaactaaaaaaaaagcaataggaagttgcaatttttttcttagatacagtccaatcctggatttaaaatacattggtatgctggatattctgtgacattaagttaggaaaaatgagaaacagcctaggaactaaaggatattttactttaatacaatagtgacagttcttttagtcctctggcctttcagtgtcatttctcttatgatcttgctcagcagcatgaaaattaaatgacattcaaaaacaaaaaaaaaaatgccctcgttggctaaaagcggtggagttgtgcgccataagattttttccctttttcctacgatcatactaaatacacttctttttt

SEQ ID NO: 2685 - DNA, 201 bp, Homo sapiens
ctaggttattcggggtagagatgtattcagactttctaagctcaaggtttctttcctgcaatgcatcccactgcatatgcaggcctcacctgatcctcttcatgtcagcctttaggaattgcggcttggagagcaggctgaaatattgatactctgactactgctgttgctgtgaataaactaatggcctcgttggcctca

SEQ ID NO: 2686 - DNA, 252 bp, Homo sapiens
agatgtgaagatgtttggcttggtatgccatcacctattcctgcgaaatacattgactaaaggacctttttgaaggacgcgtttggcttagaggaggaataaccatgccagttttggtcaattctctatgatttacttctctcattttgccacatttactttagtagatataatttcattaaaaacaaaaaagaaacaaggtttatattaaatggaaatccataaaccaccaattaaaaaaaaaaaaaaaaa

SEQ ID NO: 2687 - DNA, 817 bp, Homo sapiens
cttgggattactctaatggtgaggtcttatggaacaactgccgagagcctctcaatgtggttccctggaatctgaccctcttctccatcctgctggtcgtaggaggaatccagatggttctctgcgccatccaggtggtcaatggcctcctggggaccctctgtggggactgccagtgttgtggctgctgtgggggagatggacccgtttaaacctccgagatgagctgctcttactctacagcatgacgactacaatttcttttcataaaacttcttctcttcttggaattattaattcctatctgcttcctagctgataaagcttagaaaaggcagttattccttctttccaaccagctttgctcgagttagaattttgttattttcaaataaaaaatagtttggccacttaacaaatttgatttataaatctttcaaattagttcctttttagaatttaccaacaggttcaaagcatacttttcatgatttttttattacaaatgtaaaatgtataaagtcacatgtactgccatactatttctttgtatataaagatgtttatatctttggaagttttacataaatcaaaggaagaaagcacatttaaaacgagaaactaagaacaatttctgtttttaagaggaaaaagaatgattgatgtatcctaagtattgttatttgttgtctttttttgctgccttgcttgagttgcttgtgactgatcttttgaggctgtcatcatggctagggttcttttatgtatgttaaattaaaacctgaattcagaggtaacgtaaaaaaaaaaaaaaaaa

SEQ ID NO: 2688 - DNA, 219 bp, Homo sapiens
ccctaggtttaacccatgttgtcatcgtttaaaaaatatgacatcgaagccaccagccttcagaagatctgggaaaagcacccacaacaactgatcctttttacccttaattcattgggaaagcagtgtgttaaaaagttttataaaatatctgtcaaagttttcttgtcttcatctcaatctggattacattaaatacattgcagaaaaaaaaaaaaa

SEQ ID NO: 2689 - DNA, 256 bp, Homo sapiens
aggagttttggagagtcatgcatgatgatctctgaagattctactgaaatctaatcaatatgtcctctctgccatcaattcaaaagaacttgctaagaaggctctagaggcttgtactctcagatagtgaaagtgagatgatgtgtagtgaaagtcatatataggttgtaaattgcaatatggaattcccaaatgctgaattcattttatctcttcggaaataaaaacctgttaaagactcaaaaaaaaaaaaaaa

SEQ ID NO: 2690 - DNA, 714 bp, Homo sapiens
aggaggataacctgaaatgctgcttttagatcagaaagctaagaggttcatacatcctgcctggatgagaatgtttttcagcctcagagcctataaaaatattgtggcatgaatggtacagctgaaacaacagaatgctgggaaaatgagtctgcaaaatgtacttgaaatattagtcatcaacacggtataaaacaccctttttaccataaaggcaagactgtgcctgagagctaagtacactttcgcctgcaggagcaggtggggagcgtaggtttatgttctacaaactcttaactacccaaacccatctactaatatgaagattaaagggtgggaatatatctcattcctctggactttcctaacttttcttcagaggtgatagaaaacatatgtgtcttcatattataaagacattggaatacatatatatattcctatatatatagttttatatatatatacacacaatttaaacaactaatataaatatattttatataaacctataccgcatattttatatttgtaaccctgttgttcaaaagtttgtttgtgaattaacctggaaacaaaaggttttctgactactctttgtttcaataaaaacattgaaactaaaagtggtaatgaaaggagaaatacgaaatgatattaaaatgggctaagggcattaaaaaaaaaaagaaaaatgggcttccgtggcctcaa

SEQ ID NO: 2691 - DNA, 410 bp, Homo sapiens
cctagatgcaagaaaaagcaaaccacacagacgaactgcacactgcaatgaagttggaatgcaagacttcatcagaagggagggaacaaactggataattcaaccgcaaaatatgtgaaccacaaacgagtaaatacacaagtagacacaacacacacacgcacacacacacacacacacatacacacgtctgctttttacccaggaattttcatcaatggagttttaaaaaagcatatatatcccccagcaaaagcatatggaaaatttcacatttctatgtttaaatgcttggctttacacgtattgtgaatattcttttagaaaagcacgaaaaaatggaaacaagtttttttttatcaggccataaacagcagattaaagttgaaaataaatcaaaaaaaaaaaaa

SEQ ID NO: 2692 - DNA, 339 bp, Homo sapiens
agaggcaactcctgttccagttactccatcatggcttgaagcagaaaaggaattttcagtttggaaaatataaattacttgagaagatcctcaaactgccatggttaatctgcatatttcagagatattttaggcatataaattattgtttttgttttatacatttctgtgtccacttactagggattacattgtcttcccatatgcatgtggaatcaggtattcattccagcttcttatcttccacctttcttccttattagattttcttgggctctatgttaatcctcatatttagctgcaataaaagttcccttctgtatttgaaaaaaaaaaaaa

SEQ ID NO: 2693 - DNA, 574 bp, Homo sapiens
cagatttgaccagtaggaactgagattcaacgtccccaagactgcaaaagtacctacaatcaaacaaattaatatatttcctaattggatcagcatgcagacaagtttacaaatatattacagaaagatttgaagagggattctggttacgttcagttaagcaggacactaatcctgaacaatctgatgtattaaagtttctaatgtttgtatctttggtttgatgcatacaatagagtggaagtctgtagtagttaatatgatgataattcgcttctaaatttaaatccttatttatatatgaagcatagctatgtcaatgtccagggaagcatttttaaatagtaaatcagaaacatgtaaactagtgaatacaattttctatttttcattcagaaatttgttgtcatagatgcagcctttatctggaaatcagtgggcagctctggtcaagcacagcatggcgaccactgtgtagtattttaccacctaatccttagtagccaacactgttaaatctgcataatgggtagcatatgaataaaataatatcttgtaaaaaaaaaaaaaaaaa

SEQ ID NO: 2694 - DNA, 387 bp, Homo sapiens
ctttcaggctgaaagtccaagattatggtgccagcagagttggtttctccggaggtccttctccttgcttcacagatggccaccttgtcactgtgcgctcacatggtctcttctctgagtgagtgtatccttggtgactcttcctcttcttctaagcatatcagtcctactgaactgaaaaccctgcccttattatctcagttaaaattaattacctctttaatgggcctatgtctaaatatagtcacactctgggttaaggcttcaacatactaatttttactgttatttggttcataagcatggaaaaggtagaagaaattatattttcaaatgctagtgggtggatatacaataaaagattatccttggccaaaaaaaaaaaaa

SEQ ID NO: 2695 - DNA, 620 bp, Homo sapiens
agaaaaaacaaaacaaaacaaaaaaaaccagaggattttcttatacaccatttctgcaagaatgagaagagaacaagctgggagtgggaagcttcactaaaggcagcagcaggtcccagggaagagagcacatggcagccctggcccctcacagctggcacggagacagctctcccaacctaaaaggatgtgtgtgtaccacataatacgaaggagaaaaaactcagaaaatcaggaagaaaacattaaaataatctccattccataggaaacatcacattttaaaagtttaaaattttgttataacaaaatttatgttatatataaaatttatagtttatattaaatataaatatataacatgtatcaatttataaaatgttttatgtaaaatcttcaattttacgtgtaaaagttcataaacaaaatggttttctcaacatggaggattatcagaaaacaattttttaaaatttatgtgagactagaattattcttactctaaatcattgtgatattattaaatgtgagaatgccatttagaatccaagaaaagtccagacctccttccagcttagttaaaaaaaataaaatgacaaataagttcaaaaaaaaaaaaa

SEQ ID NO: 2696 - DNA, 759 bp, Homo sapiens
aacattgtcactgaaaagactgaaactaacatgagtggaaaagaattgaagctcaagaagcagaattcacaataatcaagacagagaatcaacctaagtgtccatcagtggatgaatggattaaaaaatgtgatatatatacacaatggaatactgtcctgctataaaaagaaggaaatccagtaatttgtgacaacatggataaacctgggagacattgtgttaaatgaaataagccaggcggaaaaagacaaatacctcatgatctcactcatatgtggaatctaaaaaagttgatttcatagaagtagagagtagaatggtgatcaccagaggctgggacaattgggaagaggttggggagttgcaggtcaaaggctacaaaattacagttagatatgaggagtaaaatcaggagatctattgtacagcatggtgactacagctgatcatgatttattatattctcaaaaaatgctaagagagtgggttttaggtgctctcaccacaaaaatgataactatgtgaggtattggatatgtttgcaagctagagttaactattccactatgcatatatgcacttcacaacatcatattggatgacgtgaagatggacaattgtaatctgcgattcagtatatctcttggttttcgttcgggtcggatcgatctccaacaaccaccatcattgtcccaattgagctccatggaggccttctgcccccatcattttcccgtgtgcgaacgtgacgctctc

SEQ ID NO: 2697 - DNA, 789 bp, Homo sapiens
agaaaaacattgtcactggaaagactgaactaacatgagtggaaaagaattgaagctcaagaaggtgagaagcactttgcttcttcaaatgagagaaactattcattctttgatcaagtattttgtaaggtaatgaaaaaatatgaaaataagtggaatcaatatgtcgaagagatatctaacatccgtgttcactgcagcagaattcacaataaccaagacagagaatcaacctaagtgtccatcagtggatgaatggattaaaaaatgtgatatatatacacaatggaatactgtcctgctataaaaagaaggaaatcctgtaatttgtgacaacatggataaacctggaagacattgtgttaaatgaaataagccaggcggaaaaagacaaatacctcatgatctcactcatatgtggaatctaaaaaagttgatttcatagaagtagagagtagaatggtgatcaccagaggctgggacaattgggaagaggttggggagttgcaggtcaaaggctacaaaattacagttagatatgaggagtaaaatcaggagatctattgtacagcatggtgactacagctgatcatgatttaaatattctcaaaaaatgctaagagagtgggttttaggtgctctcaccacaaaaatgataactatgtgaggtattggatatgtttgtaagctagagttaactattccactatgcatatatgtacttcaaaacatcatattgtatacaataaatatgtacaattttattgtcaatttaaaaaaaaaaaaaaa

SEQ ID NO: 2698 - DNA, 795 bp, Homo sapiens
agacattgcttggtgaagttccaaatacatggcaagagaagaattgaagagcaaagaattcatgcaaaactggtttcagcaagtacaactatggtccaagggaactatgcccatttctcctacatgcttacaggatcccattagttcaacttcagtttttcttagttcctattactaagacttctttaacttatactatgtagatttagttttaactctatacgcagaagttgaaacttattcagcatgaattaaacatttattaagtacgcatcatgtgtagaggtgcataatgatggccaaattgcagaaggcatagttgttaccctcaaaaagctactgttacctcagtaaaggacacaaataattactatatataacaataaaaaacatgattgataaacagataaacgaagatagttatttctataaataaagtacctaacccaatctaaaatcagcaatataaatggattttagaaagataagtaggaataaaccaggaaagtaaagtagagtggaaactttctaggcagaaaggacagcataagcaaagacatgaaagagaaaagcagaatgagtcttcagagatgtacctcagttcaagatacatgaagtttaaagtactgggcagaagatgagtggacctattcacaaatgaaaaaaccctgagcctagtgcacacataaagaggaaggagagccaaggcatgcaagcttcaaatcacacaagatccacagggccaattttaaatggaggctttaccaatctaatctaatgacagagtgcaggttg

SEQ ID NO: 2699 - DNA, 1115 bp, Homo sapiens
agatacaaggacatctggtttgcattctgaatacctcaagatgagcactctgcaagtctgtgtaaacgtgctaatacatctgactggaatataataaagtggttatttctatgtctgactgaaagttataaagtccttagaaccagaagctgaatgcaggaaacccatggttgtcgtggtagccatgaaatctttagatgcttccgattgacccttctcacctcttaatttggcaaataatatcttcccaagaagattggtcttacagagcagtaaaaagagcttttaaataaaagtttaatgaaacccagtttcggcaacaatgctgtattagttcgttctcacactgctatgaagaaatactcaagactgcgtaatttataaagaaaagtttaattgactcacagttctgcatggctggggagccctcaggaaacttacaatcatggcagaaggcacgtcttcacagggcagcaggagaaagaatgagtaccagcaggggaaatgccagatgcttacaaaaccgtcagatcttgtgagaactcacttactatctggagaacaccatgggagaaaatgcccccatgatctaattaccttcacctcgtcctgcccttgacacgtggggcttatgaggattacaattcaaggggagatctggatgagaacacagaaccaaaccatatcagatgccccaaaacaaacttttgtgtacttcttgctgaagaagtgagttgatgtggattctttggaaacaattaaaaaatgtctgttacttaattggcattggtaatatgttcacagtaattgcagtttagaaatatattttaagatttagctgcaccccagaaaatgccacctaaatttatagtgccagaaaacagatcattggttgcctagggaaggggataggaagaagggtgtcaattcaaagggacaacttttggggctggtatatacattcactgtgttgattttcatgatggtttgaagagtggcaaaatctagaaaattctatgcttcatacgcaatcattacatttcagttatacttcaaatctgttgatagagatatgtacaaatataaaaaaattttgtcaaaaaaaaaaaaaaaaa

SEQ ID NO: 2700 - DNA, 408 bp, Homo sapiens
cctggtaattgccaggaaggtggttccgtttgaccagctgtgctctccagaaggggatggtcatgctgaagagccaatggatgtcctttattgctggaggctttcatcactactgatttctttttattctttattaatttatgggtattctacttcaaattcccagtggaagggagatggaattaagatactgataatggctagagagtagtattcagactgtatttatacatgtatctaaatacattcatatatttaaatatacatatttaaataccaatatgcagtaatcctaagcatatatagacatcttcagaattaaaatgcatttagtttaaaacttaaggatttcaaagttctaaaccaaatacgaagacaataaattattaagcaataaaaaaaaaaaaa

SEQ ID NO: 2701 - DNA, 554 bp, Homo sapiens
ctctgaactgtgacacatgcacaccgcctgagtcggcatacaacctctccttaagaggccttctggaccattgacttacgttaggaaaaagcattccctaatcaactgtatgatcatgccgtcatgccaccctttcaataccatttccctacacctagttcttcctaactttgctcactacccccataaaccaaaatatcagtgacatatttggcttctctgtgtctcaattttgacagctaaaaatggatagtaattcataccacctagggttgagataaagtaagcatatgcagtgctcaggtgagggccaggcaaagaaaagatttttatctgactttgaaaatacagatctcatagctagggcattctttctactgcaatagtccctctcccagctcttaaaataatccttttgaatagtgcctctccttacctatgtctggattgtttaagcttgacaatatctgcattatgtggcttcattactatttatttctattaaatgctcatttacataaattaaagtatattttaaagcaaaaaaaaaaaaa

SEQ ID NO: 2702 - DNA, 802 bp, Homo sapiens
cttctcatgtacgttttctgacaacaccttccattgtaccatctgtttctgaacaatacctgggacattgcaaacttgttctgcaagaataccctgggtctcagtgtgtgtgacaagggatggaagaattcaccagtaaaaccacctggacctgaaattttttcatgggaaagtttttgatgatgtattcaatctctactcaaatgttctatttcatcttgtgtcaattttgtagatacgtggtcttgctatgttgcccaggctggtctcagactcctgggctcaaaggatctgcctgcctcagcctccggaagtgctgggattacaggtgtgagccactgtactccgccacaggagcgtgtggccggggactcgtgcatgccagggaagagcactggcttccggatcctctgacttcaccatgtgacttggccagcaatgaccctgggttagagataggtggagcggaggcaggcagtggtcagagaccccagacatggggtcctggcaccacaactgtgattttccatcactttagaggcaccaacaggggtccctctggaaacgtggagcagaatcatccaggatcccgaagaggactttgtcctcctgcccatttccagttcctctcccatctcctctggtttccagaagcagcacatccccggccccacccctcatctgtatacggatcctcctaatgcagacccaggtgatggaaaacccgtctacaacgaaccaaggctgttcgtgctttcaaatattaaattctgttcagaatattaaaaaaaaaaaaaaaaaa

SEQ ID NO: 2703 - DNA, 853 bp, Homo sapiens
cagtgataaatccatgtgatgaaaattttacaaaaaatggatcactggatagagggtaagctaacaaaaataaaaatgcaacaaagaaacaaaaagtgataatgccggcagtaaactggatgtgattagattgaagatgtgaaattggcaagagcagagcaaagactggatgcaccatggcctgcatggagctatggaacaaactgcactggaaaaatccaatgtgtattaaaagcaaggtaacgttgcttcatctcttagtttaaattgcaataggaccagaaagctgcttatgcttggagagttttctactttggattgaagactgtaatatttcaaaatccgaagcagtttggcttgcatcctggccaaagcattgatcttagttgccacattgaaagaaaatggtaattacaagaatactgaagaagaatattttactgccagtaaaggcttgtttcctcattccagaatttagcatgaattgattgatgtcaagctagtgatgaagctgctagcacatgtaagcatgcagctgggaaatctgcatccagattccaagaaaatgaagatgtcccagtggaagtggcactggcaaaaaacttcaccttcaaggaattcttatagatattttgtaacattgcaagagcaaaggataaaacactaggacctgacttagaactagactacacttacaacaaagtacgacaattcaccaaggcatagaaaagttgctccagctgtatcataagctatacagtaaggggagaaaggcaagaactgtgcaaactacttttgatatgttctttacaaagaaataaaacaccttaattctcaaaaaaaaaaaaaaaaa

SEQ ID NO: 2704 - DNA, 469 bp, Homo sapiens
ctaggttcagaacctgtgttccatcagtttcagtaacaatgcagcaataggacaagtcttgatcaaacacttttctgctccctgtgctctgctgaacgtcaccaaggacacaaaactctgtgctctggagcgagcgtgggctgccatcagctaagcagatggataatgtgggagacagatcagcacatctggcagaagaggcccagaattgggtgacaatgaatgttttcatctgggcagatgtaacaaaatctcctcgctccctgcatggactactccttgaggaagtagcccacgtctgagcagcgtcttgcatcagtcaccacgcagttacttcacttcggtgccctcgagtgagaagtggaggaggtcaacttgatataaaagctgtacagctaagttttgctcagaaagtaccttgtaaaataaacatatgggtaaggccatttaaaagagaaaaaaaaaaaaa

SEQ ID NO: 2705 - DNA, 524 bp, Homo sapiens
cctaggattctttgaacccacctcacttagaagattctggaagtttcttcaggtggagtaacagacaactattcaagtcctggaagatcactggagctgttctgaacatcctcagtagtattaaagtacatatggattcattttaatatccagggtatttacatttctattattaaaacaatataggtataattttccacaataatatgttcttaataaccaatttacatctgcatttagtttaactgtaaaaataactttaccaacttatttggtattttttgtgtatgtaatttctaatctgtgatggctctgaatagcaaataatttaatatattttcaatttctaaagtattttcttcctcatgtagtaatcaactgcatgacaatttattatcaagcaaatatccagaattataagccaattttctttcatctgctattatataatatcattaattttgtctgagatgtaattaattaaataaaatacagtaatttaattgtaaaaaaaaaaaaaaaaa

SEQ ID NO: 2706 - DNA, 430 bp, Homo sapiens
ttagagggagtcttgctctgtcgcccaggctggagggcagtggcgtgatctccgctcactgcaagccaagctccacctcccgggttcacgccattctcctgactcagcctcccgtgtggctgggactacaggcacctgccactgcacctggctaagtttttgtatttttagtagcgacggggtttcaccgtggtagccaggatggtctctatgtgctgacctcgtgatctgcctgcctcggcctcccaaagtgctgggattacaagcgtgagccatctcacccggccaacagctcatttattttatcattgaatgatattcaattgtctggatgtaccacagtttgttaattcacctactgaaggaaatcttgcttgtctccaagtttttgcaattataaataaagcttccataaacaaaaaaaaaaaaa

SEQ ID NO: 2707 - DNA, 412 bp, Homo sapiens
aggtatgagacaaaggacagagttaaaaagtcatccctccgctcatctgagacaaatgcatacctgaatgcttcctctgccctatgtttatcttatgtaaaaatgcggattcactgagcatgagacaaacatccaagtgactatccctccaccccgcccacatgtaaaatgacagtgaacggtcatcagagactcaaaagaaaacaactgcttgcctcttttatctatcctcccttttttctttcttcctctctcccccaatgtccactctttccccttcaaatattgagatccccagactgtcttcagaaaagcgcacagaccacagatttttcctgtgtttctgcattctttttccaaggtgtgtccttaaccttgacaaataaacctcttaaaatgaaaaaaaaaaaaa

SEQ ID NO: 2708 - DNA, 739 bp, Homo sapiens
atgtggcctgttgctatggaaatctctcccactatctgcagatatgaatcacacacttggtagcactacatctgcagtgctgcagtgaaccatatggagaatttactgcagccaaaggagtcaagtaaaaactctctccacagatggattcagcacttcaaaggttgaggcaactgttcaataggttacactgcctatttctcagcaataccaaaattcaaaaaggcatttgtcctaaaagactagatacacaggtcctgagctgtcacttgaagtgggtaggcaaaggggctgctgtaaatagaactccaacagaaatccgcaaacctgaattggcaaacacagtctacctatcagagtcgtctggtcttcatttgaatccagttcatcaccagtgttatagaatgctactagtttataaatttataattttttcctttagctcttgaaaaatatgaaggcttgtttcataagaatcatttaacttgtgaaaattgaatggatgaatggtaaatcacaaattgagaagttaattcttgatgggtctggagttacagttgatatgagcagatattggttcccaatttgtagaccacccatatatgctatacctttatctaagtggttatatacattattctgattttacttttctccattcctacaaaaataagtgttattagccccatttgaactgaccaaaaaaaaaatttttttaaaaaaactaaaaaaaaaaaaa

SEQ ID NO: 2709 - DNA, 365 bp, Homo sapiens
ctagactttacttaaaagaagcaattttacatggtgtgtaaaaccgaccttggacaagaaatggaacacaaagataaatcatttgtggtgaatttaaacatgaatccgtggagctcctccttttctgaaatcctccatttcttttaaaacattctggtaataaattgctgtgagtttttgccatatcctatgtccttactcactgggaacaattgatgcttggaacccattcaacgatggttacatagatttgtgaaaacaggagccggctcagctttcctttaagagttgtttagtgaagttatgctcattgactttttactcttattattaaaattcctcattaaacctgaaaaaaaaaaaaa

SEQ ID NO: 2710 - DNA, 661 bp, Homo sapiens
ctaggtatcctgctgtccatcggtccgcagctagtctatccacccaaacgcccgtcagacctccggcccaccctcccagacggaggacaatgctccgccctctctggccccgcccccagtcaccgccttttccggaagctgctgcagcgaatcctggcaccctagcaacagcgcctttcaggctgtccagtccgcgtgcgcagctcctaggacgagccaatagtgaggggcaccgggagcgaggtgcagggggcggggctcgacctggccgcagccattttggtgcgagagaaacaataggacagtagatgaaaatattctataattagatttgttgatgattgcacaacactgtgaatatattaaaaccattgagttgtgacttaaatgggtgaattatgtgatgtaaattatctatcaataagattgttaaaaaaccaattgatcatatatgtgtggatctatttctggattctattctgttccattgagtgatttgtctatctttttttttccccaagccaaaatgtcaatttgattaacttatgagtttgtgtactttacccattttttattttattatttttgtttctctcgttgtatatgtgtgctttgaaattgaaagtataaatgttttaatttcaaaaaaaaaaaaaaaaaa

SEQ ID NO: 2711 - DNA, 434 bp, Homo sapiens
tgatggttgtctgaagttcctgaagctacaaacttctatggtaaactccagcaagaaagaggaagagtgagagagaaagagaaagaaatagaatacgtcttaaattaaaaagttccgaagtacaatctcctttatttgaccgccctgaattgggccatgtgcctacttgtggagttgtactgttcaggaaggtgagatatgataactagtttaaattctacggtccaggaagatgggatatgatgattggtttaaattcaacccttattcaaggacaggaccaatggaagacaaatcgtggaatatggggtatttttcaaaacagtaaatggagcagaaatgcccaatgtagcttctttattcatttaccttcttgtttccccagtgatatctataaaatacaaatatgaacatgtcaaaaaaaaaaaaaaaaa

SEQ ID NO: 2712 - DNA, 480 bp, Homo sapiens
gtgcctaacaagtctgaaaatggtcgtctggatctccacagtttcaggctccttgactaggctccatgaagacaagatatctttcattttggctgacacgtcagtcacagtaaacagactcagatcaagtagatttctaactacatcctttcactgagataaaacactcaagtttaccctatgtttacctgtgcagtgcacaaacaaaggcacttaaaataaataagcattgacttagcactacaatgtttaatataacacattaaacctatataatgtttaataaagaacaattcacaattctgcatgcatatctaagcaagggaaattggaaagtagttagaataagacagttaaatgtgtactttttttacaatctcttttattactgaaaatgctcttacatatttatttctcagatttgtaaaaagatcaccaactggaagttttaaataaactgcaaatttaaaaaaaaaaaaa

SEQ ID NO: 2713 - DNA, 301 bp, Homo sapiens
cttgaggtgaacgcggggttgagtaatttctcgaagctggctgtgaaaattcccgtgctatgcaactgaagaggaattattactttacctggaatccttgacactctcagccctcagtttgaactctattttaaagttgcatatttatgtgccatttacagtgaatgctccaggtttgatcacccaatattccaaattttgaacacctactgcatgccctctcagcccataggaatttcaaatgccttctgtcttttggtgctgccttaattaaaaagaaaggaaaagaaaaaaaaaaaaa

SEQ ID NO: 2714 - DNA, 586 bp, Homo sapiens
tgtctggagtgcagtggcgcaatctcagctcaccgcagcctcaacctccaacctcctgggctcaagagatcctctcaagtcagctgctggagtagctggaactacaggtgtcaggagatggcgaatcaagagtgaagagtgcaatccccagttcaaaagaacagaacatttttcaaatccatcagcatatataaagtacatttatttttatttaaaatggtaattacttttattttaaatttaatttttattctgtctcccccaccccgacctttttaaagcagaataattttccaaatgttgattttctttaaatgtaaattttataaagacaaattactcaaaacaaagagtattctatcctaattattaccaattttattttaatgtttaagatgctggtatgtatgaataataatcatgtaatctaactgtccaccttcagtattgatcaactcatctacctgatgtcttcttgctgttgctatactgacctctgcaggcttctgaagttgggaacaattgtttactctgtgcatagcgctgctggccattgtagaataaaatcatggcctcgttggcctca

SEQ ID NO: 2715 - DNA, 892 bp, Homo sapiens
cctaggtggagcaggagcctggctggttcctcctgctccagccctgggcttggggccccactcacctgcctcactcaactcatctctcccttcctctttcttccaaccctggcccaaggaatcctttctctcctaggctgcaggggacccatccttcctcacttatcagcgtgctcccaaatgcagtgactataactgaaaggccttcctttttccaaaaatgatggctatttgaaactcaaaaggcagtgattgagtctttaatacgttaaacacagagatatcataagacccagaaattctcctcctgggtatatacccaaaagaattgaaagcaagtgttcaagcagaatcttgtatgtgataattcatagcagcattccttataagaggcaaaagataggaatagcctatcatccttcaactgatgaatggattgcaaagtccggtttctccataaaacagaatattattcatccacaagaaggaatgaaatactgatacacgctacaacgtgaatgaacttgaagtcactatgttaagtgaaagaaatcagtcccaaaggacactgagtctatcggtcccgtgtatatacaatgtccacaataggcagatgctagagagacagaaagtatattaggggtgcacataggctgggggtgaggggggatgaagaattaccattaggggtatcatcctttgggggagaaaaaaatggtttggaactagatagtgataaaggctgcacaacactgtggaatgccggaaatgtcgctaatggtagatcttatgttatatgtgttttcccccaataaaaacaaagtaaaatagataattgcttaaaaaaaaaaaaaaaaaaaatggcctcgttggcctcagcggtggagctctc

SEQ ID NO: 2716 - DNA, 872 bp, Homo sapiens
ggtttttccattttcgtcacgccgagaagaccttctatgtgactctgaacattgtttgctggtataacctgcatctgctgtaaaaatcaaacaaaaagtgatactaatgtcattcttatgaacagaataaaaaagtacaaagagaataataaatttatttaataatgattaaagcaataaagtatatcaggagaatcagtaaatctgaaggaagaagaatgaaatgatcaacatgtttggaaattataaaagccatatggttactaataatgccaaaagtataatgttatgaaagagcaggctgtaaccttacaggtccatttgttcttcatggaaaatcacacttacaaaccatttatctttaaccatttttttgtggcaactttggttccttatatatatatagaattattgttataatgttaataagttaaacacttctagaaatctatgtctttgacctcatgataatattttgtcattaaaatgtctgattttaaaaggttgaacattttataaaatctcaaagatggtgatatataaccaaaagcaacagaaaatatttttatattttttctattttcatctcttccaagatgcctgaggatttcttttggggaacaaatgttcaatgacatagactaaaaatcttatactgtctttgacaattaaaacttcagttcatttttacacagacattcattcaataagtgaggtttaatgtaaactaaataaaataataaatcatcctggttagcaattagactattaaatgttatttcaaatctactaaataatttgaagcctaattaatcaaactggaaaccctaaaaattaaatgttgtctattctaaaaaaaaaaaaaaaaaaaa

SEQ ID NO: 2717 - DNA, 685 bp, Homo sapiens
ctagctcatctctgcggtgtgagcttctgtgcacactgggtgcttctggggaccgattccatgagttctctcctcatttccctccctgctcattggagaaaacagcagacctgcccttgggtgacatcaccgctttgcagcgcgggagctgcctgtcagaccttctgaagggagctactgcctcgtctgagccctggagtgccaccgcccctgcaccagcaatgtttaataacatgaagaatacaaaggctggcgagatgagtcactggtgcgagtgaccagccaaattgaatctcctttaatggaaaggccttaaaataaagaaatacaaatgcactctaatttccagttttagtgggaaatgaaatgtatttccagggagcatgcccacatgtgcttctttctggtggatgccataaaacacctctgaacctgaattagggtccaaattctttcttcacccagtgtttggcaaatttcagcatttgcatgccatcttccctaatttctttgccctacctgcgtgcctcctgtggtaataattacctttctaagttttctgggaattacttttttgtacctcaaattacccttggctttaaaaagtggaaaaacaaggccctggccccggggggtttacgccttggaaatcccaacacctttggggaggccaagggggaggtga

SEQ ID NO: 2718 - DNA, 829 bp, Homo sapiens
ctaggtcttgcctcatcactgccatgacaggggggtccaatgtgaggattctggtgtctatgccaagcatctcttttccaacgtagatctgatttcgtaacatagccaacagcaagtcaacatcagctttgcagagaaaagcagcaccaacaggtctgccaaatccagaagaagatgatgaagcttcccacccaagaggtgcagagagatttcctgaaagaagcagttaataaatggatcccacgcagctttgaaaaactcattaaaaggtcataaaaagatttgccaatttatttatactctcaatgatgtcttcactagaaaattcaaagtttgaactgggaaaacttgaaggtagtagttcttgaaaagcttatggatatgaactgccagtccaagaatctgtttaaaattcagatgtttaatagtgacaaacaaaaatcctgtatgtgaagaaaaaaaaacatcatgatattgctttctatataatttttttctgttgtattgtaagaaagatacatcccttttcctatagataagacttctgagtgtttttctgtttggcaatattagcaatctattttctgcctcagaaaacctatttatagacctcctattatcaggcattgtactgaattatttctttgtgtccaaaggttttcaatttatttccttggtattttagtgcatatacacattgtataaaataatgggccttttagtcttcttccactgtagctctcttatttctgttttatcctaaattcatgaaacataactttcaaaaggatcttacaaatagtgataattacagacactttcttaagtt

SEQ ID NO: 2719 - DNA, 290 bp, Homo sapiens
tctaggaagaagcccgtcagcccttcccttccgagacgatcctgaattccaagcagcaccgacatgccagcatggcgagccgctgctccccgcacccagcgcccccggaccccacgctgaagggcattctccatccgctgcaagataaactttgtctgggcaaagagtttccggctaaccccctgtgatcaacgccgctgcagctcgggtgcagaaaggcgaggggagacgggaagctatttttaggagaaaaaaataaatctcagcctacctttagaaaaaaaaaaaaa

SEQ ID NO: 2720 - DNA, 504 bp, Homo sapiens
taatgtgttctgcatgacttctgcactacaagcacatgtgacatttggacctacaggagatggtgggaagaagccagaacttgaagtgggtctagaagatgactggtttccatctgcaagaaaagtttttcgtgggagatgcgccattatgtttgaaaatacaagaggtgtttatggagaaagatggaagctgcttatgagacacaagacaggccctgtggaagtttagtcatgaagaagataaagaagattttctggagggatcctctagaaacaaacaacaaaacccacaaattataatgcatctgcacttaggctgctaggaactttgactcgatggagtgaaagcttaaggctttgttctttacctgtgctgctttcaaaaaatgtggacagtgggtccatttttgcaagcagaagttgtttaaccatgagatgaatgtcccatgatttcaaatgatatataataaacacttttcttttgtgtttccaaaaaaaaaaaaa

SEQ ID NO: 2721 - DNA, 819 bp, Homo sapiens
  misc_feature (1)...(819): n = A,T,C or G
gccatatctcaaaggtgatatcttcatgcgatgggagaagtctatgtgaacagatcggatggacacaagaaagagacctaacagcactctctgatggtttggctgtgaaaagaaagaatcaaaggtacttcttaggtttctggatggagcatctcggaggatgttggcaccagtttacttggagagggaacgctggcaaaagaactggctggggaggaagatgacagattcagctttagtttatacatgcctcatgtgaacactagattgtcttgatagattactgaaaattaaatgttacagaatcttagagtcagtattattcaacagaagttgtcctagtccacttgtgttgctataaggaaatacctgagactgngtagtttagaaagagaaggtttatttggctttcggttctgcaggctgcacaagaagcacggcaccagcttncagtgaggacctcangctgcttccactcctggcagaagatgatatgaagccagtgtgtgcagaggtcacatggtgagagaaagcaagaaagaggaggggaggaggtgccaggttcttttaacaaccagctctcatagaaattaacagagtgaaaactcatcccccgtttggagattgacaccaatcattcatgagggattctcacccatgacccaaaccctttccactggccccacttccaacatcagggatcaaatggtcacctgaagagggggagaccaacttccaacttttaccgaaagaatccgaaagcttctggttgatgggtgggaagaaatgtggattttcttcccttttggattacaaagg

SEQ ID NO: 2722 - DNA, 818 bp, Homo sapiens
cctagctgtaactctagcatctttcttggactggactgtggatgtaacgtcagctttccctgatgaactggaattaccaacctgagacttttgaacactgctctaagaatgctgaacccaagaaagatggcaaaggaatctgaaaagctgtgaaaatatagatctcattaaccaggtcattattttgacattgtgccttgatttttgatcataaggagtaggtagaaatgaaataaatgatggtacctgtatgaacaataggaatatattatgggccaccttccttgaagccatttccaaaatgaagtcagttccttagcctgccacagcctattcccatgtcttctccattcccctgaatgtccaacactgaggcctatgattgcctcccagccaaatccatgtgagaactgtcagcttccactcattttggtcaatgggacacagaacttcatttctcgcaatgtctgtccttcttcacccaacagctctcatcaggtgccacgttacctgcattctacttcctgagagctctcaaatccttctcttctcttcatgtccaccttcacctttctaggtcaggtgctcttaactctccctgacccaaactaccagctaacttggcagctccctgtactttggcttcacacaatccttgacacctccacacacaattaacattttaccaggtcagcttttcctatccccaccttcctcaatgctgggaactggctcctgctgctcacaagcccagtccaaaccttttaactgaagttgcgctgggcccctgggctgaatccttccgatcctggtactct

SEQ ID NO: 2723 - DNA, 540 bp, Homo sapiens
catggttcagcatccttaactatgattggagtcaatgtgcaacaccctttgtacatttcaaatgggattttttaaaaaagagagaaaaactgctgtgagcttcctggaatgtcagagtccagcaggactgtggggatgtgatatcttggtttatctgcgaggagttagggctccccagggaagtggaccctgacagtagacattttaacagaggagcacgcacacgcaacagtggggagaagacctaccaacagggcttggaaggagatacagttaggcaggcacaactcagtagagtagaaacttttaaggttctgatatctttttaaaaagtattattaatatccgtggcacaataagtgctcagagaatttagtcagttgactcatgcaccatattatttttgctacaaagtctgcttcttaaaagttatatgtgtttgttttctaaactgttatgacaattgcacttcttgtgttgttatataatttaataaaatattgtctcaagtagtggtataagaatgcaaaaaaaaaaaaa

SEQ ID NO: 2724 - DNA, 974 bp, Homo sapiens
caggtgatttctggaaaatcctgctggctcagctcctctgtgatcttgctgactttccacagcatggcctgaggcccatagcacgctcagagcccgcagtcctccctgagcctggccagctagcggcagggccttgtggcctgatgcaaatgctaccactacccaaaggccatttatgagactctccaagcagctgcctctaaaggccatcctaccagcatttaaatgaccgtcatacaagttttcttcatctcggggctctcctaccagctcctgctgcctttttttttttttttttttctggcaaacatattcttctgtgactttctcttgattgacatggggtgatgggatgtttctatgctcctatttgggtatttttagaagctgactgactgacctgctcctccttcctagaatggtttagttttttgtgtcacttggtagagacactgcagggcactgtgtggcatctgcctggtctgtttgtcaaactccggctcagggtcgcagctgtcaagtctggagtgcccagagcaccaggcacccttttcctgcagcccctgatgagttgacatgggacctgggctctcgccgggctcagcccacacctctcagaacagaaggcagttggaggagtggaatagcggactgaaatgttaaatcagggagcccagaggttctctaccaaaaaattcacgcaccctgattcccacttccacttagaaacaattctgcttagtcccgtctttcaagcccactgagcaccacctatgaattatcaggggcaccaggcagatgagcgactctttctgtccacttcaacatgctctctgacccagccctggctggagtgaaatttttaaatgattttttcatttgcatatttccatatggactatgagattcctgaaaatgcctatgcttaaaataatgaaaataaataattaaaaataattaaaaaaaaaaaaaaa

SEQ ID NO: 2725 - DNA, 931 bp, Homo sapiens
agatggagtctcactctgttgccaggctagagtgcagtggcatgatcttggctcactgcagcctcttcctcctgggttcaagcgattaccctgcctcagcctcccgagtagctgggactacagatgcccgccaccacgcccagctaatttttgtattttttttttagtagagacggggtttcaccatgatggccagatggtctggatctcttgacgtcatgatccaccggcctcggcctcccaaagggctgggattacaggcatgagccaccatgcccggcctctttttactttttaattgtggctaccagtttgaaattacatatgtgacttatagcagcaatacagcgggataaatggaaagtatctagttattctagattaaataatcgatcccttttccactaaatttaatggccatcttttacctatattaaattactttattaaataaaaatgtttcctcaactttctgttttcttctgcttatccacttccctatccttattctaatcacacaccattaacatgaaagggactttctaatgtgaggtagatataaatgcttcatcactattgaccacatttttgttccttttcttaattatttccatatatttattcttctatatgaaattacatgtgggcctacattttcttttctttccaaaaaatgtctgtcagctggtgatatgattcaaagtatatttttaaaagtataattaaataatctgatgcttaatatatttggtaggaaacaacattttcatgttaattgatatcatgtagtaaaatgatctgttactctacttatcaagatcttattttatgctcttctataacttttttagattttatattaggtgcctatatatatatgtatatctatctatcttattaaatttatttttaagtaaaaaaaaaaaaaaaa

SEQ ID NO: 2726 - DNA, 433 bp, Homo sapiens
ctgatttatctatgggcaggacttcgaggaggcttcccttaatcagggtcttagctctcgcctgaagcaaatgcaagcctgtcacatctctgcccttaaattgagaattgaaactccagccctccgtgtcttagcccaaatgttgcctttttggcctgcctcgccctgctatcctgtgcccatataaaccccagaccccagctggcaaagagaaaagtggctgaacaccaagagaagaagcaacagagcattggagactatagatagatgtggcttaactttagatggcatgacttcagagaggagcccggtcgtctctgggaaagatcaccttcatcctacaccatcccctctccagctcctgattctctgagagccacttccactgcttaataaaatcctctgcattcatcacctttcaaaaaaaaaaaaa

SEQ ID NO: 2727 - DNA, 555 bp, Homo sapiens
cctggtgatgactcttctgaatttcactctgaatgtggaaaacttccctagtctctggatgagatttaccaggctccaccaacaatcacccagtatactgtaggatgcaagatctatttcccgttactcttagaaaaattgcagaagtaatatttgaatgcattatttttataaaaacttagctcctggatgtttcttcattgtttcaatcctgaataatagtccagaagagaggacaaggagagtttgccaggccatgtcttccagagcctgctgtgtcctcagtcactgccagtgacaggagtgaactccttctcctgctaatggaagaagagttaactatgaatcagcctctggaaggcccttcagaaaatattccagaaaaagacattgttattttagaagatgaccactccatatgtcttattgcccatgagataagaaatgaatgtggaagaaagtgattgatgattctgaccttgtataggcaaatttttatgttggagtcttagttttcaataaaaaaatttaaaaggtgaaaaaaaaaaaaaaaaa

SEQ ID NO: 2728 - DNA, 492 bp, Homo sapiens
agcctggaaaaagctaagacacactttcccagtctcctgcaagttggacggtggctgtgtgacatggtctggccaatgaggtgtaaacctgagtctgctggaaagatactggaagaacttttgatatcctgataaaaggaacacacatctctatcattgctccctttccccttcctccatctgggaatgcagatgtgatgacagaagctgccatagccactctgcagtcatgaggcaaaaaacacaaaagcatgaggacaaagtgccatcatgctaaggagagcacagcaaaaagacagaaaggctctggtcctaaatggcacagctaacaagtgcccatttccatgcctcttgccaaccaacacaattcatgtccttatgatttcaatccctggtggtcaggttttggtcacttgaagctaaaagcattcctaactgattcaaaccccaaataaaaacattgccctaatgatgaaaaaaaaaaaaaaaaaa

SEQ ID NO: 2729 - DNA, 897 bp, Homo sapiens
ttttttttttttttttgtatttacaattacagttttattatagcaaaggatacaaattagaaccatctaaagaaaaaaatgcgtaggatggaaactgggaggatcccataacttgaatctctctttgcatcaggcgtgcattaagctctacaaatagatagatgtgtgacaatatgaccagagtattggttacccagaaagctcatcagagtctctaggggctagtgattttattggggtttcattacatagtcaggattaatggaatcagcatccacacagttgagcttgatctctagcaccccaatcctgggaggtgaggctgatatcacttggccccaaactccaaaactagacaaaactacaatcgtacgttttgtctttctggcatggcttgctcctttctgagtcatctcattggcattaattatcagatgtggtacaaggggattaccatgaataacaaagacattccaatcactctcaaaattccaagtgtttagaagttacttccaagtaactaaaaacgaagaccagacctctctttgagctgttgttattattattattactattattatgttttctttttctgcacatcctatttcatttaccgctttgacaaccgcatgtaaaggctttcatagtacgattctcaaaataaagtcttggtagtacatatttgcaaatggaatacagaggcattctagagatcacttttaagacttgacaaaactcagttctatttgtttttcataaagacaattttaatgtgaaaacaaaatatcaaatagtaatttgtggtactgagtgagtacgttatgggtagaacatcatctgaacaaacatttaaaaaatatggagggccaggtacaggggcgtattcctattgtccca

SEQ ID NO: 2730 - DNA, 125 bp, Homo sapiens
agcgaaggctgactcaaagcccaatcctgaagaaattcaatcacctttctccttgaagctcataacccctctcataacgattataaatcaacttctagatttttctttttgcaaaaaaaaaaaaa

SEQ ID NO: 2731 - DNA, 409 bp, Homo sapiens
cttaggagacacttgggtgcccagctgctgtccatactctacacttatcccacctgatggaaggctgttaagaaaaacatcactgcaatgcctaataaacagacatgggtcccagacccaataagagtgaaaccatccccctatttaaatgaaattatggctgatgagaaagacaaattaatttctctgtccctagtattacacaaaactttggatgctgccattgttacaattttattttccccaggagctcagagtcccaccttcattctttttgtttaatgcttaagcttgcctgtccacctatggaagactagaatgagcaaagaccatgtattcaatgatctgtaaatctaacaggaaacaatataataaatatattgtgtttgctaaaaaaaaaaaaaaaaaa

SEQ ID NO: 2732 - DNA, 1003 bp, Homo sapiens
gggacgcccaaaaaggaaacatccagcaagcagttggaaaaaacagttataagatgcttgctgatctgagatattttttcacgaacataatgaataataccaacataccaaactttttggacttttcttctgatggaaagaataattgtaaagaaccacctggcaagctttatctgaaagtgaaacgatatctgataatttcccagagtgtaacttataacgcacatcatcacacagcatcaaaaaagaaaataaaattgtctcacaacatcttgtggttgcttcctaatatgatactgcactgttcctaaagttatttaatagtgattaattgcataattgttttaatagttaatatgtgaatcccttacatgaatgtctctttgttttattttaattcgaatgcaattttgataatccaggatatttttaaaaatatattttataatattttcaatctactacaaactccaacatataaaatttataagtaaatacagagacagaattttcaagttgcctaaatgatttaaaatattgtgtttacaattatcatgaaggaaataataatatattgatgctttatgtaacagtaaatttgaattcttctgaaagatataacagactaattttactgtagacacttcattaactttgtaattaaatataacttggtcaggacactgtctttaactttctctttgtcataatgatacatttaactgttttgtattctattgggctaaagaacttggtaaatatagttttttaacattttacatttttttcctgaatatatgttttaaaatctttacagtgtttccagttgaattatatctatgcattgctatctttttaaacttgggacttttatttatttcatagtctttatattttatttaaaaagaataaaattttgcaacctgtgtaatcctctatctctaactggacaacccaattaaaaagcataatataaaattttcttgaaaaaaaaaaaaaaaaa

SEQ ID NO: 2733 - DNA, 799 bp, Homo sapiens
cttaggcacagagcggtgaacgtcatcgtggcgtatcaaacctcagccgaaccggcgaaagtggctcaggccgacaacacctttgctaaagaaagcggagcaaccgtggactggcgtaagtttgacagcggagccagcatcgtgcgggcgctggcttcaggcgacgtgcaaatcggcaacctcggttccagcccgttagcggttgcagccagccaacaggtgccgaagaaagagtatagatcactttttaaaaaacactgaatgttgctagaaaactcaaccacgaattgcctgtgacccagggcttgaccaaagcttccttaagacatcaaatattgcaaagagacaacttaatgcacttattcccctatggttgtcagtgtttttttttgtgattagctagatcatcagaaagtaacatttccaggtcatattattaccacaaatccgtgctaaagagccttcactaagttgaaatttaatgtaacttcaggttttattgagggtcaatgaagaaatgtctatttgaacatttctgtcttttacagacccctaggttaggacattgttaccatttgttaccatttgttattcatgttaccatttgttattcaaataattaccatacacaataagtttctctttaaaattggaagcctgaaataatgctctgtcttaagaaatgtctatgctggctattaacatgtaatggccactctagactttattacttattatttttaggtaatttactcatctaagaaacaattatgcaaaatttttttactttacaatcttg

SEQ ID NO: 2734 - DNA, 523 bp, Homo sapiens
aggaggaaatatcactgtttcaggaggagagttacttcaggagccctgcggacagagggacagcccaccagactaccatctgttgtttgaataatttttttccttatcaattggattcattttggtatcctgtttttgaactcagcttaagaacttcccatctcaaatcctatggccttctggaagatccaccactatccaaaggaaaaagtagattaatatgcctcaagggatatgacatctatggcatagggctactggtctcatcccagcgatcgggacagaaattgctaatagctcatgcaactctttcatgaagagcttagctatgaccttagaagacaaagcctgtttgtcatggctgccgtaaaccgagctcttacagtgcgtggaccatgttttaataatccaaaataattccagtgccgaaccctgaatttaacatatggtagacattcagtaaatgtttgttgaatgaatgcatgtcttctaaaagttttccaacacagaaaaaaaaaaaaaa

SEQ ID NO: 2735 - DNA, 731 bp, Homo sapiens
taatccgagagacgcttctaagcgcctctatttatatttggcgcgtcaggcttgttgctattttatatcggatagtaatagacggaagataagtcggtgggtttgctaagggactatatggtatgtaatttgtaatcacattatttgttgtgcgtggttatggtaatattcatgggggttcaatacatgtattttttgaaagataaagtcttctagcagaattgtgttagtgtcacctctgacatttcagcagctcatttctgttgatgttaattgttactcatctcaattaataatgtccctggaggaatcaaggccggtggttcgattatttgcgtgctatgtagtggtgcagcatccagtcagtttgaagagtttcgattggaccataccaatgagaagcaataggtcggtttttgatgggggattgaggacaaatgtattaatacaagagtcctgggatagtatacaaccaagtcagggtttttttaacatggattacatgcagtgaatggaggcataggttttttacccaacaaaaatggtcagtggatttgactttttaaagactttttttgtggacattttgacatttggagaataaagatggcgcactaacccagataatagtttttatgcctggaattttttgcagtttgatttgtatgcgtatgacctcttgaaatgttaatttttaataaaatttgtaacacttaaaaaaaaaaaaaaaa

SEQ ID NO: 2736 - DNA, 279 bp, Homo sapiens
tttttttttttttgagcaacaatcatttattttcctcaagatgattctgtgggttgccagctagatgcgctcagttggatgcttcttctgttggccctcctgagctccttcacgcatctgcagtcaactccaggttaagggatgagtgatttagggggagccacagcccagatgcatggagctaaaacacaggagtcctccatcgtcaaaggaagcgtcctgcaggatgccttggcaatgggaaatccagttatcagaattgattccagaaaagagaaa

SEQ ID NO: 2737 - DNA, 359 bp, Homo sapiens
tggacaagatcagggacagttctgaatgaaggccagcaggcagtatcagccgaaccaagaagggccataaagctgcagaccaggaaatctgccctctgagagcacagaatttagaatggacagcaaatttagtaaaagtgttccagctagaagatttggatgaaaagtgattccaaaaaaatgaggcaatctcatcccgaaactatttaaaactactctcctctctcttgataaaccgtcagtaggaagtgtgtcgtttattccctcactccacactggattcatatgggctgatagcagcaggattaaaaatttttttcatcatgaaaaaaaaaaaaaaaatggcctcgttggcctca

SEQ ID NO: 2738 - DNA, 461 bp, Homo sapiens
taggagttttctaaacggacagaaagtattgcagtccaggctgagaaccttgtaaaggaagcttcagagataccgcttgggccccaaaataagcagctgcttcaacagcaggccaagtcaatcaaagaacaagtcaaaaaattagaagacacgcttgaagaagatattaaaaccatggaaatggtgaaaaccaagtgggatcattttggcagtaattttgagactctgtccgtctggataactgagaaagaaaaagaactcaatgccttggaaacttcgtcatctgccatggacatgcaaatcagccaaattaaggtgacctgctcacacattatatttataatccatgtctagcttttaagaactactttcttacatttcatcaaatgctgttcggtcccaggacaagactttcattgcaatgtgactattaaaattaaattcatacattttatcaagct

SEQ ID NO: 2739 - DNA, 594 bp, Homo sapiens
cttcaggctaccaaaatagatatcttccctaaggaaaaagcactgcactgggaaagaataaccacaattgagtattctcctggataccctgaagatgtacaggcactcagtcatgaggaatttactgagcaaccaccatatttcaggatactggatgctgaggacacagagataaataaaatattgtttctgccaacaaagagcctacagaggcaggaggctcctctttgtatcacatttataccttggaaaattgacttagcaacttgagagactgcaattcagaaataactgtctctttaatctagttcaaagaaaattcttaaaaaatttgtgaaatgtttctttatatcagtttaatataatgtattatttatactcagaagataaaatgtgtttttttcattttctaccacagaattcaatactttataaactataattatagacaaatttctcagaaaatgaaaagtaattgtaataatagcagttagatagttacattactttttaaagccttattgttcaacagtttataagggggcaatatgtaattttattttaaatgaagtaataaatttggttcactttaaa

SEQ ID NO: 2740 - DNA, 667 bp, Homo sapiens
agagtttactcttgttgccctggctggaatgcaatggcgcgatcttgactcaccacaacttctgcctcccgggttcaagcgattctcctgcctcagcctctctagtagctgggattacaggcatgcgccaccatgcctagacaatcttgtatttttttttagtagagacagggtttctccatgttggtcaggctggtattgaactcctgacctcaggtgatccacctgcctcagcctcccaaagtgctgggattacaggcatgagccactgcacctggcctctatttataatttttaaagattaattttcacttttgaagacctatcatatgctgaagtatattcattaaattcaactctatgaaattgtcagtttcatgtaggtcaatcatctttgacctacagaaattgcaatgtatacttcattctaatagtgtattatcattgttcaactaacaaaatgaatctgttttggaataaaagtggctagctcctattccaaaatgttctttaagctttcaaataagtctaacttctggaaaattgttggtgaaataaattacttcaaaatcacgtttgaaaactgtgactccaaaataatcaaaacacaatggaagtttttgattttgaagaaataaactcaggtcagactgttttgagttgaaag

SEQ ID NO: 2741 - DNA, 342 bp, Homo sapiens
cagatgctaactcaactaatgacaataaaaaaactaagacacaaaaataaaggcaagaaccacggatgcaaagaggaggttttctttccagagatgtctgcagacacttcagtaaaatgcagtgtgaaaacatccaagcttcaattccttattaactaagagtctcccagaagggatagatatcttagctatcttagaaatctctttagtttttttctatctatttgtttttattactagaaaaatgttgtatttactgggaataaataagtctttggagactttacaaacgaagaggacttaataaataaagacagacttgatggatcaaaaaaaaaaaaa

SEQ ID NO: 2742 - DNA, 344 bp, Homo sapiens
tcagggcccactctgggaacacaagatgaagataagcagtcattacaatggaagaaagtggtgtggcagaggtcctaacactgaacctggcatagagcaagtgtttggtaaatatgttctgagccaacaaatgaaggagtccaataaacaggatgacttgatttgccttgaccacctcttcttcctcttcccatgattctttatgagcatgtgtgatttaggtaattgttctctaagccctatattgtaaatggtaattaagaccaatgatagaagccaaattccgagtgacatttcttcttcaggaataataaaagttggttataacaaaaaaaaaaaaaaaa

SEQ ID NO: 2743 - DNA, 1264 bp, Homo sapiens
gctagagtcaacaccacatagatgtcatcaagacttactgcttgagccctctggagtggtggcacaagccatacccggacccatctgagccacggctgggacagctgaggagtgctgagcctgaatgcagggagcagagtcccaagcatctctgagcagtgaatgttgaagtcccacggcaaccttcctggaaaccttctctggaaggccctgttctgggcctgtgatgggaggggcaacctgctgagcccatcaaatgcccttgatgtcttttccccattgtcttgatgaatggcacctggctcccttctatccatgctaatctctttagcaaacagtctcttggccacactcttagtttactctcctaaacatgccttttcactctttacatgaccaaggctgctcatttcccatatattttgttctgcttcccttttaattataaatgccatctttaaatcatttctcttcattcacatcttactatatgtggttaaaagtagctatgcagttcctccagtattttgcttagaaatttcttccaccagatatccaagttccttgctcttaaattctacctcccataaagccctcagttgtggacatgattcagccaagaatttatatagtttctttgtgaatttataacaaagatggcctttactccagtttccattacttttgtttctcatttccatctgagatctcattagattagcctttaccatatcagaaacgttcatatttctaccagtattttgattaggaccacttaagtaatctctaagaagcttcagactttctctacaagtctctccagaatcatgcttaatggtctgttcacagcaatataggctgttgcttgcctgctcctccacattttcccagcatctagccattacccagttccaaaggtgcttccacattttcaggtatttattatagcaacagacctacttctcagtgccaatcttctttcttggctcattttctgtggctataacagaaaaatacagactgggtaatttataatgaacagaaatttatttggctggtggttctgcaggccaggagtccaagagcatggcatctgatgaggacttttgtgcagcatcatcccatggcagaggtgaaagggcaagaagtattgagagcaaaagatcaagagggggccaaaggttttgtaacgaagtcactcttatgataactaacccactcctggaataacaacattaatccagtcaaaaaaaaaaaaaaaaaa

SEQ ID NO: 2744 - DNA, 764 bp, Homo sapiens
acttacgaagaatgtggccatgatgacagggaggaagatttacatcagacctgcagtatggacttctgctcatcaatatttactggtcacagaaactgctgaattcaaaatctgccaacaataccatctgtgtgctacagaataccttattcaggatcatattattccttataccatcattgttgaccaaggaatttattttacagcaaataaaatgtggcaaagggcccttgctcgtgaaattaactaatcttgccatgattttcttcatagcatggataatagtatgatggaatggctttttgaatactcatttatgatgtcagccatatggcaaaacttttcagggctgaagtaatatccccaggatattctgcatggtcagcatacatgtgtggtgccatatctcttacagtccaaatgtatgggtcaaggaatcaaaaggaggggaaaaaaattagaatgcactatcactatttgttcacgcgatatactagcaaacttttgacggtcattgccattatttttacgccctgtgagtctagagatcttattgtaataggaagtagcgcctctatcaagtgataaccgcaataatgattgcattgacccagaaccctgagactcgacccagaccaactaggggtctgtattaaccaggcaacaaacggggcttccgcactaagcggagtgattcttctcaatatccgcggaaactcgggttgttatgaaacagccaaggaatctatacccgacacaaaaca

SEQ ID NO: 2745 - DNA, 425 bp, Homo sapiens
agacttctctgtctataaagctaacttctgggaggctgaggcaggtggatcacgaggtcaggagatcgagaccatcctggctaacacggtgaaaccccgtctctactaaaaatacaaaaaattagctggatgtggtggcaggcgcctgtagtcccagctactcaggaggctgaggcaggagaatggcgtgaacccaggaggcagaggttgcagtgagccgagatcgtgccactgcactccagcctgggcgacagagcgagactccatctcaaaacaaaaaaaaaacaaaaacaaaacaaaacaaaacaaaaagctaacttcttctggtcagctcattggaatacttattctattttagggaatgaagtgtttctagattctggaattgcaataaagccagttgagattttcgaaaaaaaaaaaaa

SEQ ID NO: 2746 - DNA, 861 bp, Homo sapiens
ctggccgcaacactccaccgctgatgccaacgaggccattttttttttttagcatccaatcaacatttttattgacttaattaaacttttaaaattattttagtaggactattttaaaaattcataataatatttttggaataaaggctcaaaattccaagttgtcataaatgaaacctcatgggcttacagcttcagcaactagtaatattagtagcatgcattctctggaatagagaaaatgatagatgatgtgtgatcatgttagagaatgaatcatacaaaatatcaactgaaatcaatcttttttcatagcaatcataggtatacgaagtaatattggaaatggcttaagctcctgtctgatggagagtaacatcaaggtagaggtagatgaaatactgaagctcatctttttatcaaactcctgccagtctctgaagaaggtcaataattatgacaggacacagataaaagaatgctccatatttcccagcactgtgagtgactgagcatggctttatatgcttggccaagagaaacttccagaaaatcaataaggaagtaataaccatatagaaaaatctagatgtgaggatttttatcttgttattgaaggaattacttacaaggatgtatacttgttaagtgttcatctttacctaccaaaatactgtactactcagttaaacttttaggtcgtatcattttcatacagggtgaataatgatcaactgcccttcatttcagtcgcaaccctggtgtgctgtttgctgttggacttctgtctgcatgagtgagttttcttgcaggttaaaagactgaattccttcttttcatctcccttcgaccctgagccag

SEQ ID NO: 2747 - DNA, 784 bp, Homo sapiens
taggggggacactaccagttgctgaaccagggactattccaggatttccacacacatgacttcatttaatctccacactcttcttgtgaaatgactgtttcttatccccattgtgctgaggaagaaactgaagctcagaaaagttcagcaactagttcaggatgccacagctacaaagtggttgagttgggacttgggctcaaaagcctgtgtgctgaactgccgcagcccagtggtgaaatctggatcataggggcccccaggaggatcccagaaggactcaagtgcagcctgaggggcgtgtggggtagagggcggggcttgccttggtggtggtggttatggttgatgattgtccttgcgcataatatgtggtcgcaggtctttttttagtccccgccggcttcccctctccctggctgccccatgagtcacttcccagctgtccatcagatcacagcgtagcctcctcagctggaggcccaggggaaatagctggctttatcgtctccagggacagctccccccataccctgcctagctgggtggggctcagtgccttaagaagcacaggccctttgacaagtagaactgaattcagaaaactgtgacctacaggagaattgatttcatttctactgcagaggagactgaaggtggtcctcacctgaaattacagatctgggtttttcccagactctgtgagctaggcggaccacgggtcaaattctggtatctattgcttaaaaccacgggatcttgggcaaggctttaatgtttgcca

SEQ ID NO: 2748 - DNA, 650 bp, Homo sapiens
ctagtgttgaactacctaaccccacccctgtctaccatggaaggactgacctgcaggttctcagtggcagcaagcccttgggatttgctgcttctcttctatgattgcttaataactcagtcagcatgaacagatctttgtgacgtggccacaagttcagatttctgagagttattcagagctcacagcaacatgaccagacccaccacccagccatctcaccatcctaaaaccagaaaccttccaaaatgtcttctgatccctcaaccctacatccaaccagaagtcaaggactgcatgaggcagatactgccaacctacctgtttcagaagtgagaacactaggactcggagacactgtggaagctagaaagcccagccgcatggtactggcatctggttcttgaaataagtattttggaagatgggaagttatacggcgataggaagccttctatagacaatttaaaggcaattatgtcaattacaaggtaaccgaaatatgtcagtactacattttgtcacttttttgtgaataattcttagtcttgaattcttataccaactcaagtatacccatgtttggagacctattctgatacagagtcccttccttggaaatataaaattgaaactgaaaaaaaaaaaaa

SEQ ID NO: 2749 - DNA, 435 bp, Homo sapiens
cttggaaacagaatgtctgtggtcagaagttccttcttgggactaaaccagttgaagctggcaaaatccatgatggcagcttactcgatctttgaagaacctctagcttcattatactccaacttccatactaaatgacactcccaccaatgccatgacagttgacaatcatcatgacagtgaccaaaaagaaccaaaaaaggacaggaaagaagtggctacttgattccaggaaaatctccatcctttcccaagaaaagcatgaatattcctctccttggttttaacgctcaaacctttcattaaagataccttgtgtctgtaacttcctgattctcaggagctgacatgttgatgtgtgagccacactcccacttctccatgtcatgaccatcgaataaaacctgtactgctctatgctcaaaaaaaaaaaaa

SEQ ID NO: 2750 - DNA, 385 bp, Homo sapiens
cctagggtggagtctcactctgtcatccaggctggagtgcaatggcgccatctcagctcactgcaacctccgccttccgggttcaagcaatactcctgcctcagcctcctgagtagcagggactacagacttgggtgtaactggatcagattttctggaattcaagggagaagccgagatacttccctcacagaaattgttcttcaacaatagaaaaagcataacagacattatgagagagaacttcatgataaaataagctattaatttgactaattcagaaatccatagcatttttcagaaattatagttatatttaaattctgtacatcccttgaagaatattgaccatgcaaaaatcagaataaactatgttcatccaaaa

SEQ ID NO: 2751 - DNA, 777 bp, Homo sapiens
cctagatgggacaacaacaacaacaactaacaacaaacaaagccagagaacacataaaacccaagattacacagcgatttttccaacccatttggtgtctcagtacacggactgactccatagttgccattcaatggactacagtgaatgatgctccccggagtgtgcaatctgcaagcctgtaagagaaaaaaagaaaatccccccatggtcagaaggactcctgggacaggaagaatgaatctttggtaggaagctggctgtggacttttcaggcatataaacactttagtcctcacctactttttgccacatgaagagcaatttagtcagaagactgccaagccatatatttctacaatacttactggcttcaacaatgctaagattattaatgcaaattaaagtttaagaagaatccttcagttagctcttttacagtctccctccactctacaaacatcatttcaacctatctgactttttgtctgctttcccataatagcctatataaggataggaatgtttatatgtctttctaatgggtaataaccatcaaagggcaaatacatttcaacgctaggcaattgcagaaaaccttttaccgttgagttttaagtttctcaaatgcaacatattctgtaaaaaaacttaacactactttgttaatttacagaggtaaattctacaaattctattaaagtaacaaaaaagcataaaatatttttgagtaaaactgtcatgaataaagatattctatttctaaaaaaaaaaaaa

SEQ ID NO: 2752 - DNA, 210 bp, Homo sapiens
ttccaggaaggctattctaggtgattgagtattttctgggagaagacgttgccaactctatttctgacaagaaactgaccaacacaaacctcattttaaaaagtgttctttgaaaatgtgtacagaatggataaataaaatgtggtatatccatatgatacaatattattcagtaataaaaagaatggagtaatgataaaaaaaaaaaaa

SEQ ID NO: 2753 - DNA, 569 bp, Homo sapiens
cctagagaaaatacacaatgccaaataatcaggcttatctctaatgagcaaccaaatacaaaaacataagaagccaaatcaatcccctggaagaagatggagcaggagaactatcaagaaacaccttcaatttcttaggactcaatataggtgaactgtaggtgaaatgccattgaaatgctctgaataaacctgcaaaatgaactgtacaactaatctcatctgggaaatatgaaacctagtggtcccagtcatctagacattggggtatatgattcaaaaataaataaaaagaaatgagtagataataaacatccttgaaataaaaaagaatggagtttcaaaagaagcggttacagaagaaaaatgtttttcggcagcatgttcttcacaaaacaatccagaaagaacaaaagctccaattatgaattgaggtttgttttttctgcagcagccttttttctctcttcaaagcagaccctctacccgcacttgtgtggctgttgctgaagatgtttttattgcatagtgcaataaatagttatataataaaaaaaaaaaaaaaaaaa

SEQ ID NO: 2754 - DNA, 569 bp, Homo sapiens
cctttttacgttaccaacctggtccggaactgctggtctcaaacaattctccctcctcagccttccaaaacgctgggattgttgacagggtctctctctaatgtccaggctggagtgcagtggcacaatcatagctgactacaactttgaactccttggctcaagagatcctcctgttccagcctcccaaagtgctgggagtacatgagagagccatcatgcttggcaccttttattttatttaatatgattaagtggttataattttgtaaatgtatctattcaaccttagacataaggtcataggaaactgtatttagaggtaccttatattaattaaacttttgtctaaaattaatactgccagttataagaagatagctgattacttattattacatattgtataaaatatagccaattatgcaggaggtaatgtttgctgttttagaaatgtaatgacagtatcatcttatttcatgtacctttaatatgttaatttgacttttattgtttaaactcaaattattaaaatttgtttagtttaaagttaaaaaaaaaaaaaaaaa

SEQ ID NO: 2755 - DNA, 158 bp, Homo sapiens
ctaggtcctcttggaggagaatgggtgactattcccgaactcaccagaaggtattcatccaaatgagtgcccaccatgctaccctttggaggctttgcctgtattctaatgatgctgcaataataaaaagtatgttttgttttgcaaaaaaaaaaaaa

SEQ ID NO: 2756 - DNA, 506 bp, Homo sapiens
ctcattctaagtctgacttccctaatgctcagaagatggctatgttgagtccacaaacttttgaattcagagcaagagtgagttgatttcagaagctctcccagaagatcaagaaagaactttccaggatctccaggaacctgaattgagtcatacgccaaagtgagtttcatgctctttggcaaaacaatcattggcaggatagatgaaagtagcttagaagtgaccaatatgtcaaagtcccatgagaagactgaaaaaaagagaagaaagaggaaagaaaagaatgacaagaaagagaaagaaagaaaccaatatgctctttgttctttgcttttgcttcctcaagcttttctctgtctacaaagccaacctctcctgctcagctcatcagaacattcactccactttctggaatgaagtgttgcctgatcctagagtcgcaataaagccaactgagatcttaaaactaaaaaaaaaaaaaaaaaatggcctcgttggcctca

SEQ ID NO: 2757 - DNA, 706 bp, Homo sapiens
ctgcaatggatgctcaggagctgtagaccatcttgaagagcactggactggaaagccaggaggccagactacaagatggaatctgtcactaattattcaccagactaagatgccctggcagaaaaactagcatcagtgtgttcttttggcaaagtcctaccatcacgaaaggaggcataatgccttggtggatagaattcctgaagcaggacccatgcaactcataatgttctatggcagcatttgaagattatgctgcctgctcaacatgaagaagacgaggatgaaaacttttatgataatccacatccacttaatgaatactggtggcagaagagcacttggcaatgaatctgtatggaggattcagcattgactcctcctttgttccctgatggagtctcactctattgcccaggctggagtgcaatggcgtgatctcagctcactgcaacctcggcctcccgggttcaagcgattcttcctcctctgcctcccgaatagttgggactacaggtgcgggccaccacacctggctaatttttgtatgtttagtacagacggggtttcaccatattggccaggctggtctcgaacttctgacctcatgatcctgccgcctcagcctctcaaagtgctgggatgcacacggcctatgtaccacctcatactgataataaaagaatactaaggaaaaaaaaaaaaa

SEQ ID NO: 2758 - DNA, 137 bp, Homo sapiens
  misc_feature (1)...(137): n = A,T,C or G
tattttgaggcgggtcanctacgatgccactacatggaacggaggtataatctcaaacccttcacagatcctgacttcatggggactgatgtaagaataaaagtcctgcagttttcaaacaaaaaaacaaaatggcc

SEQ ID NO: 2759 - DNA, 780 bp, Homo sapiens
  misc_feature (1)...(780): n = A,T,C or G
ctgataaggacaactgaggccaagatgttcttatggcttgcccaaggtcatgcaaagctggaaatggaatccaagtcctgcatgttcccaactatgtgtccttccccctacttctaccaactgcagcgtcttctccaaaatgctcatgtgtttcctacctgagagtcatgtatttctcactccaaccaagttcctggagtcaccaaattcaatttcattcttcaaatgacttccagagaacagcctggcccttgcacagccacttcggaattccctattccctgctacaagagagctagtgggttcaacaccttcctggaagctctttcttctctcccctcctcttgggatctagctaaggagatggagacagactgatggccatctgtcagagcagcactgtgcagcctggacccaaatgcactaattgatttataggctaataatgcggcttatgtgcatggctgggctgtttgcaaaatgtgtccttctccgcagctgctctgaaggtaatcccaagttcccagtgaagcaagcatttgaggggcttactggagccttttcagtgacctatgtggtccttcacttcacccataatgccaagactgtgaggtggagcctcctaggactcctgagcaatggacctccccctttaaatgattngtaccatttgaacgctgtgctgcccaccaccattacttgaggaggacaactcgcagaatcttttttaacttgtcacggattggaattacaaactcaccgaactgtttctccatctat

SEQ ID NO: 2760 - DNA, 457 bp, Homo sapiens
actgcccgttccagaaacaagctcgggctcccactgatccacattatggtctccttggagatggttgctatgatcactcagtgtctccagctaaaaatcttcaaaatgtggatcactgcttttattctcttttgtctcctctttattagctgttttcccctcacacatattttatttctctatgaatgcaatctgctcataattttttatcaaattatattccatacaaatagaatgcccccattcttttggttcctctggaaatgcttttatttggattataacatttggcagtccattagaaatactatttatacttttatgtttcctggttccctgaaagtaaattattcatatggcagttagccctgcctacttctgtttcaaaaaacactaatctacactggaagtaactaaacattgacaataaaaatgtccaacctgaaaaaaaaaaaaa

SEQ ID NO: 2761 - DNA, 304 bp, Homo sapiens
gttaacgacaatactgaaactcagtcttggcctgaacctggtgacctggagctggtggaaggcctggtgagagacagctcagacactggctcactctttcctggctgaagcctgactcctggtggacagaaacatcagcgacagacttctattttcaaacgtctacatacacatcttagggaaagtttatttatcccctcattttgtcattctacaaatatgtactgatcacattctacatgccaagcatgatgggaatgtaaaaataaatttgagatgacgtctttgaggaaaaaaaaaaaaa

SEQ ID NO: 2762 - DNA, 330 bp, Homo sapiens
cggggctgacactcaaataaatgcctcttggctacccattcatctaacagctggaaagatgacacttgacatttggaaactttcctgtgaagattgctgcaaggctttcccattagcttcctggtgagactgtaaggtcgaataagctgcctcaaaacctgcaaagggtaacggaaatactctaatattaagcctgtgcaatttaaatttctaattctcgaatcatagttcttcagatattgtagaaatcactggtatatttcagggcaaaagaatgcctttgaagatgtgaaattaaagtgatattttaagcaataaaaaaaaaaaaaa

SEQ ID NO: 2763 - DNA, 202 bp, Homo sapiens
tcccccagaaaataaaataaatctagctcatgggatgtagacgcaatcagaaattttcgagtgctttatttataccgtcgactgaggtctgcagctatggttgcccaccactttagatagacaacgcatcttgtaaacagaagacatacacttacagtatgaataaatacagtagagtactttaaaaaaaaaaaaaaaaaaa

SEQ ID NO: 2764 - DNA, 395 bp, Homo sapiens
aatctaggttgctggtgaatgcgatatttcattcctttttatggccgagtagtattccatggggttaatcttgaagccaaccaggtgtggtgaccgagctgtgaattcctccccatccagagattacctcaaggaagttaatttacaaccagccactatcaagatggcaccaccccacacttcatatgaacaacagctcaagatagccattggaacaagacacctagagcccataccctgcactctcctgcatgtttctcataccaagtttcccttctcaaaccctttacctagccccaaatatgtaatgatctttcagaggcaggagcctagccatttctcaactgctagcacttgaataaagttacttctctttcaccacaaaaaaaaaaaaa

SEQ ID NO: 2765 - DNA, 375 bp, Homo sapiens
tctatataaccaccgctacagtgaaatgctgacccttcttcacctgccaccatgagtggaaacagcatgaagccctcccgagtgctgatgccatgctcttgtacagcctgcagaaccatgagacaaataaaagccaaattatacttttctgtataaattacccagcacagcaaagtgagcccagagattccttacatttatatgcatactttataactccaagatatggcttggatttttgtgtctccacttgtaatccccaatttggatgaggggcctggggagagccatgtaagatgtgactgcttccctttcaatttccgccatgattgtaagtttatgcttcctgtagagcctgtggaaccgtaagccaat

SEQ ID NO: 2766 - DNA, 513 bp, Homo sapiens
cttcttcgttttttttttttttttgggacggagtctcactccagcctgggcaacacagagagaccctgtctctaaaaataaaaaaagaagtaggcatggaatgttcgacatctttaatggcaaatcacagattgtatttgccaggagggagagacaactgtccatgaagttctctgtccacacttcagagtagtattttgattttgctgtcttctcttttctcctgcccactccccacctccccttccctcctctgccctccactctcccaggtggccacctgtccgtattctgtctatggagcttgggtaggtggctccatcttgtgctcactctccacgttcaaggatatgtgggtcaccagcaaggagtcatcagtagaaaaagcttctgatgtgtggctttcaggaccatgttgcctgtgccttcgacaccaactgcaggatgagccttgttgtggctgaattgaacagagctcagacccagcagactttaataaagaggtcaattaag

SEQ ID NO: 2767 - DNA, 422 bp, Homo sapiens
tgaaatgctgacccttcttcacctgccaccatgagtggaaacagcatgaagccctcccgagaatccaataagatgaatgctgatgccatgctcttgtacagcctgcagaaccatgagacaaataaaagccaaattatacttttctgtataaattacccagcctcaggatcagaagaccacagcaaagtgagcccagagattccttacatttatatgcatactttataactccaagatatggcttggatttttgtgtctccacccaaatctcatgttgaattgtaatccccaatttggatgaggggcctggggagagccatgtaagatgtgactgcttccctttcaatttccgccatgattgtaagtttcctgaggcctccgcagccatgcttcctgtagagcctgtggaaccgtaagccaat

SEQ ID NO: 2768 - DNA, 694 bp, Homo sapiens
ggatcgagagtacatccgggacatgaaggagaaatgctgctatgtggctttggactttgacaaggaaaagatgaaaactgattcaccttcatgccaacagaaatatcagctgcctgatggccaagagatcaccgttgggcaggagagcttcttctgccccgaggtgctcttctagtcaaaactcatagggaaaaacacccctggcatccacacgaaggccatccagagcatcacttcctgcaaccccgacctccagaaggttctctttggccacatgctactgtccggagggacgggctcctgccccggcttgcgattccggatgcagagagaaatatctgagctggtgtcccctacagtttatgtgaaggtggccacctgtccgtattctgtctatggagcttgggtaggtggctccatcttgtgctcactctccacgttcaaggatatgtgggtcaccagcaaggagtacaaggagatgggcccttccatcatcagtagaaaaagcttctgatgtgtggctttcaggaccatgttgcctgtgccttcgacaccaactgcaggatgagccttgttgtggctgaattgaacagagctcagaaccagctcaagggcaaaggcacttcctcccccagacttcaataaagaaggtcaataagaaaaaaaaaaaaaaaaaatggcctcgttggcctca

SEQ ID NO: 2769 - DNA, 234 bp, Homo sapiens
aacaagaagatcatgtgagcatgtgaagcgagaggcaaagattgtagtgatgtgcctacaagccgaggaatgtcaaggattgctgacaacacccgaagttaggagagaggcacggaatagattctccctcagagcttccagaaagaatcagcccagcccacactttgatttcggacttttggcttcttaaactaaggaataaatttctcttgtttttaaacaaaaaaaaaaaaa

SEQ ID NO: 2770 - DNA, 517 bp, Homo sapiens
aagtttcgggaacatacaaaaccatggttttagtattacgactcttattagggcgacagatgtgctttgagagagatgtccgagtgttgatttttgctcaggagcaggaagcaaggctgtgtaaggggcccagccacatctgggagattacaataaaaggaaatgcaccgaaatattagaccatcattagctttgggtagaaagaaaagaagggtctgtggccaacacccccagaattcactagcacagaattccacgaaaatcgaagaaaaccaggcaagagatagaagaaacagcatatacaaagaagcctactgactgctggctttgaaattctgtggcactgtgtttctatgcagccctataatattgtgtgtgtgtgtgtgtgtgtgtgtgtgtgtgtgtgtgtgtatgttatacatatagaggcataaaggcaaggctacaaattgaaaacatatttaacatacacccagaatacatttgatctgaaccagtgccaaaaaaaaaaaaaaaa

SEQ ID NO: 2771 - DNA, 618 bp, Homo sapiens
agagctaccattaatgagcacttgttaccttctaggtactgctgtattagttatgtgttgtcgtgtaacaaattatccccaaattttgcagctggaaagaagaagcatttattacctcacagtttctatgactaaagaatccgggagtggcttagctgggtgatctggatcacggtctctcaggacgctgcaatcaagatgttggctgaggccatgctcatctcaaggctcagtttggggaggatccacttctaatcaaaatcacaaggaaacctgatggcatggtacctagtttccccaagagcaagcaatccaagaggatgagacaaagaatttaagactgaagccacagtcttttatcatttcatcctgttagagttatcctatcagttttgaagtactcagtgtattagaaaccagtcagtaagttcaccccacactcaatatgaggggattacacaaggatataaatggcaggaggcaggaattgttgtaaaccatactgagaggctgcctatcacatgtgctgattattgattcctgaactgatgtgtttaatatttatagcctattgtaaattaataaatgatcttctttgtgaaaaaaaaaaaaaaaaaa

SEQ ID NO: 2772 - DNA, 308 bp, Homo sapiens
caggtaagctattgggccacctccttccatagaccctccaggagcatccgcttccagtcctgcctgggcactgaacatactccttcctcagatggactgggttcctcttctcctcgaagtcccttctgaatttccattttcccagttgtgaagggtgtgattcctagagcaaagcccttacttgagaaataatagtggttttgtttccctacgggaactctgactgtttcaccccatgttctgcctcttccttttttaaaaataattgtggttaaatacaaatagcatgaaatgtaaaaaaaaaaaaa

SEQ ID NO: 2773 - DNA, 386 bp, Homo sapiens
cctagagtaaacagcagaagaaagatatggatgaagtggatataagacctgtcctgctacacaaacaatattataggtaagctgctgtgctgtgagacggacacatgtcaaggaattgaagaggcctctaagagttaaaagtggaacctgattgacagccagtcaagttgagactgcagtcctacaacttcaagcaacttaattctgccaacaagcatatgtgcacgtaagaagaccacgagctccagaaaataatgcagcccatccaagaatgcagtctatccaagactgagaccttgaaaagaagacccacctaagtgctgtgtcacctaatccacagaaactatgagataataaatgtttgttaagtcacgaaaaaaaaaaaa

SEQ ID NO: 2774 - DNA, 367 bp, Homo sapiens
agatgttccaggaggacgagagtaaaatcagcagagatatgagggagaaagaccaaagacagatcatatacattattaaaaagttgatttttcaggggaccatcagaaggcgcagagcaattttcccttggcccccacagtaggggcaaaaaacgacgacctccaaaactgagggaaacatgcagaaaccttgctcctggaaaacgcttctgaagggcctgcctctctatgggggtgaagcttgcaggataaatgagctattttaaaagctatgtatcagctttgctttaatgcccacacattattcatcaatggacaatacgccttataataaatgcaatctgcaaatcaaaaaaaaaaaaaaaaa

SEQ ID NO: 2775 - DNA, 418 bp, Homo sapiens
caggagagaggaaagtgacaatgaacattaaagctgaactcctgcattctctctcaatggagcatgaaataaggcatgtcatcatgtcagcgtatgctaggaaggatttgcttagaccccggtccttttagtatgatgcagctatgacattcagtcttcaactcactttgtgctgatggtgtccaactcaagcccacacatgatacttttccttattctcccagaagtctctacactgctgaagtatggggttaaaatagaagattgttgacagatagcatactggatgtaaaggagcacatcttgggacaaaaagaagagctctgaagaataatatttcttgacagataaaaattatctgaaatgcaagtttctgtgtccataaatgttttattgaaacacaaaaaaaaaaaaaaaa

SEQ ID NO: 2776 - DNA, 154 bp, Homo sapiens
tccagatctccctccagattggaagatccatgagaatgaagatctcatttgcctgattcaccactgtattccaccatgctgcctggcacatagaggtcactcaataaatacattcagaataaatccatgttaatcctcatgaaaaaaaaaaaaa

SEQ ID NO: 2777 - DNA, 160 bp, Homo sapiens
cctcagatctccctccagattgggatgatccatgagaatgaagatctcatttgcctgattcaccactgtattccaccatgctgccaggcacatagaagtcactcaataaatacattcagaataaatccatgttaatcctcatgaatgaaaaaaaaaaaaa

SEQ ID NO: 2778 - DNA, 207 bp, Homo sapiens
tctagaacacaggagccggaagcctggaagggcaacagccatctggtgaccacgatctgaaaagcatgaggacgaaagacaagatgttaggattacacaatgaaagagatttcagagtcttttctgtcagcctggactgcctacccctcaatatctggtcatgcaagaaaaataaacccttctctttttatactaaaaaaaaaaaaa

SEQ ID NO: 2779 - DNA, 457 bp, Homo sapiens
ctggtatctgatgacaattccctctcatctgagcccctctgagatgctgcccttgcttcttataactccctgcctaggcatgatgtgcaggcagcccttcgcccaccttgcccacaccctccccgcccagggttcctcaccatgcatctcactgcgatctgggatccctcccactcctccacctccatcccactgaatcagcgtcgccgatcaggagctgagacctgagaagctgtataagaagcagaccactcccgcgattctgctgcccactgaactggagaatcattgagtcggctgatctctaaccaccgactcagagcctgcgttctagaatcgaaatgttcccagggaaggcagcctcaagggaatcaacggacagcctcccacttgtgcaggggttttaataaccattaggtctcaaaaaaaaaaaaaaaaaatggcctcgttggcctca

SEQ ID NO: 2780 - DNA, 325 bp, Homo sapiens
cttcagaaattccataaggatgaagatatttttccgttgtctgctgaatccctgaagcctagcatgtgtaagaagacacagaatgcatattcactgtggatgatgatggctgttccttcagaggcatcgaaccggtgtcctgaactcctctgcactgactgggacaccgcagacccctcagagggaaggaatcgtgcctattcattccagatgcggtgtatgcagacagctctcttcacaagtccaaagttgagataacttctatgtgcttgaaaagtctccttttctatgacagtttaaagaaaacattttcttccaaagaaag

SEQ ID NO: 2781 - DNA, 343 bp, Homo sapiens
ctagagcttaaaggtgtgagaaataaagaagagcccacaaagaagatgaagaaatcattagaaagaaaaaacaatcttaatgactttgttctggaggcaaaggaaataaacaaaatttcagagagagagaaaaaaaaactgttcaactgtgtcaaatactcttacgaggtctactaactggagtactaataattgattattggatttgaaaacagatttttgaagacattaacacgacagtttcagcagccttgtaagtgtggtgtggagtggatttagggataaattaaagagtaatttaaaactgtcaaaaaaaaaaaaaaaaatggcctcgttggcctca

SEQ ID NO: 2782 - DNA, 384 bp, Homo sapiens
ctgatggagttttgctcttgatgttcaggctggagtgcagtgacaggctcgcagctcactgtattcttctgtgtctagacacaaattctgcttctatacctcgttaagaccctgcacttgatggatcagctggcaccacccggattaataaactggctcatctgatcatgtggcccccaacccaggaactgactcagcacaagacagcttcaactccctgtgatctcatctctgtcaaatcagcactgctggctcactggcttcccccacccaccaagctatccttaaaaactctgctctggaatgcccagggagactgatttgagtaacaataaaactcccatctccctcaaaaaaaaaaaaaaaatggcctcgttggcctca

SEQ ID NO: 2783 - DNA, 285 bp, Homo sapiens
cagtggttttgattgtaccaaaaaaagaaggaaataaagaaggtggagatggagactggaaccaaggaggatgcagagcaaagtaaatgatgctgactaaaaggagtgcttaaactccacttatattggattatgtttatatttgattgcatgaagatttttctccccattaaactatgagttatctttgtcatattcatcattatcttattttctgtgcagtgcatcatggtgcctgatgcatatattgattttattaaaattttgaatgtaaaaaaaaaaaaa

SEQ ID NO: 2784 - DNA, 324 bp, Homo sapiens
ctcagatgtcttgttagaatgctacctcctggaacccagctgccaggctctgagaagctcaagtcacatggggaggccacgtgtaggtgacctggtcaacagtctcagccaaagccaactctcaagtagtcccctgtgggtgccagacatgtagatcaagaaacttctggttgatttcaactgccagctgcttgcattacccccagctgaggtcccagatgtggtgaaaaagcagccaccctccctgtgctggttggaattccctactcagagaattcatgtgcctaataaaatggtttttgtttaaggccaaaaaaaaaaaaa

SEQ ID NO: 2785 - DNA, 269 bp, Homo sapiens
ctgggcggtgagctggacacattgcttcattatttcagctgcttgtgaaggaggtcatgaggatggagttctcatgaatgagatgactgcccttgtagaacagactcaagagagactcttgctccttacgtcatgtgaagacacagaaagaaggtatcatctatgaatcaggaaaccgttccttgatcttggacttcccagtctccagaactgtgagaaataaatgtctctggtttataagcctaaaaaaaaaaagaaaaaaaaaaaaa

SEQ ID NO: 2786 - DNA, 214 bp, Homo sapiens
ctagggtgaagcatggatgaggttatgactcagctttgaccatgcagccaaagacaacatcctaggaactgtgagccaaggggatgggaggaagccatggccccgactgacccgatggagctgagtagcccgaccagtctggaccacccacccctggccttttgcttgagaaataaattaatttcagattctttaaacctcaaaaaaaaaaaaa

SEQ ID NO: 2787 - DNA, 138 bp, Homo sapiens
tggtggctgttctttgtcatgcaacttttaattcattagcggcttgaaataaagcagtgaaaagaagacaaaagtttctatcctcatacagattactgtttaataaaattataatgtttgcttttaaaaaaaaaaaaa

SEQ ID NO: 2788 - DNA, 591 bp, Homo sapiens
tatgtgcattcaatgctatgaatgttatccgaagcctgctttcactgcatcacacacatttcggcttatgagagacaaccattttctaagactgaaaggtaatttctcagcaagcagtctcctgtgaacaccactccagacaagttcatcttcagccaacgaagatcatcagccaaacatctgggtctggcagacccaacagctgcatgcactttcagttcaagcatcatccatatgggtgtcattagcctcctaattgacctcagggtctggatgtggaagagggcagccaagcagtgtggaggcatccacaggggctaaactgagaggaagctcccatctgtgtggacacagctctgtgcaactggctctgggcatgacacaggcagaccagcttgactcagaaggctctatatggcatccacagacccaatgaatgaggctgcaattcccagcacaggaacagcaggctgaggatgggcaaatgacgtctgggtaatggaaggaatcacaagggctattgtaggtgacctctagacaaaaacaataaatgtggagactcttgaaatgttcaaaaaaaaaaaaaaaaaa

SEQ ID NO: 2789 - DNA, 759 bp, Homo sapiens
tttttttttttttttttaaatgacaaattttatttttcatcataacccatgtttgagtctacaggtggtagttacaatatctaaagagaaatttatatcatatgtcactggataaaacaagaggcatggtctgactttgggaaaggctgaatatatagcacagacaggcactttttaatgggcttttgcaggcctcaataatcattttccaaatacatttgcaataagtttcaaataacacacttcaaattaaagatcatgtagattcaaatgttttactaccaatatttatccatttacataccataaaattgcaaaattgaacattcgtacaaaagcattttaaaatgcccctgactaaaataatattttctgcaaaaatacaagtcatagactcttaaggaccctgacaattttttttctgcattagaacacaaggaacacagaaaggtataagcacaacaaaaatatcatcaatagattctgttattctacttaaggccaaaccaattctcaagctaaattacactgcagataattcggaaattaaacaggcttttggtttggccagcttttcccaccttccacccaagttcttgatggtttaaggttttctatttttatatctgggatatggggatttttatatgaataaccattccttgtataaaatagcaaaaattgatcagtaacattatcaacagcagttatttgggcatttataatgtaaaatcgcctgcaaaaatacttgtaaccatg

SEQ ID NO: 2790 - DNA, 921 bp, Homo sapiens
tccctcccccccccacccaccacacaccccgaatcctccagggcatcggcacagttcacgatactcaaaaggaatgaaattttatcagctgctctcagaaaagacttttcttctccctgaaaataatgaagatgtctacccagtgagtctcagggatttgcccaggaagaaacagggagacagcaattgcatgaggtcctgcacaggccatcctgaccacaatactctgcctttccacgataccctccctccattccccaggaaggcggccagagagagctagtgctggtttaagacgggcttcggtgatatgaaggctaatgttctgtcggctcacacctgtgtgctttctgttgctttcagccaatctttgtggattattcattgcctgtaccatcatggttgctaaacagtttggatattagtcttggatcttttgcctaactttaaagttgacagtcaaaacatgatggaaattagttgagaattaagatgacacatatactgtgatttgtttgtcaggattgagagaaagagtaggatgttgttaggataatgatgcatggtatgtaagggaggtgtcacagagtttgatgtagaaaatcatgcgtcatatctgtatttttacctgttctgcaaaaatcaattttatattgttgttataaataaatgtacattggatttgttttaacccctcttcaggaattaacccttcgcattaggtcgcctaatattcttttgcctggctggaaaaataggagatatgccatttttcttttatccccgggcaagctggcttagaaaatgattcccccacgggaggaaactcattcgccctacaagttaatagaaaattgctgttattgctggtgtaaattaaggtgcatactttattggttacaaggatttcttgcaagcaat

SEQ ID NO: 2791 - DNA, 197 bp, Homo sapiens
catgtctgcagaaatgatcagacgtatggaattacgagatctcctgctcgtttaaagaactgtggaaaccattactgtccagggaacaatgttgtctttgaaagcctcatcacctaagacatgtctctgaagtagatgaaaaggtggagcccagatgtctcacatgtttagcatgagctacaaaacactgtttaagt

SEQ ID NO: 2792 - DNA, 453 bp, Homo sapiens
catgtctgcagaaatgatcagacgtatggaattacaagatctcctgctcgtttagggtgttcaaggaaatcaaagaactgtggaaaccattactgtccaggaaacaatgttgtctttgaaagcctcatcacctaagacatgtctctgaagtagatgaaaaagccaacccaggcatagtggtggagcccagatgtctcacatgtttagcatgagctagaagacactgtttaagtaaaaatgactaaagccagcctgccaaaaaagcttgtatttcaggttctaagagttacttgctcatttgacagatatttatacattccctactttgtgtaaatcagctcacacggcaagaaaaacatatttagacggttatataaaagacactaagagctaagtgacatgagaggaataaacataatcttattagagttcttagagggaaaaaaaaaaaaa

SEQ ID NO: 2793 - DNA, 276 bp, Homo sapiens
tacatcgttctaccatcctctctcctcagcctcccaaatcattgagattacagatgtgaagtactgtgcctggctcaagaaactttgtcttaaagggcatagagaggagggaatgctagagtgataactgatggtagaaatgacagctggggtgagttgtagttgttgtttttgttgttgtttaacattaaagacataagagaatgtttgtatgtagtgtgaaatatactaaaaagaataaaaaagttggtgattcagaaaagaaaaaaaaaaaaa

SEQ ID NO: 2794 - DNA, 836 bp, Homo sapiens
cctactacatactttgtgtgcagcatgatcttcatcagaataatttacagtagattgaaggcagagaagatatgaaaaatgaaaatccaaccatctgaagacattgaaagaatttgtaaaaaaatgtaaaacagtaacattcttctcatgaatttatttttagaaaatataatttcccatatttaaaagtaggctagttatgttaacaagtaacagggtattcatgttattttatataaataaataaataatcaaatatgttaaaatgtatcagtaataatttttattatggtgaatgtcagtacatataactcatatacacaaaagctctttgaggttctcagcaatggattataaagaaattcccgttactaaaatgcttgagaactccttgctgaagaaaatctaataaatgaacaatgagacatgacaaccaactataatactctccctccccccccccctcaccacccccccactcctctcccctcaacccccccacccccgtcaacggggaggactacatcctccgccccctgtggccccaaagggggaagcctttggggcccctttcctttttgcggggggggaacacacaaggaccccgcttacataatactctgagccctccggccctcccctgtgcggaaggccgccccccccccccctccaggggcgcactccggtttcccccccaacccgggggctaaccccaagaacaacacgtgcgcccaagggccacaaacggggcaggaaccctaacacgggcgcctgctgcgcggcatcctcacgtggcccccccccccatgaggaaccacccaacctccaccccgaaa

SEQ ID NO: 2795 - DNA, 434 bp, Homo sapiens
agctacatatttgtgtgcagcaagatcttcatcaaaataatttacagtagattgaaggcagagaagatatgaaaaatgaaaatccaaccatctgaagacattgaaagaatttgtaaaaaatgtaaaacagtaacattcttctcatgaatttatttttagaatatataatttcccatatttaaaagtaggctagttatgttaacaagtaacaggatattcatgttattttatataaataaataatcaaatatgttaaaatgtatcagtaataatttttaatatggtgaatgtcagtacatataactcatatacacaaaagctctttgaggttctcagcaatggattataaagaaattcctgttactaaaatgcttgagaactccttgctgaagaaaatctaataaatgaacaatgagacaagaaaaaaaaaaaaa

SEQ ID NO: 2796 - DNA, 464 bp, Homo sapiens
ccttgagaaaaggccacatgaggacatcatgagaaggcagctgtctacaagccaggaagagagtcctcaccagaaaccagctctgctggcaccttgaacttggacttcacgcctccagaacaatattaacacagtgctatgtaatggaggaaacccaagaaatattttttgccttgaagaaaagaacacaaactcagaagtcacatggatctaagataagacttgcaaagatttaaattcaattctgccatttacttcatatgaggaccttgagaaccagttgatagcatatcagaaaagctaattaatttgccatggttaccaggaaaacagggcctagtctccaaagtacagccaaatagaggagccaaataaaaaagagggaaatttttgtcatgcatcttgtttttctgaaatgttatgttttaaaatatatcaatattcaaaaaaaaaaaaaaaaaaaa

SEQ ID NO: 2797 - DNA, 546 bp, Homo sapiens
cctaggcttgcttccctcctgctcatagagagctgatagcaacaaccaaggctacatgcttcctgagttacagctgatgagagactgtccactccacaactgtcagagtcctgagcttcattccgattgcaaccctgccgcatgctcactccttactactgtgaaaggtcattgctatcattatggtgctcagcgggtctttactaatctatttactcatacttaaatggaaaatttcagagtatgtgtttcctcatggttctatctttgggaacaagtctgatggccactgcctttctccctgccagagtcaggatctagcatcaggggtttccagggttccctgggagcagacgactgttgcctaacagctacgtggctaacagtaccactgccagcaagaacactcctttacttcacagaagtctcccccttcctgctccaccatgctagagggcttgaaatgccttgaaattctctcccttcagagttgaaataccacttccctgaaaataaaatgcatcttccccaaaaaaaaaaaaaaaa

SEQ ID NO: 2798 - DNA, 209 bp, Homo sapiens
ctaggtacaatgaaaaatggaaatattatctcagaaattacaacagagggatgaagatatagcatatgctgtacctaaaagatacatcaaatgggacattgggaatatggattgatgaaatttaatttgcgattgtcctataatgccttttcattacagtaccacacaaattgaggcaataaatgtatatttgatcaaaaaaaaaaaaa

SEQ ID NO: 2799 - DNA, 380 bp, Homo sapiens
aggaaaccaacatggcacatgtatacttcctaagaataactagaatgtgctgggaatgtaacaacttgcgacagggagagacccgtacaacagcctgccgtacaacagcctgagctctgtttcagtcccccacaggaagcaggatatccttcactacttctacgagggcagtcatgttaccctggggtataaaaactggggtgggcggctttccaggattcttcatctgtgttgcaagtggtatatgcacagatgacattctgtccactccaggcagctatcctgaggcttgtgaaaccagctcctaaccatcctagatttctgttgtcctttgctgcctatgtataaataataaaccacttcatgtaaaaaaaaaaaaa

SEQ ID NO: 2800 - DNA, 597 bp, Homo sapiens
ctagaacaaatcttggaatattcatattatctgatttcaagacttactactaagttaaaataatcaaagcattgtgtagttggttaaaatataaaacataaatcaatggaacagaacaaatagtccagaaattgacccaaacaaataataaactggtatttgatgaaggcacaaatgcagtttagtggaaaaaaaagtattttcaataaatggtgttaaaacaattggacatccatacgcaaaaccatggaccacaacacatacctcacgtattttataaagggtaagccaaaatggatttcaagcctaaatgtaaaatgtaaaattctaaaacttatggaagaaatcgtaagttaacatctttataatcttgggtttgtgagtttttgcataagacatcagaagcataatgcaaaagagaaaacttgataaattagagtttattaaaattaaaaccttttgttctgtgaaaggaactatcatgacaataaaagggtcaaccacagagctggagaaaatatttacaaatcacactgacaaataaattgtgtttagaattccaaaattataaaaatcaaacaaaaaaaaaaaaaaaaa

SEQ ID NO: 2801 - DNA, 604 bp, Homo sapiens
cctagagtattccaaggcactgggataaagaagcagcaaaaatacagaagaagtctgtgttcctgaagaacaatgtggaactgagctaccttttctgccagaaacacactcattggaaaatgtaagtgagaataagtttctactgcattagagtatatttgtttaatgttttgcaccatctagttatcccaactagtatcagtaggtagtcaataaaacattttgaaattaatgtttataatgtacatacagattatactgttgtgcaagtgtgaagacaggaaaagggaaaggattcttcttttgcattttccaaaatactgtggtacagtatgattcaggattcattatatgttatgtccttcaagtatagaaaaaaataattacagaatatttatttgaaacatattccaaaatttgcatctttataaaatttgtccattttaataattttttatttcagcactaaaagtactattttgttcaagaaagaaataaaaaacaatacaaataaatagagtacagaaaatattgacaactaattaaggcattgatagcatttggatgaaggcctagttaaaactatccaaaaaaaaaaaaaaaa

SEQ ID NO: 2802 - DNA, 541 bp, Homo sapiens
cctggcactaccatactggttcctgtctttatgaatttgactactttagaaaaggaagacattgcgccctactcctctggatatagaattcacctctacagcgagcctcacacccctgttcacctggatggatagagaagcaagggcaattttcatctattgaagattacacataaaatgttgaattgtgtgcatacgctgtcatagagtggaaacaaacactgaataacatctgaataaattacaagatatattttatacttaacatttttcaaaaaacacctcctgctgttaaagcccatgtcccataaacatcttcagtaaagcagtgataaaagcaagaataacaacctccaaatgataaattggtcaaatttagagaagcctaactaagcagtgttttccttaccagtcaaacgcaaaggttacacacacatgctcaccaactgccctctccttgttttttgattataaaacaatgacttcatttgtgtaggaactaaatatgaataaaagctattaaccaagaaaaaaaaaaaaa

SEQ ID NO: 2803 - DNA, 627 bp, Homo sapiens
cttcaggtttcctgggacaaacaaatcggatgttaatacaattccctgtttgactctacccttcatgtgttggagctaattaaccacgcttgctagcaaaggggcaagtaagagctcaggaggaaagtatttctgttaggaaaaaggattttggattttaattcatacaaccataataaaacatagcaaggaaagagacccagaggacataggacacaaatgaacacagatggtaagcgcacaaaaacggctctccgatgacgtagggatgtgagaggcctctgaggcatggaatcgtaattacttcacccactgtggaaatatttttcagattctgggcataggttattaaaagtggaagatataggccgggcgaggtggcttacacctgtaatcccagcactttgggagactaaggcgggtggatcacttgaggcctctactaaaaatacaaaaattagctaggcatggtggcggacacctgtaatcccagctactcaggaggctgaggcaggagaatcacttgaattcgggaggcggaggttgcagtgagttgagattcagccaatgcactccagtctgtgcaacagagtgagactccgtctcaaaagaaaaaaaaaaaaaaaa

SEQ ID NO: 2804 - DNA, 551 bp, Homo sapiens
ctataatgtggtaaaatcgtggggacttaattccatcatatggaggttactgaatgtatcagagacagcctgcagttcatcaccacacaaattaggagcaacgtaagaagagaaaaagaaaaaggaattacagattaaaaaatgcaagagaatataaacaaataaaaatatgttcaactggaatttgtattgggattgtattaaatggatgaactaatttgtgaagaaatgatatcattccatccaagagcatggaactcctatttttcctattgccttctatgtttctttttaaaaagtcttaagttttctctgtagagttttttgcattctggatgattttaattgaaacatactgtatagatattgttactatgataagtggtgcctcttattagattttttaattcattatgattggtaaagcaaataggaaagattttgagcatagaaaactgcctcaattacctcattacttcaaaaagtattgccattggttctattgctttttaaaaaaatacatgatgatatcttctgcaaaaaaaaaaaaa

SEQ ID NO: 2805 - DNA, 572 bp, Homo sapiens
  misc_feature (1)...(572): n = A,T,C or G
cctaggtgcaacccccaggcaagtgggcttgccaaacaagagtcctgctcctgacgcccaaacagagatgagcctctccctctcctttcctgaaaagtctcttctccatggcttggacaaactgttactgcttctctagagggagaccctatacaagaaaaagaaggaataacttccctccagtcctcctccttaccatgaggcaataatcagaatgggatttcaacattcatggggtaaaatgtaaaatcagattctgaaagtggaagtttgcatattgacagcatttgagatatttgtttattaacgtcaacacaattccgaggactcttttggaaagtggattttgagggtgatccaccaagtgggaggaacattattttaccttaggctgaatttctccacatgggtagatttaacagagattatgcattcagagtattggtttgtacatctggatgtgattctactagtttactgaattggacaataaattacccaatagagttttagatgatgcanaagaagtttagatgccataaagctcttgacatcttgcaaaaaaaaaaaaa

SEQ ID NO: 2806 - DNA, 396 bp, Homo sapiens
ctagggtttctttgtgctgttcgacttctgccttttgatcttcggtgtggtgcaatttcttatgaatttgttctctgattttgttgagcttcccgatgtcaaggcgcatttgatggacttcttcctctttggcctgtaattagtgagaaagaattaatgagtcactttgtaaatgaagagccaggaactggatgatggtaaactcagaaccaataaaaggaaattcttcccatggcattttaaagttgttctgtgagattaaatcaagcacacacaatttggttttgagagaaattgaaaaactgtccactgaataaaatatgtggttatgttttatatttttataaactaaaaataataaaaacactgaaaaattttgtttcaaaaaaaaaaaaa

SEQ ID NO: 2807 - DNA, 305 bp, Homo sapiens
tgtggaagaaaccagcaattatttggtgagaacagtcaagcaaccttacaaatatatccatgtgaagagaacctgaggccttcaattacaaaccccaccaacttgtgggccgtgaatgtgagcaaacttgaaagtggatcttctagtttcggtcaaggctttggatgacagccccagttaaactctgtaaccacatgagatatcctgaggcacaaccaccatgataaattgttcttgaattcctcatttacagaaactcaattaggtaataaatattgtgattttatgccacaaaaaaaaaaaaa

SEQ ID NO: 2808 - DNA, 808 bp, Homo sapiens
acaagttagtggagaaaaatggaaactcatcaaacaaatgatataagtagagaagtctggcacgttgatgttatcaccagatatggcttcagaggagggaacagtgcacattgaagttgacagccaccgcagccactgcagggcccagccgtacccttaggaaaggtgtgaatctcagaacaccccatacacgaggatcctgtccccatgatcctcgtggcttaactctttgtaccttcttgattcaattcggtgccttttcatttaatatctcttttaaacctttctccatacacatttccctctccccaaaagaaagaaatttctaaaaatatatataactgtaagcagcagaacgttttctgcaaatgtcacatccttgttctttttgttttttgttttgttttgctttgcttttgagacagagtctcgctctgttgcccaggctggagggcagtggcgcaatctcggctcactgcaacctccacctcctgggttcaggcgattcacctgcttcagcctcccaagtagctgggattacaggcatgtgccaccacgcccagctaatttttgtatttttagtggagatgggatttcaccaggttggccaggctgatgtagaactcctgacctcaggtgatccacccgcctccaccttccaaagtgctaggattacaggcatgaaccactgccccctgttccttgttcttatttcatattctgttcctctcctggtctatcttcttttgccatttcactttttatgtgtatcctttccccagatggcaagcaaaaaaaaaaaaaaaaa

SEQ ID NO: 2809 - DNA, 523 bp, Homo sapiens
ccagtcccaggtgatttttctaaatcagaaaccggatcatcccagtctcctgttcagatgcctgtgatggctcatggttactctacggcttgacccctgcctggctcttcgaatttacctcctgttactcccgacctcccagcattccctccctcgcctcactcctctgcacgtggtttccttggatgtagagtgtctttcctgttccctctcacccgcatcctatccacagggctgtcttcccacagatctccaaggaaagtataccttccttgtctcccctctgctggctgccatggccacagcctgaacccccgacaaccctcacgaacagagatgttgtggcattggtggtttgctgtcagactaccctgctgggctatggagggacggggactggtctattgaattcctgatattcagcatgctgctgggactgcagaaggagcttggtaaaggtttactcaataaatggaaactgctgaagactcagtggtaaccaaccacaaaaaaaaaaaaaaaa

SEQ ID NO: 2810 - DNA, 271 bp, Homo sapiens
tgtgctgcagtgctggcagccatcccgagaaggctctgaagagtgggctggttaacaggagcgttttcactgcaggcagactcggttgccttggtgaagtccccgtgcatctgaagagtggctcatctgttcctgcctggggatcacttgtgctcatccaggcatggcccccacaagaaatctgggagaatggcgagctggtgccagctgaactgtgaacctctaagaataagtgaataaaacgattttatgcactacaaaaaaaaaaaaa

SEQ ID NO: 2811 - DNA, 247 bp, Homo sapiens
ttgtatgttagctgtttgtatggcaagccagctaacagaagcagcatgtcacatgtgaggccataccgtcccacaggcaggccattttaccaaggccattggccaagtgcatttgcccaaaccagtaaatagtcattgttaaaaccaatcattttcttttgaacaacactgcagttgttaagatctctgtaatatcacaaataaataagcaataataaaaacaaatatgaaaataaaaaaaaaaaaa

SEQ ID NO: 2812 - DNA, 427 bp, Homo sapiens
cctaggagttaagacttcagaaaagcagatggacaacgatgagccccttctacacttccacttctacagacatgccttgggaaatgtgagacaaagggggcctcaacattatctttttcattacaaaatgctgtaaatatcaatcctggttggtaaagctgtaactgtttcttacatttttctttactgtattttctttttctgtactgtatcttagtttctgtattttcaaaaattttaaaaaataatctattatatgatgtagcttgcatatgcagtgaactgaaaaagaaaatcaaaacagagcttaggaagtaaacagtccatccttagcctgagttatgaaattaaatacatctgatatgaaaattccattgtttcaaggtcctctaaagcattttgaatatgtcttttaaaaaaaaaaaaa

SEQ ID NO: 2813 - DNA, 552 bp, Homo sapiens
cctagaaaacatttccctagatagtaagctgctccctattctgaagggaagtagaaacgatgaaaagcagagctggagatgatccatgatggacatatagtgaggagcattatccgctgcttggaccgtgagtgcgtaagtccgcccgactatcatttccacccctggagcgatggtgataagccctgttgttttattgatgatgaagtctccctgagccccaacaaggatttcatatgtgatctccccatttgacccttcgtctgcgtcgactgcagtgagctggaattgaaaatcacaacataaatcctcttgggtctcaacttttcaccaccatgtcgttttttcccccaacaaaagaagcttgctttcaaagaaaaaaacacaggaaagtttccttgacatatatactgttttttgttttttgtttttttaactgaggctactgtgtcctgttacaatactaaagcaatcacaaaaataagagtgattttgttttttgtgagagtgattaagaaataaactttggatcttgaaaaaaaaaaaaaaaaa

SEQ ID NO: 2814 - DNA, 430 bp, Homo sapiens
cctgtgggaaccctctattactttgagctggaaaatcagaagtgggaagaaagaaaaagatgtcttctctcttatcctgcacactcacgttctacttcaaagtgaaaagttgccttgaaacacataaatcactaatgtctttaaaaaacagatcaggaggaattcatgtatttgaaatgaatgcctatgtgaggccttaataaatcaatgcttcaattatgcctcattataagaaacatgggtgcggcctccaacagctgcaaacagtcaacaaaattacaaaggaggagagcaagaaaagaaaaggactaaagagctacaagacagacagaaacaactaagaaaaggcaatttgtcatgatacacaagagtgtgagtatccatccatccgagtaaaacaaaaattaaaaatcacagtaaaatacaaaag

SEQ ID NO: 2815 - DNA, 521 bp, Homo sapiens
ctagagatggagggtttcacgatattgcccaggctggtcccaaactcctggcctcaagctatcctcctgccttgacgttcgaaagcactgagattttcctctctgtcctgccgccatgtgaagaaagatgtgtttgcttccccttccaccgtgattgtaattttcctgcagcctccccagccaagctgaactgactaaacctatgacaatatctgagagaatgaatggataccagtttagcccgttacctggaaagccagtctacctcatgatgtcatgagccttggattctgatgctgcctcattttgcaattctcagttcaaattaaatctcttgaaaacttccataagctcctcaagtaaagttacatgcttcttcttctgggcttctgttgtatctttgagcttcagttataatacccactgcaacattctgacaagtgttaaaacaaataatgtaaaaacatgtctaaagatgaaaatagaattttgatatgtttttccaaaaaaaaaaaaaaaaa

SEQ ID NO: 2816 - DNA, 367 bp, Homo sapiens
ctaggtgtctgtactcctccctgaccatgtgcttcaggagacgccaatcccagccccattcctagaccacagtggcgaatcagtttgatctaagccaatcatgttgatgctattctagttagctgtgattggctgaggaagatgtgggttgatgaagataatccccccactctccacagccactgagaagattaggtccttctttggatttgaatgtatttttctattaatatctataaatgttttcaatctccataacactattatacttttgttagctcatgtcaaacttgtataaaactaatacccctggatcaattttacatgaagggttattaaaccaggttaactgtcaaaaaaaaaaaaa

SEQ ID NO: 2817 - DNA, 585 bp, Homo sapiens
ctggcaggagctcctaaaaatgtgctgattgaaagaatgacataatgttaaacaagtagtttgaactacatacttggaaataattattctaatttaatagatatttttcttttcttcctttatcttgcacttgtaaaagggaaaaaaagatatatgattcaatgaacatatatctccaacttgatgaacttatggacatttttgacatgaaaaagaattccagctgatccaagtatcaacttaaattacattatgatattaattaaatacttaaaaacataaatcttgggatgaactctaattgattctttgaatttataactataaagccaaagagaatttataagctaagcacaagcaaattataaacccataaaattaaaattaacaacataaatttgagataatagaacatgtgttgttaacagtaaatttccaacctcaattaaaatatgatatgattgttgtgataaagttttctgttgagtttcacaggcctagtcaaccctaagccatgaaattacttgatttctcattttactcacattaaaatgctaccaaacttttgttaaaaaaaaaaaaaaa

SEQ ID NO: 2818 - DNA, 894 bp, Homo sapiens
  misc_feature (1)...(894): n = A,T,C or G
agacggagaatcaccgtgttgtcacagacggacctcaagggatccttccgcctcagcctcccgagtagttgggactacaggcatgcaacactgcacctgggcaatatcagaatacatttattctaaacggtccagctacgagatcggtagcagtctggttccctggctccatgtgacaggacttcccaagagacgtgcctggtcctcactgcatggtaagaagagtgagaaaccaaactaattgtgtttatgcactgaaatgtcaagaattatcttttactacagcatattcaaccctatcctgattcagagataaatcattaaattagcaggaattttggagaagagcaagttttggaaagaaatatggagtggagcaaacgctgatagttcatcttcaacatgttgagattgtgatcctatgcaatgttaaagtgaggataaaagaatttggatatacaaatctggaccctggaaaagaaagctgggctggagatgcagatttagaagtcactgggttataaattgttgatgccatgaaaacggataacatgtttcaatttcatcatttcatccactgtatgtcaggttcatacaaagaatgttttttaaaagcatatctacccatcatctcgaaatatgcaaaatgccatatcaagtaatgcaaatgtaatataattttgcaatttgtgtttttcacttgcgtctgtgtaaagagaccaccaaacaggctntgtgtgaggaacaaggctgtttatttcacctgggtgcaggcgggctgagtccgaaagagagtcagcaaaggagatggggtggggccgtttataggatttgggtaagtaaaggaaaatagtcaagggggttgttctttggtgggcagggcccgggtacagg

SEQ ID NO: 2819 - DNA, 726 bp, Homo sapiens
cctggtttaacaactcgctttattccaatgtaaaatgaagacatgatggtttaaaaacaagaaaagttattgatcaactgtgaggatgcttttgctcacgtccaccgcctttgaaacaacatgcctggacagaccacacccataagcagctctccgcaaagacccaggcagatgccccagccccctccagctcacaaggcagccagctactccttcatcagagctccaacagcaggcacagagaagcagcacgggcagcggggaggggaagcagtggggcctgtgggggcccccgccacccacagagctagtctctgtagaaggtgctgtgtggcaaggaccaggaagggaactgcgctacagagagctgacatcacttctgcatctttaactttccccaggatccaagattcagccctgcttcccccagcccctccccagccccactgtgcattaggcagctcaggttaaaatggggagaaggtcaaccattgcttttagacaaaatacagagttaggtttccgagagcctctggtcacaacattttcatcaactgatcaatatgtaactttgctttatgtgtgtttctgtttaaagtcaccttatttaatatgtagttgatgcaataacattgacatcatggccaacattactataattcatgccttaataaagcctgtctaacatatgcctttctcagtaaggcacaaaaaaaaaaaaaaaaa

SEQ ID NO: 2820 - DNA, 159 bp, Homo sapiens
tagggaaaaaagttccacttatggacaactcattccatcttcaatgatgaagacagactttggggaaaaagagaaaatcacttggaaccactcaaaagaatccattgcttttataagttgaattataataaataagctttccaaaaaaaaaaaaaaaaa

SEQ ID NO: 2821 - DNA, 410 bp, Homo sapiens
ccctagagaggcgcttcaccgtgttagccaggatggcctcgatctcctcacctcgtgatccgcccgcctcggcctcccaaaatgccacaagaaggccctcaccagatgctagcaccttgatactggacttcccggctttccagaactggtgaaactgcaactttctacacacaaactagatcttcgttcatgatttttggacagacagagggtgaacatcccttatctgaaatactttggactagaagtttttccaaatttcaactttttttggattttggaatatatgcatacatatataatgagatatcctggggatatgtattagtccattttcacgctgctgataaagacatacccgagacagggcaatttacaaaataaagaggtttaatggaaaaaaaaaaaaa

SEQ ID NO: 2822 - DNA, 748 bp, Homo sapiens
  misc_feature (1)...(748): n = A,T,C or G
ctgatgttgtcttttcttgaaagattggaagatctgacagtggctggatctccacctctgcatggcaatgactggctggagcagagcagcactgcctctggccagaccttgccttctgaagcatcatcaagcctgccctcctcagctcccagctgcgttacagcatgagccctgcctagcttattgacatcaaggaaagcagcaccaggattctgatgaagagaaacagaccatggaccgagggcattgacaaatctccaggaacgtctcatgcaacatagaatttctaaaatatttatattaataacatttttcatacaactgtaatccagagagggctaaacctctctcctgatttaaaaactccatgcaactcatcaataattacatgtcaaataaacctaattatttctagcacttctccttttataactaggaagaataaatcctttgtgattttccaggttccttctaggaaatcttaaagattttggtcttttagatgtaaaagatattagttagatttcaatcttgaaaatgcaaaatattgaaattatcaggaaatttaaacttgattaagataggagcatgggttactgagaaatgacacttagcgacctattaatccaaggggcaataaaagattntgaaagtaaacataggagataacatgattgtaaagaatcttaactntnttatacgtattttttttgttttctaaagtaataaaggacataataaatttaaa

SEQ ID NO: 2823 - DNA, 532 bp, Homo sapiens
cctgatggagccgtgttctgtcactccaggctggagtgtgatcctggctcactgcaacctccacctccctggttcaaacaattctcctgactcagcctcctgagtagttgggattacaggcgtgagccaccacatctgtctgtgtaatcactgtctgaaatccactgatggggtgagtagaaaagctaagagaagccagacagatggcctggcttccaagcctggatctcccaccttggagctggaacttccttggagctggacatttcgaccaatagactttgagtaaagcagatgacccactgtcataggggtgggcctcatccgatcagttgaagactttaagactttaagagaaaagactgaggtcccccaaggtggaaggaattctgcctccagactcaagctgcaatatcaagtctcccctggatcccctgcctgcctgccctgcagatttcagacttgccagctccccacaatcacgtgaaccaatccattaaaatcaatctctctctccataaaaaaaaaaaaa

SEQ ID NO: 2824 - DNA, 323 bp, Homo sapiens
ccttacacttaccctgtgatgagatgttcatatttatttgcgcaactattggtttcacatctacatgctcccaaagactgcaaacaccacgaaagaacagaacccaaccactctgtctgctgctgcctgcctcaccccagcacagtatctggcacaaaacagacactcaattatcgctgagaaatggggaagaaccatggggtgatgcatgctgcatgggctctgtgccaataagggactgtctgtctcaggcttcctgctttcactctttacctgagagccaaagcctcactcttatactaaaaggggcaaaaaaaaaaaaa

SEQ ID NO: 2825 - DNA, 579 bp, Homo sapiens
ctgatagttactgaccctatgcaactgttaaaaaaaatgtgggcatccctttggactagtctggattcctgatgctgaggaaatcgaccacacgaacagcttctggaatttaaccagatccacaaggattgtgcatctcagagcaagcttggcccaagactactcagtctctggatgtgttgcccatggagcttggacaagaaggcacagaagcaggaatcttgctcagaagttagtaatggcctccagttccaaccacactgctgcaaaggacgtgatttcattcttctttatggcacacggtatttagctccaagtcaagaccagaaagcatggtggtgagagaatgagcttctgagtgcctggctggaccaccggttccactacacacacttgattcaggaataaataaactggtataaacactaaacttagatgctgctcagcttatattacactctcagtgaaagctattatgtttataaaacctgctgtgtttttactaaagcaagactgtaagatttcagtttatccaataatataacaatgaaaataaaattgtgcctaaaaaaaaaaaaa

SEQ ID NO: 2826 - DNA, 729 bp, Homo sapiens
aaatggacgtcttgctatgtgtcctggcctggtctcaaactcctggtctcatgtgactctcctgcctcaacctcctgaggggctgggatgacagatgcaagccaccacacctgaccgaaggaaacttggatgcatgttaccaagtgaaagaagacgatctggaaaagctgcatactgtatgattctaaatatatgacattctggaaaaagcaaaactatggagaccgtcaaaaagaggaggggttgccagcagttcggggagagagggacgaatatgagaaaagaggatttttaggatggtgaagctactctgtatgattttataatgatagatacacgtcatcatacacatgtctaagcccacagaatgtacaggggtgaatcctaatgtaaactgtggactttcggtgataatgatgtgtcaatgcaggttcatggattgtgacaaatgtaccaccatggtgggggctgttgataatggaggagactgtgtgtggtgtgggggcaggtatatgggtagtctctatattttctgctcaattttgtctgtgaaccaaaaacttcctaaaaaataagtctatttttttaaaaaaggaaaagcagcaaccatgtttcagtacattgtgttgtatcaaataaagtcaccactccctcacaagatttcttttatgattatgactttgtacctctaataaaaatgatcttttgaatgaaaaaaaaaaaaaaaaa

SEQ ID NO: 2827 - DNA, 296 bp, Homo sapiens
tggatggggaccagttttttcacagaatcccttttcatttggggtaagatgctgaagactagggagtgggaaagtccaagaaaactaagacttcatcttcctggaaaaattgaagccattgattggaacaagagaaacaccaagacaggaagggacgtagaaattttccctctatccctcttccattacagagacatggaaaatcccagtatatggtggggggagtctctatttcttcttctcatacagaatttaaaaataataaatttgggatgcattggggaaaaaaaaaaaaa

SEQ ID NO: 2828 - DNA, 424 bp, Homo sapiens
tgatgaggaacagatatggagaaaaaatacataaactgcccaaggtgaaatcacaaggtttcctgagttctagtcattcaaccaaatagattgacttctctagggaaaactatcatcccaatattaagcaccagaatgtcatatttgatgcggttagtgagaatgactttctcccccagattcttttcataagggtggattaaaggagcaagaaaatgagttaaaaagactacaatttggttacatttgatggagttcttagaacactaaaaagaatctgtgtgtgtatacatatattaattctaaatgtaaaaatattaattacagaatgagatgagacatatttgaattgccattggaagttattggaataagactcacacatctaataaaatgtcctctgagaaactgaaaaaaaaaaaaa

SEQ ID NO: 2829 - DNA, 497 bp, Homo sapiens
catgggtcttgctattatgctgtctatgatgatctcgaactccttggctcaagcgattgtcctgcctcagcctctcaagtagctggaactacggcacgggccatgacaccaagccctgtctcagttttgacagacctggtccttctcatcttttatgttgatcaagggccatgtcccttaaagaaagctgttctgcttacccaatcgaaatggtgaagtctttcctccttcccagctcgaaggactctagcatatctccctttttattatacttttgacttttaaaatattttactattattattttcaaagtagtaaatgcaccataatttcacactccaaatgacttatggtgaaaagcacctgcattactcggcattagccactttccattcttttctgtttgctgtggtgtgtaacttcatgcttctaaatagtttgctaatacaggtgttacttattaaaaaaaaagaaaaaaatgggcctcgtgggctcac

SEQ ID NO: 2830 - DNA, 662 bp, Homo sapiens
ctgatgaggaaattagaagacgggggaaactgcagcttgtccttttctcctcaaaagcccatttcaaagtccacattcgattgcgggattacgcttaagagaatcatagaagataaggagccacaaaggttcactctgttttcaaaggtgcagtcaaaatgttacacttctaaactgtggcaacgagacacaccctgaagaaagagagcgttacaccttcacaagaaaacagagaaaccaagataccttgtgatgtcttgtacataccaagaaaaatatgtcctaaccttgaaagcccattttgggtgtgagtggaaccacatcattacaaaaccaaaaagctgtatctttctcatccactataccccttcttttccaaatggacacctgagactttgagctacttcatacaacagagtttcacactgggacctcccacgtctacctgcatttcaggcccgaatctttcctggcatcagatttatcatcaagaacctttctgtggttcatttcttggggcacaattctctcgtgatggggactaatcccgtcaaatcatccatttttgttaacattaattgtgatatccattccaggtatctgctttgtgtataaaaaggaaatttctgaagatacagctttatgtgaaaaaaaaaaaaaaa

SEQ ID NO: 2831 - DNA, 608 bp, Homo sapiens
catgacgggaagaatcaccaacacatacacatggcaaacaggaagaggatgaagacctctcatctcttggcaccagggtgaaggaaataccctcagtcatggccctggttacaaagatcctaggattcagcttctccagaaatctgaatgcctttggattaaacatcctgggagttggacaaagatcctaggattcagcttctccagaaatctgaatgcctttggattaaatgtcctgggagttggacatggctgtgtggtaatataacttctagtctcctctttgagcttaccactgagcactgagctcatggggcaattctcctgtctttgttccttcaactccttctttactcaaattcatgctttccaattttgtcctttgacagcatggatggactaaagttgtggaatgttctggggctggtggaggctagattcaaatcctggctctgctcctttcttcttgtgtgtgcgatcttggacaagatacctaacgcctgtgagccttagtttctagttctataaaaagagtacaaataacagttcctccatcgcaaagttgtcatgtgaattaaatgtattcaaagccaaaaaaaaaaaaaaaa

SEQ ID NO: 2832 - DNA, 651 bp, Homo sapiens
ctcagggtaaattcaatacgattactacgagcataatttcaactgacttctatgaagaagatttcacagtcacctgaagcaacagcctgcagctgtcattatggaaagcccccaaaaagagcttggaaaatcttgggaggatttcttcaatcttatgaaaaaagggaaacaaataaagtaaaaggagatttcttctcaaaaagaaatctgaaaatgtagcattagaaaccaagaagggcttaatctattgacattttaaactcttactacccagatttctcattcattgttcattttacattcttatgagcttcatttcaacagtgcttaaaaattgctgcatattcttaagccactaaaacagatgcaaattgagatgtgggatttctgggctttaaaagtagttgcaaaactgttttttagaaatggatcccatactaacaagggatacaaatcaatgcatcaagagaaactagaatacaatatggtgtggctcacaattagaaaatatgagtttacttcatcttgtttctatctaaatcaatccctgaaaacttcactgattgtatgactctcttcttttcaatgtatcatttaaaggacagacacattgatggaaataaaaggatgaagatgggaaaaaaaaaaaaa

SEQ ID NO: 2833 - DNA, 245 bp, Homo sapiens
gagagctgacgacaagaagaaccaaggggcaacagaagcagagattgaagttgtgtatcaataagccaagaaacagcaaggattgccagcaacagcaagagctgaaagaaagaaataggaaccaagtctcccccagacccttcagagagagcatggctcaactgatgcttagatttcatacttatttctgacctcaagaatttgagagaataaatttctactgttttaaaaaaaaaaaaaaaaaa

SEQ ID NO: 2834 - DNA, 301 bp, Homo sapiens
cttcaggaaagggaacctgcccaatctgtaacatctcttcatgagtaaaatgtccaacactaagcactactgcctacgtaccaggatcatcacttggaacattctcctacctgcatggggagaatacagtgtgttgggataacctttatgcttgcagtcaaaagcccagaattcaagtttgatcatttatgaccttatgcaaatcatttctcttccagaagactaatgatactagtatccgccctgatgactcagagtctttgttagaattaaatgtttctcccaagtaaaaaaaaaaaaa

SEQ ID NO: 2835 - DNA, 236 bp, Homo sapiens
atgctacctgtgaggattctttgcagcatccaagcaacacctcttcctgttcaaacccaggagccatctcttcacgcattttattgtccagtgtgctgtttttggttaactgtgtctctcaccaagaagaaaacagcagcagtgttgtaattaatcacaaggcagctcttcagaacctgctcacattaaatgatgtaggtcttcttgcctctgcagttccctgaaaaaaaaaaaaa

SEQ ID NO: 2836 - DNA, 409 bp, Homo sapiens
ttgtgtgtactgaagctaggggtgcgggtgccacgtggctgcgcggcgctgcccccggaccgaggggcagccaatccaatgaaaccaccgcgtgttcgcgcctggtagagatttctcgaagacaccagtgggcccgttccgagccctctggaccgcccgtgtggaaccaaacctgcgcgcgtggccgggccgtgggacaacgaggccgcggagaccacacaccaacttgcaggaaaggagatccttcaacgggtccacgaccgcgctcagcatcctccctggagaaaggctcggagctgtcccctgtgctagtcccctcccaccccgctcctcgcctctctcctgggaatgatttctaaatgtttatcttttacctagtaaaagaattcccgaaaaaaaaaaaaaaaaa

SEQ ID NO: 2837 - DNA, 802 bp, Homo sapiens
  misc_feature (1)...(802): n = A,T,C or G
cttcagtggatatctgataagaacttttgatcatagaaagtgcaatggccgtctttcaattatgaggttctacaatcttctgaggacagtggacagggaaaaatgagaagagacagtccttgattatgtcgctaagccactggatgaagattggaactgacactgctgaacttgtcactttttttactgagaaaataaatgtctttattgttcaacctgcttttatttggtattctgaaaatgccaccaaagataagaaatactgcaaagttgtacttaaaacaaccaaaacacattataaaaatttaaaatgtagaattttgaacaagtggaagaagctgctttagtctgcttgtaacctggatgacttaaagaatacaaacttattactctcacttcttgaagctgggaagtccaaaatcagggtgctggcctatttggttgcttgtgagcgctttctttttggcttgcaaaaggtggtcatcttcctgtgtgctcacatggtcgttctctggtgtgtgtactcagagagatgagagagaaagagagagagagtaagctctctggtgtctcttcttaggaacatgatttaactttaattacttctgtaaaggtgccatctccaaatacagtcacagtggaggttagggcttcaacatatgactntttggggcanacataaataataggtccatagcagaagcttaatataataaattgctatacaattaaatatagtaaatttatgaattaatcaaatatgtaaattatgcatatatataaagtatcttatttattatag

SEQ ID NO: 2838 - DNA, 349 bp, Homo sapiens
tcagggtgcatgctaccacaaacatgtaggaaacttctgttaggagttcaaccttcagagaggacagctggcagtgcaagatggtgacagccctgcaatcaggagaagaaagtcatgagacctgtttctccaggtttcccgcctccttccaccttctgtacaggacacaccagttccctcaagcccaaaatgtgagcagctgtcattctctgcatagccaagctcggcagtctgccgaaagggacgagccagtcccgcaaaggaatgatgtatgccaaaagatactgcattaggatcttcattaactggagggccaataaatttatgaaaatcatgaaaaaaaaaaaaa

SEQ ID NO: 2839 - DNA, 401 bp, Homo sapiens
cttcaggatgagcagtttcactcttgtagcccaggctggggtgcaatggtgtgatcttggctcactgcaacctccacttcccaggttcaagcaattctcctgcctcagcttcctgagcagctgggactacaggtgccaccaggcccatctaatttttgtatttttagtagagacggggtttcaccatgttggccaggctggtcttaaactcctgacttcagatgatccaccagcctcggcctcccaaattgctgggactacaggcatgagccactgagcctggccaaaattgtttttcttaaaagcgttatttgttaaactgtacttatgtctttaatgtagttttctgtgaatatattttatataaaaataaagaaaacaatatggtaaaaaaaaaaaaa

SEQ ID NO: 2840 - DNA, 499 bp, Homo sapiens
gtcagggttaaatctaagaattgggatggacatacttttacagtgctgtgtcatttcatcgctcataaaacctacaatcatggctgaaggggaagcaaacatgtccttcttcacatggtggcatcaaggagaagtgaaggtctcctgagaactcactcaccatcatgagaacagcatggaggaacatggatgcaaccggaggccattaccctcagcaaactaattctggaacagaagaccaaatactccagatattctcatttgatgagaacttattaacacaaagaaggaaacaacagacactggggtctacttgagggtgaaggttggaaggagggagaggagcaggaaagacagctattggttattgggcttaatacctaaatgatgaaataatctgtgcaacaaactcccatgacatgagtttgcctatgtaacaaaacttcatatgtacccccgagccttaaataaaactaaaagaaacacaaaaaaaaaaaaa

SEQ ID NO: 2841 - DNA, 459 bp, Homo sapiens
atggagtcttgctctgtcgcctcagctggagtgcagtggcatgatctcggctcactataatgtttgcctcccgggttcaagtggttctcctgtctcagcctctcagttacaggagattacaggcgtgcaccactatacccagctaatttttttttgttgttgtatttttagtagagatgaggtttcatcgtgttggtcaggctggtcttgaactcctgacctcaagtgatccatctgccttggcctcccaaagtgctggtattacaggcatgagccaccacgcctgtccaatgctcatctttttttaaaaaaatagacttttcacactgtacaagaaccaacacctttgtgatttgttttctgttcctgaagcctgcctgttccattttgtttcctgagctggcattaaacattgatgtattccttaaaaaaaaaaaaaaaatggcctcgttggcctca

SEQ ID NO: 2842 - DNA, 349 bp, Homo sapiens
acatctgtgtgtgacacctatgtgtgtttttcaaagagcaaaagtctttataactataggagcttattgagataaagaaaactacagctttttaaagacggttatttccctgctgggatttgggaagatttcttcatgtgaaataagcagagggaatttgaactaaataactccattgcctactgaagaagctgcccagaaaagagaaaggtgctgctcatcaaatattctttcaacattcctctcacagagccaacttgaatggagacttccttagacaaccagagaaaagttttatggctacagtaaataaatttttgttgctatgtaagccagaaaaaaaaaaaaa

SEQ ID NO: 2843 - DNA, 404 bp, Homo sapiens
atggacgaacattagccacaagattagaaaatacagtttaggattcatgcagccggagactacaagattctgaccctccctaaactgctcctaaaatcagtgcttgagatattttgaagaccctgctcttgatggatcagctgacactacccagatggataaactggctcatctgatcttgtggcctccacccaggaacagaagacaccttcgactccctatgatttcacctctgaccaatcagaactcctggctcactggattccccctacccaccaagttgtccttaaagactctgcttcctgaatgcttgaatgctcggatgctcggggacactgatttgagtaataataaaaccccagtctcccgcaaaaaaaaaaaaaaaaatggcctcgttggcctca

SEQ ID NO: 2844 - DNA, 541 bp, Homo sapiens
ccgcctagcatctaatgaatagaatatggcataagtaaagctgtatgacttttaaggtcacttcacagtatgtatagcttccacctgactaattctctttgacgcactgctgatatgtcatgagaacattcaatcagctcatagagagacctacactgaaaggaaatgacgtctcccatcaacaaccagcactgacttgtcagccatttggtacatggttatgtggcatgggctcaacagcaacaataaaataatccacccagcccttaagttaaaagttggagatgaaaacaagtgagatggctaaaatctgcctctggcaacaactacaggaaggcaagtttcctggagtgatgaggcacggtgataatggatgatcctgttggccattcaagctatttgctgctaggcagctgcgttgtgatttggaaggtggtccctggatacacaacctggtgctatgacccatcagaaattatgaaagttgcccagtattccttaataaaggtgtatccaattttaactagcaaaaaaaaaaaaa

SEQ ID NO: 2845 - DNA, 641 bp, Homo sapiens
  misc_feature (1)...(641): n = A,T,C or G
aaggaataaacaatggcataagtaaagctgtatgacttttaaggtcacttcacagtatgtatagcttccacttgactaattctctttgacccactgctgatatgtcatgagacattcaatcactcatagagagactacactgaaaggaaatgacgctcccatcaacaaccacactgacttgcagccatatggggtctttctgttgcccaggctggagtgcagtggcatgatctcggcttaccacaacctccgcatcccaggttcaagcgagtgtcctgcctcagcctcctgaagctgggaccacagttggtacatggttatgtggcatgggctcaacagcaacaataaaataatccacccagtccttaagttaaaagttggagatgaaaacaagtgagatggctaaaatctgcctctggcaacaactacaggaaggcaagtttcctggagtgatgaggcacagtgataatggatgatcctgttggccattcaagctatttgctgcttggcagctgcgttgtgatttggaaggtggtccctggatacacaacctggtgctatgacccatcagaaattatgaaangttgcccagtattccttaataaagttgtatccaattttaactagcaaaaaaaaaaaaa

SEQ ID NO: 2846 - DNA, 724 bp, Homo sapiens
  misc_feature (1)...(724): n = A,T,C or G
ctcagtttacagatgaggaagctgagaggttaagtcacatggctcaggacacgcactgctaatgggaaaggaaatgagattcaaacctgtaatcgtctgacctaatgaccaaggtgcctccttggagaggagtatgcgagcatggaaggaggacacccactctgaccttggaggctaaggaaggcttcctggaggcagtggcccttgatcttgttcttgaacgatgttgaaagactgaatatacaaatggacaatggccagaccatatatgaagatagaacttagcccgcaacccacagcaccctgcccaagaaacaaactccctcatctgcaaaagaaaaaacaacccaggaaaccagcctgctggaagtcacacatgctatctctagggacaatccagaanagctaacaataacttctataacaatagacccaaaatgggcaggccctgattaataactgacagcttccctaattttgttcctgtatccacttacaaccagagaaagccaaatggcaccccctatcaatcacaccggatgccccggttctagttagccacctccgcctcccctgcccctggactccatcgggccacacccgaggcttcttttccttaccacccccccggtcctctctttgatccaancaaaacacagtgatggaggctgactctttgctccacaagctcaaatacatagctttgcctttaaaaaaaaaaaaa

SEQ ID NO: 2847 - DNA, 874 bp, Homo sapiens
cctagtgcactgtgatttgctgagtagactgagcacttcattctagatacagctatcacctggtgtttgctaaatcactgtgaaattcttgcaacagctgtttgttcctggggaaacattcacttcatattgcagcaataaactgatcattgccaattaaatgcccattaattgtgtaagcaaggattactgccagatgtttacattagaaagaaaaatatcctttgctatttattttccacttatggccatccctttacatgtagacaattatgtatataagttttttataataagccacaaatttcaattcagaaattaataaaataatctctccataggtttgatctaacagaagataggctaggataaatcatacatgtaattaaaaagaataaatttggacagaatcactttgcaatgtaaaaaatatgctcaacattacatagtgactcaaatgttttggtttgttttatttgctatattctatctttcctagaagttgtccttattttccctttattctatttggaataataagcctatgaaattgtattttttaaagttgaaatagaataaactctctcccatagtctattatggagaagaaaactttaaaaataaagaacccatataaaataaaggaaggtggtgttttgtagaatttttgttaaatctcaccacttttatatttacctggggcttcattctatctcaaaatattatttaagttcttctccagaatgcaatagtgatgaaaatgaaacatgtacttaataatatgttgtctcaagtaatttatttttcaacatcaaaacaaaattggaaataaaacactggcctcgttggcctcagcggtggagctctgcggccg

SEQ ID NO: 2848 - DNA, 410 bp, Homo sapiens
ctcagtgtaagcactttttcctttgtgtgaacaaaggacattagatgagcaaaactcaaaattctggggactggaaacaaaaattcactactggatcacaacaggttcttcatgatattcacattagaaaagatatctgcgactggtatatttggaaaatgttatacatgataacaatgaagaaagaaatacagcagactagatatttagtgatcatgtaatcaaatgtaaactgctactttgtttctttctaaagctttctttaggttctaatttcaaattacattttaaaaagtgttgaactaatgacactatttttatcattttggatctcttaaatatataattttcattataagtgcctgctatttcttaaaatatatggtacagtgtaagcaaaaaaaaaaaaa

SEQ ID NO: 2849 - DNA, 514 bp, Homo sapiens
ggctagggccactctctgacctaccctggctggatcactgatcttcctgccagctgctgcagtgcccttacctgtcctactcccagctttgcattcctgaaatcttcatataccagcaaagccctgaatataatagattgtctactataaaatttgtactggattagataataacaaaactgagctctaacagggttggtgtgtatgtatagggatggaggaggagtccgcagagcatagtcacttctgtgaccgcccccccacctccacccaccatgctctgtccctctgcaaaattctaaatggcttcatgtcaggccttgaggataacacgagacgagtcaaaaccatgaacaccaaaggtgcggctgtatcactgtcaggtttccgatggtgataactctttgaagagagaaactgtcttcctcactgtttccctacaattggcccaatgttgaaaagtgtcagagcctacactctgtacatgaataaacgaatggcctcgttggcctca

SEQ ID NO: 2850 - DNA, 301 bp, Homo sapiens
cgtcaggtctcagctgacatatcatttcctcagaagtgccttcctgaccaccccgtggaagagaagtgtctccctctccctgatattctctatccctggccatggtttgtttctttacagatttttatcatgttttgtgataattttgtttgtttacttttgtcaagtcttttgtttgtctttccaatagtagaccttaaactcccatgtaggcagaaacatgcctgtcttactcattgttatatcccagtggcctagcacattctagaccttcaataaataagtggcctcgttggcctca

SEQ ID NO: 2851 - DNA, 440 bp, Homo sapiens
attgtctctattcagaatctaatcaaaggagctgggtctatctgatacgtgctattctcacggcagaggagacagagagcactttcccaaccccttgaatcagagctggcctgtgactttctgtggccaagagaaggtggtggatatgatgtgtgccagtagaagcccaagcccttgcaaacttctgccctctctccaaatctcaccaccatggaaacatgtggagactaaagtgtggaattaggagaagccacatggagaagagctttaacacctggaggccatccaggaccagctgatcacaagtgcatgagggggttgggctgagatcagctactgaggccagactggtacagcagaccttccagctaacactaagacctgtgagcaaaaataaatgcctggcctcgttggccacagcggtggagtgttcggccagg

SEQ ID NO: 2852 - DNA, 148 bp, Homo sapiens
caaccttcttcttcagcacgattggactgagtccctgcacacatttctatatttccttaacttagagctaacactattgaccattattttataaactatatttgccaataccttcattgactatgactccttgatacttgctcaatga

SEQ ID NO: 2853 - DNA, 1005 bp, Homo sapiens
cggaacattagataatgttctgatatgtctgcgatctggatttgattttgcatgggttcagaggttcacactattcttgcagaactggtgatggggggaatggtattggaaaccatatatgaatcgagattagtgacactaaatgagatcgaacataaatacatgctgggacaaaatctagaggacatgactctatcacagacactccaggcaccgtgcgtgtatctaaatagtaactatataatgtaatccctcgctgagactcccaggtaaatatataacaattgcgcgacgatcagcaatagcaagtgccttatccctacatctatatttatatcacaaaatgttaacatatgcccactctccaggtagaagagccagctgggatgtaggcaatctacgtctaaccattgcatgaaccttacactaaaatactacgcaggatagacttaacttttcgctctctgcattaaccttcaagcgtgtagtctaccagcctctgttaacttattatgaaagttaattcgttaccgctccttgcatcaatgcttttaaacaaatccagtcatgttctaagacaatagttttatatttacctttattataatggaattctgggttgcccacactactagaagggctcgtctgcagtagggttcctcagggtgcattaaacagtgtctatagacctttttacctataattcccaaccctagacgcgtattctattaatatgcacaccaattgacaactatactaatactctttttatatatctacaccgcctatctccaacatgcccataatgatcactatgcatcactctacaatgatatctagaatatcaacaattacttgaccgacccgcccatacacaagaagtcgtctacatcttcatctgtacgtctagatattagccgcgccactcaccctacgcctcgcatactatcggcaatattatcgtctacatagtgcactctactcactctccatgagtctccttat

SEQ ID NO: 2854 - DNA, 267 bp, Homo sapiens
ggaggaaagcaaatgtatggatttaaaatgaagaaaaaaaaaaaatgaaagcttccacactgcacttagaaatgcaacaaccatcaatacaaaaagaaaatttgaagaaatttttctaccgccaatagtttatctctttttattttcagtatatgaaacaatttgactacctttctcagaaatattttaaccttttaataaagacagtttatttacagatatttaaacattctgaacaaaaataaaaccgtggcctcgttggcctca

SEQ ID NO: 2855 - DNA, 738 bp, Homo sapiens
ctagacagggtctcgctctgttgtccaggctggaaagcagcggtgccaatcatggctcactgcagcctcgacctcccagggtcaagcgatcctcccacctcagccagcaagtagctgggacaatatgcatgtgtcaccatgactgccttatttattttttttaagtgtttgtggagacacagtttcatcatgttgcccaggcttagtgctctaattcttgttttcaatgatttacattaaaattgctcttgaatggcagtgctatggaggatcacagcagctggtgcagggtaaacgcacctgacagcaataactgaagcgcacctttagaaagaccttgtatgcctgatgctcctgacatgtgtgttctcagctggggtatccaggagtggccaaccccgagacttattctttgtctatgaggcacatttgagctcctggcccatcccgtggaacatggaccatgcagggggatccaggccctgagttctgggttggatgaaggttgccaggtggaggttaagaggagggtgttaagtgaaaatgctgaataaactgcatgctgtttgcaagcagttgcggttttcctgcccaggttgccaccactgggctgttgtgctgtccagcccgccgccattggaccgtttctgcagggaagccgggtctcctgtccaacccactgccactggactctctcccctgtgaatccctaataaaaccctggcctcgttggcctca

SEQ ID NO: 2856 - DNA, 472 bp, Homo sapiens
tagacctgggaccacttcggcccttggacatcagaacttcaggctttttggccttaggattccaggacttacaccagcaactccctgggttctcagaggtatttggccttggcctgaaagttacacattagctttcctggttccaaagacttcggacttggactgagccatgcttccagcattccagggtctccagcttagagatggcctaccacaggacttctcagcttccacaatcattgtgtgagccaattctcctaacaaattccctctcatccatccatctatcatctatcttatctatgtatctatctatccaaccatccatccatcttattggttctatctttctggagaaccctaatatactaggtaaatttgaaaaacataaaagattttactgtccagttgatttaatatattttttactttagtcttctgttacaataaaatcatggcctcgttggcctca

SEQ ID NO: 2857 - DNA, 785 bp, Homo sapiens
cagaatggaatctcacactgtcccttcggctggagtgcagtggtgcagtcttggcacactgaaatcccctggttcccaggttcaagtcattattctgcatcgcatcttgatacctgagattgcaggagtgcaccaccgcagctgatagggcctatcaccatattggccaagcttgtctgaagcttctgacctttcttggccttcaaatgcgctggaattacaagtgtgagccaccatgctagtcccttcattgaatttctaattgagaaaaaatccctcttgaaaactttagtttttttatatcatatttttgatgagtttctttatatgtttcataattcaagaaaaataatataatttaaattcattttctttttattggaaataaatttatttcaattaatatatagttaacagagaagattaatttagaatgttatttttcttttggataaagtcagatttcagaaattttaaaaaatctaacttgggaaactaattacgtttattgattatggtcactttttttaggattggcttctgtaagaaaattcaaaattgtttcaagatataatgagatgtttaattttgtcaaataaactttaaatgtattttcctttggaaaaaacatattttcttaacctatgttttctactaataaatgtgataactttttctaactccgaacatgaaattaaccgaatactttacactttggcctcgttggcctcagggggggactctgcggccccttcctttaatgaggggaaataatgaccctcctc

SEQ ID NO: 2858 - DNA, 333 bp, Homo sapiens
ccttaggtggatgaagttttgtgtttgctctactgacctgaagtgaggaacaaccacatacatctttgtcttcactctgtccagctgtcaactgcattgttccctcacgtcttcctgcaaagtaccattatttccacaccttaagaattaaagagtgaagagaaaacgacaaaatgttcttgtttatcaggagatgggggtgagctgagctttccacaaggtcctgaatggatgagaaggacccaaaacatatggaaaatatggagaatagggtataagtaataaaaataaaaataaaataaataaaataaattggtggcctcgttggcctca

SEQ ID NO: 2859 - DNA, 259 bp, Homo sapiens
taggtattacaggtgctagtaaatcaaacccccaaaaactttctccaccgaacttcacctgtaacctctaccatttaaaggaatttccatttctgtgaggttcccaagatttgctaaacctaccagcctgctgaaattgtggagcagaaattgtggagaagataaaagccatgtcccctatgccatgtttaaattacctcgtccacagaattcacaagtataataaaattattgttttacatcagtaaaaaaaaaaaaa

SEQ ID NO: 2860 - DNA, 772 bp, Homo sapiens
  misc_feature (1)...(772): n = A,T,C or G
cctaggtgctcgcttcctcttcactttctaccatgatcgcaagtttcctgatgcctccccagccatgtggaactgaaggacaagagttaatcaccagtgacaacttatctgcctgaagttgacaccagaggaatctatgtaataaactctactaactagtccttatccaccattagtttctcatacatttaccagcccacatgtgctgccattggaagcctaaaaccactttcctttgtcttatcatttccctacaaacttactgttctttgttgaagatgctgcataagccaccgttccaagccacatctttgctcattcccagagtttctcccacacatatatgagatatacatgttaataagcatctctttgtttttctcttgtgaatctctctttgttataggggccccaggtgagaacttagaagggttgaaggaaagatctttttcctcctctatacatacaacagaaacccccatgtttccttggtgagatggccaggaggcttggtggtggagtccttccctgcagcctatggcaagaatcctcaaacccggctgcaaatttgaatcacttttgaagtttttgaaaaatgtaaagatgccgggtagacttaaaaattcatcagatcagaatttccggcatttggctaggacgtctctttcttaaagcatcttgaagtgattttaatgagcagccagtgtcgaaagctactagcaaataaagacatggcctcgtggcaaacagcggtggagntttgcngnccagg

SEQ ID NO: 2861 - DNA, 375 bp, Homo sapiens
cctagtccagacccctagaattggtacaagtcactggcaatggaaaagaatgacagaggattcctaaagcttaggctctatgggcatgcctgaaacatcccaaggctcaggaatctctgagtcaccatcaccatctctgatgatttcaaagaaccagatctctctaggttttcctgtgtccaaagtataaatcaagcccaaacacataaatgtctcaataattatgaagttattttcctgaaccagctggtaagatttgttaatgtatttttatcttcagtctatataaaattgggaaacttttgtataaagtattataattgaggatgctaagtttttatctattttaataataaaaagttgattcggtttaat

SEQ ID NO: 2862 - DNA, 680 bp, Homo sapiens
cctaggaagccatgtgccaatggatgtgggaagcctctagaagctgagaacagtctaaggatgacagccagcaaggaaatgaacaactcagttctgaaagattgaggaccctggtcagcttggaagcagactgttctctacagcctccagaaaggagtctagtctggtggacaccttcatctgaatcttctaagaccctgaacaagaattcagtcacgtggtgcctggaatcctaactgacagaactgaagttgataaaggatattttaaactgctaaatttgtagaaatttcttacataatattagaaaactaatacaccttctatcgcacacaaagctgtttgaattatgggtatttctttttgctcacaattgtcagcactaattgcagtaactgcagctacttttcatttagtatttatgttaatcaaaatatgttaacattatttcacattaataaaatacaatttaagaatgttgctctaggaaacttcctgaaagacacaatgtgaagggttgtatattagttagactatgactaaggttaaaggacaacctgtttaatcctaaactaccccaaataattgtaacgttttcacctatcagatataattaaataactgaatgcctccaataaagccctggcctcgttggcctcagcggtggagctctgcggccg

SEQ ID NO: 2863 - DNA, 337 bp, Homo sapiens
cctggtatgacaagagacagactgaaatcagcgtctttccacataatcaatgggggctcatcgactccaagggcctgggataagactctatgctaattgaataaattttttcttcctcagaatgggtttttttttcccccccagcctattaagataatgcttgggaggcatgtctgtgcttggtataataagcctattaaaaggaagtggtctgtctatacctgatacagagttggggggaagatgtcattccttcccataaccctgcatccaggggaaggagaaatcaactcttggccttctttataaacttatgctaaaattgcttaaccctccc

SEQ ID NO: 2864 - DNA, 257 bp, Homo sapiens
cttaggtaaaacaggcaaatgaaatcttgcaagaggatgaagacgatgcagttgcagattctgtatttcagagccacatcatagccctgcaagttaagtgtgatggtcgctatttgaagatgaggaaatggatgttctcaaagctactgccttgctcagcagcgtgacgaggatggagtggaatcatcatccaaaccaagactatactctgtagctgtgaaataaagttaaataaacccctggcctcgttggcctca

SEQ ID NO: 2865 - DNA, 568 bp, Homo sapiens
ctagggccactccggtgaggtgatgacatgacaactttcaaggttctctctgccttgggagtgaagccctgtggactttgcacgcccacctggaacaggcctgctgtatgtggaactgtgtccccacaaaaggtcccgcgacggaggctggcatcaccgtgggtggacacacgagaattatgtggcaaacggcagaatagagggagaggtgaagtcaggccatacttgcaacctaccacaccagccagccttcagaagacctccagccaaaccaggaagtggcatccaaagctgacacgggctgacttccaaagagcagacagagaggcgaagaaacggattaaaaattctgagtttgcctacaagggtggattctggaacaaagtggcctggagcctctgacacttttcctagaatatcacctttctgatgacagccatctctgtaattacaatgataatttgctttcaatggtaaataccacttcatctggctataagagctgtctgggtcaaggcaaaaaacagaaaataacacaaacaatataacaatggcctcgttggcctca

SEQ ID NO: 2866 - DNA, 449 bp, Homo sapiens
caggtcccgcgacggaggctggcatcaccgtgggtggacacacgagaattatgtggcaaacggcagaatagagggagaggtgaagtcaggccatacttgcaacctaccacaccagatagatcaataagtcagcttgaaatactctagaagccagccttcagaagacctccagccaaaccaggaagtggcatccaaagctgacacgggctgacttccaaagagcagacagagaggcgaagaaacggattaaaaattctgagtttgcctacaagggtggattctggaacaaagtggcctggagcctctgacacttttcctagaatatcacctttctgatgacagccatctctgtaattacgatgataattgcttccaatgtaaaataccacttatctggctagaagagttgtctgggtcaaggcaaaaaacagaaaataaaacaaacaaaa

SEQ ID NO: 2867 - DNA, 219 bp, Homo sapiens
catatgttggcgttggcttctatgcactaccggaaacagtcacttcttccagacttaagactggcttcagtggggaaagacctacacctgcaggagaaaagaagtacaaagtctgcaatgtggaagaagtccttcaacagaacccaatcatgctggcaccctgatctcagactgccatcctccagaactgtgagaaataaatatttgttgtttaagcca

SEQ ID NO: 2868 - DNA, 528 bp, Homo sapiens
agacagtcaaaatctccaggccacactctgcaataaaaactcagcaagtttagaggatacagcatgaagcttcccatattgccagaagttctgctgacggtactaaaattcaggagcctcatctagcatcccaggcagatgaagacgttgatgctcaaaagtcgctaatgagaagctgagccaagagtcagatccaaagtccttccagctctgaagcctgcattgtttccaacgcatgatgttgtctgaatggtgagcaatggaagacagaagatactaacatggtagaaattatcctgagtggggagagagaaggccctggggtgctgcgagtgtcctgggcaggcagcagggagcccctttagccctgactagcttggttgcatttctgatgggtttgacatcaacaggctctgctgagtcccaatttggctaggtaccaccacttgtaccacagggcagatcactccaatgcctgcagcattcatttctcaattttcaaataaaactatggcctcgttggcctca

SEQ ID NO: 2869 - DNA, 492 bp, Homo sapiens
actccccatagaatcaagttagcgaaaacagccacaccttttatgtaacagaatcctaggttaaagtagaaacaggaggaatcaaagatgtaaagaacagtttctccccaagaagaactctgaagatgattcatccttccacagccagatctcttgtcggaaaaaaaaaaaagaaaaaagtgactggcccaaagcatatccaagaggaagcattggaatgaccagttgacagccaggacttcccactctagagttgtcattgtcccagaatagagtgacaattaaaatcttggaggagtcacccaagaagcatttgattttaggattaaatgaaatttatcccctcaatattggagagaagtagcagaacaaaggaacaccctctatgaaacacttaaggaaaatgagaggcttcacagagaaattgaagaaagaacaatgaaattgaccacttggaaaaggagaataaacaatttggcctcgttggcctca

SEQ ID NO: 2870 - DNA, 823 bp, Homo sapiens
ttttttttttttttttgagagtaaacaagaatttattatagacctttagcccaggatagtcttctgcttcttcactagaacaaatatcgaacaaggggtaggaccattttagatgccactagcggtgacgcccggactggtattcgaatccaagcctcccctcgtacgtgtaactggatactgaatacttgaggtgttttttgggactgtgagcagggacccacagtgagtaggagaactgtcctccaacaggaatgcaagcatatagatagggcctagaaaagcaaatgtacagggccccgtcaaaagccagggatgtaataggcacactggccagctcgacaatggcgactagggattaagggctggatacgggtgcgtcatgtctaaaagatggtaacgagacaccagatcgcggggaggcgtgtgtgacatataaatgagtcaaatttacgggaacccgttggcctatggctgtacacggacgatcttagatggagcggatgtttaggcaagtagatgagagtcgcacacaattgtgaagtatagcgatgagggggctctataaaagaaagagatcggaggatctttaaagtcccgacggacgccgcggccgctcctccggctcgttgcgcgccagacgcatgtaaataaaaactaggctatgaaggggctggtcagtgttcttattggtgagtgtgatcagaggagcaaactaggcacatcgcgtgtgtatgatgacaccgttacttccgaacttatacgagaagtagtagcgccgctacatcgacgaaaaatgcaccgcgtagaacgactggcgaag

SEQ ID NO: 2871 - DNA, 439 bp, Homo sapiens
cagggggatatttttttttataagacctgcctgtgatgtttctctgccgtgaatcatgtctatatcctcacaaaggataaaaaccaaagccactagagcagagtctttggatttttctgaatatggaaagcagccatgcattacattgaagcatattccaacgtcagggaacagagcactgcttcctgtccatgtcaccgcaaattccgtgctgagtgttactgcgccaaaggacatgttaggatgccacaacggttctcatctggtccgtgatactcacaggctgatgtagtacactagaaagggagggctctttccaagttacagaacttattttgcaatatttcctgggaaagaattctgctacaagttttaatcaatgtaagaaatgctgtaactacattaaagtaaactgtacatgaaaaaaaaaaaaaaaaaa

SEQ ID NO: 2872 - DNA, 441 bp, Homo sapiens
gcctagcttctacaagccacctacatcccttggctcacggcccctcccttccaccttcaaagccagcgatgccagccccgccttccaggagggcatgtgcaaggctcctgggatcgctgcgtgcacccggcagcaagcagccacacgccaccgccttcttcaacacaggccgggatgccagggacacagtttcagcagcaaaactgtgagcaaaggagtgcgtgtccccgtttggggtaagccccactgcccgtgtccttcccctcacaggcaccctttagaagcaaagagattctcccctgtagcccccagaaagaacctgctccactggcaccttgactgtagctcggcccagcaagaatgattttgcactttggacttgcagaactgaaggataataaatgtgtgatgttttaagtgccaaaaaaaaaaaaaaaaaaa

SEQ ID NO: 2873 - DNA, 775 bp, Homo sapiens
aaccttattgtttcctcttttaatcacaaacctgaagaatagacaactacacgacctatcatgaagcaggaagaaaaaaatcatcgacatttttgaccatgcaaatgagcattttttttctgcagaataaactaaggctaacaaaaaagacaaaaacaactgatcatttgtatgaaaacctaattatttggtggatttttcaaaaggtggtcagctaattatgtggtatcatctggaccaatgttttctaggcaagcctagatggtcaacttttgagagagtttataataaagtttgatttgtttatgcatacaaattcattcagtgaacaggagatttttttaaaaaaagttatattctttatttcaaatgtgtgaataaaaagaaaaagaggaaaaagtgaaaaaggggaacccaaaacaggaaaaattaaaagagaaagatttaaaatgggtggtgcacatatgacccttttcttctgcttggccacatctacggttaatactatttttctttttggtgaatagatttgacatcttacatctgcagtgcttctctggagtgagttacttctatgatccagttatgacctacgtaaaacagatactgtttctttacaaatggatagaacgagaagaggagaatgagatatcatccggtcctgaagaaatgagactcaagttttccgagaagaggatcccaggaaattaaactccaactcaaaataagttaatctgctggtcacaagtcacaagttttggttagcaaattctat

SEQ ID NO: 2874 - DNA, 943 bp, Homo sapiens
ctcaggattccagaaggtcacttgtatgaagaaagccaggacttttgtcctctcccctgcatatgggttccagagtcactcctgtgaaaagtctttggtgaagaacgtcctcctaagttttgcgtaaatggatttctcaatgttgcctccttgattttaagttatcttttcttttcatcctttttttcttccccaattttttttttctacaactgcactctttactactaaacaagggccaccttttcctttcatcttgatggacaatttaaaagaaaaaccagaggttatttatttgaaaacaggatcatagcaagaggtgggaaagaatgagagagagatcaggggctgctttcagttgctataacaaccatatgtaatatctgtattttcttccctctttgcttttagtagcttctctaatctgtcttctggcttttgattctagaaatcacctgggattattttatgaaaggacatgtgattttaataatactttaaaaaagaaacataaacccaacaatggcttgctgggattgagggtcttctacctgcccaggcactttactggggtatttaatatatgtcggttcaatataaaattctcctttcttcacaaaattgtagagaataatgcttggacgtaattgctttctgggcaattcggtgttgcacgggaccctgatagctggagccattaggaaacttccaatgtatattctatatcagagcttctataaggagcacccttctggattggcaggtgctggttaaggaggatggtttgatcaatgccctttcatgatttttccagcaatttgtgtttatttgatacaattaaagttacgtttggtgaaaaaaaaaaatggcctcgttggctaaagcggggagtgttcgcagaactttttttggttttatttatttgtttacaaattttaaattt

SEQ ID NO: 2875 - DNA, 342 bp, Homo sapiens
ttaggtagctgcagatgtcacatgtgtcctccatgacatctaaacagcactacacctgcaccagctttcctctcaaattaactactcatcaattctattattaaacaaacaaggagcagctgtaatactgaaggaatgcgtggaattgtgctttaaaattacatctctgccaacacttttagtttgcttgttgaataactacaagttttccagttaaattaatagaatacattatacccataaaatcctgaaatacttgacaatacacacaacaaaatattttacaagtagagaatataataaatgtatgacactttagaaattcaaaaaaaaaaaaaaaaa

SEQ ID NO: 2876 - DNA, 818 bp, Homo sapiens
ctgactttatacacagttgacccttgtacagcacaacaggactgcagttgtgcacttctatgtagattctgttcaacaaagcaccgatggaaaatacagcatttacaagatgagaaacccgagtacacagaggatcaatctttggtataacacgagttccacaaggctaactgtggcatttgggtatgtaaggattttgttatacgcaagggacctgacgccaatcctgtacatacaccaagggatgactgtataatctattgtttattacctaatcccttcacttttgatactcagcgaggttaagaatgtcttgtccaaaaccacttagttgataataaagaggctaaaaacccaaatcccttacccaactactagagcagtactttttcctctttctcaaccattcagagctcacattgaatgatttcatattatcctgactacttgacagttcagttcttcctcttctaggcatttgaccaattccacccaatcctgttccatttttgtttgatgtgggtggaacaggtgtaggggtacccaatggcagtttacaagaactcttctcccttgagaacactttaatgatattataaaaaatgaatttacctttaaaggattagcacaagttagccccatgacattaaacttttttattaaaataaagtgttttatttaagtcaattaatttttgtagcatcattcaaattttatcaagaagttaattctttaaatagtcatcggtacaacatatggtgtagtaaacattggtttattaaaataaaatctttcattcaatccaaaaaaaaaaaaaa

SEQ ID NO: 2877 - DNA, 374 bp, Homo sapiens
ttgccggccgcggcgtccgccacagccgggcccctctactacccatggggcctgggctagcagtaagcaaggaaaagatgaattcagctccttctccacccactgctgtcagccttacaccgaacgctaattttccttctgaagtggagggctcttcactccccatctccagtgacctgcagcactctgaagccgggacgctgagactcattccggacactcgttctcagataatttttcagctccctatcagcattgaacagccttgacttcccagactgaaagaagactaattaaaatgacaaacctcacattgatttattaccacatgggtgaaaacaataaacaaccatgacattgcaaaaaaaaaaaaa

SEQ ID NO: 2878 - DNA, 842 bp, Homo sapiens
  misc_feature (1)...(842): n = A,T,C or G
tcccataataagaccgacaaccactgtatggtaactgcctgacaacgttctccacccccacctccccacccccactcttgggaatggactctgacatactcaccatcaggaaagttgatgtttcccatctaggatgggagaatgggattctgaactcagtaactgcacacagaaacctaataaaattctctaactgtttggcgggcacaaaaacattatctcggttgggatgaggctcttgattaatgtaacaacattgtactacnccacgtcacgccagccacccccccggccccaagcccccacaatcagagatccgcccaccagctaaacctaccctccccccccccacccccccaccccacccaccacaaccccacccccaccaaaccacccccccccgccccacgtccgaccaccaccccgcccccccgccctcctcgtccacacctcaccctcacaccccccatgccccccatccataccaccccacccagcccccccctcccccaccccccctcttagccccgcccaccaacccccaccccctcccacccctccctcacagcccgtcgacccctcttcacnccctctccgcccccctcctctgttcaccatcccacttcccctcacccccacccatcaacttcccccccaccccccaccccccacatacaacgagcccacgagaccagcacctaatcctctccagcgacacaccccccccagctcccccaccccgccacccctacccctccccctctccaccaatacctaccacaatcccagcagcgtcacccacgcccacaatcctccctctcccgcccactcccgcaccccca

SEQ ID NO: 2879 - DNA, 816 bp, Homo sapiens
  misc_feature (1)...(816): n = A,T,C or G
tggctatcaagctccaaatagtgatgcaaatgaaaccacacatggatgcacctttcttccaaggactcttagactggcctcagtaggaaccctaccagctgttccccacacaatccccctctccagtagaaagtagctagaaggatcttctccccacttccctaacagcagttatggtcttcactcctgaggagggggaatgagagaggagaaaggaagaaactggtgaggcaggcagttagggtggattctcagttaaattctttcaaacaaaagaactgcccaaaaaacgaagctgcacagccattgcagtacattcagctccatagagacagtgccggggcaagtgagagccanatgggctctcacttgcatttttttgtgcaaacttttctggagaagcataagagaagcatccagatgcttcagtcaacttctcagagttttctaagaagtgctcagagaggtggaagaccatgtctgctaaacagaaaggaaaatttgaagatatggcaaaggtgtgcaacgcccattttgacagaagagatgaaacctacctccctcctaacgggggagattacaaaacaaggttccaggcttcccaatgcgcccccagagggcttccttgtgacccttttccctgtacttccgctgacgatagccacaaaatttaaggcagaacatcctggcccggtacgttggacgaaagtccagaagaacttggaagagatcgtggatgacagtggttgatatggcgaccttccttttgaaaccaaggcatgcgatcgctgatgaagaaatgagaatgatattggt

SEQ ID NO: 2880 - DNA, 406 bp, Homo sapiens
tttttttttttttttttgtgagaaaagtgttaaaagtgatttaataaatgcatatgtgcgtagtgttcagtaaagcctgagggaaatatgtggtgtaggcagaaacgacgaatcaggcaaagcttatgtgaagtggtgcttcatctgaggatggaaggtgaggagtcaggtcagggaaacacagtgggaggaacatcaatctagagaagcttcagtgtttggcttatttcacttagcacaatgtcctgcaggttcatccatcttgctgcaaatggcagggtttccttctttttttatgcctgaataatattccattgcatatgtacaccgtattttctatatccattcatctgttaatagactcatagaagcagagagtagagtggtggttttccaggtctcgggg

SEQ ID NO: 2881 - DNA, 858 bp, Homo sapiens
ttgccaccattaccgacgatttattgctacattcatgcagagtcccgacgagcaagacatggtacagtaataaactcatataggggcagagaccctccagctacaccatgaatcctgtgttcatacagtgtctcttttctgttcaggcaactggacagagccaacacttgcccagcccactaatcgatttcctctctagccttgggatctggccactaagggttagacccttgaagaaacccaggttgaaacgtcatggggagcagagactgccaactagaatatatacgaaccatttgcttataactgagtaaataggaacaatcaatttaagaaaaagggataaaaaaattctcaagagaagaaaagatgagctcccatatgcatccagaaacagagcaaggacagagaagagaaggctgatggttttccaggtttctcgaggcttggccgtaattccagcattttatttatgggcaattttcctataattatgcaatgcacttccttgttcttatgttgtgtgaatttatttcttttttctgttttccaacaaacatgcccaagacaccagggcgagagttttatatttgaatcagtgtcttgaggtagagtgtttcctaccagactatcttaattcaccccccacctacctataacagtatatgtccaaagacagcctctgccttcctgctgagatatttgcatttgtccccagacctttttgacacgaactgcctaatttctagatttactactattgtcttctgtttcagtcattcccttaacaaggctatggatgacattggaccacattttttcaataaaatggaaacttctgagaaaaaaaaaaaaaaa

SEQ ID NO: 2882 - DNA, 749 bp, Homo sapiens
ccaccatagggggacagcatacattcaatgagtttggaaggataccgtcctataaccgccaccacaatcaagatatcaaagtttcatcaccccacagaatggggtcatacccctttgtagaaaattctcgcccacacccagccacagacaaccactaatctgctttctgcccctatagttttttgcctttttcaaaatattgtgtaaatgaaatatcgccttttatgtctggcttctttcattcacgtgatacttttgagactcacccaagttgttgcatgtatcagtagctttgttccttttcatttgagtagtattccattgtttagagataacacaatttgtttatcaatttactagttgagttgatgtacttctgggttattcatccaacaggggtgggatttctgggtcctatgctaactgtatgtttaactttgtaagaaattgccaaacccctttcccaaagtagctatcattttgcattattgatccaaatcctcgtcagcacttggtgctgtctggttttttgtttgtttgtttcgtactttaattttagacactgtagaaggcagatagtggtatcttgttgtgttttaaatttgcattatccctaataactaacaatgttaagctctttcatctttatttcatttcataaaatacaggacattttggatgctttaaatctctataactgtattaggtagaaataaacatgttcatgctgataaaaaaaaaaaaaaaaa

SEQ ID NO: 2883 - DNA, 900 bp, Homo sapiens
  misc_feature (1)...(900): n = A,T,C or G
atgattcgggcaatatagtgagaggggagaaggggctcaaggattaccctccatccctttatttccaccctgtcagtgtcatcaagtgtgagatgggtctcttgaagacagtataccattaagtcttgcttttttatccaaactgacactctgtgactttgaagagggctatgtagaccatatacatgtaagtacataggatgtaggaaacgatgcaccacggagatgaggaaaagaataaatataaaagagtaaaactaaaaagaatttaacttaatgtcaagaagtgattgtcccaaacgataaataaaccccacagagccggagcaaaaacagacaccgccccacgtctccataccaagcttcccccccctccccgcgcagcacccacctcacctaccacgccccaaacctggaagcccttcaaccaccccacacccctacctccccccacccccagacctcacacctacgcccacacaaccaccaccaccacgccacgatccccaccctccacccaccacaccctccaacaccatacgccgggcgcagttagcaccacaaccccacgccgccgccntccccactcaactataccccgttcccccgcccaccctatcacaaactcccccccaacacacgtccaacccaccttnacccccccccccgccaccccccgttcctcgtcgccccacgccacgacccaccccccctccaaccccccgccgcccgacgcccccgcacaagcccccgcgacacctcacgcccccgccgcaccaggtgcacacgcccaccgaccccaccggaccccagcgcccagtctgagcccagccgccccaaaccaccaaacaccaacaccaccgatattcacaaggggccgtcgcacttcaaccaaacacc

SEQ ID NO: 2884 - DNA, 318 bp, Homo sapiens
cttaagaggacactgaggcactgactacttatggagtgtgcccaaggcgataaagtaaataatgaaacaagcggtgcttgaaataagctgcaacagatgcagactgtaatccagaggtcagcaaacaacagcccaccagcaagatcccacctaccacctgtttttgaacagctcatgagaaaagaatggtttttatcttgtaaacagtagaaaaatgtcaaaagaaaataacagtttgtggtccatgaaaattatatgaaattccagctgcaatgtccacaataaagttttgttggaacacaaaaaaaaaaaaaaaaa

SEQ ID NO: 2885 - DNA, 382 bp, Homo sapiens
cctagctttatcggtaaagctcccatgagctgaagtacattctgatcactgactccttctcaactccccgcaggagcccagcaggggaagaacaaggtggggctcctggtgctaaaagctggagagaggacaagacccagggtctctatgaatagcgggactggatggcccgaggaggaggaggggacagaaaagaagacagacaggggagcgtgaaacctgtcttcttctcatttagtatctcaaacttcttggtgtcaggaccacttgacatccttaacaactatcgaggatcccaaagagctttttgttatgtaggttttatctatcgatatggaccatattaggaattaaaactgagaaatatacaaaaaaaaaaaaa

SEQ ID NO: 2886 - DNA, 490 bp, Homo sapiens
cctagcggtaactgaggatgcattgagaagagaacgcggaaacagaagaagtcctgaagaaaaccactattgaaagaagttaaaggaagtcagtccacaaaatgttgtaagatgaatagccagagaggttgaaggaaaccaggagagtgaatgtagtacaatggaaggaaaggaagagcctagctcaacaaggaagaagttgtcatctgtgcacatgcttctcagtatttaagataaggaagtttcctgatgcccacaaagtttaaataacggactcgaggttacccagcaataaatgttgaaaaagagtttaaattagttggctttcagagtttgtgttttggacaactatattctactttggacagcactgtattttctcattgtaaaagcaggcaggatggagtaaaaaataaaagtcaaaacaatttgaaaacaatattttgtgatgaacataaaacattttctacaatcagcaaaaaaaaaaaaa

SEQ ID NO: 2887 - DNA, 750 bp, Homo sapiens
  misc_feature (1)...(750): n = A,T,C or G
cctaggaggactccatttccaactcttgtcagaaggcttctttgtggtctcatttgccagggggatgaaaatagctgactagaactgtgaatcatactcagtcaacactagcatgggaatatggagcaatacctccttatggaccactcccgagaatctgacaaccttgggaaaagactgtttctgttcaactgccctatcaagccaccattccaccctactccccagtaaccagtacttattgtcttctttacaccttcctattaaagaaaattctcctctgcctattctataaggtgcttggagatcttatgatctgaagatttttccctactgcaatagtcttttaaaataatatctctccttacctaagtcaaaaatacttgcttttgacactttattcattcatcaataaatattttttgagtgtccattatatgccaggcactaactacacagagcttacacaactgcctcagtaagccctgctttaaacgaatgcgaataggactgttttaaataaaatggcttacgagggttcctctgagaaagtgatattatagatcaccctcataagagacaaaggagccaccttcgcaaattgtggcatgcagtgtntcagatcgagacacccaaccgagttgacgctctgggacatcccacccattgtgaggcattatgcccctactttcgatttaccaacttcgaccaccactcccaccacctgacactccatatatcacaaaccca

SEQ ID NO: 2888 - DNA, 311 bp, Homo sapiens
cctcccaccgaccagtccaaaaggacctttcagtgacgattaaatgcggagtcggcgggaagcgctcttgaaacctcccggctgcagccaccgtttcattttcaagcattgttcccagagaccagctcagccccacgccctggtcctggtccacaggcacttccatttaactgacctttggccgttgtaaaccccatcagtaggtgttaatccctcctgatttagacgagggttttttctttcctctctaccacctcccctgcccttttgcttttgaaggtaagttatgtttcaaaacaaaaaaaaaaaaa

SEQ ID NO: 2889 - DNA, 550 bp, Homo sapiens
agtcaatggatcaggaagatggaggtggtggctcatgcctgttaatccccacactatgagaggctgagggagggggatcacttggggccagtagtttgagaccagcctgggcaacatggcaagactccatctctacaaaaaaatgcaaaaagaaatcagtggaccatgtatgtacacatctattttggattcatgcctgtaagatactgagcatcgaccaggcgcagtggctcacaactgtaatcccagcactttgggaggctgagatgggtggatcacctgagctcgggagttcgagaccagcctgaacaacatggagaaaccccatctctactaaaaatacaaaattagctgggcatggtggcgcatgcctgtaatcccagctactcgggaggctgaggcaggagaatcgcttgaacctgggaggcaggaattgcagtgagctgagattgagccattgcaccccaacctggacaacaagagtgaaactccgtctcaaaaaaaataaaataaataaaagatactgagcatcttttgaaaaaaaaaaaaa

SEQ ID NO: 2890 - DNA, 1620 bp, Homo sapiens
  misc_feature (1)...(1620): n = A,T,C or G
atagtgataaatgtagccttatgggaaatacatagagggagacttacacacatgtcattgtactttttgagcttctctaagaataatcagaaaaaccaagccccgggaatccactctgtgcaagcccaaggacactcaagcctccaagtgcctgcacaaagtggatgaatgccttctccacagaagaatggagctcatttttcatggtcaatctaagaaaacccaaagaacaaggctgcccttgcgttttttgcacatttcagccactcctgtgggccctgctgtctgctcagtgtagccagcgctccaagtgcattgccagattcagccatcacagccacattccagcaagtgttgctaccctcatgtaacagaggagcaagaagattcgacacattaagtgaaattttcactgagcacctaagagcaagcatgcctgattctaaaacttaaattcgtatccactgagtttgctgcctctaaaaagccagtagcagtgattgcaattcactcccagaccccttcaaggccaggaatcttttcattttatcaaggttgactcacccccatggatgcatgcataaggaatttagacatgatgagcctgccttgaattattgtcatagacaatggtacttaaaggagcagaaattcttcctttcctttccaacttagctatcaatgtattgcacaatcagaatggtttgggctaatgttggaaatatttctctgtatttcatttctatgaatgtatttttctatgaatgtgtatttccttacggaaactgccgccaactttagaaaaactacaacacggcaaatcgctacaggcaagacattgtgaaacttttttttgccctgaagcccaaagcaccatagctgctctcatcattcactattttaatgctcagttcctgtttggaattgtgtattaaacctcagtgtccaacttgtcattctgattntgattctagttttcaatcatagttttgaaaagttgctttatgaagggctcaagtattgcagttatagaggtcaccacctataatctctctaataaaaaatttcaaatgaatcacagccattctaataatgttgcagccatgctacattgctcataattcagaatataacacagagcccttacgggtctttcagataggcttttttttttaaatctgtttaataagccaaaaataagtgaaggcttctataaggatcaggatggacatgctcggatagacaagtagaaaaaggttttacaaagaattgattagagccaataattaatgattaatatatgcattaacttcaatataaactttagccttactttgttaataaacgataaatcatttcatatgtaacatagatattaaaaatacattactatttccattaaaattgccatactcttctccatacttgttacaataagcttttttttcccagcagtcaattcaaaagtattttttcagtgctactttttatatatttcttccttatgctgtttgtgaacaaagttaataataaggtttttaaatggtgccagcatttttcttacagtgtttttttgtgtctgaataaagaactgtccatgttaagaaaaaaaaaaaaaaa

SEQ ID NO: 2891 - DNA, 364 bp, Homo sapiens
cagattcaatgaaattccaatgaaaatctcaagttattatgtgaatattgaaaaacgaaccctaaagtttatatggagagccaaaaaatgcaaaagagccagcacatattgaaagagaagaacaaagtcagaagattgacactacctgacttcaagacttatgataaagcttcagtaataaagacagtgtggtatggacaaactaatagaaatacagatcaatggaacagaacagagaacccagaaatagattcacataaatatattgtcaactgacctttgacaaataagaaaaagcaatacagtagagcaaaaatagccttttcactaaacaaatgaacatccacattcaaaaaaaaaaaaa

SEQ ID NO: 2892 - DNA, 874 bp, Homo sapiens
gggtaggggggggagagtaataagaagaaagagggcctagtaggaaacagatgatcagctctctagccacataaccaggtgccaattctctaaagggtagactctgtgcttttttgaagcctggaagacaatacctaccaacatgtgaaagtcacagtggagcatttctggtatgatgaagattaaatagaagaatgacagttccaggataacctcgatccctgacgaaggggctgagagtggtatatacgttggtgggagaggtgattttttcaacagggagaggactccactcttcgcgggaggcgtcccgaggcctccgtcgcgacccgcgcggtgggggccgacagggggtgaccggcctcccccctcccccctcccccccctccctgcccgccgaggcggccccgccctcggcggccttgcccccccgccccgccccccgcaccgtccccactaccgcacaatcactccagggacgccccgcccccccgcgcctctatctcccacctcacccacgctgcccccccctcgccgtagtgcccggccctgtgttacatcctaccgccccgcccaccttcctctacgacgccgtctccgcaccccattgatatgtccctgaccttacgtaccctccgcccgcgcgtgatacgctcgacgcgggcgacatccccccagtccgccacggtgtgctcccctctagtgacacaccgtcccgcgaccacacaccagaatgatgaagcccccaggaatacactagtttattcctccttacgaacaactcgcgtctcctcggccagtcgcccaccgcccccgccctcgaccacaatcgcccagagatgccgcgcgctgccgcgcgccgcgtccgcacacc

SEQ ID NO: 2893 - DNA, 328 bp, Homo sapiens
ctagtagacatcttacaaggctgttatatgaaacacacagatacaaccatgcaacaattgtgatcaacaaatatttgatctcttgaagacagcatactgatgggtcttaattctttattcagcttaccattgcatggaggaacatccctcaaaataataagagccatttatgacaaacccacagccaatatcatactgaatgggcaaaaaatggaagcattccccttgaaaagcagcacaagacaaagttgccctctctcaccaccgctattcaacatagtattggaagttctggccagggcaatcaggcaagataaaaaaaaaaaaa

SEQ ID NO: 2894 - DNA, 201 bp, Homo sapiens
ggcgttacacaatagtaaagaaggactcaaagaaaactagtgtttaaataactctggctagaacaagtagctatgcctgaaattaacgtgatcattctttctggtcttcattgtgtattacacaagacctaaacagggtggcacacttcgttccaatctttttgcactgaaataaatacatgacctataaaaaaaaaaaaa

SEQ ID NO: 2895 - DNA, 529 bp, Homo sapiens
atggagaatttgggattaaagactgaattcacattctttctaaccagtggccttttttggactgttaaatccttgatgccaaaagcttctgattgtgaagctaatgaaccaatgcctagtgtgattacctccaactgctaaatgtaatccaaagaacatgcctgattgcaaacaatcttgccaagcatagacaaaggaagaccattcattaaaactacttgttttcgagcagattccagcccagattttattcagctgcctaatcaaggaagactgctttcactttctgcaaactaggcagtaaaagccacagaggccaatggcctcctgtagatttttctaggagttggcaaactatggcccatcagccacatctgacctgctttcctgttttgtaaagcccatgagctaagaatattttgtacatttttagatggttggggaaaaatcaaaagaagattactattttgttatgcctgagaatgaaataaaattcacatttcagtgtcaaaaaaaaaaaaaaaaaaaa

SEQ ID NO: 2896 - DNA, 553 bp, Homo sapiens
atttatgagacaggcagaaaaatcacaaaaaggaaaaaaagtcagtttgaagtgtgaaatcaagtgaatgaagtaagacagaagcaataatctctacaacaaaagatgagaacttgcctcctctaaatcccatacacacatggctatttgttccaagcttatgtggatcatcgctaatttacaaacagtgggtgatgtgctataaagaaaatgactcattggcccatctgtaatttaaatatgtgacaaaatgtttaaatgtttcaaacaatggttaattattagagacttaacagtttgaaaacaagtgtggagctttttttttttttttctgtttttttggcttcattttgaaccagcccaaatggacatcaggtgtttgactcttcctgagatgcagtacataatctttaattggacaccttgttggaaaataaggaggaaagtatccatttttttttttagaatagcctggccaacatttatgtactgaatgctaatatgtataattgaaaaaataaaaaattctaggtcttacttaaaaaaaaaaaaa

SEQ ID NO: 2897 - DNA, 541 bp, Homo sapiens
cctagacaggctgtctctgacagatgatacagttcatcaaaagtgtctgcaggttgtcaaactcagagaggtttggggaccctctgaggctgtcgtggtcaacaagaagattttctgttgggcttttccatcactcaccctgaggaaataatcactcactacattctgcatgttctcatgatagagttctccatttgagagaaaagagccattttatcaaaggacaatatagcccttctctgggtccacgtagcttccattatcagaccataataaatcatatttatgttcccagttaataagactgattacaacacaggttccagacatgggaaaagcaaagcaggtgaaaagatgttttaatgaaaatatgataagaaaacagcttcttgtgaacattctgtgctattatttgtaatgattacagacaatttttgatgcatcttgtttagcaatggtttaagctgcataaattggctcactggtagataagtaaaaatgataagaaaaaatcatgaaatcttaaaaaaaaaaaaaaaaa

SEQ ID NO: 2898 - DNA, 297 bp, Homo sapiens
cccaggaaaaatactttgcatcatttttgaggaagattcggaaagagggatgaattccaagcagaagcaagctagacgctgaagatacactgaagagaacaaagagaatctggagatacctaagacatggcacatgactttgatagcagagtctcagagtttgaagagaaaattacctttgaaattataattctgttttctcacaaagcatggccaactttcctgttttctcccagctttactgaggtgtaattgaaaaataaaaattgtgtgtatttatagtgaaaaaaaaaaaaa

SEQ ID NO: 2899 - DNA, 213 bp, Homo sapiens
ccttttttccaccgttttctacaccgttcagtgacactcgctaccttctgccaacagaatatgagtggaagtgtttgtgccactttcagagttcaagatggaaggagcaggagcatggatccccagtcaccatgtggagggaagctgcccacccagtaggaatacctagtctggactttacttggcagagaaatgacctcaaaaaaaaaaaaa

SEQ ID NO: 2900 - DNA, 1411 bp, Homo sapiens
ctaggtattcaccttcagtttttctaagacgatggaaagcaccactggtgcatgtagttaacagcagcttgactcagacacagaactgcagccagggcccatctgttcccatcactcctactgccagttttacaaccagaactagagtgatttatccatctcagtttgctcaggactcagcagaagaggatcctgggacacaagactttcagtgctcaaacttggagagttcaagactttcagtgctcaaacttggagagtccttggcaatcacagtttgactatgactgagaagattcccagaaagaaggacttttaattctaaaactgagaaagtcccagggcatgagttgttcaccttatttgcaaccaacttctaattcatcatgagggctttgcataaacttatgctttaggactagtagagtcagtcattgcttcaaattaagtagtgtggcaaaagtctgttatttttcaggaaaaattaatgtctgattgtgttaatcctggttgcaataacttatctcatttccccactttcctgtggaaaaattcccaatttctcaacctggcatattaagcagctgaaaagtggcctatgccttcacccctgtcactatctccctccacttgccaccatgtcccagtctctctgaactttgtcattctccttcaagactggtgatatggcttggctgtgtccccacccgaatctcatcttgaattttagctcccctaatccacaagtgttgtgagagggatccagtgggaggtaattgaatcatggggatgggattttcctgtgctgttctcgtgatagtgaataagtctcatgagatctgatagttttataaagggcagttcccctgcatacactgacttgcctgccaccatgtaagatgtgcctttgctccttctttgacttctgacatgattgagaggcctacccatccatgtggaactgagagtcataaaactaacttacctttataaattaccccagtcttgggtatttcttcatagctgtacgaaaactggagacctgagaaaatagacattttttcatcccagattctttctttccctgtctcccttactgcttccatccattcagcatagtcatgtagaaaactcaagcatcactgactctgaataactgttttcatcttcctcaagaagttatctccctatcctttaagctcaactaatgctttgtttatatctttaaaatagaattgattacgtactatatcaaatacatatgctttatacctgtctcctttactagactatttctctatttagtagacttacttctcaacagtgataacttatttttctttttatctctagtgcttaatctcttgcctggtgtacaataaaatttgttgtatgaaaaaaaaaaaaaaaa

SEQ ID NO: 2901 - DNA, 526 bp, Homo sapiens
ctgatcagagacaacagccatgaaacaatttcataaacacatgctctgtgtgcatatttctatttctgtaatatacacacttggagtacatggttgacttacagattcaatgcatctttgattttactacattttgccaatcatctcctctgtgtatttacactgagtagtctacccaccaataaaaaggttactgttctgctttctcacaacatgcgatattctgtttcctgccatcattatgggtgggaaaatatatctcataatggtttgaatttgtaattttataattactaatagcgttgaacatcttataatttgttttataagctttttatgttttgtttctggtgtaatagtgttcacagctttggtcctttctgactgacttcttaatgcatactatataaggcaatttgttgccatttttttggcatgcgatgtcaggattcaatttctttttaaataaatgttttattgttcaataaatttagatctacagaaaagttgcacaaaaaaaaaaaaa

SEQ ID NO: 2902 - DNA, 522 bp, Homo sapiens
cctggcagagactcactctgtggttcaggctggagtgcagttgtttgatcttggctcattgcaacctccacctcccaggttcaagtgattctcctgcctcagcctcctgagtagctgggattacaagcatgcaccaccatgcccggctaatttttgtatttttagtagagacggtgtttcaccatattgaccaggctggtctcaaactcctgacctcgggtgatccgcctaccttggcctcccaaatagtttgcattttctggaattttgtgtaaatggaatcctataatgtatgggatttcagcatctggcttatttcattcagcatgtttatttggagagtcatccatgttgtacatgcatccgcagttcatttccatttctgagtagtattccattgtatggatataccacatatatttttatccattcacttgttgataaacgtttgggttgtttccaatttctgactgttagaaataaagctactatgaactgtttgtgtaaaaaaaaaaaaaaaaa

SEQ ID NO: 2903 - DNA, 513 bp, Homo sapiens
agggagtctggctctgtctcccaggctggaactcagtggcatgatcttggctcacttcaacctccacctcttgggttcaaatgattctcctgcctcagcctcctgagtagctgggactacaggaacacacaaccaggcctggctaatttttgtatttttagtagcgatggggttttgctgtgttggccaggattgtctcgaactccagacctcaggtgatctgcccacctcggcctcccaaagcgttgggattacaggcatgagccacagtgcccagcctgtttttattttaatttctgattacttatattgatataaagaaatgcaactaattattattattaatgataatattattatcattctattatcttgccaagatcacctgttaggtttggtagctttttgtgggtttcatcaggttttataagtaacaatattgtctgtgaataaaagagtttacctgaacctttcaataaacactccttttattacaaaaaaaaaaaaaaaaaa

SEQ ID NO: 2904 - DNA, 407 bp, Homo sapiens
gggacacaacacgtagactgttcacaggactaacgataagagtggatcttctaattcatcttcctcagcagcacaaactcttcccaccctaggagcagaaaccaggctgagatgtatggaagcctccagtgctaagctacccagacagaaagcaacatccaggtcaaagcatcactgtccgaccacatgacccttctacacctgggcccccaaggcactgctaggagttatcagctccacctggtgaccagaggctggcctttatgaaaggctcaggcactgcagcagttgacaactcctctttatgggtatttcctcaggcataaatacaggaactaaaacatatgttttcattgtctgctacttatggaataaacattaacgctctgcggtcaaaaaaaaaaaaa

SEQ ID NO: 2905 - DNA, 373 bp, Homo sapiens
gtaggcctttattcttcccataattcagaagccatctgaacagctattggcttagtccagcttagtctggttcgtcatgctgcaacatctacccatcatgccactactgctgacccttatcccccacatcaacccttaccaccaccatgagaacaagctcaggctggcctgccagaacatggaaccaagcagaatcatcccaactgaggccatcctaggccagcccccagccaaccctcagttgacagcacatgcataagcaagccctgtgcacatcagctgaacttgtcacagatcagcaaaactgtccagtcaatttgcagacttccgagaaataataaatggttgttttaagtcaaaaaaaaaaaaaaaa

SEQ ID NO: 2906 - DNA, 184 bp, Homo sapiens
gaccgatctctttggatattaactcagagagaaaaagaagccacaagttctatgcagaaaatcacctgcttcatttccctacagcagagggtcaaggctcaattatacatggttaccactctcctaagacgaatatctgacactgatggaataaacattaccaacacctataaaaaaaaaaaaa

SEQ ID NO: 2907 - DNA, 369 bp, Homo sapiens
ccctaggatcatccacatcaaacagaatcgaaagcaaaggatgcagccaagcagacgccacctggaacccattccagtgagggcagcagtagccaccacactcaagttccacaagagccagggctaatcttctggggccagctgggatctggagcagggagagcacttaggttgtcactgactgcagtgtcagagcctgcagtgaaggtttaggtgctctccctggactggtcagttctgcaaagtgattttggatgttgttcttcactgtgggcctccaggccagtcctctggccctctagagattctgcaagtttctcaaaatccttttaataaatctttagttcacctaaaaaaaaaaaaaaaaaa

SEQ ID NO: 2908 - DNA, 824 bp, Homo sapiens
cctggcgctacccttcctcagccccttccagacagaacagaagagagaaaagaagaaataaagcaaaagaaacatgagagagtaaaagaagctcccatggtttttctctgagaatttcactggggatctaattttaaagaaggggacatgaacattgaagaaagaacacataactttcatcattttgataagtgaatttcgctgattatataaataaaataaaaaaacgtttctcttatagcgcccccctctctcttttctccctcgttgttctcccccccctgttcggtgctcctgtgcccgtcccgtcttccggtctcccctgccccctcccacctccccacctactccccactcttccggttggtgcttcacgtggccacttgtgcaatccacatgtgcaacttactccctctgccttcctttttcctgtctggtcgccggcccttacgctctctccgtgcctctcccctcccccccccccctccttatttccctcgctcttctacacaccccctcccgccattctctcccttctcttctctcctctctcacccataccctgctcgctgctctctcctttctcttttccacccttccccttccctctccctccaccttccccttcgcctgcccccacaccccctcagctttaacgaagttttctcatccacactctcccttcattactcccccccccatttcctcatcctctcctttcatcttctccactcccattgcttctctcctcactccggccccgcatctctcgcacgcattaacccctccctccccgtcctctcctcccagccccatcaagtcgt

SEQ ID NO: 2909 - DNA, 535 bp, Homo sapiens
gttccagtagcagattcatcggtaaaggtcctactatatcccaagacctggaccagtgagctctgagtctctggctggacttgcttggctggggacatcccctggcagagggcagcacctggtaccccggggagttcaccgcagatcctggtctttgtggagagcaacagcaagacgccctgaattctgatgagctccccccaaacttcccaaagcaaatactctgagcagcatctccctgctgtgctttaagacacctgtacactaacagtgtggcacaataggtgctgagtcaggtgacagctcggggcagccacctctcccatcaggaaagcacaggattcctgcagcatcctggcgggaaaagccccccaagaggcagctaacacaagtgcacccctttctgtatccagccctaacatcagatggtccatgtcagaactgggtttgtactgcagaaatcagtggcttactgaacaccacaataaatgatttaaaaaggggagctctccatggtgaaaaaaaaaaaaaaaaa

SEQ ID NO: 2910 - DNA, 800 bp, Homo sapiens
cttcagggcaacacaaatactctcttcattgattttgtcctttgccgaacatcaagcacattttcaaccagtactgtcaggatagcatttgaatactctctatgactgcattccatcaactacattataagttcctcgaagtgacaaaagtggtttaacacttctgtctatctaaagatgtctactcaaatactgggcacaagagtgattgacagcaattgattgatagagaggtttctttaagaagagcttttactctgaataaaatattcctgtgaggaagatgctgactggccatccaggtctgcagaagacaagaccagaggaaatggattttgaacatgtcccaagagatctataaaaaattaactgcaaaggagtttaaacacaggaataacagaacaaagaaagctgagggttctctcctgaagtgaatgttttaaaaatagacagtctatgtgtagataaaaaaagttgacacagggcattcggtcttaacctatagcctgtaaacccaaaatatacctggtattgctaaagatctgcaaattgatttccataccaaacaccttgccaacgaaaaatgtcttacacttatccgcaataccttttttcaatcccatgtggaaaaatatatcccattcgccttaatacatccaaatcgttttaaagcattaaaaaccctggtgtaaccttcgtccataggcgatatcccaataaatcataaaaccacgggctaagattattaaacaacaaaaaaaaccctcctctttgcccaagagaacaactcttcctccact

SEQ ID NO: 2911 - DNA, 486 bp, Homo sapiens
cctagatttacaaaacatctgttgacattggttgcctgttcataattaagagagaaaaactaaaagcaatttgaagattttataacatggacaggagggcttgggaaatagtgaagatcccctatttggagtgggaaaagatattaccttggatttgcccagtacaagttcctaacatattctgaaacattccagaaataagaggctgcctccatgaacatttttttagccagtactctttacggtaaaaacaagaaatttggacacacaaagaaaagacaccaagtgcacgagtacccagaaggacaaccatgtgaagaggcagtgagaaggtgccacctgcaagcccaggagagaagttgccacctgcaagcccaggagagaagttttggaagaaaccacaccagctgacaccttggtctccaacttccagtccctgagtgagaagaaaataaatttctgttatttttaccaaaaaaaaaaaaa

SEQ ID NO: 2912 - DNA, 197 bp, Homo sapiens
ctgagagaacatgttgcctattttcgactactggacaacttacctacaagatgaagccaacactgttgttagggcagaaagacaaaataaaacctgggtccttgatcatattactaaactgctggatcaatgaattctgatacacgctgccaagcatgtgggccaataaatgtactcattgttgaaaaaaaaaaaaa

SEQ ID NO: 2913 - DNA, 298 bp, Homo sapiens
ctgatatgaacgagagacatgtagcctattttcgactactggacaacttacctacaagatgaagccaacactgttgttagcacagaaagacaaaataaaacctggatccttgatcatattactaaactgctggatcaatgaattctgatacacgctgccaagcatgtgggccaataaatgtactcattgttgaagccagtttgatttagattgtctgttatttacgtctaaaaccatcataagtattcaacttgtctaaagccttattaaagagatattatgtctaaaaaaaaaaaaa

SEQ ID NO: 2914 - DNA, 368 bp, Homo sapiens
catgttgaatgcgatgattcatcagtcatcaccacaatggccacacgcatgtggaagagaagctcatgattctaatctgcacagttgctggcggctagatatgcctaaggaggatgtgaaacagcagcttcacttccaatggagatccggacagtaataaaacagtttcgcaatctcttcactaaatacatctttgtttgcatggtctatgtatattgtcatggggcaggtgcaggaaagtataaaatataaatatttaaaatcctactgagctgctgtgaagtcagtgacaaagaaaaacacacacactctggggcttcatgcatgtagttaaataaataactttgagatcatcaaaaaaaaaaaaa

SEQ ID NO: 2915 - DNA, 329 bp, Homo sapiens
ccctaggttgaccagctctgtttactggagggaaaatctgacagagaggagaggagcatacctcagtgagtagagctcagcagacttctggactccagctccaccacttaccacttaccaagtgttacagaacctccctgaacttcaatctcttcatctgtaaaacgctgaaagtaatcttacccacctcaaagggctgcctggaggattaaacctgatactctaggtaaagagcttagcatggagcctggcacatcatatatgcccaatagatatttgggatgtttattacttgggaataaagaaggtacaaatgaaaaaaaaaaaaa

SEQ ID NO: 2916 - DNA, 347 bp, Homo sapiens
cctttttccctcttttttcacccattttcatggccccggagagggtcagtgaggggcctccactgtctgagtccgctcctggcaacgcctgctctctgcactcagaggcccggtcccggcagctgccacgttgctcagaagttctggcagggggagcctgaaacccctgtctgctggcgacactcccggagcagcaggaaatctctacattttattttttttcttaacagacaaaagtatttgactccagaatgatttccaggaattacagtatgagaacttagtctttgagatttttattttcttattaaaaaaataaaaatgaaatcaaagcaaaaaaaaaaaaa

SEQ ID NO: 2917 - DNA, 281 bp, Homo sapiens
ccaggcaggagccgaagagagaaaagaagaaataaagcaaaagaaacattagagagtaaaagaagctcccatggctcctctctgagaaccgcactggggacctaaccccaaacaacgggacatgaacattgaacaaagaacacataatttcaaccattttgttaaatgaaattcgctggctctataaaaacgctcctgttttttttatgccctctagttttcccctgcttcccttacaaagaataataattctcgttccgccctctccaaaaaaaaaaaaa

SEQ ID NO: 2918 - DNA, 306 bp, Homo sapiens
ttttttttttttttttttcccaagtgaatgaatgtcctaattttcttttatttacttaaaaaatatttttaaagaaatgagtcaatgcccatgtgcgtaggggggtttccttgccttggagtcacaactttttgaatttgggggtctgtccagctcctaaagggtctcgtttctctgacaggacatctaggctctgctgctgcccgggtattcaaattgttccagcacagagccatggcgaatatttcaatgtttttcttgtccagtgagtgggttcaaggtgaggagtttcacactatttggtga

SEQ ID NO: 2919 - DNA, 303 bp, Homo sapiens
ccatctaaaaacaaaggtattcattcctgtgtccaagggggctaagaggactcagctaatgtgaaactcaaagcacatctgaagagcaactattccagcggctgtttacagaggaaaagagacccaaggatggccataacaaacaagaagaactatgtcaagtgttggcaatgatgcaaagaagttggaacccttgtacactgctggaggggatgtaaaacggtgcaacctctgtggaaaacagtttgacaattcctcacaaagtttaataaagagttcacccatcaaaaaaaaaaaaaaaaa

SEQ ID NO: 2920 - DNA, 232 bp, Homo sapiens
ggcagacaaccccacagagagaaaagaagaaataaagcaaaagatcaagagagagtggaaagaagctcccatggctcttctctgacaatttcactggggatctaattctaaagaaggggacatgaccatcgaagaaagaacacataattccaaccatttcgttaaatgaaatttgttggctctatacaaacgctcctgttttttttaaaaaaagagaaaaaaaatggccaaa

SEQ ID NO: 2921 - DNA, 894 bp, Homo sapiens
cttagagatcgggtctcactatgttgcccaagctagcctctagctcctggactcaagtaatcctcctgcctcagcctcccaacatgccgggattactggtgtgaaccaacgcatctgggacacttgatcctttcgacaacctgatcattaatgaagatgtgaagtgagacaccaatcctcacagcccccaccacgtgctccctcccatgcctggcgctgctggagtcattatccttcctggtgtgacagggtcagaaccaaaccaatttgcatcagtctttggtgatgttgtgaagcgtcgcctgccctgcaatcctgctgctgtaacaactgcttcagctgtctgttctggagtgctcttcgctcctttggaagactgatcagatctggccaccccagttctggctgaaagccctagagcgaccgcaatggtagggcaggattcagggctacacatggctgacattgttccttcttcgttttgctcttctgagctggacagaaagcagtccctctttggaaaacaggatggacaagtgcatacattagtggaggacgcagcagatgtggcaggcatagaattttactcattgctccatctatttctatcaaggaaaatggggagtgctcccaatttccgcccattttctagcccaggcctagtcagatgtgtgggcttgtatattctgggaacctggggctgatgtggtcaagtcacttcttggggacaaggtcaattcttctccattttctcatgtcatttggtcctgagggttttatatcttctttagcaattccatgactatgcttctcatcctgcagggaaactgactttatatacacacttgtctcccaataaaagtgagaaccacctcctaaaaaaaaaaaaaaaaa

SEQ ID NO: 2922 - DNA, 264 bp, Homo sapiens
ctagcctcacccgccattagaggtctgcagcttctcaccctcatggtacacagagatctccatgctgtgaagacacccaggatgaaaaaccatgtggagacaaacaggccagacatttcatctttttcagccatcccagttgatccaccagctaactacagacacataagtgaacccaggtgaaaccagcagaactgcccaatcaatgaatagaattaggagaagtaataaactggtttatttaagtctacaaaaaaaaaaaaa

SEQ ID NO: 2923 - DNA, 536 bp, Homo sapiens
gtctgtagggacaattggcatctttgtagagctcgctgccatctcttcacaaaacatccccacggaaagccaaactttcccttagcaagcgtggcaacgtcccagagtgcagcctggatcccgtcaaggatatcacatgatacttccttgtcatgtttccttaggctcatcttgactgtccatttctcagaccttccttgattttggtgaccttgacaatgttgaggaacagtggtcagaaaccaagtgatggcagctttgtgtggggctaatcagcttcatccaagtgcagtcttcatctgagtgcaccctgacagtgccttgttcagatctgctcacacgtctcttggctaccagcctgtgacttctgataatgccagggcatgggatgccacaggaaccccttggtgcccacatatacatgactcagttgtgcaggatagttaatgctccacttgaaagctctttaaacaatgggagaaaggaaccaataaataaacgtttcctaccccacgccacaaaaaaaaaaaaaaaaa

SEQ ID NO: 2924 - DNA, 166 bp, Homo sapiens
agcatccaataaagcaagtcttccaacagactgagaggtgggagactggggcttggtcctgttggcctccagcagctgtgtgacctgaatgagccattgacccggtacaagctgcaacatcctcagccacattaataaacatgtgaggccactaaaaaaaaaaaaa

SEQ ID NO: 2925 - DNA, 461 bp, Homo sapiens
ggagaagacccagaagctctgcatttggaacttttcctggattctgtcccatttgcttcttcccatgaccgattttgatctaccaccctggcccatcatgcccccatcctgtacctataaaaactctgagaccctcgcaggcagagacacaagccgctggacgtcgagaggaacacattggtggaggaactcacaggtggctggatgtcaagaggaacacactggcggaagagcacactgacaagcaccagcagacaacggcacgctggggcacgccggcaggccatcaacctgcagaacgatgtggagtttggcctgggcagtcggaggagagtccagctgctgagcagtccgactccaggaaaaaaacaccttcccattccatctcccttctggctctcccatcttctgagagctacttccattcaataaaaccttgcactcattcaaaaaaaaaaaaa

SEQ ID NO: 2926 - DNA, 442 bp, Homo sapiens
tggtagagagaatattcaactgggtctgacctaatcacatgagcacttagaaggaaagttgtctctggctaggaacaaaagaatgagacaagaatgcactcctgctagcctggaagaaagcagacactcatgttgtgaacacctgatggaggggggcagtctcttggagctgagagcagtcctcagccaacagctagcagggaaataaagacttcatttctacaaacattggaaaatgaattctaccaaccattcgaatgaagttggaattggattcttccccagagcctccaaaaaggaagacaacccagctgattctctgatttgagccttgcgagactctgaggagaaagtccagtgagtctctgtgcctgaacgtctcacctacggaactatgagctaataaatgagtattgttttagactaaaaaaaaaaaaaaaaa

SEQ ID NO: 2927 - DNA, 122 bp, Homo sapiens
cctcagagagcgaagtgagacaaattcagaaagtcttctgaatcatgttggagttcctggaactgccagtatctagaagtcataaagaaaaagactgacaaatgtgaaaaaaaaaaaaaaaa

SEQ ID NO: 2928 - DNA, 224 bp, Homo sapiens
acgaagtgagacaaattcagaaagtcttctgaatcatgttggagttcctggaactgccagtatctagaagtcataaagaaaaagactgacaaatgtgaacatataacaatttttcgcttttgtctcccaaaagactccataagcaaaaggtcatcaacatgagaaaattatttgcaacaacaataacaaaaataaaggccaagcttaatataaaaaaaaaaaaa

SEQ ID NO: 2929 - DNA, 211 bp, Homo sapiens
tagtacagaagatcagctgaacgctggaagactctccagtgtgaaatgtttatttctaggatcttctgttcaaccttggagccttcagagtcctatgtatagtcttaaactgctgatctaaaactggtgctctgtcccaccaggtacttactcgatgctccacattttaatcaaatttctcaccctagattgctacctaacaaacaaaaac

SEQ ID NO: 2930 - DNA, 540 bp, Homo sapiens
aaatgaagtcttactgtatgcccaggctggaattcagtagcatgaccacagctccctgcaaccttgacttcctgggatcaagaaatcttcccacctcagccttgaaagtagctaggactacaagtgcacaccaccacacctggggttggctggcaagatggcggaataggaacagctctggtctgtagctcccagagagatcaatgcagaaggtaactctacattcttcgtagaaattgagaacaatgataacttggagaatataaattaccagaatatccgaaatatgaattttagacagatctttccatgtcttgatcagtaatttgtaaactttctattctgttctacacagtggcaaagtctatgtccttttaacttaatttctccacatactgaggaaaatgctgagaagctgtaaaatgtccaacagtgaagaataatagagaaaattttccattcaaaggcttgaatgaaaaattaaacaagctcccaaaattattacactcaccaactctgaaaataaaccctgatcggcaa

SEQ ID NO: 2931 - DNA, 410 bp, Homo sapiens
cttgaaacatgtctgggatggctacaactccattttggaccaggaagacaagggacctaacttagaaatggtggaggagaaagcttcagtcagcttggggtccagaggatggtatggcctctataccagctccggaatgcttccatatggacttttacaagaaagaaaaataactgtcactaatttttgtgtctttgtcattcctgggacaacctaatgctaaataatatatctaccctaagccttctctactcccctaggtttgaccatttcctctttgtgatccttctgctctttgttcatgattctatcatagcaccttccataatgtattgtcataacttatgcacctcacatgtaggcacataatttgactgactttgttgaaacctgaaaaaaaaaaaaaaaaa

SEQ ID NO: 2932 - DNA, 323 bp, Homo sapiens
cacatttggaaactcaaatttattccactgttgagtcctttcattcagctcaactgtttagcaaagattctccacaggaacatctgagctattcaattgtaggagtgacaggaatacaataactatttgacagtaagacaggagaagtcaagatgttgaacaattaagaaaggaatgtgatgccaatggaagacacttgactttaaccagcataaaggtcaccatatcttcatgtcacttgctttctttgaaaaggtcttttaaaatcacaggttttaacaataaaactaaatccattttttcacaaaaaaaaaaaaaaaaaa

SEQ ID NO: 2933 - DNA, 935 bp, Homo sapiens
  misc_feature (1)...(935): n = A,T,C or G
cttagtgcacagaactcggttctgtttcaagccgcagagtggaggagaaggcaccgaggcttggagatgctgtttcatggagtcttggctttgcagcacatcagaagccaagcagtcaccggtgggccagcgaccgacatgaaggagggaccggacagatggccaggaggaaggagccatcgggggcgttgggaggcccgggaggaactggacagagccaggtctcaccggggacagaatgcggcctcacaatcctgccccaccgccaagattctcaggttctgagcctggagtccgactgctagccagcgactcatggcgcccacagccagaaggagtttcgctcttgctgcccaggctggagtgcagnggcacaatctcacatcaccacaacctccgcctccggggttcaaggcattctcctgcctcagcctgccgaatagccggttattacagaagcaaggcactttgttgtgatcagcccctggagagggtcatgcgcgaagaaatggtaggtggctccacgacctggcggaagacacctgtcatcagaacatggggcctttccttatcgggttgcacggattgaattctgccaacttggcagatcttgaacggatatatttcccacgtccaccttccaaagagaatggagcctccctctccacaacttgaatggaaccccatagtcactcgacagaaaacccatccactcctccccatgattcgtctatggaacctgtgaaaattcattggtcccgccgcgacttacattttcgccaaaaaaaatatactcggcctttttggtctcattgcgcacgcctagtaggttccttctatgaggtcaacccagaactctctagagtgctactccccacgcccctggatacgacttcgcctccccgcctcaagcggccgtctgttcttcgcctgcg

SEQ ID NO: 2934 - DNA, 192 bp, Homo sapiens
gtcaggtttctgtatccagtgaaaatatcatttaaaagataaacatgaaataaacgtttccagctggactacactatgtaaaaatgaagttatttgggatgaaaaataatgacaccacatagataatcatattttcagtaaaaatgagcaaaaccaaaagtaaataaattgatacatgtaaaaaaaaaaaaa

SEQ ID NO: 2935 - DNA, 393 bp, Homo sapiens
atagacagggtctcactatgttgcccaggccagtctcaaaatcctgcctcaagcagtcctcctgccttggccttccaaaatgctcggattataggcgtaagtcactgcagctggcccagccatttttgtgatttattggaaaaatattgttatgtatttataataataagaagagtgtctggcatactatatgctaatccaacaggactgtggtcttataagaagaggaagactctctctccaccatgagaagacacaatgagaaggctgccatctgcaagccagaaggagagccctcgctgggaggtcagccatgctggcaccctgatctcagacttccggcctccagagttggaagaaaataagcgtctgttgtttataaaaaaaaaaaaa

SEQ ID NO: 2936 - DNA, 313 bp, Homo sapiens
caaaaagggtctcactatgttgcccaggccagtctcaaaatcctgcctcaagcagtcctcctgccttggccttccaaaatgctcggattataggcaagagtgtctggcatactatatgctaatccaacaggactgtggtcttataagaagaggaagactctctctccaccatgagaagacacaatgagaaggctgccatctgcaagccagaaggagagccctcgctgggaggtcagccatgctggcaccctgatctcagacttccggcctccagagttggaagaaaataaacgtctgttgtttataagcaaaa

SEQ ID NO: 2937 - DNA, 826 bp, Homo sapiens
tttttttttttttttttgaaagtcaggaaatcacttttattggtttaacctgtgttttcagatgactagatgagactagaataagaaagaaaatattagagtacatcacattggtaagattatgtgaaacttttatgttagatatgtatgtacacacttgtacatcctatgggggagtgtgtgacaatagattatgtgtttcttattgtgagttgggagtcaaaaaagtgtttgtgagccattgtactatgaacagaggaagatctcagtctcatctgttaagttctgtgagagcaggaaccaagagttttctttaccttagtagcccccagtgcttaatatatagctgagcacatagtgtgtttactgaaggaagaaaggaatagaaagaggaggaagatgatcatctaagctaagatcggttttttttttgtacctttcaatatggttttgaagtataatttacatacagtaactaaacttaagtgttacagtttcaagagttttgacaaatttgtacatctttgtaatctatgtcaagatatagaataaatattttgataagagatatctttccattgcctcagaaagtttctcttgtctcttcccagccaatcccccaccccaaggcaaccactgttatgatttctttcaccataaattagttttgcccgttgtagaacttcacaaagatgggattaccctttttgtgtctggcatcttttgccaacatgatgtttttgaatttcgtaccatgttgtttgcatgtaacggtagatctttcttttctgttgacctgacggttgggtggatgtgattagtgatt

SEQ ID NO: 2938 - DNA, 240 bp, Homo sapiens
ggatgcacgctgactgcaatcatactgagactgtggaatggtggattaggaaggactacagtatactgaagggtgagggtgaggacaagagaagggaaggtggtggagatgattattcaacagtcaagactctgctagtacacaagacaccagaaatccggaagacctctccctgccccgccaaaacaggagaaaaaataaatttctgaaagattttgatatattttaaaaaaaaaaaaa

SEQ ID NO: 2939 - DNA, 630 bp, Homo sapiens
gggccgttgagatctagaaggaaattggagttgctctcttctcacataattgacacagtggcaccttggaaaaaacataagcatctcttttatcagcttgggtcctggatataccttctgggcacacaacagaaacatgacttcagccctggctgcttgccatttatggcagaagccccctgggaagagatgcatcttctattccagtgttgaccatcacggcccaaacaataagagtctggagagagtgggggaagagaagcttcctcaggaagcccaaactggcttgcctgtgttggtggcacgagggaatcctgagagacaccctccactccttgtcgatacactttccatctctgaaataaaataaactagacagcagctacatctggccaccctcagaggggtagctgctgcagatggttcatttcccacttggctttgcagttacatggtgcctactctgacgcctagtcagctggcagcctttcctgaaaactttttagaattctatattctgtgttctaaacacttgctgttatttataatcatccagtgaccagtggaaactatagccgggaagtgtatgtggtccagtaaaccctttgcaagcatgaaaaaaaaaaaaaa

SEQ ID NO: 2940 - DNA, 154 bp, Homo sapiens
ctggctgaactgggtttgagcctctacgagacagaaactctgtgttcacccgtggatccctgcgcctgaaacagtgtctgaatgagctcaacaaatactgcctgattgaatgaatgaataaatctacgcttttcttaaaaaaaaaaaaaaaaaa

SEQ ID NO: 2941 - DNA, 955 bp, Homo sapiens
  misc_feature (1)...(955): n = A,T,C or G
ctactaatatctccacggaaaaaagaacttcagggaacggtctcactctgttgcccaggctggaacgcaatggtgcaatcatagctcactgcatcctgtaactcctggactcaagtgatcctccaacttcagcctccaagtagctgggactacaggtgtgcatcatgctcaactaattgaaaaaaaaaattttgtagagactgtgtctcctatgctgcccagtctgctctcagactcctggcctcatgcaagcctcccgcctgtttcccaggtcactgggattataggcatgagccaccacatccagctgcatatcatttcaaagggttccaagatccccctaacagccatgcatggcccacagattaaaaaacttctgatgtacagttatacttgatcctaggttggccttctgttgatacagtagcatcattgaaggcacatggattgctgcaaactgtctttcaaccagtggctcaaactttcacaactgggaagaattttcgcaccacagggtaaaagagatatgaaatcatgaaaagcatttcggctttatcaacctctttcatatggtgggagaataaagagtgagtatcctctaggcattattctatacccacatgtattctgtcggctcttaataacaattaaataggtttatacccagnggcctgaatacacctcttttttaacgctatgataaactaggggtataacaaccaaattttttcctataccatgaacaaagaactaatactccagtattttctgaaccaactcttaaccatggaaggaagtgttcgaattaaaaattaaccatcccactttaataaaaaatattgcctctttgactcccgtgatatcttggtccctctctgtatgggtaatcataaaccaactctgatactgatctgcataaatagtgcgcgcgtcttccttgagcggtgaaggatcg

SEQ ID NO: 2942 - DNA, 283 bp, Homo sapiens
ctgcttgacaattcaacattcaaagggatgagtgtatgacgtctctaagagatgtcatggagtgtatgtagaagggactttttatggagaactacttctcaaatcactattcacatcctggtagaagtcaagcaatgaagatggcacagaaacacatcccaaatactatgataccataaagtatactgtagcaatgcattggcacaccctcatttgaacatttgtctcagaagattttgacagaagataaaattgtctggtttttatttcaaaaaaaaaaaaa

SEQ ID NO: 2943 - DNA, 798 bp, Homo sapiens
gacgaacgtataataaccaacaaataaaatattctagggtctcaccgtgcttcccaggctgaagtacagtgttgtgatatcagttcattgcaacttctgtcttctgagctcaagcaatcctcttgcctcagcctctcaagtagccgggactgactacaggcatgaaccaccacacctggctaattttttttgtatttttgtcgaaaagacagtttcgccatgttgtacagaactacttctcaaatcactattcacatcctggtagaagtcaagcaatgaagatggcacagaaacacatcccaaatactatgataccataaagtatactgtagcaatgcattggcacaccctcatttgaacatttgtctcagaagattttgacagaagataaaattgtctggtttttatttcattggtttcatgaaaatttatttcactggtttcatgtcacaggcccatgactgtataaagagtcataatctttacaaacacaacaatgactcacagcgacatgttgcaaagctgtaatcgaaaacactgatgttgatttcagaggccattaatggtgttaagaaggcgcttttgttaaccaaataattgaatactcgtaattacttttcagttctagttcagttcttgacaccaaaacaagccattttctttacatagtgaatgcagaacttgccagtaagaactttcatactaaacttctatgtaaaacaaaacatgtcaaaatcagtaactactttaatggaacggtaaagaatttactttaacacaaaggaatgaaaatatctc

SEQ ID NO: 2944 - DNA, 508 bp, Homo sapiens
ctttttcccgttcttttttgcaacaatttcagtgggcactgtaagaggttttggccatgagggctcctccctagtgaatgggattagatgccctcatgagagggctcgactgagggagtttatcctgcttgcccttctgcattttgccatgtgaggacacaatgtttctcccctctgaaggatgcagcaataaggtgccatcttggaagcagagagcaaccctcaccagacaaccaaatctgctagtgccttgatcatggacttcccagcctccagaactgtggtaaaataaatttctgttctttatacattcctcagtctgtagtattctgttatagaagcataaatggagtaaggcatgctcttaagatcatttgctagtacatcattaaatgaatacaatgcactcgacataagcattcaacttctgtacatgtatgatacagcttaccctctgctgttattaataatctgcaataaatttcttgaggcatgaaaaaaaaaaaaa

SEQ ID NO: 2945 - DNA, 256 bp, Homo sapiens
ccaatgctccattgaacagagatgcgaagaccgtccccaaaccaggtctaggcatcttctccgcaggaggccccagagacattgtgattgactggccaagtttccaactacaagggaaagccagggaaaatgaccactttctttacgcctctcagttatgataccttttatgtctttctcaagccctggctctctgaggtccagtgttaaaacataaatcattcctgtctggaatggaaccagaaaaaaaaaaaaa

SEQ ID NO: 2946 - DNA, 468 bp, Homo sapiens
taagtcagcgcacgaaaaaaacaacagtcttctgcaaacaaaaccatgtttttccaaaacaattgcaatttcagataagcttttactttatgatggtttccaataagaaaatggcaacatcaaagtcattttggagccatgtgacaataaagctacatgtcacagccttaaataatgataaattaattctggcttttttcttgatatcctttgtcccttatcttggccttcagcaaagtgcttctcatcatcatattcaccatgcacacatatacatgaaactataatgacaaatgatgatatgaatatccattgctccaacaaatataatcttgataccaataacaataatgaaaataagaatattttacccttgtaaattactttggtgtttataaagtacttacacatgatattctccttaattttttgttaatataaaaaccaacatgcctatgaaaaacatac

SEQ ID NO: 2947 - DNA, 263 bp, Homo sapiens
ctttcaggcgacatcagaggcctatttgcccacttcattatcgtctgcatgttgggaattcatttccatcccagaagaccttctgagtcatattcaccatgagacaaatatacaatccattttaaatttttctgtgctcatataaaattgataggttaattttattatatgttattttattttccattaagccatttggattagtaataggttaaatttcgtaaaataaaaataattttttgaaaattgtaaaaaaaaaaaaa

SEQ ID NO: 2948 - DNA, 507 bp, Homo sapiens
cctaggcgtggacgtacagcggtgccttcacagctaactgcagcctcggcctgccgccaggctcaacagatcctctgacctcagccttctacgtagtctggagtacaggcacatacctctacatccagctaatttttgtattttttgtagagacagggtttcactatgttgccctggctggtctcaaactcctgggctcaagcaatccacccacctctgcctcccaaagtgctggaattacagtcatgagccacagctcccggcctctttgaggttcttaaaaactattttaaaaatacattccagaaagtttgcacaaaattatagtcccaccaatatatatgtgtccatttcactataccatgaccaaaattagatatatgtatcttgaaacatccattctatttttataaagtacagcttattgtaattaatgttttctttacaaaatgggtttaaatattttaataaaaagccatttgtatgtcttctgcaaaaaaaaaaaaa

SEQ ID NO: 2949 - DNA, 537 bp, Homo sapiens
tttttttttttttatatgagcacaacatttatttacaaaattaactatttttctagaacgagtttagatgagtgtacttccatttaagaaaataaaatgaattacaattaggattaaaacaataaactaatacagtaaaaacttgccatacatgaggtccagaaatttcagttgcgttaaacacggggtgacgttgtcgtgaggtcagtgaatgacttgagggcccttcgctggtccggaggcaagagccaaatcggttccatcccggttgcatcttggcgccacctggtggcacgattctgctctggtatccgtatcaatgggaatggtttggggtccagtagctcgtgagaaactatgggccaggcactgttcaaagtccttgggactctccagagagtaaaatggtaaaacagctccatcatcatggtgcttcttttagaaccattttcagaaagcttgttcccatcctggtttcattagagcaaagacgacgttcttgtcactcctgctgggtcctccacccctggcagagag

SEQ ID NO: 2950 - DNA, 527 bp, Homo sapiens
agcttgcagaggtcaggagagagccgatggcggtcttaatgaagaggaaggagggaaggacgcagctttttttacccccggcttaatttactccgtattcggcttaacttactgcctattctaccctccggtcttcaagttcccttaagctcgttggcctgttacccagtaaaactacaaggaaatggtctgtgtggtgaattttgaagctgtccacagtacagatactccagtgtctgcccttccagaaaagagctggacctaaggggtcctcctgtctcacgtgcagactcccagggcgggattaaaaatgcaaaaatcccatgtttccttgcaaatccatgtgaatctgtggctgatattattataccactctatgtgatgtaatgaagcataatttattttggttctataatgtatttatttatcaaggcatttgtattctattttattgttgatcaatttcctgtaatttaaaattctaatgaccacctctccaataaaccaaaggccaatgtcttcccaaa

SEQ ID NO: 2951 - DNA, 463 bp, Homo sapiens
aagagatgctaaatctatcgtgcccacttcattaatcatggaaaaagaggctggtgatcagcttgacaaattgtaaccaatgtgctggttctaccaatggttcaacattaaagttatgaagacagaagcagctagttcagctgggtcatcataaaagtccaggagaagcaagacgaaaagaaagaaaattaaatgacgaaacaaaggaggaaaacctcccagcagagagatgctggtgaaaagcagtttgctacactggccaatgatgtagcttggggaaaattttgccgcaagtatttgctaagtactgaatttaattaaagtagccttgttgaccaaaaccacaatccactattaaatgtttgtgtgaaaagcactggaaatgagatctgtattttctaataaccatgacaagctttttaaaaaagaaacaataaaagcattcatgggaaaaaaaaaaaaa

SEQ ID NO: 2952 - DNA, 499 bp, Homo sapiens
aaatggaacttttctctgaactcttgcctatttgggtgtcagaagccaatatatcctctcaaacaagtgtcattcacctgagatggggaggaatatgccctatgaagcccctttgctggctgtcgcaagttagagttttactcttcaagaaatgcagttactgacagctcccagctgttattgccttcagtgtctacctcggctttccagcagaggccacgctcttcccccacaccccccagccaatgactgagtgtgctgcaggtaccaggacctagtcatttctgccaactgtcagactcccagcaggcctctttgatctggagccccctgttggtttgtcggatactgactcgcatctgcatcgcagactgaggctcttcctgccccatctcgctccccttcctccggtttccttttcaggtgtaaaattggcttcctcctccctttgtctttcatgggcattacctccaataaacacatggcctcgttggcctca

SEQ ID NO: 2953 - DNA, 421 bp, Homo sapiens
gcctggcggagccaactgaggcaaattatgaacttacttctcaggaaattaaccattatgttggcaatcgctgtgattatttgaacggcagcatctggacaaatttagtcacatgaagtacagaagagagatttctcatggttaaaatgaagctctctttatttgcttctgctaattaaaaaatcagagctaaagatacttaaacactacagttaaaatgccatggttgtctattggcttaatgaattctcttatgaaatcaactctaaaatgttatccatcataaattatgaaacacactttttcttattctttttagagctttacaattcatcttaaagaccagtgtttacactctcttctgtaggttgtacaataacctttggcgagaaaaaataaaagactggcctcgttggcctca

SEQ ID NO: 2954 - DNA, 287 bp, Homo sapiens
aagaggcttcctagaagtgggcgaaggaaactctctttgctacaaagaagaaaaggggcttcttactatcatgctacaacagacaagtatcctgagcactggattaaatgagaagttgtgatgcatcaccatggatcctgatttctcccaccaggaaaggacacaagggcttccagagccagcatggatacttggatgaagacagtgggatccaaggggtggtcagcacttccttgaaggcaaggaaccattaattatcaaataaaagactggcctcgttggcctca

SEQ ID NO: 2955 - DNA, 451 bp, Homo sapiens
cctgggaggactattgattctcttaggatattagtcgtaattgagaagaagccatccttattgtcttattttgttgggatcatcatcataaaaagtaaagaaacagaagaaaaatcttaagggttaattttttgatattgcaaatggcttattattgtgaaattaggatagtcaaagttggctccattgttactgagtccaacaaaaatgccatgagagatgaagagatatttaaataaagaaaataaagtagaagagaaagattgaatagcatgagagaggaggacataattttgaaatggtggagaatatatgttcattcattgtctacatacactttattgaaacaaatctaaaagtatgttgaagctgacaaagacatgaaatgtatacacctggatggtgacgcagagcattctgagtaacagaatgtctgctgagaaggataaag

SEQ ID NO: 2956 - DNA, 260 bp, Homo sapiens
caaggttcccaacaactgtgctgaatgaatggaggaaaaatgaacccaaaccaggaatacaaatccttgtgtgtgaacataaacctacttccaaaattcttgaggaatccctaactcaagtcccccaagtcctgtttggttgtgcacagaaagagatattacaagaggagccgtgggaacctgaaaaaatgaatggggagtggcagtcccttcttattaatgtgatcaagaccaataaaagaatggcctcgttggcctca

SEQ ID NO: 2957 - DNA, 187 bp, Homo sapiens
ctttgggagtccccagtggctccaccacaacctctgttgccctatgacctgaagatactgggagatctgcagggaagagactgggacaccccacaagccaggaaacgatatgggacagacaggatcaaaagtcatccctccacccacctaaaataaatgcatatttgactgcttaaaaaaaaaaaaa

SEQ ID NO: 2958 - DNA, 323 bp, Homo sapiens
attaacagttcctgtaccagtctcatcttcgtaactctagcacccagacagctcatggagaatagtaggtgctccacagcgtttgttgagtgaataaaagaaaacatgcaacatgcattctaaattgacttcttcaatgtatgcgaatatttgactataaagacgtgcagcataacattatacacaataaaaacctcaaaagaacttacattttcaggttggttagaaaaagcatggtatgttcacgaatacaacagaatttgatgtagccaataacaataaatattatatttatgaataaaactttggcctcgttggcctca

SEQ ID NO: 2959 - DNA, 261 bp, Homo sapiens
cctgttcagctgtcatgagaaagttgagtgatgagaccttgagcgggaatcatcaatgaaagggccaaggagatgagatggagcattgtaatcaacaaaagtgctaaacaccaagaagtgttgtcccatattttattacacttgagaatgtcttgctattttagacgttacaaggtatggcaagacaatcttgtagcagtgctagaatgattcgttgaaatgcattcaatcagaaataaaagtatggcctcgttggcctca

SEQ ID NO: 2960 - DNA, 300 bp, Homo sapiens
  misc_feature (1)...(300): n = A,T,C or G
cctgtngtcatcggaactcgaattataattgaaaactccacaggcacatttccatctgtgggtgtcagctgcttggtacacagtcgtaagaaggcctcagccagttctcccgttacctgaaccaaatgtattttaaaataaatgatgcaaaacattgcattttgtgttcaaatactctcatgtaatgatctgaataatagtctaagaaaattgttttgattcagctaaatgctttgctaagggcagtttttttaaaaaaaaattacaataaaattttacagcantggaaaaaaaaaaaaa

SEQ ID NO: 2961 - DNA, 745 bp, Homo sapiens
cctaggattttacaagaaaaaataggtgattaagaccttcgtgtgacatcctttatgacgtctgcaagtatgctacatatgagagctagatactacttttttccatgaaatttgatttgtctgatacagggtctcactctgtcaccaaggctggagtgtagtggcatggtcatagctcactgcaacctcaaactcctgtcaccctatcttcatacttttttggaaaactcttcactccccctaacctgtaacctcacacgttttcaaaacagcggaaactaaacagagataaatgttggtttcagtttgacagccaaagatgtttaattctgttgtatcattttttctttaaaaacatctaggagaattaaattaaagagtgtaagcctggcaataattttaaacatattggtaatctttaataataacaacagcagcaataaaagaaatcataaactccactatttatcaaaagctcattatgtagaaggaactgtcctaaatattttacatacccccccctctaatacttagaaaaactgtatagtaatcataagctcataatttagaagaaacaagaaacagattcatatgcccaagggtatgcagcatacaaatgttacagaccaagcagctcctattcagaaattctcaggtctatccccttacctctattcggtttatactattttcccctaaataaacatctgggcctcgttggcctcagcggtggagctctgtggcg

SEQ ID NO: 2962 - DNA, 345 bp, Homo sapiens
cagtgcaaagggttgcaattggtgagttctgtttgcaaaagaccaaccacctggaaatgcaagcgtggaagccatgagagtgccaaaaaatgtggaagatggaggcagagagaaccagacttgaatcctggccccacctctcacccacactccctgaacctcaagttttgcatctataaaactgtggtgataataaaacctacctatagggctgttgatccaaactgtattttgtagctcctccagggaagttttccagtcaacctaatgcttctctatggctgttcagggaatgaaaaaatgaggaaggaattaatgaattatttcatgagaaaaaaaaaaaaa

SEQ ID NO: 2963 - DNA, 247 bp, Homo sapiens
cctagacttactgcaccatcagctctccgtgttgctcagagtcagctccagcacagaattgtcttctgttaaatgaagcagggtgagtgaacccagctgaaaccacagcagaaactgccttggaaacttgcaaaatcatgagaaatagaaatcattgttttaagtaactaagttttggggtattcagatacacatcaaaggactaaagaaagcaatgaacaataaagagctggcctcgttggcctca

SEQ ID NO: 2964 - DNA, 304 bp, Homo sapiens
agatgaagtaaatctcctgtcaaaggattggagagaaggaaccaaccgtctttcactcacccacttagaaccttctggaagccctgactgccttgctgtaaggtcggctgaatggaaagagacaaaggctgttggccctgataacagaggacatggagaacactgacgggccagcacagagaggtgtcaaacctacattgcagcctgaaggatgtcttcacttcctcctgctccttcgcctcgtatccttcatagatttttcccgcaataaaactttgcatatctaatatcaaaaaaaaaaaaa

SEQ ID NO: 2965 - DNA, 202 bp, Homo sapiens
cctaggtgttttatagacctcagatactgattctgtacagctgaaccgggttacactccaagctacagcccgtgtgaaatatgacttcgtcggaatcagtaggctcaatcctgtttaccgtggaagagaaaagaatcttgtacgtaactactaaatcttcaacgagataatgtcgaataaacagctggcctcgttggcctca

SEQ ID NO: 2966 - DNA, 752 bp, Homo sapiens
cctagatgcaaccatgctgtggctcaaaggattaattaatttgcttaagataatgcaacatgagaaaagcagatcaggacggaattccagaacaaggattttgcttgaaataacatcactactaattgtctctctgcacctcctggctcatttctctactcccacaccttccctgctgaccctagtcaaggagctgtgaacatacaaatagtgcctgatacactagggcctcggcattggccatgggagtgagggagaaaatcatttaagaggctttgtagtcgatttcaacaaagaaggcaatgccagtgaagcatcttgcaggaatccctccctgactgcttcagtccacagcgctcttacctttctctatacacttacaatctgtttcatttacttcctagcaggccttgcagaaaccattatttcatatgatacgtttcccccatagaatataagctccttaagggaagagatttttgcttggttttataatgctgaattccaagtgcctagaaagggcctggcaggtcgtaggcacaagaagtattggttggttgaatatatacttcttgcaacccacagaaactgatgttggtctgggccaggccctgccctggcttccagggatgcagaagtgaatcgaacaacttcctgccctctgaacttatgggggagacatacatacctgcatattcacaagagatttcatcacatgtaaccaaaataaaaatggggcctcgttgggctca

SEQ ID NO: 2967 - DNA, 296 bp, Homo sapiens
gactctgtactgactcttcctgctggctgcagtgaaacaagctgccatatgaagagatccacatggtaagaaaacgaacagccagcaagttgccaaggatttcacctgacagcttacaaagaaagatgtgaatcctgctcaaagccacatgaacttccaagtagatccttcctcaagtagagccttagatgagactccagttctggtcagtgccttgaatgcagacttgggagagacactgaagcagaggactgaactaagccgtgctgggattcctgatccacagaaattgagag

SEQ ID NO: 2968 - DNA, 265 bp, Homo sapiens
cctgaacctgcttttagctgaactgaaaagaagccctgcacaacatctggtgtgatagactgagccatgcctccaggaagcaaatcatatctgaagtaagatgcacaccttagattttgaaagcactgcataatcactctccacacctccatgcacttctataaaaaatgactctatttcatttctccctgttctcttacattgtaaaaaatattttaaccatgtgataaatccagtgaataaaacagtggcctcgttggcctca

SEQ ID NO: 2969 - DNA, 449 bp, Homo sapiens
atatcacactctctcgctattattcgatttacgtattgtatgctggcgcggttctgggtacgactagaccacagccatccctctgggggatgccaccttcttctcactgaacatgaccaccaggtggagaagacttcctgtattagagttctggagccattgttgctgccgttgtggtggttgtcatcatcatcctcaccgtggttctgatcctgctgaagatgtacagcaggttgtatgagctggccacataagtatttgagatgacaaatactggaagcatgtaccctgactctgctttctggagacgtataaggggaaataaaagaatataatttgatcatacaaaaaataaattttatatgttatcaccttatgtttaattaccttcagtcacaaccttgatggaaggtaattcttttcagggaagaaatcaaaattaaaaaact

SEQ ID NO: 2970 - DNA, 790 bp, Homo sapiens
  misc_feature (1)...(790): n = A,T,C or G
acacgttgtggcgtgtaaacttccaaaccaaaagcatggagcttgacagaggataatgaataggaaaaaataaaaacaacaccccaaccctacaaatgcaaagttaatcccatgagggaccaagatgaagaagccaggaatatgaagggctgactatacataacagaataaaagacaatctaatcaaaagtagaagaggaagggaaaaagtcagtgaagaaaaaaacctgtggaaaagcaacattatttataacagacaggaagagaggatgcttcatctaatatagcttcagtaaatcaccctttttaaagcagggatttgatgagttaaattgtttgcgtataggctaaagataataattattgcctaacttgttttttcaatgtaactctggttacattgttgaagtagtatgctgaacagatcaataattgttaccagtctcttctcaaatgctaatccaatttgctatactctttccacattatcacttagaaagtgctattacctaatcatttaattagatacattgaaggtggcattaatttgctggatatttcaaattaatagcatataattatatagctgcatttaaaattaagacatgtaaattagttttgatttatcattctaaattgcttagtatctttaacatcaaactttcattaaaataaatccatggcctcgttggcctacagcggtggagtcctgcggccgaatttttacctttttatatacaaatatacttaaaatanaatttattaaaatataatttattaattaataaaa

SEQ ID NO: 2971 - DNA, 965 bp, Homo sapiens
ccgcactctgtccccgtaggcccggatggggccggggaagggttactatgcacctatggactgttgaatgggagcacggggggaatgcctttaatgaggaaaacctgttttgctcacaagagggggccggctagcgatgatgaggctactgctgactctgaacattctactcctccaaaaaagacgagaaagggagaagaccccaaggactttacttcacaatggctaagctttttgagccatgctgggcccaacaatacaactcttgcttgctttggggggggcggcccaaacgacaaagctgccctgctatacaacacaatccccgaagaatatcctgggccctctataagtaccgcatgccaggcctaagtatagcaccgctggagtttctcactatcaagccggctacgaccggctgctcttcccacgcttcggcccaccaccgtagaccccctacgccttcccaccccccgacgggcggtagcaggggaccgtccgagttcgctcgcgcccccgaccgcagaacaagtcctcagacggtacagcccccccgccgaaggctcccacctcacgtcgtatagaggccctacccgcccccacgccgggcgaggcttgaagacataggcgtgagaagaccccgcgggacgagccctcaatattcaaccacgccaccccgccttactcagcgcgtcgcccatcgatcacctcgcgggcccaagccgacatacccgactgcgcccgtctctcacgccgcgcgctcaccctcccgtgatgcgcgtgcaacccgcgcaggaccgcacccgaccctcgcgcgcgccggccccgaccgcatcccgatggccgccgcgatgcgcgagccaacagcgaaccccccgcgcgcgccgcgcccgtcggtcgatggccgtcccgccctctacggctccggcgcgcgcactgtaggcgctacgcccgcccgcgcatcg

SEQ ID NO: 2972 - DNA, 603 bp, Homo sapiens
  misc_feature (1)...(603): n = A,T,C or G
gtaggcctcacctattccttgaagatacaacaatattgaaattaggaaaattcataaccctacaatgggccgggcgccgtggggcacagctagaatcccaacactttgggaggctgaggtgggcagatcacctgaggttgggagttcaagaccagcctgacctacatggagaaaccccatctctactaaaaatacaaagttagccaggcgtggtggtgcaggtctgtaatcacagcgacgggaggaggctgaggcagaagaatcacttgaacctgggaggcagaggttgcagcaagccgagattgtgccattgcactccagcctgggcgacaagagcaaaactccgtctcaaaaaataaataaacaaacacatataacactgtcaaaataaggagaaactttctttcccacattgaaagtcattgatgttttccttaaaagcattgtatcatgtttgtattctttaacgatcaaaaagaatcaaaaaaaaaaaataaaaaattggcctcgttggcctacagcggtggagtcctgcggccgaattgaaaattattttaaaatatnctttaatttatattttttttattatttaaaaattaaata

SEQ ID NO: 2973 - DNA, 887 bp, Homo sapiens
ccacaaagcaacaccactacgccccgatcgccaacacgaccccgccagctcactgggcaacaggaactcgattttgcattgaaaactccacaggcacatttagcatgctgtagggtgtcagattgcttgctacacagggggagggaaggcctcagccagttctaccattacctgaaccaaatgtattgtacaataaatgatgcaaaacattgcattttgtgttaaaatactctcatgtaatgatctgaataatagcctaaaaaaatcggtttgattcatctaaatgcttttctgggggggggtcttctaaaaaaacattacgctaaaatcttccagcactacaaaactgggctgtttggcctcagtcgtggagctcttagggccccttccctttacacacgggtaattaaatgatactcgatcactgactccatgagctcggaccattggatgccaaccaagagataagacccagtcaaaagcgagaatacgtgcactcaaaagactcgtgtgataacgcaggaaagaccttctcctccagaggcccgagcaaggccggaatcgacggaaagggccgagtaggttgcgagagtccccaggcttcgcgccacctggcgggacttcatacatcacccgtaaaataaaaacgggcaatcccgccgggtactttccaaaatttaggtggacccccgctcgaagctacctaagcgggtcttacagggcggagtcgccgagataacctgataaccccgaccacgtcacacaattgagcagagctgggactttgcggagagccaacccacaagaatctacactcccccgccgagagcaaggttctagctaacactatggatccaaccaccgagaagacagaacagcccgcgtta

SEQ ID NO: 2974 - DNA, 310 bp, Homo sapiens
cctagggcccccatgcttctagactctcactcacaaatgatgtacaataaaggagaagctgccacttatgaatcaagtcctggagtgagcaagccaaagcctctaactgtgaactcctcaacaggaactctaacatcacacatttaatctgaacgttctgatttttgccctaagtatttaagtctcttggcttaaaatcaaggaacaagcatatacttgacagtagacttaataatttgtgcttgaatttatttatattgcattacaattgaataaagattaaaataaaccactggcctcgttggcctca

SEQ ID NO: 2975 - DNA, 355 bp, Homo sapiens
gccactgcacacggtcgggctcccgaaaatggcgggtgggggggggcgctgagggggacccacacgggattcagagcttcagggagcagctacgcaaagttaattgtgctcagcaaagtcttctagattaagcggtcgctccaataaagtttcctgattctgtccagaaatcctcaactccgacaataagaagtgggttgaggggcaatttgaatacataatcaaaaagcatataattgaagattgaacttgagctatagcttcatgtattgtctctgcgttgttctattttaatagttgcatatggagacaataaagctacatgacaaataaaaagatggcctcgttggcctca

SEQ ID NO: 2976 - DNA, 964 bp, Homo sapiens
cttcaagtgtccttgtacctgcaacaataaggatggatcttagaaacatgggttaaggaagacaacaagaaaatgcagaagaattcattcagtattatttttattatataaaacccagatctgcacacacacgtgcatgcatatgcattcattgtgggatagcatgaaaacacacatggtaaaactatagagaaaaatataaaatacagggagggggagaagtgtgaaagaaagggaaggaggttgagacattcaaagagaagcacggaggggtttcagaggtaatgatgatatatttctaattatacaatggatagttggaattcaaatatgatgttatcattaagtctttatcctaaggcagattgtattttccatacctggacaaaccaacagcagcccatactgcattctaattacaatgtggtgttgaaacacttcagtagaaaggtagtgtctatgtttcctctcttttattctgagtggagctttgaatttgcctccaccaatagagttccactgcataccatgatttgaccactgaggctaggtcatagtagggtgatctaactctttctctcttcctcacctctctctctcccttcccctatctctctttattaagggaatgtgcctttgaagccctaagctgccatatatatggctactgtgaacacgctggctactgtgctacaaagatcacacggagagaacagatacagagaaacagagagagattcctggggaaccctagctgcttcagttcctagcttttgaggcatcccaaaccagaggccagatgcgtgaatgaatgagctcttggatgatggcagctgcaaccttttagtcttctagctgaggccccacacactgtaaaacagagagaaaaaaaaacccagtgtcttgtctgaatttctgaaacacgaaatttatgagcataatagatggttgttttacaccaaaa

SEQ ID NO: 2977 - DNA, 399 bp, Homo sapiens
ccctaggtgtcacctaaaaggaaagatcttgaagcagcacaatacaatcaggcaaacagacaatatccactgtctggaaggtgcggtgcagtgcagaacatgaactggtacagctttgttgggggcaactggcaatatatatccaaaggcttgaaacagaaacatccttgcacttagcaatcatactttctggaagttactcaagggaagcaatcagagacatgtacagcgagaatgtggagatggatatccatacagcaacgtgtctattagcaaagccattggaaacaacccgaatgtccaacaggggactggtctcttattcagttcattatggtagagccgtatcatggattcccatgcagccattaaaataaagtactggcctcgttggcctca

SEQ ID NO: 2978 - DNA, 312 bp, Homo sapiens
taggtgccagaagggagccatgtgccaaggaacctggtgtctccagaagctgggaaccgccctcaaccgccagcaagaaaataggaaccatgttcctaccaccacatagaactgaattccgccagtgcgtcaaggagcaggaaatgggttctcccccagagcctccaccaagaaggaagtcctgtggacactttgtttttaacctggtgagatttgaagcagagaatccaaccatgcccactgggcttctgaccttgagattttgactgtgagataataaatgggtgtcattttaagccaaaaaaaaaaaaa

SEQ ID NO: 2979 - DNA, 799 bp, Homo sapiens
cagatgcatttgtcattgaagaaaaacatcttacaaaggaagtttaaaagagaacccagatgaatatttcttcagatgaaccacaaataagttctgatttcaacatgttctacaactccccagagctgagaagctaaagacggttctacaatatcatattccaaaggcatcacagggtttagctgctaatgcaataaagtggtttttgtcttggaagcacgcaacatcatgaataacattgtcatctagaaacaatgagccaataggcaccattttgtgttgtaaccgagcaggcttgcttgattgtggatgcagatatgcccaccctacgtaagttgacattttgtacagactagaagaaatgtgtggtatgagatcaataaagaagtaactaaaagtaaaagactcttaatgattgtaaatgaagctgagaacaaaaacttagatctcaataacctagagttatgactctagggctatggtctgttaacatctgcttcttgggtaggaatgtttttctttcaaaataacagtgctacatgaatcaacagcttccaaaggaactatttcatgccggccaaccttaggtctcagacctgaaaagctcattgatctttggtaaaatctcagttacataaggagggaagttatttttaaagccataccagatgctacaggttcttctcattgttcccacatggatgttaactggttattaagatttgggccaaaacccctgaataaaaaagtaagtatgattcccttgcaaaccaagagacagaagtgcttgcagggattg

SEQ ID NO: 2980 - DNA, 292 bp, Homo sapiens
aagtggcgagggcagctcccgccagaggaccccgccgaaaggttagttctacgaccttgttgttgccgttgtggtggttgtcatcatcatcttcaccgtggttctgatcctgctgaacatgggcaggggataatagaggaatgttcaaacctcttctctcagagatctctcttctaggttgtatgagctggccacataagtatttgagatgacaaatactggaagcatgtaccctgactctgctttctggagacgtataaggggaaataaaagaatgggggggttggcctca

SEQ ID NO: 2981 - DNA, 417 bp, Homo sapiens
cctaggtacagcgtgtcatggaattttctatgcagctgtgtaacaacagagatgccctgtgtggaaataacaaccttgttagaaacaggaagccctccagaactcagcctctggtattggccgattcttccaactaattcaatcagaattgctcagtcttctccaagcctacttcttattaagttactgcaagcaaatgaaggaaacaagtctcaaggctattgcatttgtctctcttaagatacaacattcgtgggtttggcaaacaaattgtactgttctaatcttatgcataaaccaagcaagactgtgtaaacttataaaaactatttattaactacttaatatatgccagtcataaattgtatctaaaagctaagagtacaacaataaacaagacagacaaaaaaaaaaaaa

SEQ ID NO: 2982 - DNA, 658 bp, Homo sapiens
gctctaactcccaccttacatcaattactaaaaaccacataacatcaatatcttaaaaaaaaaactaataatacaataactaacataaacaacatatacgatacagctatacattacaaaataatatattaaataacgttgcatagagagtagtatatctctctctgaacttacattttattggattcacttcagaatgatgaagagtgcatgtaacattcagctagaggaatctcaagtgaattttccagatatcaagtgtcagtcctctgagcccaagctaagccatcatatcccctgtgacctgcatgtacacatccagatggccggttcctgccttaactgatgacattccaccacaaaagaagtgaaaatggcctgttcctgccttaactgatgacattgtcttgtgaaattccttctcctggctcatcctggctcaaaagctcccccactgagtaccttgtgacccccactcctgcccgccagagaacaaccccctttgactgtaattttcctttacctacccaaatcttataaaaacggccccacccctatctcccttcgctgactctcttttcagactaagcccgcctgcacccaggtgaaataaacagctggcctcgttggctaaagcggtggagctctgctggcctat

SEQ ID NO: 2983 - DNA, 291 bp, Homo sapiens
tagaagccagttgtcatgtaaaaaatgggactactctgagatcagcatgctgtgagaagccgaggccacatgcagagattctgaagaatgggacgccattgtggagagagaggccaagaaacactgaggagccagacatgtgactgaagaagccataatggaagggattctccagtgtcagcaacacaatatggaacagaagaactgcccagctgaacctgtcatgaattcctgacccccaaaaattgtgagcacaataaaatggttgtttttaggccaaaaaaaaaaaaa

SEQ ID NO: 2984 - DNA, 696 bp, Homo sapiens
cctgggtcctcgggaataaaagattctgcattttgtaagagaaaccctagatgaccagaacatctaagagatgagcataaaaaccatctcctgaaaagccaagggaaggtgccagcctcacaggttttgggggctggtgaaaagggagtagacattctgcgggcagtttggtcatctacctggaggcttcaagttctgcacatgccttgaccaacctggtgattttccttctagaaatgtaatctaaagaaatcattgtgaccgcaccagtgatgtagcaaagaacattcactacagtgttttttaaaatactgacaaattagaaataaggtgtctaacaatgctggcgatgttaaatcaactatggtacatccattaaagaaaataatatgcagccttttataacggcttggtaaaggttattgtactgaagtgtttgatatattacatggaaaaagcagattctagaataatctgtgctatgcagagatcattattttgattatatatcctggaataatatctattttgattatatatcctggaatgatacacgccaaatggctaagagtgacacctctagggtatagaattagggttgattttatgtattctccctttcttcctttgattctttttctcatgtgtatttttcctataataagtgtatagctctgcgtaataaaaaaaaaaaaa

SEQ ID NO: 2985 - DNA, 495 bp, Homo sapiens
ttgataatgaagagactaggacttagacatgtttagagactaaaacactgtgatctgaagagaaagaagttacaggaaaggaaactatgaaggcgcagtcaatgaagtgacaggaaacatgggcaagtgagctgcaatagaaaccagaagaagaaagtctttcaaaacaaagatagtggccaatgttactgaatgttactaataggccaaataatataaaaaaagaaacgatttgatttgacaatatcagaatctttgatattcttgaatagtattaaactcttatttaatgatattaagataaatcagcttggtgaatatagtctttacttctcgctgttgcgtttaatagatagcaataatgggaaaggacttcaaacctactaagcaattaatgatgcagttctagtagtattgtcttttactgtgtctcataaaagttattaatgtcattaaaatagctgaagaaataaaaacctggcctcgttggcctca

SEQ ID NO: 2986 - DNA, 222 bp, Homo sapiens
aggtgaatacattcaacagactgtggtacatctacaccattaattactatgcagcagtaaaaacagagtggactacgactacacacagaagcttgggtggatctcgggaattatgctgaatgaaaaaaagccagtctcaaaatattacatgctgtatgattccatttatataacatttttgaaataaaaaaattatgaaaaaaaataaaataaaaaaataaa

SEQ ID NO: 2987 - DNA, 249 bp, Homo sapiens
aatgcctggattgcacacttcccataatcccactggtgtggagaacccttaaacacagccagttcataaggagagcaacaaggatgactggatgctaattaccagactgatgaatatataatgcaggaatcaacagggactggaagaaaactcgtctgagctaagatattaacatgctcgataaccttggccaaggcacttggcctctgtacgctttaattagccaaacagtaaagctgaataaaataa

SEQ ID NO: 2988 - DNA, 633 bp, Homo sapiens
ccttagtttgggaagcaactaaaaaatttgatgcaggaaacaggcgaacacttaaatgtcaactttatggcagatcaaagctggattgggggacacggtgcaaatgagcagcctccatgaacttcctatcccattcctgtcacagcaaatgtagacagactattcaaccagtcacaggagcgctgccctgtctgagcagcccagaatctaccctcaggcaagtcctaaagagaatacctggtgaggcttcccacctcaacttctcccttgaaatcttcacaccagaaggtgatctggtttcatgctctacctcccaccatggtcttgaaatataaaggagggcagctgacatgagatccatggggattaatatttcctggtgacatttcaagtaaaatattgggtggagaaaatattaccggatgggaaccattcttcttgccgggagagtcaggccagagagactccaggaatgtggctccaatagagacccctccacagggaagcaagaagtaggggatggagtttccatttcacaacccagatccaccctgtgggcacacgcattgttattgctttctgaaataaagaactggcctcgctggccaaagcggtggagtgttgccggccaag

SEQ ID NO: 2989 - DNA, 490 bp, Homo sapiens
gtgacccgctggggttggctttaggagttgtcctcttgtgacctcaaagcaaccagcatgataacaaaagccagcacaccacagacggcagaatggaaaggcagtaagaatctgggttcggtctctcacaaggttgttgagtcactacaccagtcctggaatgctgatctctggagaacttgttagacagtcttcccaccaccttgttccgaggctctgggtgagtgttccagaagctgacgagatgcaggatcgtctccctcacacacacaaatgccatggcaacagcaactccgtgacaacagcaaagaaagccagactggaatttgccaacccagagtgttgaccatctgtgaggccaaaccctccaaatgttgcccgttctaagtgctcatctcaaccaggcttttgtacatagcagaggcgacatttaagtgacataagaataaacattgggcacatgtgaaaaaaaaaaggaaaaaaaaaaaaa

SEQ ID NO: 2990 - DNA, 532 bp, Homo sapiens
gacacagttaagaactggctctgtcacctggacttcacacatattccggaacaactctgagtgacaatgagtcatctgcagttaagaatttcactgatatgcttttctgatcactgtgggttaaattgacattgcaacaggtgcaagaatacttaggaatatgggaacataatatggtgttaagcataataggaagcttacaaaatttaacatactattaccttgtatactgtctttatggctctagaccagattttaaggtatatatgtttaaagactattgatgaaattttaaaagcacagtgtagataaatctggatggtggaattatggctaatttttggttgttatttttctaaaatattttccaaaatgttttttaattagtagcaattatatttactatcggaaaaatattaaagaaaggaatttttatctcaatgtggactaaatagatacgcagatccaattaataaatgatgattcaataaacccctggcctcgttggccacagcggtggagctctcggcca

SEQ ID NO: 2991 - DNA, 601 bp, Homo sapiens
agtcttgacaataatttcttggatatgacatcaaaagcacaaacaacaaaagtgaaactagacaagtgggactacatcaaactaaaatgcaaccaggaagcgaaggaaacaacacagtgaaaaggcaacccatggaataggagaaagtatttgcaaaccatacatctgataagagtttggtatccaaaatatatttggaacccaaacaactcagtatcaagaaaacacataaccctattaaaatattgacaaaggatttgaatagacatttctcaaaagaagacatgcaaatggctaacatgtagataaaaaatgttcaacatcactaatcatcagggaaatgcaaatcaaaaccacaatatcacctcacatctattagaatagctgttatcaaaaagacaaaagaaaagaagtgttagtaaggatgtaaaggaaagagaacacttgtacactgttggtggaaatgtaaattaggacagtcattatggaaaactgtatgaagcttcctcaaaaaattaaaaatagaactaccatatgatctggaatttctacttcggggcatatatccaaaggaaataaaatctgtatgttgaagagaaaa

SEQ ID NO: 2992 - DNA, 626 bp, Homo sapiens
gcctaggggtactcaccaactaggtttaaagcttcactcactctgcataattccacgttcaagggtagagaattgcaccatgcccacaggacaattctatctggtcaccttcagtgtgagggtcaagctgtgcagtccccagaaagaaacattaaataagacaacttcataatgcactagggaggaaatcacttactattcatgtcgacagaaaagaagagaagatggatcacagcaactctgtatgctcaaggaggactcaggaaggccccaggttccagttccaggaaagtggattgctttaaagtggttaacagcaaccctttgatgaaatgcttaggtttactgcaaattggcactgggtgaaaaatgagagcccttccttactttaccttcaaattaatcatattgtcccattgatctttgttttctgtaatgtgcttctcacaatcttttcccctcttttgtacagaaaagcaatcttcaatgaattttaaacaattatggagactatttcctcgcatatttacttcgccgtacaggtgacttaagaaaaaatatgctttcttctcttagcaaataaaaacgtgtcctcccggcaaaagcggtggagagttacgaccagg

SEQ ID NO: 2993 - DNA, 277 bp, Homo sapiens
gtttcattctgtcactcaggctggagtgcagtggcatgatcgtagctcactgcagcctcaaactcctgggctcaagagatcctcctgcctcagcttcctgagcagctgggaatacagataaacttcctccacgtgaccagatgagtggaggtgagatggagagtgagattgccaggaagaactcctgccttgccattccagcccagttacttggaggaaagagtgcctctcctgtcttccagtggctgcaaataaaatcctggcctcgttggcctca

SEQ ID NO: 2994 - DNA, 296 bp, Homo sapiens
cacccctgctctgtcacgtttttaaaacatcagagacagaagcatgaagcatgcctgcctcacaacattgaatttatgaatttatatctaacagtatcaccgttataatctgagatggttcattgttttaaacattatttctcatttggtctttaagaagattatgattgtatctgtccttctaaagtggcaatttaaaatccttgttatggcaaagaatcctatttttctaaaaatcgttaggtatacctaaaattgttaagtatgaaaataaactcctggcctcgttggcctca

SEQ ID NO: 2995 - DNA, 917 bp, Homo sapiens
cttcagtggcctcccaagttgactcaggttttggcatgtgattgacaacaggacatcagcaagtatgatgcaagcagaggtttgatggtgcagcacactgggatgctccttcctggacccagccacccactgggaaaagcctaagccacgtggagcagctacatagaagagggccggggccacagctacagccagcagctcctgccagccacgtgagagagctaccttgatgttccagcctccagagatctaagagcttccagacatctaccaccccagccacaccacctgagccaatgtcccacagagtcatgggagataataaaaggctgttgttctctaaagctaggggttagtgaactctttctgttaaagtaaacatgtgaagctttgcaagtcttacagtctctgtcacaaccactaaactgttgatgtagctccaaagcagccaaagacaacacataaattaataagtgtggctatgttcccataaaacattatttgcagacagcaaaatttgtatttcatatcacttccatgtgtcacaaaatattaatcttcagtggcctttttcctagtcattttaaaatgtaaaaactatttgtcttagtctgatcacgctggctataaagaataccatagactgggtggctcataaacaacagaaattatttctcacagctctggaggctggaagtccagataaagcactggcaattttggtgctgatgagggccaacttttgggtacagacggcatttttttggtgcggtctcacttgcagaaggggcagggagctcctgaagcatttttttgagggacaatcccttcatgagatggcttgccctcctaactgacacctccaaaccctcccatggactaaggttgaaccccaattgggaacaccacttcctctg

SEQ ID NO: 2996 - DNA, 944 bp, Homo sapiens
  misc_feature (1)...(944): n = A,T,C or G
ggcgtctgtacaccccctgcaatactgacgttaggaacaatatcacaggacaggagtcacaccctgcgatatttgtggggaagaaagatccattagaagattcatgaaaatgcacaagtggaagataatgatggtcttctttatggctgcagcagcagagttacaaagagggatgttcattcaagagtcattcttgaagcagaagcaacaatttcatggccaatcagagagacagtggcagatggcagctgggtgctggaagaaatggaaaaagaagactagaaaatgctgcagagattttgcttgaggagctttgaaaattattgctcatgaaatataaaataatgggctgatttggagtaatggataatgaataggtgatgtttgaagtggaattacagttggaattaaagacccaagagctggcatcatttcctgcaaatctcttccaagtatcagtctcttattttgcttgttcaatatcttgggacctaaaggagagattgcttttccttcttgttctctagggaccctgctagacaataaaacgcagtctcaagtcgggatccctttggatccaagctaggcaaatggcatttctgccttgagcccatcactccactctgacaggtntatatcagttggttattttaatggaaaatttggaacgaccattatcttatatgatggatgaatnttgcaacctaacactaaaacataatgtgcttggatggaaatttattccttcctgagacaaaaaaannaaaaataaggccctctttgagcctaacgggaggagcttctccgcccgttccctttaatgaagggtaatatatgatcctccttcactagctcggtgtgcctgggaggtccggttcggcggagcgggttaccttcttanaaggcggcactcggtatcccaccaatttggggtataccccgat

SEQ ID NO: 2997 - DNA, 370 bp, Homo sapiens
atgtggacttgacgatgacatgaaagcaccgaacaaaaccctcaaggtgaaactgtggcacatgggttattctgttggacgccaggcggcctaccacaaaagtgtcactgtgcacacctaggaccatggattcagaaaacatcagcacctgattcccatctgccgtcttccattttagggcccttaaaagttaagaagggaaactggcttcatttttcacctttgcagagaaaatctatgtaactttcattgctatatactcattcattcattttcatttttaccagtcaactctacccatttattgggatggggccaaaacaaagtcaattatcccagcattaaaggaaccaaaataaaaaaaaaaaaa

SEQ ID NO: 2998 - DNA, 668 bp, Homo sapiens
cttcaccgtggtaagatgtgcctgtgtctcctttgccgtccaccatgattgtaactttcctgaggcctccccagccatgcttcctgtacagcctgcagaactgatggaacaccaggctatagtttcaggaagccagacttgacccagacttgaccttgcaaaaaatagcaaccccttcagaactggtaaagcaatgagaaagaattgctcagaacttcatggagctgagccattcacccatcctggaacatccaccttcctctggaattatttttttaatgtttttttctttcttgtttaatccactaattccctctcttttcctctgtttctctctctctcatctctgttcctttccatagcaacatagactatatatgagtaatatttgaatatatttaataataaaagtacatacacaaatatttacagaactgctcaatcagaaaaaatacacttaataaataattgttcaccaatggccttgatgtgctgtaatttgtatttccaccaaatgagtcccagttaccttttatgtgtattttccatgcttgttcacctatttgattttatactaaaattatattaaatttctctctaatgttttgattttctaataaaatgttggtcatgtttagatgttatcaaaatcaaaaaaaaaaaaaaaa

SEQ ID NO: 2999 - DNA, 426 bp, Homo sapiens
cttcagaccccagtctatcatgatagacatcagacagattccaactcaaggacattctacaaaatacctgactggcacttcttataactgtcagggtcttcaaagacaaggaaagactaagaagctgccacagccaagaggagcctcagaagacgtgatgacaaaacgtaatgtgggactgtgggacagataaaagacattagagaaaagctaaggaaggccgaaagaatgtggaaggcagctactaataacgcgtcaacactggctcctgagttgtgctgtccgtactgcacactgcggttaccatcacgggaaactgggcgcgggttgtgtgggaactctgtatcaccttttgtaattttttttttctgtaaatctgaagttattctaagttaaacatttgtagaaattacaaaaaaaaaaaaa

SEQ ID NO: 3000 - DNA, 480 bp, Homo sapiens
tattctcctatttcccatccagacatacaagtccaagaaacgttccccattttacaaaaggcctaccctgaggcttcaagacctgaaggaccttacagctcatcagcgatgcgaccaggatttggatccaggccgtctgcctccgagaccaacctcttgaaccctactcctgctcttgaggggttgcgggggtttgccagcctccttgcccacctcagctagcttactcaagcccaactttgaatcagttaacgatgagcaatcggtccttctttcagaatctggcctcctttgtgtgcgcggcagtgtctgtcgtatatctgtgtgatgtgtgataacagtgctgtgggaagagggtgggtctactggagctctttaaagggcagggtaagggctgtgtctgtctcattcaatgctttatcccagggcttggcagatagtagttgctcaataaatacctgtggaataaaaaaaaaaaaa

SEQ ID NO: 3001 - DNA, 435 bp, Homo sapiens
ttcaggttaacaagtatacagactttaaagactaaactgcatgaagcattttagttttgcttttccgttatggagtgaaacttgccaacttcacttatttataagaagagaatctgaaatggaatttggagaaacatgaatttatagggtctttttttttgcccatgtgccattaagtactttgtaaaatttaaaggcctataaaaataagctatgactcaaacccctggaaagatcaacattttggaagtaaagtttaatacattaaaactggattctgcgttcagaattataaatattgagctacaagagacactacacatcaacacgtgaaaacctggatatggttaaacagaccctaggagagtgtatagctaatattaatttttgttatttcacaaattaagatttaacaaacaaaaaaaaaaaaaaaaa

SEQ ID NO: 3002 - DNA, 227 bp, Homo sapiens
gctcaggcaaacccaggatgctactttgggaagcaagaaggaggatgtgccgatgtggaaaatcttaccccctgcacatgtgagcaatttccaataagatccttcaggaatatgtatttgcagaacttcttatttgacaataaaatcttgatcattttactttagcccacctacttagtccaaacgaatcaagataccacatactaagcagcttaaaaaaaaaaaaa

SEQ ID NO: 3003 - DNA, 591 bp, Homo sapiens
gctcatcattaagcttcttaggagcctaccaagagtcacctcagaaaaaaagaagctcctgtcacccctacaggtctcagaaaactgcaagggcttaagaactctactgccagggactggggacacggaccagtcacatgcttataatatcacaaaatcacactgagagagcaagactgagcctctcggagactctggggagacactgatcaatcccaggatggacgcacactcagccctcagggtccgtgggggaccgattccagatccccaaggataccaaaatccacagagactcaatcaagtctctgatagaaaatggtgtagtatttgcatatgacctgaacatatcctcctgtgtactctcaatcatctctagattccttataacacctaatatagtgtcaatgctatgtaaatagttgttacgctgtattgcttttttatttttatttttttatatttttcacctgtgattggttgaacccatggactgaatatattgaggaccacatgcagaaaactatttttacttgagttttgtagaggatggaataaatatttcaatcactttaaaaaaaaaaaaaaaaa

SEQ ID NO: 3004 - DNA, 322 bp, Homo sapiens
ctcagagtgacgaacgtggacttctagataagatgcctagagattcagtagctatcatgtgctcatgaggcaacaaattggaggatgaaagtcccagtgctggcgatggtaacgcagagagggagcaggtgcatcagaaagcagctgcaccagccctgagctgaccacatttggatttcctggctgaagaaatgcaggatgagctgaaaaaaataagctcctagttgtttaacactgcacttgaatcttctgatccttgcagccaaatattttcctaatataagaagataaataaagttaagcaataataaaaaaaaaaaaa

SEQ ID NO: 3005 - DNA, 736 bp, Homo sapiens
aggcgccccttgatttcgcgcatatgggagccgatgtatctgtcacagttcatgctaacgtccgggagcaggcaagaccatggctagagtattcggctccgtatagggggcgaagtcatgaagatgtcaaccatagtttatctgtggaagtaaccatggtgataaggagtggtgtctttattccgtaggctttccctataagagggttctatgatcgttttacagaccccaatatagtgcctccgagaggttaagcccctatcccaaggataaaggactagttgtgccaagagccctagaacctgggttcaaattccacctccaacacttacaagccattgttgtttgttccttaaattctctaggcctcagtttctacgtctttaaaataaggttgttggctatgctgtggttcatgcctgtaatcccagcactttgggaggctgaggcaggtggatcacttgaggtcagaagttcaagaccagccgggccaacatggtgaagccccgactctatcaaaaatacaaaaattagctgggtgtggtagagcacacctgtagtcccagccactcgggaggctgaggtgggaaaattgcttaaacccaggaagcagaggttgcagtgagctgagatcatgccactgcactccaatctgggtgacagagaaagactttgtcaaaatacataaaataaataaaataaagttgttaatgtttccccgtgaaaaaaaaaaaaa

SEQ ID NO: 3006 - DNA, 350 bp, Homo sapiens
cagaccaacagcaagatggcagcaacagatcatcgcacctctgcagtctgtctgctagtggctacagccacctcctacttccacagatcccactcaaggattctcaaagttgcaggagtaagatttctttccagctcccttcctggtcgtggttcctcatgtcagcttcttgaagtctggggtaactattttcctgtagtaaaatttcctgtgatagtcttcctttattgcctctcttatgtataaaatggcagtattaaaattccttatactgaatgtactgtcaattttcaaagttatttacatggtaaaataaaaatatattctttaaatatgcaaaaaaaaaaaaa

SEQ ID NO: 3007 - DNA, 698 bp, Homo sapiens
atccttgaagcaaagatatttattgtcacaataatattttaagttggagcttgtgaagaaatgcaaagaaatacacgtagtttaaaattcctgctgttaagtgatgcatgtcattactgtggaagaataaaagaatctctcaagctataattcttcagaatttgaaaattatatgaagatactgtcacctaacaaatagtacatttcaaataagcctgaggtacatctccagaacaaaactaaggtcctacttgaaactgaatgcaggtgtcttcaactgtgtgtttaaaacaaagaagatccaggacacactgctcaaactgttagcatgaatctaacataaatccaaagctgttctcctggcagaaaagtagcacagccctgtgctgaacccactcaagcagattttattgatgcaactgcctggggtacactgggccactatgtccataaaaataataattaagctgtgggatgtattacacagcttagtacctgaactaagctcagagcattgattaatatttctatttatatgtcttgttttttgtcattgagtaaggtacctctaatctatttagcatctttcacttccattttacttttatcaccacctccaataaaagagaatcaagaaagcaatggagtttcctttcaataaaacaataagaaggcctatctcctgaaaaaaaaaaaaa

SEQ ID NO: 3008 - DNA, 900 bp, Homo sapiens
ctcaggatactctgaagttgctttgatgcctgaagcccagacctgccaaagaagataactaccttgagtgcttcccctgagtttttcttaactgagcctatattgtaggaaggaagactaacctctgtcagccaaccacgacagatcttttgtcacaaatcattttccattctgtgggcccaagaggctttgccctagaccattatatgatcttcacgaccactgaattctgcctagaaatggtgtcttgtacctcgacagaattcctcttctacgtccttactacaaactgttttgccaggattcaaggctccccttcctctgtaatcttaaaatggtatataagctcctgcccttcattgggaagctggatcttcattctgaaggcttccatatacacaagttaaataacactatctgtcttttctccattaatatgccctttgcaagttaccattaaccctttcctgtctcctacatagtgtacttctatatcctaccatcttgtgtgggggagtaattcatgtccccgccttcacccccaatctccctttccaatatatggccccaaccctaaatggcatcccttcgacatttcccttttaaagagcagaccatgtcaacctctgcaaatgacattggctccgctggccgaacttcccccaggacggagcccccttggctttgccgctgcatccaatatggcgcgcgacccccctcgctcccaagacttctgcccacctctattagtcagggccacaaatgttcacactcaccacttctcaccctagctcgccatccgttcccaccctccgacccgacaccgctgctcaggccttatccaaagacctgcccgtccctcacctcaagtcccgcgacctccggggctgggaaccccag

SEQ ID NO: 3009 - DNA, 328 bp, Homo sapiens
caggttttattggcggtttgagaccatccagatatctctctctgtgcacaggaatgaacagcactccagatggtgcagctccgtcagccttgatgcccaattgtacacaatgaatggacttcccacctggctatatgttatatgctcaaacaagaatgaccatacagcattaatgacacatataactgctacttacagacaattggatttgtgctttgtattttatggatgtataaacttacccaggctgtctgatccacccccttctcacatttagtttaataaaaaaattagaagccatcatctaaaaaaaaaaaaaaaaaaaaaa

SEQ ID NO: 3010 - DNA, 406 bp, Homo sapiens
ccccgagacctggaaaaccgccattgtactctctgcttctatgagtctattaacagcatgaatggatatagaaaatacggtgtacatatgcaatggaatattattcaggcataaaaaaagaaggaaaccctgccatttgcagcaagatggatgaacctgcaggacattgtgctaagtgaaataagccaaacactgaagcttctctagattgatgttcctcccactgtgtttccctgacctgactcctcaccttccatcctcagatgaagcaccacttcacataagctttgcctgattcgtcgtttctgcctacaccacatatttccctcaggctttactgaacactacgcacatatgcatttattaaatcactcttaacacttttctcacaaaaaaaaaaaaaaaa

SEQ ID NO: 3011 - DNA, 381 bp, Homo sapiens
tggatgcttcaggtttccagcccagccccaggagagaagtcagtgacccagacctaagtcaaccagtgcacagcatttccccacatcagagtcaagatgaagaagtgggcatgacctaaatcagttcaaccagaattaatcccacaagttttataggatcacctggaaaagaggcagagagtagtaagtctgtaaggctagaacagctatagcaatgctactgaccatggggaatttaatccagatgaagcagaaatgagggatggagagaagagagtcctggtgatcccatctgagcccctccatcaaacatccctacttgtatttttcactttcaactgccattaaatactccttttgctaagcccaaaaaaaaaaaaa

SEQ ID NO: 3012 - DNA, 833 bp, Homo sapiens
tttatttggtgttagcaccgtccaaaagagcttgtttcacggtacctgactgactgcagctgtaacttcaacttgccaatgtacaccattgctcacaagaggaccagctgagagtgtgaatgaatttattgccagccttttcctactcctaaaacaaagcaattctgtagatttgttactgatgagtcatagcaccatcttcatatacaaataacaacatttcatatggcactattttcaatgtaaatgatagcagagatcatgaggagatagtacaaattatcttgggccattgtcttatttatagattaaagtacaattatgtttttcactgatttaccttctgacatcttagttaattaagttacttgtttcttttatgttcattctccccttagatctggcacgactattcttttctttaatattctttcccttgttaaattgttaattttttctgaggggcagaatacctttttatcattattttgagaatgctaagtatttacataattatccttcagagaacattggaagacaatactgttgaacaaatggataaatattagaaaaggattactggataattctgtcatttctggaagcctcagtgattgatttattctctttttaccttaacatatttttcctctaggttactatttttttcctgacaggttttcaagcttataattgggccatgttctctggttaaaaaaatagttctgggagggcgcaggcgcttaaaaacatattattctattagcaaacctcattagtttaagaccctattaataaatttgctcattcctttagaatgaaaaaaaaaaaaa

SEQ ID NO: 3013 - DNA, 899 bp, Homo sapiens
ggaggatgagtgaaaaagcgatgtgtctatatgtgttaattaaagactcacagatctggaggaggctatgcactgcagacactattaacagaatggagtccatgtaaataaacaaaggggtgctcaaagttaaagggaaaggcaacagatttgtttggggaagagcaggagttcatggtggtcacagacataagaagaaatgtggggggttcacgggaatagtatcttttctccacggtgccatgatgcttttattattttgggtgtaatttctcataactggaaagcatttcagccccttcccagtcctcagaggttgaccatttttttctctcggattcagccacaaaggcagctctaccactcaccatgtgtctgtctttgactttgtcatgtttggaagactcaggaccccacctatttttacccacagggccctctgtgcctatgaaaatgaggtcccagcagtccttgtggacatatcacaatctaaaattcagggataagaaaatctacataggaatctctgcttcactcacctgtgagactcttccaggctaattttctttgggtcatgtggtaatgcaagagaaagttgattctatagcaacttctgagcacggacttggctgcaatatgtttcccctttacacagtcatattttccaggatttaatgcgatgtctcttgggaggcaagaaagagaatatgccagtgtggaaaaccttaactcctgcacgttgaaaatttcaagttctgctcttttggatatttaaataaggacctgggtggtgatttgctcacccagagattttctctgtcaatctctgtctctctctctcaacttcaaataataaaaaacgcataaattaaaaagtgaaaaataaaaaaaaaaaaaaa

SEQ ID NO: 3014 - DNA, 237 bp, Homo sapiens
accccctctaatcagagatacaccagacagcttccaactcaaggacattctacaaaatacctgactggcacttcttataactgtcagggtcttcaaagacaaggaaagactaagaagctgccacagccaagaggagcctcacaagacgcgatgacaaagcccactgagggactgcgggacacactacggacggcccataaaccgctggaccgacgtattacagttaatcgtaaacga

SEQ ID NO: 3015 - DNA, 210 bp, Homo sapiens
atgctactgacagctgatgttcattttctgggaggccatcatcctggagaaaaagaaataaagagaagagaaaaagaaagaaaatgagataaatgaaaaatgaaggctaaatcttctagtcacaggcagtgatcttagaattcataagatgtcagaaataaaccaaccaatgtctactcattaaacactattgttggaaaaaaaaaaaaa

SEQ ID NO: 3016 - DNA, 931 bp, Homo sapiens
  misc_feature (1)...(931): n = A,T,C or G
cgggcgcgggccggagcgcggcgcgccgattgatgggcactccccaagttgactcattgttttggcatgtcgattgacaacaggacatcagcaagtatggtgcaagcagaggtttgatggagaagcacactgggatgctactttctggacccaaacacaccagtgggaaaagcataagacacactggagataagtacataaaaaagggcacagaaacaaagatacaaacatcaacatagtaaacaacaaaaaagacagaaaaatataatattatataaaaaaaaaaaanccacatcatgcaacctcccgccacaaaccccccacaccggacaacgaccccataaacacacccacaacaacaatacaatacctctcctcccttcacaccccacccccaccttacatactcctcgtcccccttacatcaaccggcccccccctcccaatctccccaccaccaccccccctcccccctcaaaccacccaccaccccaacgcccccccaagcgagccacacagcccacccacaccgccaccaaacaagcagaacccaacaaacactcgacgacccacccccccaccccccacccgcccccctgctcacctcacccccacccacacccccccatctccaccccccattttcgtcacagcaccctcccatcgacccctccatcacataacgccaccctccacactacctagcccgtacgcacataccaacacctcccacacatcaccccctactcaccaccacactctaccgcacctccactccccccccgcagaccctcacacacacacatctcacattcctacacacacccccaccacacctccaccacctccgaccccgaccaatcacacctaccaaaatccttcacactgtacatacccaatcgcccaccctaccacgcacaaccagccgccg

SEQ ID NO: 3017 - DNA, 739 bp, Homo sapiens
tacgcatactcagtgtgcaaattattccaagatcagacaaaggcggcgagtgttgcgacggtttattatgagctatttcatgcagcagaacttaacaatacatgtcatcgatcaccccattactatactccatatgggtgggttttaacttgcgatttatataggtggttgcacagatatttaattccaatatgcctggtgtaggactgttggagtacgcgtgggaattccatcaaaagtagagggggggtgatcggcgcgaggcatgcagttcacgccgagagcataaaaatcagggggcgattattatgtctactataggtcatcacctccgattcagggtagacctcctttcaactctatgtgtctaggagtacattaacagaggaatggatatagagatgtagggtgtacatatgcaacggaattattattcaggcataaataaaaaaggataccgtgccatttgcatcaagatggatgaacctgcaggacattgtgctaagtgaaataagccgaacgctgaagcttctctagattgatgtacatcccactgtgtttccctgacctgactcctcaccttccatcctcagatgaagcaccacttcacataagctttgcctgattgcttgggtgctgcctacaccacatatttccctcaggctttactgatcactacgcacatatgcatttattaagtcacttttaacacttttctcaccaaaaaaaaaaaaaaaaa

SEQ ID NO: 3018 - DNA, 816 bp, Homo sapiens
cagggtttcgttatctattttgggatccccagagattccatatgaatggatgaagttttgctctgtccccaagctggaatgcagtggtgcaatcttggttcactgcaacctctgcctcccaggttcaagcgattctcctgtctcagcctcccaaagtgctgggattacaagcatgagccactgcgcccagacttaatgatcattctttaacagccctttcttgatttgtgtgtttgtatgtgtgtgtgtgtgtgcgtgggtgtgaatgtaatgcatgtagtggaggtgtttcttatatattatttttccttttccttttttcttatgtctattactactccattttataacatttatattctatattagcaaaattgttatctcaaatttaatgtttgtaaggttcttgtcactaaccaatctatctttatagtttctctgtcagcagtttttttttataacagagttatttacttttttattcatgcttcttttcattcatcatcttttggtgtgtttctctctggagtggatatcatgtttgctcatcgtttgaatggcttgtatatataacatttgaaaaaacatgtggaaatttatggctcacatttcaagctgcatttcaagctttttctcttgggcggaataatacaattataagggtatttcattaccaacttaacttaaaaaattcctatatggcatggcttggtcatttggatggctggattcgggacatacttactcttaattttaattggacccacaaattatacttcatgacatataatttcattattaaaaataaataaacct

SEQ ID NO: 3019 - DNA, 764 bp, Homo sapiens
caggattttgttatctatttgggatccccagagattccatatgaatggatgaagttttgctctgtccccaagctggaatgcagtggtgcaatcttggttcactgcaacctctgcctcccaggttcaagcgattctcctgtctcagcctcctgagtagctgggattacaggtgcatgccaccatgcccagctaatttttatatttttagtagagactgggtttcaccatgttggccaggctggtctcgaactcccgacctcaggtgatccgactgcctcagcctcccaaagtgctgggattacaagcatgagccactgcgcccagacttaatgatcattctttaacagccctttcttgatttgtgtgtttgtatgtgtgtgtgtgtgtgcgtgggtgtgaatgtaatgcatgtagtggaggtgcttcttatatattggttttccttttccttttttcttatgtctattactactccattttataacatttatattctatattagcaaaattgttatctcaaatttaatgtttgtaaggttcttgtcactaaccaatctatctttatagtttctctgtcagcagttttttttataacagagttatttacttttttattcatgcttcttttcattcatcatcttttggtgtgtttctctctgtagcggatatcatgtttgcttattgtttgaaatgcctgctatatatacatttgtacgaacatgttgaatttatgctcaattttaagctgatttaagcttttttct

SEQ ID NO: 3020 - DNA, 1067 bp, Homo sapiens
caggtggagtctcgctctgtcgcccaggctggagtgcagtggcatgaacttggctcactgcaacctccgcctcctgggttcaactgattcttctgcctcagcctccccagtagctgggactacaagtgcacaccaccatgcccagctaattattgtatttttagtagacacagggtttcactgtgttgaccaggctggtctcgaactcctgacctcgtgatccacccgcctcggcatcccaaagtgctgggattacaggcgtgagccaccgcgcccggcttctgttttatgtaatgatttcctattgatgtttagattgtcagcttttttgttattgttgctcttactgctgcaataagcctcctccatcctcatataaggatctccgtgcacacatacagacgcctggaactgtaattgtcgaatgaggagacatgcacctgaaaaactgtgactgataagtgccaaattgtcctccaattttcactctcaccagctgtgtatgaaagtgtccatctcccccagaaataactctggatatgaaaaagtgtacaattgttggtgagcagagcgagtttaagtgatcagcaggcgtttcctgcttcccactgggaaggagtagaggaggtggttgtgaggagttaccaacgttacaaaagaccctgcgcttcaacttgtagatacacaccctccaccccttgcttctgcaccttgtgtcacccgactgcacgccacttgcacggagaatgatttggtggaacattttttttacccctatgaatttgcttaatggatcgattctttaaaatgaggtgctacatactcacagtaaagtacataaagtgccctctgcttaagcgtacagcttgatgggttttgctacgtccatgctccataaccaccacatctccacacgggacattcccagcatcttagaagccctccacactcaccactgcctctccaaatgtgaccaccacctaaacttctattgttatagattcaccttgcttgtttttgaactttatataaatggaatagtaaaattgtcaaaaaaaaaaaaaaaa

SEQ ID NO: 3021 - DNA, 888 bp, Homo sapiens
  misc_feature (1)...(888): n = A,T,C or G
gtagagacatctatcaaggtaccttgctgcaaatgccaaacacttggatgaaagcctggatgaagtctcctccagctaccctgggaagtgctctctggcctatggtaacctacaggtggaacttgaggtgtgatgtgccacctgggcttggtaaacagcccctccttatgtgtatataccacattttctatatccacacatgcaggtggacatttagactgcttcctcatcttggctattgtgaataacattgcagtggaatattactcagccacaaaaaagaaggcaatcttttcacattcaacaaaataaatgaaccttgagatcattatgctgagtgagacaaaccaataacagaaagacaaatacttcatgatctcacttatatgaggcatctaaagcagttaaacccacagaagcagaatgtggagcgggggttaccaggacctgggaggagggggaaatggagagttactattcaaggaggaattgatgttcatagagccagtcatggcaagatgagagagttccagagacctagatcattgggcctaggggaaatgataatggatcngacacaataaattgtggtgaaaaggcagaattcatggtatgggtggtttaataaaaaaaagcgtctaagggaataaaactatccccccttcgaagaagacgggggggagaagggggggaccgggacgaaggctggccgttgggctggaagagaagatattgagcggtaccgttaatgaggggtaattaagagcgcatctactgatctgtgagaccgggcgtgggcggaggagcgggtcaccccctaaagggtgatgatgttaccaaaatcagtgtcgcgcgtacaaactggcggtagagggcggaaagggtgcc

SEQ ID NO: 3022 - DNA, 412 bp, Homo sapiens
tagtggtgacttttactgggaatggcattgagtgtccaggtttggataacagaggcgactcttttggaacagggaaagctgtggtgaagaaggcaagtcatatccatgttgtgtcctggccagataggaggttatcagcaagaaagggagaagtgtgtatttcctcgttcacttacacgttctcaatgtctatctattaataccctcaagccagtgactttcattcatgtttataaataaaattatatatatatgaataccctatcaaattaataatgattatttctgtttactggaattatggaatatttttccttcattttgctgatctaaatgttcattgataattgagataacatgtttttcagaagagaaatattaaaagcacaatttttcttgaaaaaaaaaaaaa

SEQ ID NO: 3023 - DNA, 409 bp, Homo sapiens
aggtggtgacttttactgggaaaggcattgagtgtccaggtttggataacagaggcgactcttttggaacagggaaagctgtggtgaagaaggcaagtcatgtccatgttgtgtcctggcctgataggaggttatcagcaagaaagggagaagtgtgtatttcctcgttcacttacgcgttctcaatgtctatctattaataccctcaaaccagtgactttcattcacgtttataaataaaattatatatatgaataccctatcaaattaatatgattatttctgtttactggaattatggaatatttttccttcattttgctgatctaaatgttcattgatgatagagataacatgtttttcagaagagaaatattaaaagcacaatttttcttgaaaaaaaaaaaaa

SEQ ID NO: 3024 - DNA, 468 bp, Homo sapiens
tttaaggatcaccctggctcaagtcctttataacagaagtgaaaaactgttaagtggtgacttttactgggaaaggcattgagtgtccaggtttggataacagaggcgactcttttggaacagggaaagctgtggtgaagaaggcaagtcatatccatgttgtgtcctggcctgataggaggttatcagcaagaaagggagaagtgtgtatttcctcgttcacttacacgttctcaatgtctatctattaataccctcaaaccagtgactttcattcatgtttataaataaaattatatatatgaataccctatcaaattaataatgattatttctgtttactggaattatggaatatttttccttcattttgctgatctaaatgttcattgatgattgagataacatgtttttcagaagagaaatattaaaagcacaatttttcttgaaatgaatgtcttcacaaaa

SEQ ID NO: 3025 - DNA, 209 bp, Homo sapiens
cagggggactgtctcctcctgaaatctctgctggcagctccacagttggaaacagttacaagccagagaactacaatacggttatctccttgctctaatggttctttccagaaagaggtaaccctacgtgcctaacttaggctaaaaagaatgagaaagtctattagagaaatacaagccaactaaataaaaggcctttctctttaaaa

SEQ ID NO: 3026 - DNA, 455 bp, Homo sapiens
cagtccttgtacatcagtgtctccaaccggttacacaaccaactgggaaaccaccattctactctctgcttttatgagtctattaacagatgaatggatatagaaaatacggggtgcatatgcaatggaatattattcaggcataaaaaaagaaggaaaccctgccatttgcagcaagatggatgaacctgcaggacattgtgctaagtgaaataagccaaacactgaagcttctctagattgatgatcatcccactgtgtttccctgacctgactcctcaccttccatcctcagatgaagcaccacttcacataagctttgcctgattcgtcgtttctgcctacaccacatatttccctcaggctttactgaacactacgcacatatgcatttattaaatcacttttaacacttttctcacaaaaaaaaaaagaaaaatgctttcgcggccacg

SEQ ID NO: 3027 - DNA, 997 bp, Homo sapiens
atagtattaccaaaaacaactacctactttagagttttcaggcacaagatgttcagctcatcgcagggctgctctctgctgccctctgctggatgggaccctccacagaggcccacttgatcaaccccttaagctccaatgggttgccaagcttgtcatcacacatcacctattttgtttttctcctaagaggtctatgttttgaaatatagcggattctaaacaaggctcgaacaataaagaacatccccccaccctagaacaacagaaggggggctaatacgaacataacattcgaaacttcgggccgcttccctttatgtgaaggataattactaaatcttcactcacttactacgatgagacacaacctaaagattcctaccaaccattatctgtgaatctcagaggccgacatcccgctatcccccaaacgtacggcaatgaacggcgtatcccatcttgccgcactaacagaaatacatatacgcacagacaccacccccaccgctccccattctcgcagtctattccatgccgttcaatacctctttatatcccccacaatatcataacaaatctacaccacgaggcagccacacccgcgcgtttccatcattgcctcctaacggtaccacggtaaatatgtacaatatcgcaccagatcagtaacacataccattcatcatccagtaccctcacctattgacaatcctagaatgaaccagagactcatctcactaacataacatcaacgtacatacatctctcatatcgctatcccctctcgtactcggacatacgtgttacccgttgatatagaatcattaatatatacccatctcaaaccccgtacgtcacaaccaccatcactaactgtatatatgacgtatcagtcgtaaatcgctcaatgataccccgtcctcctaagagcacagatctcatcttatgtctcctcccactcgtgaatccacaccgtgagtcgctgggtcgggcg

SEQ ID NO: 3028 - DNA, 714 bp, Homo sapiens
attctccttctccccacccacaccaaaatctccggggaccttgctcttggttgttggccaccatgctgtaaggaagtccaggccacatggagaagccatgtatagatgttcgagccaacaatcccagctgaggtcctaaccaaaagccgtcatcaaccaccagatacataagtgagaccttgagatgactctagcctaagcagtatcagactgaaactacaagagagatttgagcaagaagcaccaagttgagcccagtccacctccagaaccttaacagataataatatattgttattttacatcactaagtttagagtgttttgttacactgaaatagataactgatacatagttggatagtacattgtaatttataaagcacttttactttcattctcataactctcacaatcttgtggatgtagataagaaaattctttatgcagaggaaaaagctggagctctgagagttaggaatctgggattataaatatgagagaactggcctatatcctatttcaggtactattaatagctacctgctcttagacagtttacttaaattcttgaaagattgatcttttatctgcaactgggctataatgttaccaaccttacaggcctgcgcaatggggttgtctaatggatgtgaagccataagccccactcatctcaataacggtttctggttgggggccaaaaaaaaaaaaa

SEQ ID NO: 3029 - DNA, 252 bp, Homo sapiens
ctagtttgtgaagtttctactgacatgtcttcaagatcactgattcttatctcagctgtgtccagcctactgatgaacccaccaaggaatcttcgtttctgtcagttttcttttttctagtgcttgactctttcctagagtttccatttatctacttgcattacccggatattcttgtatgtactgcactttttccattacagacattataatactaataatatttattttaaattatcaaaaaaaaaaaaa

SEQ ID NO: 3030 - DNA, 616 bp, Homo sapiens
ttaggtccctgcgatttgaaaaatgcttcgttctgtattcaagaaccatgatgactattgtgtttgttctacctttttttttaaatttgctgacaaagtgaaatatggaatactgtattcacttatttcatgtttggctcacaatggattgagttatataaagtaggacatggacaaattacaaaaaccagaacaagcagggtccctaatagtcttatataactgcaaacactctacatctgctttaatccatcatcgtctttgcttttcaaataaaatagtgtgtgtttttctctctctgatttttaagtacaaagagaaagttttccatcctgtaaaactgaaaaacttatgatgagaaagtacctcaaaaagtgcaaaggaggaaatctctttggttatttcatttgtgtgattctattaactccaagagtacattgcaagctgtgataaagcaaagctattctaaatcttcttttgcttgaacaaggtgtttgtgacaatatttcattggcatggaaataaagaattcgtcccaatgccatgcaatgtgctagagttctcttccaagttggtaatagaatgactaatggcaatgttagtaaaaaaaaaaaaa

SEQ ID NO: 3031 - DNA, 455 bp, Homo sapiens
taaattaacttcatctacgcaagtgagtcacttcaacctaacaagcttccacaagttactcagctaaattgtactatttactgtgaaggcatacccaaacaaatttcccagcctccctgcagtgaggtggagccaaatgactaaattctgtgtgttggagagataaatgccacttctgggcctgacccctatggcccctgccatgctggcctgaagaagagggtgcagtggaggatgctgaggccatagggaatggtggagccattagacagagaagctggtcccagaacttctgcaagaagcagagtcctcctttcatccataatgaccaccactgaattgacagcacaggaaatataacgttactgtgttagccacagagactgggggttgcttgttataggcgttagactttcctgataaaaccaccatttcaaaatacaaaaaaaaaaaaa

SEQ ID NO: 3032 - DNA, 344 bp, Homo sapiens
gctcagctggccatataaaatgtgcctttcgccttctgccatgattgtgaggcatccccagccacatggaactgtgagtccatcaaatctcttttcctttataaattacctagtcttgggtacatctttatcagcagtgtgaaaacagactaatacagctggtatgacaaactccacaagcatctgtgtaaacaatcttacctttttaagaggaatatcagcccctaaaaaattgattttaaatctcctgaacataaatactcttatttatgagaatgaaattatacccaaatgccatatcccaacttaataaaatctcctttttgaggagaaaaaaaaaaaaa

SEQ ID NO: 3033 - DNA, 524 bp, Homo sapiens
cctaggaaagatgatgaaagaagggctagcctgaaagaacttctgccttctttggaaatgagatgcaaaaagtatggctccctgctacaacaaaaatggatcccccaaagaggacataactggaattgctgtcattgttacccctttgaaaatctcagccagctagaggaccagagacattctcatcaagattaaagccagagcaaccaccaccaacaaatgatgacaaatccctgccaggattggagtgggtttgaatggcatagctggcccctggtactcctgagtggttagatcgtcagtcttacctgttcattttgttaacctcatagtagtacagcaacatattttacttgtttgaattgtttgtgttagaatcaggtattaaccttgtaggcaacatggataatatatttctgtagttcaacataatttccattttaaattcacaatttattagagcagcagaaaataatgtcaataaaattgaagcctctttttcttaaggaaaaaaaaaaaaaaaa

SEQ ID NO: 3034 - DNA, 205 bp, Homo sapiens
gttggcgagatgacactgtgaagacatagacagagattggagttatgctgccaaggaatatctggagccatcagaagctggaagaggcaaggaaagattctccactggagtcttctgagggatgccaacaggttgtttgacttctcaccttcagaactatgagagaataaatgtatattgtattaagccaccaaaaaaaaaaaaa

SEQ ID NO: 3035 - DNA, 290 bp, Homo sapiens
ctgaaacatacaatggccctagacgtgaactgtggaagacgctgaataaggaccaacatgtctacagtccagcctagaaaacaggatgcctgtaatcattattcagtgagcagcaacctgcagcagctcctcctgactggcagatgggcctggcggccacccagaggctggggacacagcaagaatccagcacagcaccgatcccgattccctcctccccaaactacctgagccatggacctcattttgtggacaaaattaaacttgccactttcacaaaaaaaaaaaaa

SEQ ID NO: 3036 - DNA, 344 bp, Homo sapiens
tttcagggtcctccttctataccatgtgacagagagccccatggcaggtgcacactgggactgagaaagctacagcctgcaaagttgttctgtgaaccacctgtacaacttaccccaggtatcaaaccttggaccaagaagaacaaagatcatatccccaggaagacaaaagaataaagcatgtgaataatttttaataagtaaatcctttattccaagcaaacctttcattggattacattgaggtttgaataagaaattgtatgaaaatggcttagaaaaatacctcatcaataagtaggcaataaaatgtaactattaatcattaaaaaaaaaaaaaaaaa

SEQ ID NO: 3037 - DNA, 638 bp, Homo sapiens
aggctcgagtaagcggacttcatataggctgccatggaaggctttttcctttgctgaagttcagccccaagtttggctaaaaaagcatgaaaactataggccagaagaggaagccgattaaatccaggaatgaaaatgcaggaggggaagttgctgtgtgatcttgaacaagttattgaaccttgctgtgtttcttcatcaatgaagtggaatcatcatggactccatctcatcagattgttttgaagagtaagtgagataatggacacacagtgcccagcacagagcctgacctagagtatgcccttgcatgagtcaaggtaggctagttgtgtcgttatgacaatcaatgcagggtttaagtatctttaaaacataaacatttatttatttatttttacctaatgttggccgtcagtctgggagattcctccaaggagtggctcaatgataaaggctgcttcgacctcatggcaccccgtctcaatacatacatctgtggttgtgatgtaggtgggacagatggagggtctcactgatagtgagtgctttggcctggaaacgactcacatcactgccactcacagccaattggccagaaatagtcatatgatcccaaagcaaaaaaaaaaaaaaaa

SEQ ID NO: 3038 - DNA, 275 bp, Homo sapiens
gaggaaagagcccctgcctggaacctgatggtcctgtgacagagagaaaaaattgatggcaaaactatacaatgcgctctgtgagcttctacatacatttcattgtaaacaaaacaaatggccaagcaaaacaaatggccaagcctggcgttaatggagtaggaggtctaattcctagatctccaaaacatatcagcaagtattttgaacaaagaatacaatcccccgccccatcattaaaggtacaccaaaaatcccaaaaaaaaaaaaaaaaa

SEQ ID NO: 3039 - DNA, 411 bp, Homo sapiens
tgaactcaaatctggactgaggacatgaccagtaagaaaaggaagtagtccctactacattcgaatggcctggaagctcctgggaattggaagacatagcagtcttcatcgctgcctcttgctcactatctgatcttgggtgagatagacccatcctctttgctgggcctcaatattttccagactttaccctatccatgtagcccctgtactattagtttttttctcagtttcaaataaatcaatttattttacttaccctgtcctacataataatacctttaatattattgttatactaattatattttttcctatcacacatgataataaatgcccacatacctatcgaaacataaattgtaactattataataaaaatgtttctttgtgtaaaaaaaaaaaaaaaaa

SEQ ID NO: 3040 - DNA, 441 bp, Homo sapiens
ctcaggacctccagtacaatttttatggagaagtggcacgaatggacatccacctcccaccatgtgatgacatgggaatgttctggctgtcaataccactgtgtgttacctcttcactgggaaggagtccatatgtctcagatttgcccttgaccacagacatttgccaagaagagacaagaaatgtgtcctcatttgtacagatgtacggagaagaaagctcatcattttcaaaaaacaactaggggggccttctctgtactgaacattatgtggtgtggattacagagtgggataagagggatgcaccctggccttaataagggaaaggtgttcatggcacacgtatacctttgtaacaaacctgcacattctgcacatgcatctcagaacttaaagtaaaataaaaaataaaaataaagaaaaaaaaaaaaaaaaaaa

SEQ ID NO: 3041 - DNA, 274 bp, Homo sapiens
cttcagttcctgctattgtccatcctctgttcctttcaggagctgtgatcacaaaatgtcagtcttctattgtgagagatggttctgcctggtggctctttggtcctctgttccctgagcactgttgggtgccccagctcctcccaccctctctgcttcaatcaagacacttacgttgtagaaagcatagctgactgcaacagctgcaatttttatcatctccctgcaagccaaatattaaagtatcttagtggaactttgaaaaaaaaaaaaa

SEQ ID NO: 3042 - DNA, 976 bp, Homo sapiens
acaaaacgcaaaaacaacacacaaagaaaaagccttaaggtacacaggctactggatgtcttatacaagaacttcttcttacatcactcccacggagacaccatgactgacatggatccaaagcagatgaatcgctgccgctgctgttcggaccgacgcagtataagccagcggcaaaattcaaatatatgatgcctacgccctgcgcacggttgagaccgccactgtagccgagttgatagagtcaagaagcatagggcaaccaccacggtttattgcgagcgaataatgaaatagaggatagaaccatacggataatcccgcacacacctagcctactgtatacatctcatagtcccatcatagagaatatatcataccaaccccccacccttttaggatgtgccatagccggacacgcgctcgcggcaataaacacagtacatcccgatgagcggaatgatgaaatgaattaccgagaagcacgtgctgaaagaatttattatgaccttacgtcccctggcagggctcgcggaccaacagataagcaatcctgcccccggcacaacgaccgcggccgatgagagcgttgcctatgagcggatgcgtatcgtgccactctggagtagacccgacagtagcagtgctacgaccggccgctctcacttcgagttgagtcaaaccatctaccctacagctcgacagaacaaccggcacccggtcataaccatcaataccgacatcagccgtgatattatgctcacacactacccgacctaaaacacatgagcaacccgttccccctacataacgcacaatcacccatcgaatatgcccactgacgacgcgcagccaggaagtgcgtgaatcaagtgaagcacgatgaggagcaaacgcgtcgataaaatttatgataatgacagtctctacgaacgcatatacacaatcggaggatctactacccgcattccatgat

SEQ ID NO: 3043 - DNA, 495 bp, Homo sapiens
ttctgggcactcacaggactggctgcaggcgctacaaatggccatcttaactgacaccgtcttgcagtcatcttgtgataaaaacttggcatctgccactgaggacccggcctcctcagagacttccttggaggaccaaaggaccacctggccagaccaggacaccttttgtcttcttcacttcccctggactgattggttaacccattctcctatctcttcttccgtttgatgttaaacatgactttatttgttgtgaaatgtttaacctacaccattgatatactgattaagtatactattaagcttggtttgcgtattgactggcctgtggaatggcttgagcctgtgtgttcctggctctgcctagcgagtgactgggaaataggaaggagaattccttccttgggaactccatggggtgcatggcttctgtgactgaaatggcatcaataaaagcctgacatggtggaaagagaaaaaaaaaaaaaaaaa

SEQ ID NO: 3044 - DNA, 655 bp, Homo sapiens
tgcctccctcaaactggatatatttccattcattactgctctcggcttaccatgatccaggcaggcaatgaaaggagcagtttgcctctctctgtgattaccaaaccagagtgaaagccttcaactacggaccactgcaatttccaccataacaggcaacccagcaattagaactgtttgttacagtgacagcagagagaaccattttcaagcaacaaggcacaggagcaggagctggaggaagagagagcctgttcatttgaaggggactaacgccacacagcagctaatcctggaatggcaggcagttttgggaactgcctatcctgcaaaggctgagatattcacagacattcttgaacttttggaaatggtctaattctgcttttttctgaccaggaatacaattgggtcataaaatttggcgtttgggaagagacaaaggtttatctttagtccagtgcataatttaatttcttacttcaatattaaaaatgaaaacataaaggtaggcactttcttttcaaattctggattttagtgagtatttcggtgctcagaaaacatctcacaattgaaactttgcaaacagagtcatatttgtttacaacaaaagtacttgaaataaaactacagcatgttaaaaaaaaaaaaa

SEQ ID NO: 3045 - DNA, 485 bp, Homo sapiens
cctagaattgcaaactgatatttcacatagaagttatttgacgaaaacggtgcattcacacttcaagaatatgcctaaggacatcacctggacaaatcccagtgattttttacagttcagccctgaagcctcaaatcccaagtcagtatcatctttcgcaggactgctgacatctctgcaatctggagcttataaagacactggggtgaccgaggaatagctgtatatcatccccagggttttcacatcaaaggacccagtggaggcctcatcctgttcaaaatgacaaattaaaatgaatcccagagctttattctctaagaacataagacatgttttctttttgaacatttcattgcactgtcttcagaatcaagctctctaaaggatgttattataccttgagcttcttgacacatttcctaataatttgaagcttctgacatttatacaataaaagattgcgctctgcaaaaaaaaaaaaa

SEQ ID NO: 3046 - DNA, 867 bp, Homo sapiens
caccaggtgcagaacaatcgggcggcgcacgtgccgcgcacgactacttggagatttatacaagtatttcttcttccatcactcccacagagacaccatgactgtcataggtcgaaagggggggaatgttcctgctgctgtttgggctgctgtttcttatgttgttgcagacatggaagaaatgctgcctaggtcctacaaacagtaagaaagaaaccgtggtcatgccttgtggccaggaatccctgcggctggaactttgggaaaactcctctgggggtagcactttcatccaatgcatcttcaaaagaaaactctatttcatggttcctgatagcatctttcttgaggctttccagactcgttgattgtagaaaagggaatcatttcgcccttcactcccaccacatgcagtgaacaatgggggcggatacccggtgggggctggcatttatatgccccctcaaaagaatgcgtacactttcagaggaacattcacgtgcgttcggggagggccgagtgagcaccggtgggcctccgtgtcctcccccccgggggcttcggggcttccccctttcgcgagggataatccctgaagtccgcgggctgacctcgcggaccgcggcggtcgcgtgcgaggacgcccgtcttcctcattaggggcggtatgtccggggtgcgctaatgccggggttgcgtcgcgaggtaggtgctgactaaagccggtaaaggtgggaagccgctaaggcaggggcgggggggttccctgaccccgcccctgcacgcgttcacgctgcggtcgtacgccgcgcggatgtcccccgcgtcgtgcaggcccgggttcccggtcgggccagtcgggtacgt

SEQ ID NO: 3047 - DNA, 442 bp, Homo sapiens
gtttcgagttcagctcgtttttgctttgagactgttgacttagtgtccatggttctcaccctccagcactctccactggcatcttgtccatgcctggtcttgactccatccaccataatcatgggaaagaaccctgcctagctcctcctctgaaagatccaccggcaagtccaggcgtctgcggagctagtgcccctcaggtgtctgtgtcttcaacacacttggctctagggcccttgcaaacaacatgactcagccctgaataaagaagctgcagagaaagaagccctctcagacatagcagtcatcccagcctcaagtggacctaaatttggaatgcctgaaattgaaagctccgataatggatttgctcaaatcaaggagaataaagtccttcctcctggcacgaataaaaatggtcgcaactttaaaaaaaaaaaaa

SEQ ID NO: 3048 - DNA, 837 bp, Homo sapiens
ccaaacactctaactactctacacaccaacctaaccccaccacgctacttgatgacttatacaagtatttcttcttccatcactcccacggagacaccatgactgtcatggatccaaagcagatgaatgttgctgctgctgaatgggctgactgccccctatgctaatagtaacaccgaaaaaaaacgtctaatacactcttcctctgtatttattaaatttttagaattttatgattggatactaatattcatatctattcaaattttttcttttaactcgcctaatacacctccaaccaccctccaccaaaaccactccactccacaatgcaatcaatcatcacccatatcacctacccatcgccgacccgacacacccccacccctcacctacgaaccgccccccaacacttctcccccccaaacccctacacaactcctccccccaattccacccccctcaccccccacccacaccaaacaccctttccctacccactccaacgtccacgccatcagcatcacgtccactcttccctaacccgctcccccccccccccccctctccccctctcccccttcctcctatacccaccccacaccttccaccgcccccccttagacctaccccacccccccctccccatcccccccccaccctcctcccaccaactctcaacacaaaccacaatattcaaccccccatcattccccccccactcttcccaccactcaaaatcaaataccaccccacacactacctacacacactcccatacagtcatcaaccccatcatatcatactccgcttcaaacaccccaccacgccacccct

SEQ ID NO: 3049 - DNA, 552 bp, Homo sapiens
ttcagaattgcaaactgatattttacatagaagttatttgacgaaaacggtgcattcacacttcaagaatatgcctaaggttttctgtgccagagacatagagctgactgaatcaagaaaaagtctcatcaagcagaagaaatagcaactaatgtgttatttatgtgatacagtgttttttgcattttgtgttttttatttttcatttttatgaaaaaacagttggaatgccaaagatggagagtctcaacacatgctccatttaatctctgattgttaaaagtcagactgttaaaaaaaaaaagtgctgtttttagtaggaaaatccagagcttctacacacattagctgaaatagtattcagtctctacaaataccttgtaatggatccaagaaggagaaaaaatttctttttatctgtcattttcactaatgcattgaacctagaatatatgagttacatgtgctcctttatcttattctgtccttcacttttcttgtttccttgtttataaatacaagtttctacactgtaaaaaaaaaaaaaaaaaa

SEQ ID NO: 3050 - DNA, 767 bp, Homo sapiens
agtttccccgcttttatacccgctgtaaatggccaagccacaggcatactctctggtctctgccaagtacatggtaacaatatatgggccccttaaagggttaagacatataatttttttattcatacctggcccccccacctaggagtttctatagcccaagggcagtccaactgttgtgtttccctgccagttcgggattttcaagaaggtaaatgaccaacggccatgggatagattttaataccgggttaccaataagtcctaaggaatctaagaaaaaagagcatggcgctggccccctgaaagttggttcgcttcagggataaatagaactttatggaggttcatgaataactggacagccagtgttccatgcccacataaggcatgggtaatgcaaatggcccaaggatgaaagtcaggacagccgattcctgatttgctctgccctcattcactgtgtgacctaaggtggagccagtcacatctatgcggcctttatttctcagatgagcaacagggacaacagtgaatgctccaccctccccatggaagatcagccagtccagcagagaacatgtagacagacttgctgtaaggcacaaggtcctagacaagtgacatcattaggatttttttagtatacttgtgtttctcttttcagcatgtttataataaaaaaaagaaagagcaaccctgaattcccaatgctatataatagttaaataaattataataatttacataaaaaaaaaaaaaaaaaa

SEQ ID NO: 3051 - DNA, 376 bp, Homo sapiens
atagatggagtcttgccctgttgcccaggctggagtgcagtggcacaatcttggctcactgcaagctccgcctcccaggttcatgtcattctcctgcttcagcctcccaagtagcggggactacaagcacccgccaccacgcccggctaatttttatacttttagtagggacagggtttcactgcgttaaccagatggtcttgatctcctgaacttgtgattcgcccacctcagcctcccaaagtgctgggattacaggcgtgagccactgcatccggcccagtaatcttttaaaccacactcattgtctaattttgctagcaattcaatataaactttatgcttgaaaattaaattgattccattttgaagaaaa

SEQ ID NO: 3052 - DNA, 753 bp, Homo sapiens
agtaatgtctgggagctactgtattcgatgaaaacagaactccacgtctccaaggctacaggcctcctgaaatggagaagagaccccaagcaaagtggtctttccaggagacatcaagtgcggtcatcacagtgactctcctctcatctcctcctcacagcattggacttgcctttaagatctccagtttagaacagcttcagctgggggatggcaatggggaatgggatggaagccagaatttgctctcctaaatctggcccgagcgatagaaggcatctttggcctgaagaagtgtaatacaaagaaaatcctaattgttacagctaagtaattagaagatccaacctataaatcatagtgtggccacccctttaattatgtgcacagttcggtcggtgactaatgcatcttctttcctagatgagcgaatttaatatcctgtgatggcaacaagtttcaagctgacttatcgttattttgtttggtcagatgatttttctgcattttaatgtgttttgtggttacatatttgctatgaacaaacaatgcttttcccaggtagtacgctctaaaatgctggctgcacgatttgtttactattcttttaggcctctgagaaatcaaacaacattatgtacttatttttgagtagctgcactaaaatcttaaacagtctccttagagcccttctttctctggcagtatgtacacacgcattaaaatatttgaaaattatcaaaaaaaaaaaaa

SEQ ID NO: 3053 - DNA, 172 bp, Homo sapiens
ttagggtgatcttctaaaagaagttagctgtggaattacaccaactggaatttgaatcccaggaacccactcactcaccagtatgtggccttgggaaaattacctaaactcttatagactctgttatgaagagttattaaaatgacccgtgtaaaagtgaaaaaaaaaaaaa

SEQ ID NO: 3054 - DNA, 563 bp, Homo sapiens
ctcagggacacgatctcgccatgtggcccaggctagctctcgaactcctggcctcaagcaatctcccaacttggcctctcaaagtgcacggattacaggcatgagccacagcgcctggcccatatctctttttttagttatgaactcaaattgtttcatggtcaattcaagttcctctttattcttcgataaggaagctaagaagacacagacgggttaagtaaccaagtttggacaagcaggaagtggagaactaagaattcacaatcaggcaatctggttcaagagtccacactcttaaatactacataataatgcatgatttatattttattatttttccatcctattaggcttttaggcatattttgggttttttcctaatttattgagatgaacccactacctttcaatctgtcctattttctaacaaattcattaagagctataaatttccttttgaatcataccctacaagtttgtttatatagggcattcattttcattgtgtggtatttagtaattctcattataatttctactttaactcaaaaaaaaaaaaa

SEQ ID NO: 3055 - DNA, 486 bp, Homo sapiens
  misc_feature (1)...(486): n = A,T,C or G
cctggaaaggggctgaagatacaaaacatctcccaccacncccttctaattttatatttttaataaagatagaatttctccatgttaaccacgtttatctcaaactccccacctcagataatccaacctccttgcactcccaaattcctactattacacacgtgagggcactntccctnccaaaccttatattaaaaaaaatacaataattatctctaaattaacccatccccactataaaaacccttaattatttctttaatacttaattaactaaatcccgattacaaaaaaaccaaaatcttcaccacataaattactacaaattattaaattccctgttattttctaataaattctatcttccaaaaattcccttcccttaacaataaaaaaaaaaacccccctttctaccctaaccttcaaattttaaaaaaaacaacaacctaacatttctttctctaaaaacctccaaaaaaaaaaaaa

SEQ ID NO: 3056 - DNA, 732 bp, Homo sapiens
ctggagtgcaatggcgcgatcttggctcctgcaacctccgcctccgggattcaagcgattctcctgcctcagccttcggagtagctgggattacaggcatgtgccaccacgccctgctaattttgtatttttagtagagatgggatttctccatgttggccacgtttgtctcgaactcccgacctcagatgatccagcctccttggcctcccaaagtgctgggattacaggcgtgagccactgtgcctggcgaaacttatatttttagcgctacactccttgtgtctagattagcacatgccaatataaaagtcttcattatttgttgatagttgttaagtgaattggggttagtaataaaggaaatgttagttacataaattactatgactgattaagtcactgcttatattttataaaatttattttccagaagttacattttcttaagaataaaaaaagaaacaaaaaatgtaatgtaatcttcacattttataaataaaaataatctaagaattttgtattgtgaaaagttcactccattgttttctgtcttccaataaccctggcttaaatagataatttttaaaatatgaaggtttgcttaaatccacagtaggatccgcgaaccataaatgacaatattaaacttgcataaaatatttgtgagtatattataaagaataatttaactgagaataaacaataatattataatgaaaaaaaaaaaaa

SEQ ID NO: 3057 - DNA, 625 bp, Homo sapiens
ttaggtcaccccccaccttgctggtggcagctacttttctgtaagctgcatactgaacatgccaaatctggcacattgtggcctggctgaagaacatgcctccaagggacagcagcactggccagaccacatctgaagcccctgctgattcagctcagcagaaccctagtgattcccaggtgagcactaggagcttgctttttgacatggcaaggcaccgattggcattttctcttgagcatataaacactggctaataagcactacagaaacagagaaaaacattttatctgtttaggtgaagcccttgtcccctcctaaggagcctttggtcaaccagattttcattcccgaatgctgttaaatttagcaactgcctctgcgttatttggttcaggaaggggagcagagatggaaggcaaagcagttctgcctcaagcagccatccaggaaggctcggcagtggacaaggccatttccacaccaagggagctacagttaggaacaagtcctggagtcctagttatttatggcttgcttcagacatttcagttgtatatatcttcaggaccaaaaaactttgggtcaaataaatctggctttaaataaaaaaaaaaaaaaaaaa

SEQ ID NO: 3058 - DNA, 182 bp, Homo sapiens
tctctatctcacaacccaaaaaggttcactaaccccattccctgttcaccaccggctcatgaccttgctgcatatcagagagaaaacgaggcttctcggagaagatgtgcctgcctttcctccaccaaacccaagcccgtcttgctgtacaatatatgtaatttcaaccaaaaaaaaaaaaa

SEQ ID NO: 3059 - DNA, 693 bp, Homo sapiens
ctgaattccttactttctggcactataagatgcttcaggttcatcttgcagattttttgatctccctctccagccttagaatcagtatttcttcaaggagacttggctccatgtaatagcatcaaacatcaaagtctgagtgatagatgcactcattgctactggggtctcatttattttagacctctcatctgtcagagcaaagaaatatatgtgtgaatactaaccatttgtatacacattttaataaatatttatctacacaaccaacttgatttatattgttacataagagtttttaatattgtcaaaagctgtaattcattacagtattgatcaattaaatttctcttcttgcttatctgtagatccccacttcaacagtgagaagcctggtttccatcaattgtcatgtatttacttaatttttcaattcctgtttctgtgtacactgttatcagaattcttaatcctttccctagtggtaaagaatgttaccaactagagtacagaaatacgtgtagttattttgcttttagtcttttaaaataaatttaatttttaatttttatgggtacataataattgtatttatttatggggtaaatgtgatgttttgatacaggcatacgatgtgtaatgatcaaatcagaataattaaagtatccattacctcaaaaaaaaaaaaaaaaa

SEQ ID NO: 3060 - DNA, 833 bp, Homo sapiens
tttttttttttttttgacaatacaaaattgcttttattatgaatataaatggcatgagatgagcactgtgctgtctgtgtttctttttttattattagagaacaagtggctcggcgggagatacagcttataatacttttgcggtgactcaatcgcccatattgatggatgtagctaacattggggtgtcttactatccctactccacttaacggctatcaacctattccgtgaactctaatatacggcatgcgctggtctagacacagggagtgcgctgctctaatacaggggtggacacgcacagtggcctacgccgtgtatcccaaccttgccgaggccatggaggctggatcatctgatgcctgaactgctaacatacgcggccgacattggaaaagtgccgtctatactaagaatacactatgaccagggtgtgggaggcccatgcctgcaataacagctactgagaaggctcaggcgagatattcccttgactcccggaagcacatgttgcaggagccaagatcgggcccttgcgctccagcctgccgcctatagggaggctgattaccggttccttggactcgtatgcaaaaggacaccatgcttgaaccgcgtcaataacattgtctccgcatgggagggaccttcagtctcctatgcactctaaacgaggctcttggccacagaatagtgatcctcttgcctgtttttccaaggattgtaagacattatatcatgaaatcccccaaatgcccgggcccaccatatttgattacggcgtttaaggcaaacaagatgcccaagggtccgctaatacttccgccccc

SEQ ID NO: 3061 - DNA, 387 bp, Homo sapiens
ccttagaagtgactcacagtttgataccttcatgggacttgaagagcaagaaggagttgacatgttgttgttggctttaaatggaggacaccgatgacgaggaatttgagcagcctccagaagctgagcataacctccagttaaacaggtagcaaggaactggggccttcagtcctacaactgcaaggaactgaatgatctctgaaggggattgtccttaaaagcctctagagaagagttgtgaatggctgacaacttgattttggtcttatgagactctaacttctagaattttaagatattaatatgcattgttttaatctcctaaatttgtgatatgttttgatgcagcaataaaacataattaaatgcttaaaaaaaaaaaaa

SEQ ID NO: 3062 - DNA, 421 bp, Homo sapiens
  misc_feature (1)...(421): n = A,T,C or G
gtaggtgaacaagagctgtgagaagatctgaggccttagggaatgggaaagctaccggtcaaaaggatcctggcccctgaataactgcacagctctttgctggtctgcactgggatgcgatgtaactgataaataaacatttcttatgttaaaccactgagatttaggaattatttgcaatagttgttagcctaccctggtaaattaatacaaaacatagtattcctatgtaaaatgtatgaaaatatgaccttaaaatattcctcctgtttaagacacagaccaaaattgaagatgtaatttncttccttccttatctatgttttataggaatgtattctcagagatctgtagattctatttattagaaattagtgttggtaaaaaataaaactgttgggttgaattaaaaaaaaaaaaa

SEQ ID NO: 3063 - DNA, 377 bp, Homo sapiens
ctagaaggtcagctagttttcatcatttttatgtatgtcattctcaatataacaacagaatctcttatggaaaacaatggagcctagactgggagctgctaatgagcgtgctggagagagtgtccaaaccaatgcaggctggagacaattcacctgtctgctttcagatccagggttgaaaactgcaatttgttataatatgtggaagaaaaacaactgacaaagaccatctctgtcaatcacattgtggaacactatgcttccctcaggatggtctcctgcatatgcagcaaatgaccctcttccacatggacaagttacaatctctattaaataataatttctgtctgtttattaaattaaaatgaatttcaaaa

SEQ ID NO: 3064 - DNA, 203 bp, Homo sapiens
ttttttttttttttaatttttaaatctttttattttgaggtaatgtgagattcatatgcagttttaagaaataagacagatgggccgggcgcagtggctcactcctgtaatcccagcactttgggaggccgaggtgggtggatcacagggtcaggagatcgagaccatcctggccaacacggtgaaaccccgtctctacgtgg

SEQ ID NO: 3065 - DNA, 839 bp, Homo sapiens
  misc_feature (1)...(839): n = A,T,C or G
cgtcccttgctccaccatcacattcttcctacttttcaccctcgcctggaaggcatgttgacgctactttcctcacttctcactgtgccaagcaagcaagaaagtgcccacaggagtgggagggaaaagacacatgggatggcagcaaggtaacctgcctagaggagccagccatcccgtctgtcccctcacttgcttccagagagaacgtctatccttgacagcgcctgcctccttgtcattttcatcccaacactttgcccagccccgggaaatctggattttctttttaaagaaagatgtctagagagaaaatagaaaatgaccagccaatagaaagtgcaacagagcttgttgatttggttctgtcagatgccccaagtgttcgtggtaagctggaaaactctccatccactagaggcagccacagctcgggatgctgataaagttctgacacagggagtgagtgatgagtggtgtgcaacgtgctgaaaacaggaagctctgacaacaatgtgaagaggaaccttctgaacacaaattctatggctccaaataagcaagttaatagtcctgatatcttgacttgatctacagaagaaaccccactcaggataacttttacttttctggtggaagagacaataagaataaagactcaactaaacggtaataaanaccgatgcgagncgntnananagaganganannatnnannanntntnacnatcnnnananaacnnnnanannnnanananannnacnatntaagaagagnnganganannanngtaannnnagaannaananggaannnganncatcgtacgnannnnaaa

SEQ ID NO: 3066 - DNA, 347 bp, Homo sapiens
agaacaaatggctccttctgttaaatcttgcaccagacgtggccttaccagggcccggcaaattacctggctggggagtccctgactgaggactccacgagtgagctggtcgtctctgagatcttcatcagccagacaacctttgtgggcatcatccctcttgccatggtgagaaattgggcttcagaaaaagtgtcacaaagaagtcttttttgcatatgcttaatattcacagaaacattaagcatttttataacctgctgttttccaagcaccagatatatttgtttaaacgaagaaaatacagttaaattaaatttaatttacctgtttcaaaaaaaaaaaaa

SEQ ID NO: 3067 - DNA, 587 bp, Homo sapiens
cttcagaaatatgcacagatcctaaatgaacaacttgatgacttttcacagcatgtgaattgtataatcaccacctaaattaagaaatcgaatactgccagaacctggggtatcatgttgtctcaacttccagtaattatttcccttttcttcaaagataaacattaataattgtttatgttttcaaattcatatactatgtactttttgtgtctgtcttctttcatttgttagtttatttgagattaattcacattgtggattatagaaagagctatctctataaaatattataaaaataatattccataatttatcaattctgaaacagtttacaactaatgttcactacaaaactaaacctgttatgaactttcttacacatatcttttgggattatgtgtgtaaacacatttttttgagtatgtaaataggaatggaattgctgcacctttggatttgcttatgttttattatatatattaccagttttctaaagtgattttgaaaaattttatttgtgtataggtgcatttattttgcctttatcattaaatactaatttaaccttgaaaaaaaaaaaaaaa

SEQ ID NO: 3068 - DNA, 682 bp, Homo sapiens
tcagatttacattgacaacatgcacaacaggctcatgtaaaaggattatctgatgtgtcatcatgacttaatgaagaacgcaaatgcttctcgatgaaattgaagtaaaaagaggaaacagaagggaaaatgagagtctaaaaagaaacaaagagaagttaacttttaagagatgacaaattctacctgccacgatgttttattttaatctgaaagaaattataaagctgatactttctgaaaatatatccttttacagtaaatattcttgtgaaatctgccaacctacttttgttttatttcaaaagcttttgtacctctccagactaaacaaaatacttaaaagatgatatggacatttaaaaatattgtacttaaaaatagagaagaataaaaatcaagaattcattcaaaagaatagtgaattcaaataactttcaaatgttattctaatttatgagttgctgctacatcgatcttcctactgaaaacaaaaatatctgttgctgacatctaccaaaaagtgatttttttccccaaattgagctgagtccacctgttttggtaatgagttagagaaatatattctgttctttttcagaagctccatcagagtggaagacatttatgaactatataaatgtctcattagactccgtctcaaaaaaaaaaaaaaaaaaaa

SEQ ID NO: 3069 - DNA, 400 bp, Homo sapiens
  misc_feature (1)...(400): n = A,T,C or G
tggcagacgtggtgctgagtcagttaaatctgacccttcccccaaagcctatgatcttaactggtggctgcaagaagatgctacatcatggagcaatagaatcccagatcagttgctctgggggaagccagctaccacgttgtgaacagccctagggaaatgtccatgtggtaaggaatggagcctcccgccaaccgccatgtgagtgagccgtcttggaagtggattctccagcctcagtcaggccttcagataatgcagtcccagctgagatcctgactgtgaccacataagagacctgagctagaaccactcgggttggccacacccaaattccagatcctcagaatctgtgagagataataaaagttgttttaagtggcnnanaaaaaaaaaaaaa

SEQ ID NO: 3070 - DNA, 280 bp, Homo sapiens
atggtgtatcctcacccttctacgctccatggtgatcttcctgccaagatttttctccaatcaaaagtccatcttccactttctctttggaaaaagaatgcgtaacagtctcactactgcccatcacctattccctttcactgacatctccccaagcccaactatcattttctgcctttaaaaaataactggaatttatataaatcaatccaacgcctatcatagaccttggttcacagtatgcattaaaatatgtattggttgatcaaaaaaaaaaaaa

SEQ ID NO: 3071 - DNA, 282 bp, Homo sapiens
ggatattctgtgcagaatgaaagcataagctaaagaagagccacattttcatgtagatggtgcaaagaaggtcattcagattccaagatagcagtgaattcgtctgacccagatacgacagaagatcctctctggtgaatatgtgcaaccgttctgaacctctcttttgaaaactttactcttcttctgatttgattccataattggaaattaaatggaaactcatgccttcctaaaagtgttgtaattacatattttgtatttcttttaaaaaaaaaaaaa

SEQ ID NO: 3072 - DNA, 323 bp, Homo sapiens
agctgggtgcaaattccttctgattcaaagaccaagtttctaccctacacactcagcccatgcctccttatacagccttgcatctctacaacttcctaccctgtaacaccgtcaagagtggtgagtgatgtgttacacgttgcaacacttcctgatcgacaccaggcatccaacgtggggcaagaggtttcaaaatacatagtggcttcagattagcacaggtaccacagattccacatgattctcaggtgttaaggaaaatacagaataaaagcttggaaagtaatagtaaaaaaaaaaaataaaaaggaaaaaaaaaaaaa

SEQ ID NO: 3073 - DNA, 440 bp, Homo sapiens
atgatacttgcttgagaatcagaagcaaagcagagatcgctttggtctactcaaacgtcaaagcatccccaacttagctcattacggatggaagtgaagaaaataggccctttatggagaaaataaacaattgtctagaacttctattatttttatgtacacagctctgagtgcaaaatttaaaaaaagaaataccagatatttacctaagcaagaacatatatctcatatctaacatattacaaataaaatgcagaaaaaaatcataatataaagtgttaggaatgatccagatggctagcaaatacaagaaaagtatatggaatctacataagtctgatgaaagtctttaaaaataattagaaaatagttggcactattgggagtttcacaagagaatatgaatatattaaaagactctttaaacaaaaaaaaaaaaa

SEQ ID NO: 3074 - DNA, 569 bp, Homo sapiens
gagaaacctggaagaaaattttcctggaaagaaagagagcattgttcagcagcaagaacactgaccatgagaacaattcttctactcagaagccacctgaccttgggcctgtcactcaggttttctgagccacagttccctgaccactcgtcttgcttattttataggggctttagtttctttactgataaaattgctgtgctttgtaataataacacctatgtaagaatcaaattagttaaatatggaaatatgcataattgtaaagtatcatacccagtttctggaacctagctgatattttattagtgaatagaaggagaaaagcttgtcccattgatgctcagtaatacaaaacatttaaagaataaattcaaaatcttggctataatagaattttttaaagtgttattatccttcaatgtttgagtttgtaagtgaaaagtcacattaggaatcagctttgattaaaacaaaggaataactcttatagcaagtaaaccatttgtatgataataatccattggatatataataaagttcaaattctccagctaaaaaaaaaaaaa

SEQ ID NO: 3075 - DNA, 345 bp, Homo sapiens
gaaagttaattccaagaaacgcaaaaaagcggttcctggaaaaggaccacagttaaagcatcctacattattcacacagcagtgagtgagccgatgccaggagagagctaagtgtaagtatccactgctagacatcagaaatggcaccgctgtcacagaggccgaccctcgaggcgcacagaatgaacgttttgaaatgattcatgattttcatgtatgtgataacaccccttcgagttttctcatatgagagttataaagtttcatgatgaagttgtgaataccaaataccaaaacggagtaactagacaataaaatcttcttggaagatgaaaaaaaaaaaaa

SEQ ID NO: 3076 - DNA, 244 bp, Homo sapiens
ctataactcactaattatactttagcctgcgaacagaacagcgggaggttttgtaaattaacttgggaccagtattcattgtccacctggtgagtccccaaagagctaacaaaaggcactggaccttgaatatgacaagaccacagagtaagtaaaaggtcaaatataaaatcaaaagtacttctatattctaggaaaaaacaattgtagtgacatgatccaattgagattaaaaaaaaaaaaa

SEQ ID NO: 3077 - DNA, 165 bp, Homo sapiens
agggtccagcctcaggcagaagaccctgaagccctaagggaagacagaaagatgacaagaaagaatgagcctggattcctgagtcacaccatggaggaaagctccccaccaaccttttctagattatgcatgagaataaacttctattctgtaaaaaaaaaaaaa

SEQ ID NO: 3078 - DNA, 376 bp, Homo sapiens
ctgggatcccagcttcatcaagagagtcacaattctcaaaagcataagaggcaatcgactgcatctaacgagatacaaccaggatatggacgtcttctcagtatttcacttcttgtcgtcaatccagtggaaactccaaaataccactgaatgaacgattctcaagtcaacactgaagaacgcatcaagatttccattaaaaaaaaacagaaaacccagcatgtacccaggcttttattcatttgtatacctataagaagcagctgcaactttacatacaagtgatttctttttacataaaatgttttttgccatttttagtcactgaagcattaaaaaaaataaatacagtggaagcatttgaaaaaaaaaaaaa

SEQ ID NO: 3079 - DNA, 837 bp, Homo sapiens
  misc_feature (1)...(837): n = A,T,C or G
caagatccacagcaagctgtggacagaactgtgttttcccaaaatcacatgttgaagctgtaatcctcattgtgattgtatttggaaatataacctgcagggagtcataaaggtttaatgaggtcataaggatgagtgtggggcccaaatccaagagcattggtggcctgtgaggatctctctctctttctctccctgtaagaagaggctatgtgagcacacagtgagaagacggccgtctaacaaagaaggaagagagccctccttggaaacccaccatgttgacaccctgatcttgcgcttccagcctcgacaactgtgcgaacataaatttctgcgatttgaggctctcagtctcctgtattttgttttggcagcccaagccgactaattcaaagcatgggctctgtcggttctgagcatgctcctgtgtttttgttctggaggccccaggggcacgtggaactgttctcgctgttgggaatgcccatgggtgcagatctcatgtgtgctctcctgaatgtggcttcagtcccacccaccacattccctttgcctgctgtgtctggttcttccggctcctccctgactcagcctccctttncttaatcgtttttttttttttttaattttttcctatctctcaagggcaatttctcagccttccactatttgcatttatttatctggatgtagttcttatctatccaatataacttacatttctaagggggtcccagaaacccttttcagaatgggggggagcctgtgtttggccgcattgcagatccccttaagtagctaaaagaccactcttttcaaatggctgtaacaaca

SEQ ID NO: 3080 - DNA, 147 bp, Homo sapiens
ggatcccagatttattggtcttttatgaagacactaagaagcccaagttctaaccacccctttgagtcacactcttcattttgatttctcctgagtgatgtatactgtatgttttaataaataaacagctcatcaaaaaaaaaaaaa

SEQ ID NO: 3081 - DNA, 157 bp, Homo sapiens
ccaagatcccagatttattggtcttttatgaagacactaagaagcccaagttctaaccacccctttgagtcacactcttcattttgatttctcctgagtgatgtatactgtatgttttaataaataaacagctcatctcttaaaaaaaaaaaaaaaa

SEQ ID NO: 3082 - DNA, 626 bp, Homo sapiens
  misc_feature (1)...(626): n = A,T,C or G
caactttgctagattcacttattagttttaaaattttttaaatattccaccagattttctgcataaacatttatttcacttgcaaataaagattatttcttcttccttttccatctggatgcatttatttcttttccatgtctaattgcacttgtcagaacttccagtgcagtgatagaggatttaaaagaagatatcttgtgttattcctgacctcaggaaaaaggcattcagtcttttatcattatgtatgatgctatatctaggtttttcatagttgacctttattaggttgaggaatttttttttttaattcctagttggtaagaatttgtatcatcagnggatttggggttatgtcacttactttcctgctcgtgttgaaaggattatatggatttcctttattaggttgttaaattgtgaactatattggttgaactttgaatgtaagtcaactttcattcctgttataaacctactgtttattacataaaataaaaaaaatgggcttgttggctcaaggtggagcttgcggcctttcctttatgagggtaattattaccccgtcctgactcgttcccttgtctttgttgagaaaccgtatcactactaagggcgtatac

SEQ ID NO: 3083 - DNA, 178 bp, Homo sapiens
gatccaggattctacagttttgaccgcacaaccttgattgacctgactgtcacggtatgaagacttgcctcagtttctcacctcttcagagtcctaacatgttacgtgttatactatttagaggtacagattataaagactgagtcatgtgtgggttgttcagtgaaaaaaaaaaaaa

SEQ ID NO: 3084 - DNA, 358 bp, Homo sapiens
catggaacgaagctcaagcagaatactgatacactaacatatctactcaaggagtctttctataaagagatgtaaaagcagtggcattgcaatcaacatgttaacagctacttcagagaagccattagtccctgagttgcggagacacctctacttcttctggccatttaagtgaccacaccatcttactgatatcccaaagttcccaaaaaattaagcttgatataaacttgaaacctggtgagatgtttgagttacttcctacattttctacgtgaaactttcaattctgtgttaaagataaaactaacatgtaacaataaaataaaatgaattattcattttaaaaaaaaaaaaa

SEQ ID NO: 3085 - DNA, 776 bp, Homo sapiens
ctggtatcctgtgcaacgaagtgtggaatataaagtggagaagtaaaaattagagcaaggcttatggccagaaatgaatgaaattcataatgaaggtattctgaggaaatatgatcttactctcaaagtctcaacaataccctgggtgataacaactggctctcaaggaacaagatagctcccaagcaactccagtgcccaggaaagatggtgaagagatctttgcagacaatctatcagttactggggcagaaaaatcattgtgactagtcatcttcatacgatagcttaaaccaacagactgagaatttatagtgtagcgaagggcagtctaatgcagtagttacttggatccactcttgctgttttgtgaccctgggcaatccagttaacctcccccatatattagctttctaatgtataaaatggagatgacaatggtatctacctcattgaatggtgcaaattaagcaaattcatgaatgtaagatgcttagaggacatccgacacatgagtgcaggacaaatgttggcttttattcaattctaggtccacaaacaaaactttacaaaataaagaggtttttggtgattttcttttctctctctctcttttttttttttttattttcatcatctcaagaaatcaaaggcatgcaccttggaaaagaaaacacacttttgaagtcttttaatactagggctctgtattttgttggcgacctatggggtgggtattaaggataggcaggcaactctgctctagcctttgtcat

SEQ ID NO: 3086 - DNA, 597 bp, Homo sapiens
cgagaatatagagttgggaatcattcatttccttcgtcgagctaaagttgaaagacaagctgaggttttggctgagagcacctccatccacatttcaataggtctttgaagagcaaagtctagatattatgtaggatccatgaccaatttcggaaacaccaagtgtaatagctggtgtgtttccctactgcttgttatattcacgcctttattttatgtactaatcaatcttttattccttctcttggttgccctcgttcttgtgtattttatatactagttattggaagttaatttgcatttcagtattaagtaaaagaatattcaatgcatcagaccattcatttaaaccccctgcgaattttgagaagtgagaaatgcagctttttatagcttcaataactgtagaaaatgtgtgtcttctcattttggagaagagtgagagcttttccatttgtaaggagagatgtgtgccgtttaggtatacgtgtagagtttccttattataatgaggagttcgaatatatgtagagggatgcttatttggagtaaccaaataataaataacctgaacttaaaaaaaaaaaaaaaaaaaaa

SEQ ID NO: 3087 - DNA, 847 bp, Homo sapiens
catggtgttgggcagatactttaatgactcaaggaccaagacactcaaggatcaagacttactggtcaagaaagccattccaccatggacaaagccattcctaacaggatcaccatgaaatggttaaactaagaattttcattatcactaaaaaattcattgacacctttactcaagtgagcattgaaaagaaagccaaaatcatcaacttttaagcaaaaaactcagatggaacccatctgtaaaataataaaataaaataacttctgttttctaaaaggtcaatgatcagcaataatgcaaacacagctaaagcgaacttttgggactgttatgaatgtattctagttgcacatataaatatgtaatttataaaacagaatatgaaatatttgactaaattctttttgatgcttcaaatatcaggcaagggaagaacccatcttttttaaaaattgcaaaattatagtgattttcactcaattttagctaggaaattttctagctttgtaataaatagctacagaagattagatgttgactatctcatcttccagagagaactatgggaatgacttattttgttaaacacacacacacacatgcatcacaactctttatagttctgaaattaacttagatccatgggacaagagtgaaacctcagcgttacttagcaaaactcaaagaatttagcctcacctctagctgacaggtcattgcaggtttcatgtcctctccagcctccaaatccttccctgacttcacagcggcccttgtccccgctgatgagtttgccttgaattaaaaggaagcctatgtgatacgaaaaaaaaaaaaaaaaaaa

SEQ ID NO: 3088 - DNA, 855 bp, Homo sapiens
atacagcgtctcactcccttgctgaggctggaatacagaggcgtgatcatagctcactgcagccttcaaactcctgggcccaagcaatcctcccacctcagcctcccaaggagctaggaccacacacatgcatcaccatgcctggctagttttaaaattctttgtagagacagggtaccactatgttgctcaggctggtcttgaactcctggcctcatgcgatcttgccgccttgacctcccaaagtgctgggattataggcatgagccactgcacccggccaaaagagagaacaaatgagtgggtttgtgtagctcacccggaaatcgcctgacctgctccaggtgggaggcatgctgcagggagaatgccaccaggacctgcccccctcaccctcagaggacacctggactctcactttgcctcttcttccctacaaaaagtcgggagactagaagccctgttgtctcctctagcaggcttctgggattcccttggtgtgcccccaaatgagactgcctccaaaatgggatcctgatgccacattaaagatgagtaagttcgatcctcaccctcaccaaaagcatatgtgtggtgtgtgtgcgcacatgtacacacacttaccatcaatttgccaccccaaattaattaaatttggatcctggggacctaggcactttctggggatatcccactcattacctggcctgattaatgcaaatattggagagctgactggattcagctttacagattttaatctttcccggcattgtatttgccgaaccacaagtaatgagatggaatagggtaaccagcaagacccctgtcgccaagctcgtagcttaaaagatc

SEQ ID NO: 3089 - DNA, 823 bp, Homo sapiens
cagatgtttacattctggagaaaaggggaaagaagcagacttctccagtggggcactcagtctggtgccagaaagcatatcaaatcagagcacagacctggctgaacatggggctacttcccaaggtgtcaattttctttgaagattttcagggtggatctacttcaagaaaagagaccgtgaataaaccgaccccaaatcctctctccagggaagtttcattgtcctgaaggagacatgaaagaggaggcatatcactcataactgtatagaaaaacattatcacaaacttccttatctcctgtttgttctcctcaaaacccatttatctttttttttttttttttttgagacagggtcttgctctgttgcccaggctgagtgcagtggcgtgatcacagctcactgcagcctcaacctcccaggctcaagcaattctcccacctcagcctcccaagtagctgggaccacagaaacgtgccgccatgcctggctaatttttgtattttttgtaaagatgggatttcactgtcttacccaggctggtcttgaactcctgggctcaaacgatcctcccatctcagccttccaaaatgctgggattacaggagtgagccaccacacccagccccatttacctctctgaaaagtcgttgttttcacataagtgcctttcttttcctactcattcccttctaaggtggtatgtaagcctgtctatccactcctttgagttagtcactcaccaaaatcagagttacgtactgacttctgtgtgtatatgaattacatgcataaataaactcatggcctcgtggccaaa

SEQ ID NO: 3090 - DNA, 694 bp, Homo sapiens
ataacgtctctgaagggatattttcactcctgggagttctgtttttgcatcttgtgcatcaaatgtttagttttacacagttacctatctatataagacacaaaagtgtcataaaataacagttaaactaacaatatgtgatgcattatggcacatgcattttaaaattctatcctattttattcatatatatatgtgtatgtatatatacaattatattttttttaggtggagtctcgctctgttgccaggctggagtgcagaggtgcaatctcagctcactgcaacctcttcctcccaggttcaagctattctcctgcctcagcctcccaagtagctgggactacaggcacctgcccctatgcccggctaaattttttttttgtattttaaggagagacaggtttttaccatgttggcccagatggtctcaatctcttggccttctgatctgcccccctttgccctcccaaatttctgggattacaggcatggacccactgcccctttatatttttaaatactgggtaacaccccgcaaaactgactttatgacccttccaggggatcatgaccttgtatttatacatattgaatattgctctagtcttcgagacagaccacctttacagttatagtgtatctacctttattatgccctctaagatacttagagctgtaaagtaaatgctac

SEQ ID NO: 3091 - DNA, 840 bp, Homo sapiens
atggagaagcttaaattgaaataaagccacacacctacaaccatctcatcttcaacaaagctgacaaaaacaagaaatggaaaaaggactccctattcaataaatggtactgtggtaactggctagtcatatgcaaaagaatgaaactggaccccttatcatcatcatatacaaaaattaactcaacatggattaaagacttatgggtaagaatttaaactataaaaatcctgaagaaagcctagtaaaaacccttctcagtatcacactcggcaaagaatttatgtctttgtcctcaaaagcaactgcaacaaagccaaaaattgataaattaattaaactaaagagcttctgcgcagcaagagacaccatcaaggaggtaaaaagaaattctacagaatgggagaaaacattcacgaactatgcatttgatgaagatctaatatccagacactataaggaacttagacgaaacaacaagaaaataacatataaccccattaaaaagtagacaacggacatgtacagacacttcacaaaagaaaacacgtggccgggcgcagtggctcacgcctgtaatcccagcactttgggaggccgaggcgggcagatcacaaggtcaagagattgagaccatcctggctaacacagtgaaaccctgtctctactaaaaatacaaaaaattatcccgggcgtggtggcgggcgcctgtaatcccagctactctggaagctgaaccatgagaatggcgtgaacccgcgagagggaacttgcaatgaacccaaatggcgcccatgcactccagcctgagtgacagagcgagactctggctaaaaacag

SEQ ID NO: 3092 - DNA, 496 bp, Homo sapiens
atgttatgtctgatgactagaagtctgtggaatccattcttcagggtctaaactcaagcctggtccttagttctccgtactgtattcttcctgacctccagacctgagcgtcctccccttcaaaagacaaagccatccaaagagtctgagcactccaagtgagcagcttgaagagtgagagacgtggacagagggaagggcaggtctgtgcagcctgtggccataaaccccacctctggccttctccagtgaagccacactcaagatttaagagaacttgtgatcaacttggggtatttgcaccccacgaaaagggagtttgcaggatccctaatatcactgcgagttgccacttttccagtctttttttgctgttcgctcatatccacagggaaaaaaacgaaatgagcagcccagtccctcaggcctttttctttaatgttgccatcaaaaatcaataaaatgcatcaagctgtttcaactaaaaaaaaaaaaa

SEQ ID NO: 3093 - DNA, 500 bp, Homo sapiens
tagggaacagcagttctggactgtacaatacatcaaccaacactgagaattcagcctgcatcattgggctgaactggtgctccaaggaggccactacatcctagggaatgatacacaagagaacccacatgaaggccaggccctccaagagcttccttaaagcgtggcccagagcgagctgatagtctccaacccattgctgctctctgcaccatatttgaatggctcttcatgaaaagagtattaacttggctgtccaaatccactggaatggcaattccacgattttttgctgaaaaagaaagatttaaaatatttccctcttaatttgactaaagtttcttacatattatccatacaatcttataagcataaaagaaaaaatattaaatctttaaactctgtcattaacttgttttatataactgtaaaagcttctaacctgaatgtatttcaattcttaagaccaattagtaaagtgggttcatgaaacattcaaa

SEQ ID NO: 3094 - DNA, 270 bp, Homo sapiens
tattgtaagacgttctatggagaagcccacatggcatataactgagggaggcctctcagtccaagagcctgtgaggaactgagtcctgccaaccttccccatcaagccttgagatgacgtcagcccagtgagagacccagaaccagaggactcatctaagccatgcctgatttcctggcccactgaaactgtaagattataagtgtattaaatcatttaagtttaggtaatttgttaatagaaataaataaaaataaaagctctgaaaag

SEQ ID NO: 3095 - DNA, 459 bp, Homo sapiens
caccgcccccgccccgccccccagctcagtcttgcccccctctaggtgaaagagaaaacacagcttggtgataactatgcaaagatatgaggcagaaggatataaaaaaaacttggagaatatgccagtatccagaattcgcttaatttttattccagcacaaaaaacagaagactgggaatttttgttggagggtaatggggaagtgaaaattctgctttattatagatcttatgattgcattgatagaatttatcattttttttttaccacttatctaccaaaaatgatgggacatttcttaaaacaacttagcatgcctttaacttatcttcatatcctctttatgtagtatatttgggaataaataaataacagtagtaattaatattaatatatagccattttctttcctaaaaataaaacaatgaacacaaatatcaaaaaaaaaaaaaaaaa

SEQ ID NO: 3096 - DNA, 349 bp, Homo sapiens
tattatatattttttctaacaacacagggcccccttcagttacctaattctctgtttcactccttgctttccggcacaagattctccaggctcttcagctccagccttgacacctgccacttgtccaaagaatcctggttacttttggtggagaatggtatttagaaatttagagacatcttggccagaagcaatgcaacaacaaacaaactttaaaagataaaaaacacttgaatcttcattcaatattattgttaatattatttgtcaattcatatttatattatttgtcaaattgtattgccgatatacaaacatggcttaaaacttggaaagaaaaaaaaaaaaa

SEQ ID NO: 3097 - DNA, 309 bp, Homo sapiens
ctcaggggacccacgccacctttaatagctgtaacactcaccatgaaggtgtgcagctttattcttgaagtcagcaagaccaagagcccagcggaagaaatcaactcctgacatagtgggaaatggaagccatgcacacccctttcccatggggaagcagaaggaatcctccacccctgctgtgtctcagcaaaccacagaggtgccaggtggccactcctccaccacctctgtgtgagagaagccacttcagatccacactcaatggtgagaaccaaaataaacaaattgattggaaaaaaaaaaaaa

SEQ ID NO: 3098 - DNA, 974 bp, Homo sapiens
cgaagaccgggagttgctataactcaaacgtgatggagccttgaaaggatcaattgagcaaaagcaggaaaccctgaagttggaaaaaggccctataagcagacagacctagatttcaatccagaattcaccttagcatcatgagcctcaatgagttggaggcgaggaacataggtaacagtgtacagaacactagaactgttaagcaaattttaattctcgacaccaagtttacacactgtcataatattaactctaaaaacaccaaagatcaggaaacacatgccaggctccttatacacagtggtggaaatcctggtaactacttaattcagtatgtattagttattaaatgatgcacaaatattcagcaggattaatggttccaaggtttcccagttgggcactgggatgagatttaagtccaggttctatttaattcccagatattctgttgctctgggctttaggagataggaccatcattttggcctctgcttggaccctttagggagtagcccatcacgggctgggcaagctggctggtttaacctgtgaaattgtttcaactgctaagatttggaagagagatgcgtttgaaataatacccaagttctaatgatgattgtttctaagagttcgtcatcgaattaacctctttaatttggttagcatgagaaattagacttctggagattcatttttaaaaatgtgtttaaaatatataaatgatctttcaagggcaaggttcaaaatggaaaaataaagtataaccttcaggattgatttttagataatttttactgatcactgctgaaaaaggcaagagtcaatatgaaattgaatgtatgtacatgaatggataggacacatctttgaatgtgatcaacttaaaagcatcgtaaacaaggcatgtaattattttgatgtctttagagcaataaaataattctctacaaaaaaaaaaaaaaaaa

SEQ ID NO: 3099 - DNA, 355 bp, Homo sapiens
ccgccagcagtgcctttcatttttttacagggtctagtagcaaacttctgaccatcatcaaatgtgtttctgagcagcaatgtacatgctgcttaggaattgtacacacttcatgggcacacattacccaaatgtaccatctcaagtgaaacttcttgagaatcttctacatggaaccatcttgcctccaccttagatgaacttgcccacagaccccacagattctcatatttctaggaactggttggttaaatgtggtctaacttttattggctggaggtgacttacaaaatttgaaatgaataaattatagcctttttctataaaaagggagttaagctgaaaaaaaaaaaaa

SEQ ID NO: 3100 - DNA, 781 bp, Homo sapiens
caaaagaaaagaccagaagaaggaaacaaggagagaagaggagaggagaggaatatgttcatagagaatacagcccagagtgctgcaatcccattcagtacttcttttttgaaaggagagaaatcctagccctgcatagttatgcatttccagcaaaagataacaagtccctgaaaaacaagaactcattatagtaggcaacaaaatagaatcaatataagtttgtaacataaacagttttagattttaatgattcattctagttcttttagtaatgtgtaatttgaaagtttacattgttatttgcttgttggtcatagatattggggttattatacttaaaataggtggggtgcatgtgtgcacgggcacaagtgtgtgtgtgtactttgaatagtttctacagattaacttactttggacagagactgagtctctccatatataaaagtctaattaaaatacaggttttacagattgtatggccaaaaactaaaatctaaatttaaaatattaacatggaagtgtattccttacttaaaaatacttgaatgtgtcttaccttgatccaaaacagacatacaaaataaaatgtcatcccttactcctgttcctatgcgggaaatgcccgtgaaaaagtcctacatgttatatagtttagatctaaagcgagttgaatatgacccagggcaagaggatattatcgttccagggggttaattaatttaatttgagaggtaatgtaaagctcgtttgaataattagtctctagccgggggac

SEQ ID NO: 3101 - DNA, 875 bp, Homo sapiens
ctttcagaatgcaacagaagagagtgcacggcttctgaggttgcagcttttgggagaagccatctaccattgatgacagacatgccgtgtggaaaccaaaccagccatgtggagaggctacctggacagaggcacagggccagcagcagctgtggagacagacatgtgagcaaagaaatcatctttgatgtacagccaagttgagccttcagatgactccgatttcagccacctttggactgcaaccacatgaaagactctaaatagaagcctcccagctgatcccggttaacccacagtgctgaaggggataataataaattgttgttttaagccactaagttttgtgggcctttgttgcatagcaatagattatccaaactattttttttattgcaaggtattctaggtgtctgctgagctcaggaaactgggaactccttcaaggcagggcctgcattttagcatttttgttattgtgagagctaaatccttcggcatggagaggcaaaccctggatattcacacagtactttgttagaacgtctgggattacctatgaagcaactctgagaagtgtgtgaaatacctattctgtctacaaaatgtatcttattcattgtctgcttgcggccaccatgggatgcttctattccaggccctcggccagcttttaagtgacagaaggcatttttttctttcctccttttgaacacgaaatacccggatttaaatgactggtttaaaatggaagataaaaagtgtccctttctccgcctccacgcctctgattcctccaaagactcataatgcagtttttggtctgccgggaattttggcccctttaccttttgacgcccacgctcccccccccg

SEQ ID NO: 3102 - DNA, 803 bp, Homo sapiens
cagatgctgggccacaaaagagtatgagtaaatggaccttgactctgagacactcaacccagcaagagaaaagtcatgcagttattcagtcaacaacttcttattgatattcttccttgcgtgatgaactgcataccagagatactgggaaatatttaccattgtctgatatattgaaattatccttttttttgtcattcctgtctcattaaatataattttaatgattgcttgcaattctccacctttctcagaaactgtctagtcagtaatgtttttaaaatatttgtcttttatattagacttcaaaaacactcatctttgttcccctgggaagtgttaggtaaagctgctatttttctgtctgaatgtatttgcctgaagtcctgtgagacaacattaactttgtaatttttagtatccttattttgaaactttgtttacattgcacttgatggtctacttactggagtcaggatttgtgattggtatagatctatatttttaatctacataattaagaaactgattatgacatttaaaataagtatttggaaggtaaaggtcaccatatttttgtgagtttgaacttcggaaaatttcactacccaaatgtacgtactacctattgctttcagaaagctgctaagaataacattgcttttctgaatcgtgccagtcacccaccatacatcataatgggaaaaaaagaataccattttttttactggcctacacaactgtgcattttaggtcaggccatgtgaacagaaagatctaaagaatattacattaaaaggaat

SEQ ID NO: 3103 - DNA, 763 bp, Homo sapiens
cagacacttggtagaatgcaccggtgaagctatctggtcctgcgcttttctttgtggtcataaggctccgatccctgctgagaggaccctgctccacacccagaaggaaagaaagcatgctcacagagaccacaaaaaacctagacagacactgggtttccccactcttttttcttttttcttttttttttttttgaagtggagtttcattcttgtctcccaggctggagtgcagtggcgcaatctcagctcactgcaacctccacttccctggttccagtgattcttgtgcctcagctacccaagtagctgggattacaggcgtgtatcaccacacctggctaatttttgtgttagtagagacaggttttgctgtgttggccaggctggtcttgaacttctggcctcaagtgatccacctgtctcagcctcccaaagtgctggaattataggcatgagccactgcgcctggccttctatatttaaaaacattatcttcttaatgttgcttttgggattaaaattaataacatattaatctaattttgattaatatcaactttcattttaatggcctcttaaacccttttggccctatagcctctggtcctttcccttctccttggggctggtattggcaaacaaacctatttgtatgcatagagtatgcatcagcacagaattactatttattgaattatttctttatgtggctgtcttttacctcaagtaaaagaaagagttacaaacaaaaaaaaaaaaa

SEQ ID NO: 3104 - DNA, 524 bp, Homo sapiens
ctagaatctactccatcccagggtatgtaaagcaatgttgcacccagggattgctactggcatgtggtaccctcctgagcagaagcgtgggaagctgatcttgaccacagacctgatgtgtgtaccctgttgttgttgttgtcatgtgctgaaggactgcaccccatcactttggcttccacttcatttctgcattacccactccacctgcaaggcttgccccacagtgactcccatggcaagtctcatcctagttacaccctgtttgctatttccaaattgttttgctttccttctagaaaatgtagacagaagggtgcaggtgttttgcccacatctgcataatgtaaactgtgtatgtatatacatatatagttgtttccaggagcccatctctgtgggataatgtgtaattcaaacacctaccagactggaggcagcttttgtacacttggcttctgaaagagttgctgcttccctcttgcacgtaataaaactgtgatatccatctaaaaaaaaaaaaa

SEQ ID NO: 3105 - DNA, 556 bp, Homo sapiens
atgtgaaccttcctccctggaggaatggctgatcccaagtgtggggaaaatgtacaagataagcatagggcaccagtttccttattttgctctctcgtacaacaccagacaatgtgctcatgtcaaaaggactcagaacccaacatgaagatgcacccagcattcactgcacccagcattcaacgaagggaaaaaacgagcaccaataaaaataactgctaggtgcgggggctcacgcctatcatctcaacactttgggaggcagaggcaggtggattacttttgagctcaggatttgaagaccagcctggtgaacacggcaaaaccccgtctctaccagaaacacaaaaattagctgggcatgatggtgtacctgtggtcccagctactcaagagggtgaggtgggaggattgctggaggtcaggacgtcaagcctgcagtgggcagcgattataccactgcactacagcttgagtgacagagttaagaccctgcctgaaacaataaatgaataaataaaaataacatgaaaataactgcggaaaaaaaaaaaaa

SEQ ID NO: 3106 - DNA, 370 bp, Homo sapiens
ccggggcctgaaggggctgaacctacaggggtccccaaggaccaaggtgctatccatctccctgttcatctcccagagtggtatactcatccagtgcactcatctggagcaattcacatgcaccatgtctacattccagcctgtgggaaagcaagaaaggatgaccaggacacacggtgcatcaataagaagatgactataagtgttgtgttttcattcctctcacttcccattggcccaaacttagtcacgtgaccacaacaattacaaggccatctgggaagtgtagtatctatttgagcagttgagtatctggctacaacttggagcattctgttattttaagaataaaggaataaaagacaaaaaa

SEQ ID NO: 3107 - DNA, 806 bp, Homo sapiens
cttcaggagacttatccttatgcccactgcctacagtatgcatggctctatgaatagaataaattcctagaagaagaatttgtgaaaaggacatcctgtttttaaagaactttgaggtatcatctacatgcagccaaatacataaatctaaggtccactgcttgatgtacccacgaacatgtatacgtatacccatttcactattcttaaaatctgcatttattgtatttcaatgacattgaatatactttcacatgtacagaaagcatttgaaactctatttctatggattgtgttcacgtcctttgccccctttcctgctgtgttataatgttgtcttctgttttcaatgaacctcctttcctaacataaaaggtagtcttttgttgcatgatcagccatctttttccctggtctgtatttggtagagcaaattttcattatgttatataaaatttgctatcgtcttaactttggctatgtgagctttcacagactgagaaaaaagagttaagattttctgtgacaaatgtgtatggctttggctcctgctatttccaacagtaatggttgtttttttaataacaaaaggtgaactcatgtctgattttaatttgtaatttgcaccttttgtcggggaaaaaccgctcttttttaaaagctaacacatatgcgagtcctgcgaccctatcttttctctcgaattcacttggttggtcattcttaccaacaccatttaatggagtttatacttgtgaccttattaaatgtagctttttaaagttaaccagatcctttatttctaa

SEQ ID NO: 3108 - DNA, 812 bp, Homo sapiens
  misc_feature (1)...(812): n = A,T,C or G
gagaggtccagaaattgggtagtagtcaacttgacttaacatgagaagaattttggtgatgcagaaagtcaaataccgccagcttagcgggtcagcatcctctcctcccacataagcagagatcggagcatgagataaaatacctggatgccctttgctccagcctcgtgctcccacaactttgcttctgacagagtacttatctctctgaccactgggaaactgctaaaagagagaaacttgaaaaggattggacttttctgtgcaaatctctttgaaaattgccacctcccaggttagcttttaagagaagcccaatatattaggaacctgaaaataaaggaaagtttgcacattgaaacatcacttgctaatagttctattattggaaacggaaatatggaattctagaaaaagaaatgtcattatggggttaggaattaaccacttgctacttatgttaatgtgacgtggtttaaaaaagctgcaggaagttcctgaaattattgaaacaaaaataaagtattttcccctggaatctaagtaatgtaagtgaaagtctttaaacattctcttcaactttatatttcanaattgcttcacagtaatttcttatgttatccatcacttgtctaactggaaggcaagcatttttattgttttagttactatttagctntatgaacagcattcttgctttgttgcaattacaaacatttatttccatagggatggaaagattatgctttgctctctctgccaggtaccaattgtcaatagaaagtagagccaactagagtaactttagctct

SEQ ID NO: 3109 - DNA, 524 bp, Homo sapiens
  misc_feature (1)...(524): n = A,T,C or G
ctcaggtatctctaggacccgcattcttcagatggatgtggaaaggactcctgggagtggagaagaatatcatagtgctgcagaaagcagagactatgcagtaaaggataaatgcccaattttctaagtgactgttcaggaagctcatcacatgtcaattagtgctttgtgagccaaacagattctggattaaatggaaacaagtgacctcaacaatagaccatgcatctctatttttttcctccacaatgctttcctgcagaatggggtttaccagaggagctgtgatttccactactgttgatgtggcacctgtaatgtgtttgcagagcggtggcattttaaagcaataaatcccaagttttatttggagtttcacttgtcacacatagtgtgaggaaaaggaacttctgtccagaaacagttctaggccagcttgtgctgactaaacaaaaacgaaaaataaaagggcattatggagccaataaaattgggaccgttaaaatcacanaaaaaaaaaaaaa

SEQ ID NO: 3110 - DNA, 408 bp, Homo sapiens
agatggagtcttgctgctctgctgaggatcgagagcagtagctattcacagccttgatcactgcgcaatgcagccatgaactcctgggcccaagcaatcctcctgcctcagcctcctgggaagctaggattacaggtgcatgccactgtacccagctgtcattacagcttctgttggttattgctgatatatacaattttttgtttctcttacagcaaacactctgattcctgttactggctacaataaattttcagttccttcatattttctaagtacataatcaagtcatttgcaaagctatttttgttttttcttctcaatgtttatacgttttaattctttttattgcttagtgcattggccaggacttctaaaataaaacggaataatacaaaaaaaaaaaaa

SEQ ID NO: 3111 - DNA, 403 bp, Homo sapiens
ctccggatgcagtacgatttttgtcttactgtcttggctggggaggaggaatgtttcgatggcttctactcactttccctacgctgtcacagctgttatccatgggtgaagagtcggtacaaggtggtgccaattaccaagtatactatcgcatcatctgcaaataaagatgggagaaaacagaatgactggaagattaagaacattacaggaatgtatacttggcttctctgtcaaccagatgtctgtactgctgccctaaaatatactgggaacctaatgcctttctgaaaaatcagtccaatgtttgtaaacagggaagttgcaatatggacagtgaagtcacctgaattgtttttttaaataaatattttgggtatttctttccacaaaaaaaaaaaaa

SEQ ID NO: 3112 - DNA, 943 bp, Homo sapiens
tttttgatatactgtcttggctggggaggaggaatgtttcgatggcttctactcactttccctacgctgtcacagctgttatccatgggtgaagagtcggacaaggtggtgccaattaccaaattcccttgagtttttcaggtatactatcgcatcatctgcaaataaagatgggagaaaacagaatgactggaagactaagaacattacaggaatgtatacttggcttctctgtcaaccagatgtctgtactgctgccctaaaatatactgggaacctaatgcctttctgaaaaatcagtccaatgtttgtaaacagggaagttgcaatatggacagtgaagtcacctgaattgtttttttaaataaatattttgagtatttctttccacatatcttgatctttcacctcatttttgcttaacttaaatttttctcttttgcttttgggtcagctgaaaagcccatataagtttacagcattaacagcatataacactgtgatattttgcaacttgaagccaagttaaacatatggacattttaacgttattttgttgaaaacctttctatggaatgccttttattcacttttaggcagatctaattatagatggagttttagcttgcatgttaagcacatgatgtgggatgtctgaacatgcaagaaggggccaaatctctcctatgggagcaggaaaatccttgggttgcactggaatttttaaaaatattaactattgctccagtaataatagtcattctcttgggcctccaactatcttacttatagcacatttttattataatataacttaatctgcaaagttaaatgtattaaattaagctgacagtctcaatttttaatgttatcatcaatgtaattttaaaggagatagagtttgcctataagaagcttcagtaactcttgatagtgcactctg

SEQ ID NO: 3113 - DNA, 472 bp, Homo sapiens
atgggttgggaccccgaccgagatagtgtctgtggctggtcctggaggctgtttagggattcaagacaggtaccacttcccacctcttctggaagtgatcagctcggcttggcaaaatctctctctgctgcccagcctggagtgcagtgggatgatctcggctcattgaaacctccacctccaggttcaagcgatactcctgcctcaggctcccgagtagctgggactacaagtgtgcaccacgatgcccagttgctctggctgttaattccagcatatgctgaacagaagtgacaagagtgggcatctttaccttgtttctgatctttgaggaaaagttttcagtttctaatcattgaatatgacagtagcttgggctttattatgttgaggtacactccttatatacataatttgttgagcatttttataataaaagaatgtttaattttgaaaaaaaaaaaaaaaaaaa

SEQ ID NO: 3114 - DNA, 446 bp, Homo sapiens
atgttagaaaataagttgaaggagcgaccttaggagaacatgtctagtcgttggaaacaagcccagagctcctgctgattctacaacatctatggtctagtggaaaaattgtggttacatgaaaccggtccttgctgccaaaaaggttggggaccactcttctacaggacagacaacttggtttcttcaacaaataagtctgggggaccctcatcagtactcaaggcctgagcaggttctggagctcagcaccctgagggttggccctaagagccccatgacttgtacgaagctactcgctagagtttgagggtttccaacccttcctgataacagggcgattgacccctttcccaggactccagttcccacaaaggaaaaaaacaaaagggggaggcttaaagaaacttatgaaaaatgtcagccaaatgccaaaaaaaaaaaaa

SEQ ID NO: 3115 - DNA, 915 bp, Homo sapiens
cttcagatgacgattgtctagtcgtaggaaaacaagctcagagctcctgctgattctacaacattatggtgagctgtataattagttaatgtatatattataatgtaataatagaaataaagtgcacaataaatgtaatgtgcttgaatcatcccaaaaccatcccacccctcctgcctccaggtctgtggaaaaattgtcttccatgaaaccggtccttgctgccaaaaaggttggggaccactcttccacaggacagacaacttggtttcttcaacaaataagtctgggggaccctcatcagtactcatggcctgagcaggttctggagctcagcaccctgagggttggccctaagagccccatgacttgtaggaagctacttgctagtgtttgagggtttccaacccttcctgataacagggcgatagacccctttcccaggactccagttcccacaaaggaaaaaacaaaaagtgggagtcttaaagaaacttaagaaaaatgtcagccaaatgcaatcaatgtgtgagctgtgtttggatcctgatttaaacaaccaactacaaatggccatcagtgaggcaactagggaatttaaactagagatatttgatgatattgaggaatgattattaactttcaggcgttataacagcatgtggttattgtttttcgaaaaagagttcttacttcttaaaaggacttgaagttttacagatgaagtgatttgcgcctggaattcgctctaaggaatcacatggcccaaggcaaaagaccaaatggaataaggacctggaatgaaacaaaattgtcctttgtctaaaatgctacagctagtctcggaccacgggaagattctccgatactttctctcttcggggatgctgaaactcctaataaaaaaatctttag

SEQ ID NO: 3116 - DNA, 572 bp, Homo sapiens
cctaggttaatcaactatatcctcacaactgctcaactacatgacgccaatggatccgaagagagaatctcgaaaacctcctagacggaaacaaacatgcacagcagatggaaaaacaagcattttgtctccaatccctgaaaatatttcttactttacacaagttactcttctgcgaaccaaaagcctaaagactgaagggctttcgaacagtgtgctatagtcaaccatttgggtagtacatgccccagtcttgaccaggtcactatgcccagggtagagtctaacagccctaggcaatgggtggacaccaccactaaaacaaaaggtttctatgagattttataaaaaaaaaagtacccaagataaatcattaaaatgaagcttacaatatatgctgaatgtaacatttattcagtgttagaggtttactatgccatgagcagacctcctctgcagtaagctttctaggggaaagcaatagtctcctacttctacaaatctctggtctttcaaacagaaatatggatcaataaagtttgcttgtgttcagacaaaaaaaaaaaaaaaaa

SEQ ID NO: 3117 - DNA, 725 bp, Homo sapiens
agctgattgggtctacatgccacttttcctatatcccccactgacaagtacagtgaaggccgaatgctcagtgaacagtaactctctgccctaaatccagctgtgactttcatggtccttactcatggaccttccacactgagggagcatgctgcatctggggaattttggatatcaggagcactgagaaaaagagaacacaaatgaaatctcacctcatgtgatagtagtcatgaaacccaaagacacaatgtggagaggagttcacgagaatgcctggtatgaggagagcaccccaaatcactctttatgagctcatctcaaatctcgggctccacttatcccacggcgctgctcctgcctgagttctgcagccaagtgccctgtgattgccataagaaggaggaatgaggactggggggcggcgatgcagcaaactgaccagctgccacctctccattctcccagtcaatctctctgatcattgtctctgcgctagctcacagtctggaagcttggagagcctctttttgtttctgcacttttttttttttttttcagagttctctgtaaaagcatgttttgggttgtgcctctcctgttccaattaatttatatctaccctctgacttttaggaacttattatattatttgacaaagcacatatgcgtgcagaaaatcctaggcctataaacccagattgtctggatgaaaaaaaaaaaaa

SEQ ID NO: 3118 - DNA, 1192 bp, Homo sapiens
  misc_feature (1)...(1192): n = A,T,C or G
tgataaccgacattccccgaaaaaagaacttcagggggacaaccggggtcactcacgaactgcactgcgttgtctttatgaaagagaaacaaaaactcaggaccccaattcactgtgacagaaggaaaaaaaaaaaacttcgaagcttgagtcatcgcgagaaactgcctcttcctttctgttcctgaagcacgacagtctacgtgagtaaataggctaaggcaatctccagtaaggcacgctcactctaatgttcaatcgttatcctttcttctaaacaaatctttttacattattctacccgcttcttcgcacagagacatcgatactttagtctcaccaagcttggggctgcactgcgcccgatcatctggctcactggcggacctctggtcctcccgcggctgaagtccattctggtaaacacctagctaccttggtctgtgtgccaggaggaatggcgttcgaccactgcggagggccggaaggtttgatagtgacgcctgagcatatgtctcccatatgcaactcccaagcctctgacgccgacagaaggcagaataacatccattctacaatagaattaaaaggagaagggatcctcttaaccagcgccttacgcgtccgccagaccctcaatgtactcaacagacgtactatgatagtgtatctnacctaccacgagaaccagaagacaaatcatggccctgctgctgggtcgttcaacacgcgcgggaagatatgtcatctagtgcccgtctcgctctatantggggagggcgaaaatatcagtgatctcctgcccacatcctgagctgcactctacgcagtcgtggcggttcgtgctcatcacacaattcggttgttcggcatagttccacaccgcgcacaacccactcttctctgctactaatacattgatcatcaagacgacatgtctacatatactgtgatgcctcatagcgccccagagggaccgtgtatcagagaaaaagcgatgccggttgtgcgatttctccctgcgcgctcgccntctcagaaggttcaccagctacaacttacactcccagattggtgtgcactgcagcgtcttaatgaaccncctctatccttcacatgagcgntcttggtgcgtatatggcgcgtgctcgcgcgtttcacatataatgcgcttctattcactcgttaccgg

SEQ ID NO: 3119 - DNA, 841 bp, Homo sapiens
tctcaggagaacaagacctaagggtaaggcctaggctagaccagcaaccaactgaagcatcctgaggaaataatttgttttatggttcggaataaatgaacgatgctcttcggaaccttccccatccctgaacttgctaccgctcaaataatgacagggtctgctggagtgcagtgatgcaatctcggctcactgcaatccctgcctcccgggctcaagtgattcccccacctcagcttccaaagtagctgggaccacagaaagcagcagcctatgcttcgagaggcctgcgcccacgctggaaatcactgagttagacggggtttcatcgtgttagccaggatgatctcgatctcctgaccttgtgacctgcccacctcggccccccaaagtgctgggattacacgtgtgagccactgcgcctggccagagtttttcaactgattcctggatagtcacagaacttctcagtaactgaagctataggataaattgctggtggccatgtttccagccaaacggagaaatgtctgctctgagaaggaatggaataaacatgcagaaagaggcagagatgaaagatggagataattctggccctactgaggccagttgcattactgctcttcccacagtttggtggcccaattctttcctagatcctgcaagccagtaagtccccattttccactaagttactttcataggcttctgatgctttcaatcaaatatatatgcaacgcctgtttttgtctaaagacttgggggctgaagtgatgaactgaaaatttcaatcccaataaataataaacacattattgtcctaaaaaaaaaaaaaaaa

SEQ ID NO: 3120 - DNA, 595 bp, Homo sapiens
ctgggctgcatgatccatagcatatatcccctgatggataagcattgtgctgagagacttgcctccatcagctgtgtaaacctcaggatgacctgcacacaggtatactaaggcacacagagaccagctcgtagtcagtgacaagtaacttgccgagagccgtggtttaaaagcatgtctgcaaattcttggacactcttgtcatccagaaatagagtctaaccctcctcccttgaatacgggctggcttcagtggtggaaatgacaatgtgtgagtttgaggtttgattagaaaagatgacacagcctctgcctgactctcaaggcccttgttcttggacattagctgccatgctgggaggaagcccagcagccacacagagaggccacgacagccgaggtcccagccaagccagcatcaactgcccaacacgtcaatgagtgatcctgcagagcctcccatctcctagccaccgcagctgatgctctgagagcggaggcaagctgtccttgctgggtgctgcttaaactgcagatgtatgaacaaaataaaaatggtggttattttaagacactaaaaaaaaaaaaaaaaaaa

SEQ ID NO: 3121 - DNA, 497 bp, Homo sapiens
ctcagagtaccttacaaaatcgttctatccagcatgcacttttggatactctttcaactcagaagtcaacataaagggtaaacaacttcagagactagaattataagagaaaaacaatgaggacagaactctccagaagactggaatgcactatatacactaaagcaagatgagactggttttatggggactatgaaaaccaaaagaggctgggcaggtggctcatgcctgtaatcccagcactttggaggcagaggtgggcggatcacgaggtcaagagatcaagatcatcctggccaacacggtgagaccccgtctctactaaaaatacaaaaattagctgggcatggtggcgtgtatctgtagtcccagctacttgggaggctgaggcaggagaatcgcttgaacccaggaggcagaggttgcagtgagccaagattgcaccaccgcactccagcctggtgacagtgagagactccgtctgaaaaaaaaaaaaa

SEQ ID NO: 3122 - DNA, 416 bp, Homo sapiens
gtactaggtaacatttgtttactcttatgcttccctacacgtgcttagccagagtactttggttataaaccggagtactttgtcttcaacaagaagggactgtctcagagacccaggaaaaggtctatgccaggcagtatggggcacagacttctgaggaattgttaagataatattgacaacataccatggactgagtcaagctatccagtaatctagtgaagaagctgatgagttcatgagactgccggttcaaactcagcatgattttatcgtctttcaagaaggagagaatgtaaataaattagctaactttggaatcttgcattctcatttgtttagtagttatttaaattcattaaattgcttcatataagtaaccattattcttgacggtaaaattaaaaaaaaaaaaa

SEQ ID NO: 3123 - DNA, 906 bp, Homo sapiens
cttcacgtctcctctagagactcctagacatcatcgtttcctgatttctttgctggctgcttttataaccaaactccaaacatcaaaattatcatcttagtcctgggtgttctgtcctaatgtgttaactgcaaaaatgacctcaattcttaggaacttctgccatcagtagctggagtctattgggtttcaagtctgggcctcaagaggcattgcaaactttcatcctctcttttgagatttcagcaccatcaccaaatgaacaagtcccaggtagcctgctggaggatgtacaaccatgtggaacgccgatgagccatcacagctgagttgttttggacctgctagctctaaaccaatgtcgcagctgtctgtagaagcacgaatgagatatggccaagctccattgagcctggcccagataagcagaactgtttcacggagcccaggacaaattgccaaaccccagtattgtgtattcaataatttctagttgttctaagccactaagtttcagggtgacttgttaagtggttataactacctaataagtacattttgtatttcctttttattatcatctaccatagcctgttattattttctttgtttgtttatttatttattagctgtttctctgcaaatgtaggacaattgcattgtcttgtcctctgatgtatccaaaacagttggtgactggcacgtcaaagacacttattgaaaagttactgaataaatgaacacatgattggatgaataaatgtttataggtaaaacttccgaaaagtatattgataaaaatgaatatttctatcagttatattaataacttatttgctgtctagaatgactcaggaaatttaatgtatattattaaagcacaatttctaaaaaaaaaaaaaaaaa

SEQ ID NO: 3124 - DNA, 765 bp, Homo sapiens
ggataataaaataccatcatgaagaagccgtctcatgagaaaacgcactatgtgaactcccaacactgctgaagagtcaccacctctagtttgtcagataagctcttcagatggccagttgtccccttcaggatcctgggatgggaccatgtacgtctagcaatataaaactggtactggcattaccagcaggtgcccttctgaaaaccactggaatgtctctggctcctaaaataggataattaggtagtagagtgccctgggatgtggatgcttacctttcagaactagacttgggttcattctcacctgactgcctcagccacctaggaaacatgacccaggtgaccattatctcagaggcttctgtcgggcctctgcaggaataaatgcaggctattctctaggcaatcaatgagaataagagcctctatacctttattgaaagagacattaacaactgctactggtttagtgaaatgcagggttcaaggaaggagtcgaggacccaattgaagaaataacaagcagtcatgccaggaatacatcccaaaccacaaccctgtcttgtacatggacactcagacaggtttgctttgctctaggaaggtagacagggagaagccttcaaaaaaaaccttatcttggccccaccttaaaaatggaagaaattaacgtcttaaaagagaaacttttcctccatccatgtaacgaagcttatttgtaaatttctagaagaaaccaactgaaaaatacatggcctgg

SEQ ID NO: 3125 - DNA, 259 bp, Homo sapiens
tttttttttttttttcatgaagagatgttttattttgtagatacttggcatgcaaataaaataacctttttaaaaagtggtattaaaaagtaaggattcaaaccagcatttaactctttttttaaatcatcctttagcctgtgtttattccttccattaattttgaatattttaaatgatataatgcagtaacacatgctgggattaagtccttgcttcttaggtgtagaacagtctttactttcttcagtggccaatt

SEQ ID NO: 3126 - DNA, 478 bp, Homo sapiens
aggacaacaggatgtctcactctgtggcccgggctggaagttcagtggcatgattagctatggctcattgcaacctccacctcctggattcaagcaattatcctgttccaaacctcctgagtagctagggattacaggtgcctgtccccacacccagctaatttttgtagtttgtagtggaggcaggttttcaccatttggccaggctggtctcaaactctgcacttcaaatgatccacccgcctcagcctctcaaagtgctgggattacaggcacgagccattgtgcccagccaaaattttagtttttaattgttcattgctatctataaaaatgcaattgatttttgtatattggtattatatactgagattttattagtaatagcttttttaaagtaaattgtattgcattttttacgcaaaaattgatgtctgtgaataaaagcattttgtttcttcaaaaaaaaaaaaaaaaa

SEQ ID NO: 3127 - DNA, 793 bp, Homo sapiens
gtcctattgtatatatcccccgcccacctagccctccggtttatcagtcggagggatttgccttgtcttggatgagactttggactgtggacttttgacttaatgctggaatgagttgagactttaggggactgctgggaaggcatgattggttttgaaatgtgaagatatgagattttgcaggcgccagggtgagaatgatgtggtttggctctgtttgcccacccaaatctcatctccataacttccataatacccatgtcttgtgggagggacccactgagacatgactgaatcatggcgggcaggtcttgttcatgctgttctaatggtagtgaatcggcctcatgagatctgatagttttaaaaactgaagtttctctgcacaagctctctctttgcctgctgccattcatgtaagatatgacttgctcctctttgccttccaccatgattgtgagccttccctagccatgtggaactgtaagtccaatatacctctttcttttgtaaattgccctatctcaggtgtgtctttattagcagcgtgaaaactgactaatacgactatcaagcactctttttttatgattggaagtatgtttgagtttcaataatatatgaagttttttgtaacataacaaactgcatgctaatttaaaaattgtataattcatgctttctattaaggatgatctctgataatatgaagattgtaaaatgatataactattatttgggatacagtctgtaaataaaagcatcaattaccaggaaaaaaaaaaaaaaaaaa

SEQ ID NO: 3128 - DNA, 740 bp, Homo sapiens
gggtagagagtgcgtgaggcaggatagacacaagcatgtaaattgtttattaggatgcccgaaagcatattcaagctgtgggtaaggcagggaattttgggccaaaaaggctgtgagaaagagtgggaagggccatgtgagagtttctcccaatgattgaaggagtgttaaatttgccagctctgagataacgtcgtggattcagcctggaacatggcgcgattaatacgactcccgatacggcgcgaggttcttgctctgtcacccaggcaggagtgcaggggcacagtctttactcactgccgcggaggccttctgggctcaagagatcctcccaacatcagcttaccagggtagctgagattacaggcacatgccaccacgcccaggaactggctttctgaagaaaatgaagaaagaataaaaagcccagaaaggcactttgggagctgaggcaggaggactgcttgggtctaggatttcaagaccaacgtgggcaacataacaagactctgtctcttcaataaaaaacgtttttaaattagctgagcatattaacacacacatgtagcccaagctactagggaggctgaggcaagaagaacccttgagctcaggagaccagcccggccacacagcatgacttcgtctctatttttttctttttaagtccagaaagtctacattgtggtttttaatttacttaataaataaccaaatacctactaaaaaaaaaaaaa

SEQ ID NO: 3129 - DNA, 416 bp, Homo sapiens
agaggaaatgaaaaacacacaacaaaaaacttaagctttacttgccttgggaagtggtgtttaccttgtaagaagactgaaggaaactcaagggaaacccattttcataaaaacatgggaaattaatgaagatcagatatttttgctcaaagataagaaatgtacatgcaaacatatgtgtatactcacagaatatgcctattgtttagaagcaaatatatgagagttgggagaataaaacaagttgctatgttttttcatggaagaaacaatagttgttaaaatactctgatgtttctaacccaaatgataccatttttaactgtgtaatagaaaaggactgaacgtcttgcttacccaccctcatctcctaatatgtggatgaataaagtgcagacatactaaaaaaaaaaaaa

SEQ ID NO: 3130 - DNA, 555 bp, Homo sapiens
ctcaggttctcttcttcacttggtaagagttcacgagaggcgagttcatacctgccaccacaatctacttctcctgtcagtcagtgctcacagcctgcttttatagttagccattaaaggagatttttatttgctatttcctttaaaaagatctgcttattatcgctgtaaaatgaaagttatttttaaaatttgtgtcttgtttaaataattacatgtataacacaaaagactatgctctaagccattgccttttttggaatagaatgagataccagtacttgcaagttttaatcaatgggaaaaatgacagttctcatttttttctgccattctgtccacattagtaataaattttaagatgaagtacaatgaaaaagtattcaatatttacaagtgacatacattattttcactgttaaagaatacaaatataccacaatttattatatatctaaatttcgttttaatttctcatttcagtttttcattaagtttttaataaacagaattttctatcttgtagaaaaaaaaaaaatggcctccttggcctca

SEQ ID NO: 3131 - DNA, 364 bp, Homo sapiens
ctcagatggagtctcactcttgtctccccagctggagtgcaatggtgcgatctcggctcactgcaacctccgcctcccaggttcaagtgattctcctgtctcagcctctccagtagctgggattacagaaagagaaggcatgtgaagagacagacacatacacagagagactccctgcaaggactgcagttatgctgcctccagccaagccactaccagaggccaggagagaggcttggaagagatcctgccccaggatcctcagagggaacatggccctgctgactccttgatcttggacttctggcacctccataactgtgagataataaattgctgttgctctaaaaaaaaaaaaaaaaaa

SEQ ID NO: 3132 - DNA, 228 bp, Homo sapiens
gcctcagagtcacaatccaggatcccttctgcatttggcggctgtgtcttcttcgttccctccaatccaggacccttcctccatctgttcttgtctttcatgaccataacacctctggcaagcactggtcagctgttttggagaatatatcttaatttgcatttttctgaaatttcctcattattataatgacattacgctttttgggcaaaaataaaaaaaaaaaaa

SEQ ID NO: 3133 - DNA, 236 bp, Homo sapiens
ttagaggcacgatcccactatgctcgcccaggttggtctcgaacttctggactcaagtgatcttcctgccttgacctcccaagtagctggggttacaggcgtgagcccaaatgaatttttaatttttttattctatagacaaaacctcagtttgaaagttgtacctgagaacattcagaccctagtttatatttcaaataaaagttgggctattaaatatgttaaaaaaaaaaaaa

SEQ ID NO: 3134 - DNA, 331 bp, Homo sapiens
ggatatgcttgaaagagaattaacagcaagaggaaaccctagtggatgaaattgaaaaaacaaaatcaagaatgtctgaagttaatgaagaattgaatcttattagaagtgaattgcagaatgctgggattgatacccatgagggaaaacgtcagcaaaagagagcagaggttctggaacaccttaaaagactgtacccagattctgtggtaatgagaatgaatagttaatttaaacaaaaaaactaagctttcctgtttgctttcaacagtatcttctcatttgggattagaaatattaccattattacaaagcaatattatttcagacc

SEQ ID NO: 3135 - DNA, 885 bp, Homo sapiens
cagacacacgcccacataatgcagacatttcagtcactggcgcctacaagtgcttgcaagagatgtcgactcagtgctcacgttctgaatgcactggcttggagccctttcccagctgatgcaacgtctccccctgggaatctctgggaagccccgagagtgtctgctggttgtccaccgaacatcttctgcattccattaggcattgtggtctctgggggacactataccttctctaagggagctctgtcctccctagggttatgaactcttgattgacctctctctattgtctctagccctagttcttccactcccaaatagcttctcagtgtccctctcccatgcaaatcacttgagcaaatatatgcccccaaagcaagtgtttagaataccaagtctcagctgggagtggtgagagatgcctattatcccagctccttgggtggctaaggcaggaggatcacttaaacccacaagtttgagaccagcctggtgcaacatagcaagaccctgtctcaataaaaataaagattaagaattaaagaaaataaataaattcaaccataacttaaaacaaagaatatcaagtccttaatctaaacttattctcaataggatcaccctatttctctcttgttccttctctctctcccacatacatcctttcctttccccccaatcacaagattgagcttaaactatatattgttttgcagcctacttttcttcattttaaattagatcatgaacattatgtcattatatcctctgtaaaactatgattcttaatgactgtatactattccaatgcttgaatgtaatattaaccaatacataatagaatagaataaatagaatattagccaaaaaaaaaaaaaaaaa

SEQ ID NO: 3136 - DNA, 428 bp, Homo sapiens
aaataaatactagttgtaattaaaaaaaaacaaaatatataaattattaatagcctacgacggcggaactcagacctcattggcatgccagctgctccaagaggaacacggccccttgcatactaatcaggtgaggaggcagtgattcatcagcccatgatactactccagcatctacaagcacttatgacatgttattggtggtgcataagcaagccaggccacattaaaaaccctacagatagtcagagataaaaattaaagacttttgctttgtgtaatcctgcatgcattggtgggaaagcggagaaggggggagttgggattaatgggcaaatctaagtaggcaccaaggaacaaaggctttcccggccttgtttacatatcgaacaataaaaaacacaagtgacaagttaaaaaaaaaaaaa

SEQ ID NO: 3137 - DNA, 153 bp, Homo sapiens
ctagattccattgatagacacctgggaacactcctgaacattcctgaaaatttgaagaaacaagtattagatcaatttatgcagtgttgtaattatgtaagtttgctatttatgtggattaaaaaacagcagctatttctaaaaaaaaaaaaa

SEQ ID NO: 3138 - DNA, 246 bp, Homo sapiens
ttagggtacagggtgcagtccataaatgacagatcatcaatcgcaatatctccagtgaagccatctcccactgaagcctccaccaatatctaaaaaaataaaataaaaaataaaaataagaaatgtgtttatgtggtaaaggaaattaagttatggaatggatgaagaggaatttaaaatgtacccaaatataaccttctgtgccattaaaaaactcctttgcagtagtctccaaaaaaaaaaaaa

SEQ ID NO: 3139 - DNA, 390 bp, Homo sapiens
tttatttataaagaagagcaacaaacgcccgcttaggaagaacgtgtgataaccttgattctcaaggccaatgccaagtgatgacagacgcagccactggagtgatacagccataagcccaggaacactaaggatccacaaccaccatcagaagccatgaagatgcaagaaaggattctcccctacatgttttggaggaagcggggttttgcggccacatttatttcagacttctagcttccacaattataagaattaatttctgttgtttgattttcttaactatgtaatatttttactattattcttagaaaaattcttaaggagacatgttttttaattgtggtaaagtatatataaaatttactatcataaccaaaaaaaaaaaaa

SEQ ID NO: 3140 - DNA, 942 bp, Homo sapiens
ctagatgggcaagaccctggagataggaaaagaaggtgaggatagaaggggccagtagggattgaagattaaaaatgtggcaaagcacacatctcaacccagtgctgtcagagagtctgcccacagctcgtcttgaaagaagcacacgcttccagacacagactttcagtccccatggaagagaagcacagtcaaccaaggccacagacttcaggtgagagacctgatgtctaagaagttaggagaggcagtaactgcgactcctgcctgatcctaagcatctgtggagctacatgtttattctttggcctgacttcattgccaattttctccttcccagggtcttgttagaaactactctaggtctgacccacaaaattctaccttctccggagatcagcagatcttgtcattaaatacagagcctgctcttcagcttttcctgcgttctggctgcaagagatgaaagaatatttctatcttagttcctgactgtgctgctaccaactcccctgttgccagtcagcatctttccctcagcccctccttctgtgtccaggaggatgcccagtgccagctcaggctttgctccttgtcgtggttttctctgggacccaggaatgctcacattcaggtctctttcatgccatccccatgcacacatcacagagaatagatgttgcccagtgatgcttctggaagtggacaatgtgttcatcagcaggtgaaccaagaagaggagaaaagatggcaagtctttctagcaacaaggaagtgacaatttcaccacatatagagaggcagcacaaggacgtgtgcgctactgcaatcgtgggctatggcaggggctttcagggccaactctttctccccagtctggtttctgaacttctgtgcttctccataagccagtcctcccattaaaacttcccgtgcgtaccc

SEQ ID NO: 3141 - DNA, 390 bp, Homo sapiens
cgtgtacgcttccacttctgccatgattaaaagtttctcaaggcctccacagcgatgcttcctgtacagcctgcagaactaaccatgtggtgatgttcatctttctgacaaccaagaaccttggaagaatctctcgcctcaggcgctcctatttttgtgcctagctcggccgccttccaaatcaccagaggcatcatagaatgcaactgtctgtggagggttggaggacgaattggacacaaattcattggacggctgaaggaaaaaagaaaggtcaaggatgctccagcttggccagcctcgcaggcctgacagcagaagctggaattctttcttttataacttgggcttgaattaaaggcatttttttttagtccaaaaaaaaaaaaa

SEQ ID NO: 3142 - DNA, 251 bp, Homo sapiens
cgctggcggcgagggcaggggaggagagggaggtcttcgagagagcataaccccatctaacttcaacgaaacataccaaaaataccaaatgaggaagattctacaaaatgtgtgaccgctgatgatgccaaggaaatcaagaaaaggaacaccacacaccctccctccccccacgaccccaacaacacaacccccacactcaccccgccacaatcgtcacgactaaccaacttataaataaaaaaaaacaa

SEQ ID NO: 3143 - DNA, 636 bp, Homo sapiens
cgaccagggtctgattttgttgcccaggcttaaaaccagggcgtgatcatgggtcacacttctgcctctggactcaagccatcctcccacgtcagccttggagtagctgggaccacagggcatgtgccaccaaatccagctaatatttttatttttgtccaaatggggtttgtcatctttcccaggcaggtctcaaactccaagactcaagcaatccacctgccttgaattcccaaagtactgagtttacaggtgacagccactacgcccagcaactacacttctaaacatcaattttacataaaattatctaagcgtgcaaggaaagataagaagcctaaggaaccagtgagttgaagaataaatgcagtttaaatcatacatgtaaacaacatgatgtgatgtggtaggaatcatctaacatgctttaaagcatgagtaaaaggtcttttcttagaaaactggatcttagtttcagatatctttagataagagtatgaaaagtcatatcatattgataattaaagtgcttcctttggctaattccaaggataggacatttactgtcatataattcataggaatcttagagttaaaaataaaatttccgttctcaaataaaaaaaaaaaaaaaaa

SEQ ID NO: 3144 - DNA, 634 bp, Homo sapiens
aagaggcgagtgctgggtgcctctagtcaaccatgttgatgacgtcctttctagaaaacaccctgataccttgtgcctgtgcttccaaggtggctgacgctgtgcctgtgcttccgaggtggctgacttctaactgagtgcagtggagaccccatggtgctttacagaacagatggcagtgctgcccaagctcagaacacagctggacggatccccatttttaaaatgttgcttttaaagttccttggtctattttaagtcttagacaatagagcactaatttgtgtccacagctagggaaaaagcaccccaaatactcatgttatgtcactttcagtaccacaattcaaatagtgaaagacgatgcttccatgtaccacgtataggtctctactagtgatttttctctcatttcaacctagcttcacatatttttatggtatagctaactcaacattgattctatacaaaatatattatctaagatagtctttaaaaatatttgaattccactgggatttgtttaaacccctacacaaataattacctcttactaaaaaccactgggtttgggcaagtgaaattttgtaataaaggggagattcattaaaatcttgtctcaaaaaaaaaaaaa

SEQ ID NO: 3145 - DNA, 271 bp, Homo sapiens
ctcaggggacgaacagaggcccttagagtaacaaccatttcaggaagaacaaccagtggactgtttttagtgccagagtcaagacgacgtcttctgattccacctgatacttattccatatacaaatagcaagaacaatgtcttaatacttttgattctcttacccagcaaagggtccttagtagacgtgagcaagaacatgtctatttcaataaacaaacaagtaaacaaataaaatctatcatgttatgaaacaataaaaaaaaaaaaa

SEQ ID NO: 3146 - DNA, 443 bp, Homo sapiens
atggagtctcactcttgtctccccagctggagtgcagtggtgcgatctcggctcactgcaacctccgcctcccaggttcaagtgattctcctgtctcggcctctccagtagctgggattacaggaaggcgaccagcaggaggtaaacatgcccttgggacgtgctagggcaggcgatgtcttcacttctgagcactcaccctggcggtccacacttaacaggagttggcccagagagacgccacgcaatccatgcaaatcccctctcaggctcagtgagatgcatttggaaaaggtgaaaaagatgtgcctcagagaatcagagaagcaaaaagagtgactgctagaagactgttgtaaaatgagtgggtaaagccctgttggaaatggaagaagataagcaaataaaaacaaatcctcctattgcaaaaaaaaaaaaaaaaa

SEQ ID NO: 3147 - DNA, 257 bp, Homo sapiens
cttcagatagctcattgtcagtgtatgaaaaacctactgattttttacgttgattttacatactgcaactttattgaattctcaacaaatggtgttgaaaaaactggatgtcctcatgaagaagaatgaaattgaacacatcacatcccatatacaagaatcaactcaaagtgggttgaagacttaaatataagatctgaaactataaaactattagaaataaaaaacgtaagaggaaagctccaaaaaaaaaaaaa

SEQ ID NO: 3148 - DNA, 705 bp, Homo sapiens
agattggctccattctccacagacaaagtggatgtggcaaccccagaccttccaacctttcagctgcaagttcaacaggaataaagacttcttcccagtggtttcttcaaaagccctcagattagctgtttgcctagcttgtcacatgccaccccagaaccaatccctatggccagagaaatgtagcgtattgattggtttagccctaggtcacatgacccacctctggaaaagggctcaatcctcactcaaactgctttggctgaaggcttggaagagatggagccaaggaaagtagacactggggatgcaaaaataaaagttcaataagtatgcctttaaatacggaccagatactgaatattaaaaaccagcacattctgaaaagaagaaatataagcaaaagaaaaaaaagtgggaaatatgagatagtatttagaattagtaagctatccaactaaggtcaagttcaagaatattttaagagttacttaaatatatagagatagctaggcatggtaacttgtgcctgtaattccagctgctctggaagccaaggtgggaggattgtcttaagcccgggacttcaatgctgcagtgagctgtgatttcacccttgcattccagcctgtgaaataaaggagaccccatctctaagaaaaagaaaaagaaataaatatataaaattaaaaaaaaaaaaaaaaa

SEQ ID NO: 3149 - DNA, 1047 bp, Homo sapiens
ttctgatcgcatcacggggatgctttgagctctaacttctggttggctgaagcaatgacagccgacagcaggacatcagaaaggggatgaagaatggagcttgaagggtattcctgtagccccttcctggctggatcacaacaggctggctaggttgccttatcaaactgaaaccgcctttgcaaaattatcactgagacggtgaaagagttttaacttaaccgactccatcttgcttctaacctccttgttcgttcagcataggctgaactaactttgagagaaacttatagtttaaaacaaagatgataacagccctttcccaaagcacacctccttcttgcctggggactagattccctttgtaggactaacattagctacaagattagaaattatgggttaagagtcacgcaactggaggcttcaagatttccttcaaatatctcagcgcttgaaaaattctccaaacccctgaattgccggatcagctggcgccacccagatggataaactggttaatctgatcttgtggctcccacccaggaagtgactcagcacaagaagacagcttcaactccctatgatttcatttccgtcctgaccaatcagcactcccgggtcactggcttcccccaacccaccaatttatccttaaagattctgctcctggctgggcgtggtgactcgcacctgtaatcccagcacttttggaggttgaggtgggtggatcacccgaggtcaggagttcgagaccagcctgaccaacatagtgaaaccccgtctctattaaaaatacaaaattagccgggcgtggtggcacatgcctgtaatctcagctacttggtaggctgaggcaggagaatcacttgaacccaggaggcagaggttgcagtgagccaagacagcgccactgcactccagcctgggtgacagagcaagactctgaaaaaaaaacacaaacaaaaaaaaactctgctccccaaatgcttggggagactgatttgagtaataataaaactgtctcccgcaaaaaaaaaaaaaaaa

SEQ ID NO: 3150 - DNA, 654 bp, Homo sapiens
atcacttgtcccaactacctgcttctggctttgttttgcctaaagctgtgaaaaatattattcaaacacaagatggcgaactgaagaatgaaaaatcaacatgtatcaaatgatgaaggggaaagatggaagaagcctgggttcttgatggcatcattgaaccctccatgcaaggccagcaaccaagctgtcattaactaaagctagatgcattattatgttcaaggaatgaacccttatctgattaaattactgccatctaggttttctgttacctgcagatgagccatcctgatgctcaatatcatagaattattctgaaagttaaatgaaataatgcatgcataattgcttaaataactacagatatactgtttaaagaggtaacacagggcaatggaaaaggcattggacttgaactctgactaatttagcctggaatcctagaaagtcaccttattagaccttcttcataggaaaatgtaaacaatctctgtgtgtcagttgtgtcatctctaaaatggaaataattagcatcttggaggattgttgtaaagggtaagggagataagatatgggaaagctcatggcatagggcttgatacatgttattcaataaacataagttagggagaaaaaaaaaaaaaaaaaaaa

SEQ ID NO: 3151 - DNA, 759 bp, Homo sapiens
gttaaaattaataccttcagtgtttttttccagttagtattgcatattttttatcatatgcaaaaggaactaccatgagaagaatctgatggtggaaaaaattcaaaagacaaaatctcaaatgatacaaagaagaagagctatagacgaggaacaaacaattccaggagagccttgttttcaagcagctccctttcaaaatgctactctatttcctcactggacattaccaaagctactagaacagggcaccacaccaagttgaagcaagcattccacaatgtttagcgccacgtcacagatacgagagctgatgtcatgattaaggacaagataaacagccttcagaactacctgaggaaaacaagataaacacagcatgattaagttacctgcactccctcttcctaaagagatctgattattctgtttaacccatttccttaggctagtctatgaaattgggtacaaataatttagacaactgtcaaattttcctataaaagctgctgtggaatcttgtgcatttacttaatagagcgcgcaagggccccaaagcattacaaatatatacatgcgttatctcatgagcatcttccagaacatgctatgatatcagcagcgactggggatcttgcacgcaccgagggaatgagacagacactatcgggccgcggggaaactggggctatgcatagtcacgaacagacacgatcgaaagccgctgcacgaccgaccccacacgcgcgctccgtgaaa

SEQ ID NO: 3152 - DNA, 427 bp, Homo sapiens
acccctgccttcaccatgagaacaaccctgaactggtttattggaggatgagagaccatgtggagcatagctgaatcattaaagctgcagccatcacaaaccagccaactcttgccccttgtcacacagaactaccagctgaccacagatgcatgagcaagcccagccccgatcaacagaacttcccatgcagccctgcagtcatgagaaataataaatgattaatgtcttaagcaactaaacattgagctggtatgttacacagccatactaactgatgtagagtacttgttacattattctctaaacttttcaatatttttccagttattgaagatgaaaaagaaagagagagcacacacgtggaacagaaagaaaaattaaagccacattggtggaagtttcaaaacccaaaaaaaaaaaaaaa

SEQ ID NO: 3153 - DNA, 574 bp, Homo sapiens
ttctagatgacgaactaaggatctatgcccaagtcaactgcacaagatgttataatatgttcggcttaacttggaaccattgcagtattacctcagtcaactttctttactataattgaaagtgaatgattaccggctttttagctaacatcaaaaaagattcattccaatctagaagactgcctgcaagcaatgcgaacacgtgtgtctagtttcttggcagggtctcccagtttcccctgtcttttttctttctcctgatgcaaaatcacagaatgctttgacagctctgtgacccagccaactttagatttttcccagtaagcttcaaacaaaaccgagatctcaaacattcccaggcactgataaagttatctaggtttttgcccaaagcactgaaagaaactggccttggccctgagccaaatttcttaaaccttcctgaatatgccataactggacctccctcactagagctgtatttaggtagaacgtgcatttctctcgctgtcttctagaggattgctgcagactgcgtaataaatgctttggtgtggtcaaaaaaaaaaaaaaa

SEQ ID NO: 3154 - DNA, 450 bp, Homo sapiens
cctaggaacactaacaccgatcccttacctgatgtatgtggagctgaatagcataaggtgtgaattctgtggtgttcacctagatcacactttaaaaccgaaggactaaatttctcatctcaagagtgttggtaacatatctctaagctgagtccctctccggcacttgtccttggtgttaaaaagctgcattgctcaaggttacccccttcgctgggagagcctgggacaacttgatatggggatatgaaagctgtgcccctcacctcaatttgaaacaactatgaaggtccattccaggtgctaatcctgaaggtgcctcaaaatactcctgcaagcaaacctccccctcagagtctactccctgggaaactcaaccttgtaacatccttaggtttagaataatattgcagctaataaatcttgttgtttttactaaaaaaaaaaaaa

SEQ ID NO: 3155 - DNA, 903 bp, Homo sapiens
  misc_feature (1)...(903): n = A,T,C or G
cctacaagaaacatcactctctcctttctcttcctcctcatcctactcatcatgaagatgacaaggacgaagaccttcatgatggtccacttcacttaatgaatagtaaatagtaaattttctcttcctcatgatgtttgaaataatattttcttttctctagcttattttattgtaacaatacagtatactatacacacacaacccctgcgctaaacgactgnncacgccaccgggaaggctnatggccaacagagggcnccnaacagccacaccgcggnggagtctaaagttatatacagggtctcgactgtctgggggtttggtgcccctaatctctgcattgctcaagggacaaccacagtgttatttctgttagacatgtggcagcaccctatgctggtattgtgacttgccatctttttaaactcccttggaactgaaggataaccctctgataactctagggaacccccagtaagcgcaaccaaaaaggggacccggatcgctaagaaaattacatccttatccatgaaaaaaaaaaacacaatggcctccgtagccctagcggggaaccctggagccccttccccctaagagggggtatatcatggaacacccctcaccgactccctgccctcgcgcgatagggcgccgcgaagcgcgataacccactccaagggcgggccccgggtctccaacgaaccgggggtaacccggggaagaacacggggcaaaaggctcccaagggcgcaaacccccaaaagggccctcaactgcgaattttcaagagtcccccccctgagagggaccacaaatagaccctccataggaggggggacacccgccgcagtataaacacacggtgttccccgagagacccccgccgaccccatgacaaaa

SEQ ID NO: 3156 - DNA, 862 bp, Homo sapiens
cgtgacctcctgaattggatgaagaaatatcttgtctggaagagaaactgaaaacaggaatactcagaaagactgaaaataagaggacggagaaaatatgtcaagcattttctaaaattcaacgagtactgacagacaggtgtcaacaccgcaacagagctgggtcaaggtctggacgtataatagaacagctatcagaagcacacgtaggaggaaggatgtatccactgtccgaaggagacacctggtaggccagttcactgggcccacgaccctacgtgtggacagcttcaccttcttcctagctgtcggattggaagactcctagccctatcaacagtggccttaaagatttattcttatatacaatgttcatggggttccccgacgcgcaatcgttctggtttaccgcccaagattctaatccccccccgctatcaacccccccctccttatccgtgattcgcctattcctttgagcccattcctagccatgccccaataagttccccaactatgagtgccccccgccaccacccccccctcgtgtattccccgtcgcccaccccctcctaatgtatcatatcctattagacctcatcttttaactcccaacacttgattatatctccagattactcccccccctccaccccctccgtaccatgcttctataatcccccctccccttctttttgttttgttttgtctctccccatcttcagtcttatttttccttcttttcctcatctgtctcttctgctctattcttcttattgaactctaccccgtcgtcgccccccccgcttctttcctatgattcccttgtctcttctatttcttcttatcctctcacatatgg

SEQ ID NO: 3157 - DNA, 772 bp, Homo sapiens
tggattaacattttcaaaacttcgatgaatggggaattccacttgtggcatgcttgaataacagtgtaaaagttgcctcacccctgcaagcaattagaaaataaggcaaaactgaaactactgttttcaaacaacaggctcccaggactgccataatcaagagagaagagaaagtaatgaagtcagttctgtgatggtcctggctttctatgtgaaggaacttttcatattgtgctcaaattgggggaactcaaacttagcacggtagtctctgagttgaagagatagggatcataggaaagggaggctgatggagctggtatttaaaagaaagagtactggaaataaaaagactacatagaaaaagagctacagtaactggtatggtttggctctgtgtccccacctaaatctcatgttgaacggtaattcccaattacagttgggaattgatggggacttggtgggaggtgattggatcatgtgggcagatttcccccttgctgttctcgtggtagcgagtgagttctcacaagctgtgtttgtttaaaagtatgtagcaatttccccccttagctttctctcttctgtcaccacgtgaagacatgatttggtctccattcagccttctgccatgattgtcagtctcctgaggcctccccagtcatgcttcctgttcaacctgcagaactgtgagtcaattaaaccttttttcggttaaattaaaaaaaaacgcacaaacgacacaaattctctacctgggcctcgtcgg

SEQ ID NO: 3158 - DNA, 970 bp, Homo sapiens
tttctagatatcagcctctgccatcagatgtactcaagcaagaccagaatttagatctgaagcaaatgggagagaatggcacgagacatctagtttgctaactagaaattgtggcagagacaacaaggatcctgaaactggggtccttcatagcagcttcccagttaaacagacagcttcctggtcatggcaacaacagctgctcccttggcagctcacttcaggagtgtagcttttgtactggtccttgaaagttcaacctagcatctgtttcttgagcaatcccaaagattcagcaagccatttaacatcctgtgataaatcttgttctgcttaaacttggttctattctctgtaactaacttcaacaaatatttgttctaactgttccagtttgggcaaaaaaaatgaccatgttgtaaagagctggttgatgaatagcatgtgtaggtacaaaaatacagtaaaacgtacctccttgttaaattgtgaaatattaaacttcacagcattcttatcatatccaatgtctccctatcctttttataaaagagaaattctatctctcaaacatatcattcagtacgggaatatcattggttaaaagaataaatactatgtgtacacagttttttgatgtttctaaaacatttgcttgattaatttaaaaagtatagagtaattaattctgctcaggaaatattcatttggcagaagtgggtctcaattttattcaagatgctctttgatatattatattaatttagctgttgtattgatgataaaattcactgagaaaatgctatgatgctattgatatgatgaaggttttctttatggagcctattttcagagtttgttcaacaacttaaataaagttatttttcccataggaaaagtacaacaacccccttacaccattcatggtagcaaaaatataccattattttatttaaaaaaaaaaaaaaaa

SEQ ID NO: 3159 - DNA, 836 bp, Homo sapiens
  misc_feature (1)...(836): n = A,T,C or G
tttttttttttttttttctttttttttttttttttttttttttttttttttttttttttttttttttttttttttttttttttttttttttttttttttaatttttttttttttgggggaaaaaaaagggggaaagggggggcccccccccttttttaaaaaaaaaaaaggcttaaggcccaaaaaacacacttttttccccctttaaaaatttttttaaaaaaattttttagcccccccaaggggggggtttttttggggcaaaaaactttgggggggaaaaaccaccccccaaaagggggttttttgtttttggaaaaaaataattccccccccttggggtttataaaaaaaacgggggggaattttttgggcccaaaacccaaaaaaaccggggccaaattttttgggataaaaaacccccccttggggccgtgggggggaaaaaattctccctggggaaaaattttggttaaaacaaagggggggggcagggggggtcaccagcggggggaaaaaccccctggggaaaaaacaaaaattcggggcgggggggggggtctaaaaaaaaacccccaccttgggggtccaaaacaaaaattttgtggggccccgggttatagccctttaggacaataaaagcccccccctttttaaaaaaaaaaagtttcggcccttgagggccggggagaaccgaaattccccggcccccccggcgnaccacccagtaaggaatatgctggcgacgggacgacgggtgccgggtggcggagaaggggagattgcggggcccaagcgagtgtaggggcgcccacgccgcgacaaaaagaaaacgg

SEQ ID NO: 3160 - DNA, 764 bp, Homo sapiens
ttttttttttttttttgttactttgttgtgactacataagtgctttccagtgttgagtgatctgcactggaatgtgtggctgccttttgtatttacttttgttgtcagttttacctagagttagtaattgcctcattttttcctttgtttaattttctttgaatgtctaagtcttctaatatccccaaacagttctgtaaaatatctctcattacagtgttctgtgtggtcaaacagtcagataatttaccagctcctttttcattcctcctccttggagccctttgcttcctgccccagcatgcactgtgctctctgggcataaggcacagctgtcactctgggaatgtccattgcctctcttctctgtttcctaaatccattttctcttcttggtttattcctttgttttggaggagtatatcctttagtgacttcttgagaaaggttacttgtaaaatgaattctttagagtttgcgtatctgggtagatagcttgcatagactagttcagtgcaggaggatcaaacaagttagccggatttttcactgaggccctctcacatatcattctgcataagtcttttttcttttttctgaaagacaattttgtctcttcagagaagaattctcagtttcctgtcaggggaatgcaccctgatgctgattccgggttgaggaactagtgatcatatacagattttcaccagtgtcttattttaacagggatcttttgttgccctctttttaccgctggcctgatc

SEQ ID NO: 3161 - DNA, 771 bp, Homo sapiens
agaaagtcctcttctgaaccctcattgccaaatatctgcatgttgttatggagctgtctcagcacggggtctttgacgcctgtatcctcacacccttagaagatcctgagaaaggaagataacgtgagaaacttcaatgtcttcctgccataagcaatgtcttcctgcaatcagcttccaactgtatgcatccaaaggtggtagaatttgttagctcttttttccttctcagcaaattttagttacaagctggagcataattttcttagcttttatgaagtccttcagaactataggtgttgaaacaaagtgctgaagatattcttcattggaaaacaatttctaacccactccagtttcaagaggagccctgggaaacacacaaaagactgaaaattcccttattcacctgccaatttctccatttactaaggaggtaacctggagaaaatggtttgagtctttgtgctcagttcctactcggaattcaagttggagagaacaatgttgattacatttctagcagcagcaaatacaatgggaagtaaagctcttttggtatgtgtcagggtaatttttatcataaacaaattgggttgtcacacattagtcatacgtaagtattagatccataataatgtgttcattctccaactttgacatttaccatttaagtttagaatagagatttttcaaccatagctgcacattaaaaagatctgggggatttttaaagcaatagttaagccacacacaatctcagagattctg

SEQ ID NO: 3162 - DNA, 888 bp, Homo sapiens
  misc_feature (1)...(888): n = A,T,C or G
agctacagaaacgaagatttttgctgcaagcatctcacaggatctgaatgttccaatgatcaactgtgattctgctgtctgcacactgagaggtcattgctttggacctggtatcatgaaggctctcttgaagttatcttcagttcatctgcttgttgctgtgactttgtttggatatgcagaatcaagagtattactgtactcttgattggcttcacatcaaaattaaagcaatgacagttgatgatttgtatgtgctttctgatgaggtgtttctgagaagtgggtgtcctgtaaccaaagtgtggcaagatttgtatacgtttttgtactctacaagtgacggtggcatcatatatcagggtaaaagggtaggttatttttagatctatgctaatattcacctctagaacattaccaaggcgaggattcatatgtatcacatgcgctgttgagtgagatgggtcttcatggcaacgtgcaatttcatttatccatccaaggcaggccaaatcactggcttcgtccacttaccaagactactgctgaaacactatcaagtgcttgaaatcatgtttcacagcttaaaatgtatttttcttaattatccaccaagattgatggggtcaaggaagtaccctacattggatcactgcacattctatgcctcatttttcctcaatgagaaacaaaaggcgagctattgtacgggaaatacaaagcaaccgccgctgcctgaggacttaaaaacaaaaagcctaactatagcaatctcgacattggaggagtcttactggaccctgggtcagnttaatacgcaccttatgaagccacctttctttttcaaccgctttcgaaaccttcaactatttggcatcactccacccc

SEQ ID NO: 3163 - DNA, 172 bp, Homo sapiens
cttcagatctcggatagatgcctcacatagaatagaatactactatgtcaccacattccaagatgtctcatcatttgtattatttgtgccatgtgtatttatttattggaatacttagcatattttaaataaaagcttaaaaggaagtttgacactagtaaaaaaaaaaaaa

SEQ ID NO: 3164 - DNA, 976 bp, Homo sapiens
aagaaggccgcccccactggcgcctgcagaaaagagtcagctcccctctaacaattctgttgtgaaatttcggcgaggggaaagatccaagttatatcacatatgtaacccgaaggtggagtctcgctctgtcatccaggctggagtgcagtggggtgatctcagctgactgtaacctctgcctctcaggtgtcaggcctctgagcccaagctaagccatcatatccctgtgacctgcacgtatacatccagatggtcttaatcatatgaagaatcacaaaggaagtgaaaatggccagttactgccttaactgatgacattaccttgtgaaattccttttgctggctcagaagctcccccacttagcatcttgtgactcccacccctgcccgccgctgaccaacacgctttgactgtgattctccatcagctgcgcagattcttcacattggtcccccgccgatcttattgcgctagctctcgttcaaaactgagcttgcctcgaccgcagagaagtaaactcactcacgtatcaacacgcagaacacaaccgggcccgatatcaatacccgcagtaactctacggcgagtgtcttggaggctgcgatagcatctacaacctgcatagctcatcatgcgaggatcgctcaagagtggggggtgagagtgcgtcaatagcgccggcacgcccgccactggtggagtacatgctagcgcctcgatccgcgcatgaagatatgtgagatgagcaagtatatggactggccgtgacgcttgatcctgacgcagcggtagcacttcactcccgacccaacccaccagcttagtgtcgtagtgactcactagtcataacggacgctgtgccacccacggcgcatacggtcggcgacgtcgtgcacgtctacccacgtcgggctggcgaagcgcgtgcagaccgacaggctttagtagataccgactctgtggaggcgacac

SEQ ID NO: 3165 - DNA, 750 bp, Homo sapiens
ttttttttttttttttctttgtcatagtctttatttcctttatagcacatatcaccctctgtaattatctgtttactttttatatttcccaccacattttatatttcataagaacagggaccttgactcttttgttcattactctacccttaaagcttggcacctgtaaatataaaatgaatgtatggctaccagaaacatcttcccacagtaaaaatctttccaggccagatggtggtagagctttgaagatctcactttggtggaatttcaagcaggaccatggcctggcagaaatagtaatctgagttaagaaatctaagctgcatgaacccgggtaggccctttcccagggccccagtttctgtgtccatcaaagaagctggagaataactcggaatgtatacagtgcaatgctatttgccaagctctttcactgcctgttatttcaatctgttctcatggtaggcagagcaaacattgtcattcccatttttatggaggttcagaatgtttaagtaagctagataagatcacttctgtttcaacattctgagtctttacaagtagcctctacaaaaagtcagtaacatgaatcctatcttttctttactttgactgaaaatggcctttcctaaacaattggaaaaatcctgaccatcttttaagggaatccattgtttcctgtagggcctccattttgcttctcagctttcacacttggggcaagcaagccggaaggaggaccat

SEQ ID NO: 3166 - DNA, 743 bp, Homo sapiens
agactcccaatcctcttccactctttaccagagattgtcagcttactctaacagagtgtgatgactctgggtgaacaattaaaggtgaaatcaagaaatgctgccttgagatcattctgctttccctctgcccaacataaacttacttgatacttaggactttctctggagctttatgctgaccttggatcaccacatgcaattaggtcagtgtattaaaaataagatctgccttttcagatttaaaatcaggccagcactttggtgcctatgcttctatttcttgttgcagaggataatgatactgaagaatttgatatcctttccgatgaaacgcagctctcttctacccatattcattgttctgctgaaggagaagcctctgtttcatgagtggaagtgtcggggagtcactcatagtctctagcgccagaccaaaaggtcaaaatgaggtttgaccttggacaagttacttcctctctgtgtacctcagtttatttttgctaaatgggatgacgggacacatgtcatagggttgttataaagatgaaatgagccaacccacttaagcactcttacagtgtctagcattgtttaacccaaactgttattattcttgtcatagttgttatacctgacttgacacttaaaaagttgtgtgactttggatcccctgagctttcattgctttattcctataataagaatgaaaccgtacttttaaataattactttggaatatt

SEQ ID NO: 3167 - DNA, 1159 bp, Homo sapiens
gtagaagtcccaatcctcttccactctttaccagagattgtcagcttactctaacagagtgtgatgactctgggtgaacaattaaaggtgaaatcaagaaatgctgccttgagatcattctgctttccctctgcccaacataaacttacttgatacttaggactttctctggagctttatgctgaccttggatcaccacatgcaattagaggataatgatactgaagaatttgatatcctttccgatgaaacgcagctctcttctacccatattcattgttctgctgaaggagaagcctctgtttcatgagtgaaagtgtcggggagtcactcatagtctctagcgccagaccaaaaggtcaaaatgaggtttgaccttggacaagttacttcctctctgtgtgcctcagtttatttttgctaaatgggatgacgggacacatgtcatagggttgttataaagatgaaatgagccaacccacttaagcactcttacagtgtctagcattgtttaacccaaactgttattattcttgtcatagttgttatccctgccttgacacttaaagagttgtgtgactttggatcccctgagctttcattgctttatttctataataagaatgaaaccctacttttcaataattacttggaataataaaatctatattgaatgtgtacttctctggctgaactaaagaacaaataatcatgtgtgaataaacaggacaaaaacactttaatttggcctcttcaaaagtgagcggagagacttggatactcccagagcaatccccgttaggtttattctaccactggaaagaatagatacttctctcattgtataaaaaatgtgtttcatttgtgtttataacaatctcaacattggttcagcagatcaaagattgagcaggttttgttttaacatttttctatgtggctaagctgggagatagaaatgtgtccatttcatctggcatttaaaaatgggaacaatgggaacttgatataaaatgactgttaacttgaaaactaaaactgtcactattgttttaaaattatttcaaagatttctatgaaaaatgtccaattattatttcctaaatttttttgtttataataaaaagacaaatgcatttttataaaaaaaaaaaaaaaa

SEQ ID NO: 3168 - DNA, 229 bp, Homo sapiens
ttttttttttttttttttgggtgaaatcttcccgatttagttgtaggacagaattagacacaaaccaggaaatctccagaaggtgctcaggagatgctgatagaacgaaaccctgaagctccttctgtgaggttctccagcacttcaatattattagcaggaaattcttccgaaagtcaacaccaaattccttctgcagcgattttagcacattctctcccttccgact

SEQ ID NO: 3169 - DNA, 925 bp, Homo sapiens
  misc_feature (1)...(925): n = A,T,C or G
cttcaggagtacgtttaaatttatggtggaganaagttatctgatgacttacagatgctttcatattttaccttggtttacgtgttcttcaaattatacttggaacaataacagacaagtagataactgcctattactactttagaacatcaaaagagagcagtataaaatatttttggaagcaatcgatccactgacagatgaatggataaagaaaatgtggtgtatacacgcaagagaatactattctgcctttaaaaaagaaagaaattctgccatttgtaacaacatgagtgaacttggtacatcatgccaagcgagataaaatagacaaatactacataattccacttctataagaaatctaaaatagtcaaattcacagaagcagagaataaaatggtggttgccagaggcttgggggaggaggaaacaaggatgtattagacaaagtgtacaaagcttcagtcatgcaagatgaataagtcctagagatctactatagagcataatgtgtatattcaataattctgcatcacacacctgaaaacttcctgaagggcagatcttatgttgtgttcttatcaccaaataacaataagtaaagaagataggtataaaattttggaggtgatgaatatgtttatggcatagactgtggtgaccatttgttttatgaatgtacacttatctccaaactcatcaagttgcatacattaaatatgtacagcattttgtatgtcaatcttgcctcaataaagtgctttaaaacaatatatacatatatgtatgtgtatatatatgtatgtatatatatgtatgtgtgtgtgcatatatatgtgcgtgtgtatatatatacataatcgcctacgctatgtcacaaataaaagttgagcttttggaaattgaaaaaaaaaaaaaaaaa

SEQ ID NO: 3170 - DNA, 593 bp, Homo sapiens
cttcacttctctgcctgtcacccttactgagtgtagcagcgcgttcatggatcactgcagcctcaacctcctgggctcaagtgatccttctgcctcagcttcctgtgtagcttggactacaggttgcatatttttctggttgctcttgtgccttggatcatattctgccctccaccaggaatgttttaaaactccatctgcgcatattcacatcttgctcatccttcaaagaccaaaaattctccctcttttttccacataaaagaaaccttccccacttctactgtcctacataattatatctgcacttttttgtgtaaggtcacctataactttcttcctggagtctagctatttttgaatagactcatctcctgtactggattgtgaacagcttgagggcaggcttgctattctaattcatctctgtgttttcaggagctagcaaaaatattgcacctaatggatgaataacatgtttatgtatttgcaaaaatcatcttattaataggtattgcaactgattaaaaataattttccacaagaaacaaaaaaaaaaatgggctcctttggccctaacaggggaagcctgc

SEQ ID NO: 3171 - DNA, 636 bp, Homo sapiens
gtggattggaacaatttggaaaaagaaaatgttggatccctacctgaccctttacacagcggttcttgagtctggttgtacatctcaagtcacttgcagaaattcagaaacaatacagtgaccacaccccaccctcagagattctcgacaaattagtctgggatggaatctaggcatgaatattttttttctcatgtgattctaatgcatagcctggataagaactattgttttatataaaaataaattccaagtagattaaagattgattgtaacaattgaagccatggcattagtgtatacagatgccagtgaagatggaatcttgggtactgaagaaaaccaaacgcaggaaccccagaggaaaatattcacatacttgattatatgaaagctttaaatttctgtatgccaaaacaatcatataaaaaactgaaaagcaaatcacaaagcaggaaaaatattttcaatatgcattgtaggcacagttcttagcaagtgtaaagaaaaagatgaagaactaacagaaaaggccaagcatacgcaaataacccagaaaaaagtcattatatataaggagataaaaagcatttccttttcaaataaaaaataagctgatcttcaaaaaaaaaaaaa

SEQ ID NO: 3172 - DNA, 574 bp, Homo sapiens
acactgatacccaagagataatgctttaagaacataatgtgaaaggaaggaagaaaatgacagcttcagtcagactttgtcttgctttcttctttaccactttgacaataggacagaacctgatacaaaggagcacccaatgtacttaatcacagttgcagaaaaaagggccttgagcccttttttctttttttcctttttgtatcaataatgaatttgcttacccaagcaactgtacaactattgacagagaatatacaaatgataaaagaggaggtgttggggaaagagcatcagtgagaacatcttctatttctacctaattaccaatacagtgaaatacatctgaaccaaagaatgaagaaagcatctccctaaggccaggtgcacttactatcaggttcggccaggcatggagtatacctccctctgggcttcctagaccctgtagagaggcagattgctcgtgtccttcgggatccagatcgagactgaggctgaggaagaggaatgcttgggtctggagcagtatgaaaaatctacgtataagaaaaaggaccaaggtcaaggaaag

SEQ ID NO: 3173 - DNA, 310 bp, Homo sapiens
gacatggatggagttggaagccatcatcctcagcaaactaacacgtgaacagaaaacaaataccacatgttctcacttataagtgagggctgaaggatgagaacacatcgacatatgcagggggaaacacatactgggcacctctggaggggggtgattggaggagggagatcaataggaacgatagctaatggaagctgggatgatctgtgcagtaaatgcatagcacacatttaccgatgtaacaaaccagcccatcctgcgcatgtacccctgaacttaaaataaaagttgaaaaaaaaaaaaaaaa

SEQ ID NO: 3174 - DNA, 829 bp, Homo sapiens
ttttttttttttttttttttttttttttctatggaaagtatgaatatttatttcaggctttcgatcccaatcgatttcaaaaaacaaagtctgatttctctcctcagggcagctgaggcctccatgttacgatggtttcatggagattgaaggagcacatttcatcaggcttagcacaaagtccctgatgcccaccatgtcccagccttaggaaaggaaagaaacagaattcaccaccatggggctgaacgaatgcacacacactaatgtaaatgagcagctaaaccttggcaaatttgttttttttttttttaaagtttgttttgtgggtttttttccattttcttttgctacccagtatatgcagcacttgtgaactcccaacaggttcccagctttaaacacattaaacatcttgaaagactattgaattcttcaagaatctaaaaacagaccaaacgtgttttgctgtgaacattctggagagacgaagtgaggcgggagtttgggttcatattttttaaaaaaagaatcattatagtggatggaggggtaaagaatggcaaaaattcagacattctgtggggaggtgtcctctctctcctttcgaggccctcgaagcggggcatactgagtacctcaacggggaagaacgagagcctggtggggttccccagccgggttgatatgtttttgtggaggggcggggcagggcccatgtgcccccttccttaggctagaaggagaggaaaaaaagggaccgtaagggtcccgaaagtcctattgccaaaggcggagagcgaacgggggtgttgccttcgcggttccg

SEQ ID NO: 3175 - DNA, 426 bp, Homo sapiens
gtagacgaaaaccaaccagtttctccagaagttcactgtcccccagtatgtccaggctgttccccttgtagtctatgagcctgtggaatcacattcaggaaaacacctacccatatattcccatttaggtatgactagaaaaatcattcctttataatttcttcatctaccacatcacctcctactagcaatatattttggcatgcttcttgaaatgtcaacagtattgagccaaaagaagactgtgtggaacattttccatattggttatgatatttttaattcgtgttggatatgccagatctgaattgtggtatcatatttactgtattgatgattaagtgaggtcttttctccactatctctgaaatatagaactgtatatcagttgccaaaacattaaaatttcaaacaaaaaaaaaaaaa

SEQ ID NO: 3176 - DNA, 517 bp, Homo sapiens
ataccgcatctccctagaagaatctagctgaagtattccctgagacgaaaaccaaccagtttctccagaagttcactgtcccccagtatgtccaggctgttccccttgtagtctatgagcctgtggaatcacattcaggaaaacacctacccatatattcccatttagaagaacatgtaagattcttgaattaactgctgcaatttgagcttgagtatgactagaaaaatcattcctttataatttcttcatctaccacatcacctcctactagcaatatattttggcatgcttcttgaaatgtcaacagtattgagccaaaagaagactgtgtggaacattttccatattggttatgatatttttaatttgtgttggatatgccagatctgaattgtggtatcatatttactgtattgatgattaaatgaggtcttttctccactatctctgaagtatagaactgtatatcccttgccaaaacattaaaatttcaaacaaaaaaaaaaaaaaaaaa

SEQ ID NO: 3177 - DNA, 328 bp, Homo sapiens
ttttttttttttttttttcttttagctttttttcagcttttattttaagttcaggggtacatgcgcaggatgggcaggtttgttacatcggtaaatgtgtgctatgcatttactgcacagatcatcccagcttccattagctatcgttcctattgatctccctcctccaatcacccccctccagaggtgccctggatgtgtttccccctgcatatgtcgatgtgttctcatccttcagccctcacttataagtgagaacatgtggtatttggttttctgttcacgtgttagtttgctgaggatgatggcttccaactccatccatgtc

SEQ ID NO: 3178 - DNA, 732 bp, Homo sapiens
cttccaggcttcccaggagcagtcatttctaacctctactacgcatcagagtcatccagagagcttgttaaaacacagatttctgcgtcccaccctcagagtttgctgactgagaaggtctgggttggaccaaagaatctgcatttttaaaaagttccatggtctaggaccacactttgagaactgttgttccaaagaaccacctgctttatactctggtttctcttcggatcatataaatctgccttttaaaaaagcacctgttggatctatgaaactgatgcagccggtagtttctcattatggtctcattaccctttacattgaaaaatacaaagccacttcaattgccatttcacagtacagcccatggcctggaacgggcacagctgccctctttaggttgaaaatatttggcaaataaggaatgctggcaagagaggctgcagttttgacacctacaccttgatttgggattcatttttctcactcaggatttggcaagcgtatgtcttctttaaagtgagactgaaaataagctctgactcacaaacctagcttaaaacaccacaaagagtaaacaactatttccataactaataattattaaaatatgtttttgagtttttgcataacttgcctgtataatgagatctaagtatttacatggaatttctacattactgtgtgaataaattaacagaactaaaacctgcaaaaaaaaaaaaaaaa

SEQ ID NO: 3179 - DNA, 679 bp, Homo sapiens
  misc_feature (1)...(679): n = A,T,C or G
ttccatactcctcactacaatgcctgaaaggcatagaaagatgactaatgacttatcatgtttgctgaacacatggctgaattttaaaatgttgcctttatgtccaagcaacccaacagctggtaggagatgctttaacttctacctcttccctatgacacctgacctccttttcctctatgtgagacccaggagaaactagtaataggtatgtctttatcagcggcatgaaaacagatgaatacacccataaagttgtcacactcttcacaaaatgtaactcaaaacgtaacacagacctaaatgtacaatgcaaaactatgagacacctagaatctaacatagaagagaatctacatcacctcggttttggaaaggttttttagatacaacgcaagaggtatgatacatgaaagaaagaattgaaaagctgtatttcattacaattaaaaatttttgttttgtgaaagacagcgtcaagagaatgatgaggagacaagccagagactgggggaaaatatttgccaaagacatatctgataaaagtctgttattcaaaatatgaaaataatataaaaaactcaaaaagaaaaaaaaaaatggcctcgttggcncacagcggggaggttgcgaccaggtcttctttctcacttaataaatgagtgcggagggaagggag

SEQ ID NO: 3180 - DNA, 814 bp, Homo sapiens
  misc_feature (1)...(814): n = A,T,C or G
atttggggtcttggtatatttcccaggctggtctcgaactcctggcctcaggtgatccactcgcctcagccttccaaagtgctgggattacacagttggtcaagaaaggcccacggtgcgtggctgagagcagccgaatggagggagcagacgcttgctggatggagacgccgccgctcgctgcattgctgatgtgtgaggacgcgtggatttcctttccttgctttgcctggcgaggctgccctcgcatcccgacgtgtttaacacaggacaccagcttctccaccgggaggaagccttgcgttctgagctcagcgacgctgaactttgttcctgtgtagcagctggaacaagaacgggcggagcagcttcnttcaagatcagagaccggccaggtgcccaccgacgggagaatggatgaacacgccgtggcgttttgtgcagtggaatgtcactctttagcaaaaagggacaaatgacagcgtgggtgaggctcagcaaggctgtgctgagtggaagaagccctgcccagacgggcacccccggtgcaattccgtgtctgtcacgtcccagcaccggcagatccacccagtggtggcaagagcccagacgaacggtggtcgctgttgtgcatgggcaggactgagcaggaaatggcaggaagcaggaagggcttcggggatgtggtaacatgtactttgatacgggcttgggttacacaggtctatgcatttgcccaagctcagcaaatatttaagcaactgtaaacaaatgttggccatgagctagcaatatgcacactaagatattaaat

SEQ ID NO: 3181 - DNA, 1076 bp, Homo sapiens
  misc_feature (1)...(1076): n = A,T,C or G
tcagttaagagaactggagacacaaaaaagctaagtgaattatgcaaagccacccagctagaagtgactttcttcagaggaagttcttggaattcctgtgccaccataagagttactcacctgctggatttttatgagaagatgtgacttggtccttgccttccgccatgaatgtgacgcctcccagccctgtggaactggtgagcctgcttctaacaactccctcaaaaggctctgtaacccgtccaaaagatgatgtcaagtgctacaaggacccaggtcagccctgcatcatagaaaagaataatcaagttacttcagctctggtatcaagcaaacttctcccggtaggcttcaggaagtttgctgatcctatcagctcaggagcagctaagttcacaggaaggacaattctgaaagctgggtgaagacattgccatcagactcatctgcttgtcatgaaatcgcaacagccaccccagccttcggtagccaccaccctgattagtcagcagccatcagctgatatcaagaaattgccgcagccaccccagccttcagtagccaccacccttgattagtcagcagccatcagctgatatcaagatgaaaaagttttatagctttgtgtaaaaaacagataatgtctnccaaanaggttttcttcntaattcctgaaactgtgactatgatacatcatacaagaaaaggaaattaaggttgcagatgtaactaagtttgctaatcagctgaccttgagatggagagagtatcctggattatccttgtgaacccaatgtaatcacaaaggtcttccttatatgtgaaagagggaggcagaagagggagaaccagatagattgcagtatgagatggtcttggccagacactgctgacgttgaagatggaggatgaagcccatgaatccaggaatgtggtgacctctagaagctggaaaagtcaaggtcatggattttaccctaaatcctccagaaggaacatggctctgccaacaccttgattttagcccagtgagacacatttcagacttttgatttccagaaatgtaagataat

SEQ ID NO: 3182 - DNA, 288 bp, Homo sapiens
ctaggctccactggcagagcagctgagcggaacagcagagaaggagggaagagaagaagcagctgaacattggagagaagcagcttgacttcagagggacaacttgacagcaggactttggagaagagtttggccagggatggaactaagctggccgaactccaagggaagactaccttcccactccatccttctcactccatcccctttctagctgcccatcctgctgagagtcactttcataggcaataaaatcccccacatttaccatcttcaaaaaaaaaaaaa

SEQ ID NO: 3183 - DNA, 757 bp, Homo sapiens
actgaagaatttgaaattgcatctcacttcccaatcaacacatctgaagaacaatctataccagaaagcttgtgctggcatttggaacaagaaaaaatagaacacatttctgaaatctgttggatgaagaagaatcagagctcaccaagaaaaatgggcttctagaaaagcaaatgcaattttgacagaaggcagagaaggcctcctccctccggtggaaagaaaggtcatccttggaactgtcctacaaatggactgtgtgtcttagatgacaccaacatctttcccagtatagcgtccatatacggagctttcactcaagaatgttttgagtggcatccacaatgtcagtgcaagtaatggaatgattaaaataattaaaaccaagtcaaggtaaatcagacattgtaacgatatcccctatgacccatcactgcagagttaagaagcctggacaggcttcagggaagagaagggagaacattcttgaggtttcagggaagagaagggagaatattcttgaggtgaaaaacgattacgaccctaggcagcgcgccatggctttgacgcacaactgtagaggccgacgtcaatattgttgctgatcaatccatttacctgcggcacttaggacagccactgcacattcattctatgcaccgtcagataagaatatctctttcccccgattcaaaaaacccaccacaatccccttctgctggactaacgagggatgctcttataaacataaccttag

SEQ ID NO: 3184 - DNA, 871 bp, Homo sapiens
aggtggacaagacactgaagaattagaaattgcatctcacttcccaatcaacacattgaagaacaatctaaaccagaaagcttgtgctggcatttggaacaagaaaaaatagaacacatttctgaaatctgttggatgaagaagaatcaggcaaggactcaagttaagggcaagggatttttccagtggggttaaattaactgcaaacctcgttctcttcaaataggatatcatacatgttctttacttttcttatataaatgtaaaatgcaaaaatataattgttctattttgtgtagagctcaccaagaaaaatgagcttctagaaaagcaaatgcaattttgacagaaggcagagaaggccccctccctccggtggaaagaaaggtcatccttggaactgtcctacaaatgaactgtgtgtcttagatgacaccaacatctttcccagtatagcgtccatatacggagctttcactcaagaatgttttgagtggcatccacaatgtcagtgcaagtaatggtatgattaaaataattaaaaccaagtcaaggtaaatcagacattgtaacgatatcccctatgacccatcactgcagagttaagaagtctggacaggtttcagggaagagaagggagaaaattcttgaggtttcagggaagagaagggggaaaaaaaaagaggtgaaaaatgattaggaccctaggaagtgtatcagggctttgaggtacaactgatagaggaggaggccaagattgtggtgataaatcccatttacctgcggcttttaggagagccattccagttttcttctattcacgtatcgataagaatttcttttatgtgtgcattaaaaaaaaaaaaaaaaa

SEQ ID NO: 3185 - DNA, 879 bp, Homo sapiens
ttttcacggtgacatgcaatagactctggtattatgaagtcttgtttccagcagtgctaagcatccactttcttacttctcttcatgttccagttgagttccgagccctggttcacaagatgccccctcagccatggaagaacaggatggcaaacatcaaatggcacgagagcttccagcagcagttgaaatgcaagtccacaagtgcaagcaaagttttgccctttttgtcaaaaatggactataatttggagaacgaatttgaaatacatcataaccaagctgttctaaagactgattttaatattttatgtaatatcacatatgtttttgaaatcagtaaagacacctggaatcataacgctttttcagtggtaaatgtcatattacgtttttagggcattacgtcaatttcgtatttcacgtattattaataatgcctcattacataaaattattactaaactggcaattaagtggatgtgaaggatccatatgctaaactgctcataacatttcaattatgaacttcacatcagatgtcttctagtgtacattaacaacattcatgaacaacctctctgccagaaccacccaaatgaactctgctttgtagcatgtgatagaggcataaagtcattttgcacattttcctgaattcaagaaaattagaaatggaggcagcacaggaaccccgctagtcctctctctcggtagtagtaaagcatttgcttatgcttggaatttgctctcacttggatatataaagccttgcgaggcgacatctatgtcttcttggttgaccaaacagttattttcttgtccttgatttgcattttcctcctccaataaccaggccgaccaacaaaaaaaaaaaaa

SEQ ID NO: 3186 - DNA, 918 bp, Homo sapiens
cctcagaaagactgcagggggtatactttcaaaatactcatatgtccaagtgtttcaattctagaggcttgctgtctttgtcatttcatagctcgccttgggaagagcttaaggtactgtgaccgagctttcatggaaatcaggaagattctgagagaatccaaatgtgaccatctgggagagttaagagaagaaaatacaccatggtggagagacaaggactgccactcctggagttccaaatggacagaaggagagagcttcctcgcatctttgggaaaatcctatctgcatagcataaatgccccatactccaccctggaagaggctaatcaggggcacctcctcatgggtgccagatattagaagattttacaggctccattgcggcagaaggtaatcaaaaaggcccaagccccaccctacgggagagcagcagcatgaccttaaactgcctttgctggtcacttggagagggagggtccattttcctcagtgggcaacaaagccgctgataatcaggtgcacacatgacgtggatgtaacctgctgaggaagtgtctgatatcccaaaggagccagcactcacaccaagcctgcccaggaaaaagaagcctcagagaaccccagaccaccctctgctttgtagatcatatgagtaaatacaacgcaaacagccacttagcaagttcagagccactttcaaacgacgctgaaggcctggtgtcagcttctggacagcaagctccattctcttccccttcaagctgtgtgcatgtcactccaagggagcacaagaccattcccagttgcgcccctggcaaagccagagaggaagcggactgtgacctcttttgcacagcccactgacagaaaatcagattgttgcctcggataatcttgctaaaaaaaaaaaaa

SEQ ID NO: 3187 - DNA, 1114 bp, Homo sapiens
cctagtttggatactttctacttatctgactttatatggacattttataagatgactggacacagcagaggagagggtcagtgaatcagatcaagatttttaagagattcctttgctttgcagctccacccatggattcttgcaccttggctgctgtcaccctatgcccagcaaaagtagaaattcctgtgaagagtttgctctgagctcacctgccccacttcaagtctccacagttaagagcccaactgttcccatctatggcaaagtttccctgtccctctgtttcaatagaggatgagagcagctacggctctcttctgaatggtctatcacttattgaagtttagtttatttaggtttctttgtgtgctcagctgcctaatgggcttttaaaaacttatcttgcttgttttggctgtttgggtgagaatgatggtctcttgtgactctctatgacttggaaagcataatggattgtttaaaggactgagttattacatttaaaggatataatatgcccatcgttatcattactacttacatttgataatttttgccaagttgttgtttccagtggttgtacgaaggacttgttaaatgctcccttatggcaaggcagaacaaggtacttggggatgacccatgaagaaagaggagttcagtggtagatatgtggagtcccaggtgtctctgtttaaatacccgtcacctggagtcactagagaaaggtggccatcaaagtgctgagtgtgaatgaaatcacctaggaagagacacagactatgcaagaaattctgttgtgacattttaggggtggacattgaagccaagaaacccaagaaggaggaagccccaagaggtagaaaggagaaccagaaccgtatcccaggaaaccaaaggattaaaaaaaaaaaaagtcaagataatgccaaatacttctagagggcaaatacaataaaaagcgaattatatttgtggtttatatttagtcaaactctacaacaatggtgtttcaatggaataatgggggtaaaagctgataagagaacggtcaataagagattggtccatagacaataaatgtatataattatgaaaaaaaaaaaaaaaa

SEQ ID NO: 3188 - DNA, 641 bp, Homo sapiens
gttcagagaagtcttccatcaccttgtttagtatctagcgggtgcagttctacagggaaagagcaccacaatacagccaagtttgatccaattgaacagaagtcccttagcactggtgagtctccatggatcaggagttgaacctctagttctctgcagcagaccacctaatgatgagaaaatgaaggctccagggagaaattgtcatctcagccttatgatggaatcaaaagggtcacaaatgggaggctgacaccatgggatctagtaccaattcttctgctgtcattctgtttatctttgactgtgtcatttaattttgtatctcagtctttttttttctttttttttttgttttgtttttttaatctctaaaagagataatagttcttgccctgcccactttgcaggctaaagagggataatgtatattaatagaattatgaagtcctattaagtatccaagttgacaatttaagttttatgacatattactatatcctaacagtaaatggtatggagaagaaattcctctaggcatgtgaataataatctgttatttctaaagagtttttccatgtgttatcttaataggtccttgtaataaatgatgagatggattgacaaaaaaaaaaaaaaaa

SEQ ID NO: 3189 - DNA, 1097 bp, Homo sapiens
  misc_feature (1)...(1097): n = A,T,C or G
ctccgatgaacaaaatgaatactatatcaggtagctcgctacggtcatagaacaagaaaacagaagaccaaagactgcaatttgtatcttctgacttctggtaccatccagcaaatacttcattcctccacactgccttgcaacagaagcaacatcggaaatgcctgccaactcacagaatgaaggaattatccacacagatatccccagtttgttataaagttttcaaagaacactgtacaccaaaaccagccttttatacctgtaatttctggggatcaacagctccatcagtaagctttaactgctggcttttggcttagagacatttaactaacccctcacgtactgtaatttcctgggagcaagcttccaccccaatggctctgaaaacgtagtggccagatggggaaaggcaatcagacagatcagtccctgcttgcctagctcagcaccagttcttccagaggctgcctctggatccgggctagggaaagcacatgatccaggcagtcctaggctagaccgacaccgaaattgacaccagaaagaacagaaactnctcatgctacacacttttaaggttaaccncagagaccaaaacaaaagccaagcagcaaggaacaaaccaacaaaangacttcaggacagctattgaagggcacctgggaaagcaaacgttttcccacgcaaactttgtttcctgctgatctctgtgccccctaaaatacctacatagaaatcctaggatttaaatatcctagagatggtcagaagtcctttaaggtttaaatctttcctgccaaggaaagaaccagtactgagacaggcggagaaggtggtgacatttccaggattcttatcctgcaatcctgaaggatttctgctctaattgccatagcaaaaaaatcagcaggtgtaacggggtcacttccagctagtcagtgagagaatggaaagtgggaactcacatgtcccagaaaagaaatctacatttatattcctttcatcctctctgaaacaaattgttattttatcttatttttcagaacgccacgaatataaataaaaatacttttttccaaaaaaaaaaaaaa

SEQ ID NO: 3190 - DNA, 421 bp, Homo sapiens
ggggcgggcggcgcggccagcacccccctcagttttcgagggagccaaagtgctcagcaaatatgatctcattagtgctcacgacagccctgagggaagatgttggcaagaattcccaccctccttggagagtctcattgtcttatgagcataaagtggagttttccagagactatacaacacacagtgttgaacagactgaatgaagaagcaaatatgagaatcctgaccagcttctatcaagccatgcatgaaagagatttgcaaagaatgtaaagcaatgtgactcttctagttccattattttagtttttgaaaatagcaatttttacgaaatttgtattaatataaacaaacactatgtttattgttgttattcctaaataataaatacgttttttcactttgaaaaaaaaaaaaa

SEQ ID NO: 3191 - DNA, 809 bp, Homo sapiens
  misc_feature (1)...(809): n = A,T,C or G
agagcactcagaaacatacatctaaggaaagattcacttaaaaaccagccaagacacagtcatataattgggatctcagggccctgagtaaagactgtctcctcccacttcatcgtcggtcagtcaagaggaagaaaaggaaacttgaggcaagggaagatgtgaaacaattcaaagtgatgcatatgactccagctgctgccgtgtgaagtaccaccgtgagatacagcagctttctcagcaggcttgtctacgaaaacatcagggactcccctggaaattgtgcaaagtaaaacctcagagtcttttttggaagatagcaaagaagaaaattttatttttgtcatgggtcaaagtttaccccatgaggggtttaacccccaaacacatttctgattggcatcatctcttcccttctgtgacttaaaggatgccagaatcctgaccttgcctttcatcgaagtcttaatgtggtagaaggctccaggtgtgtggctgtttggctggcgtcgtctcaagcccagacctatatttactgacttagaatctatattttaacaagtgggtggatttgtgcatacagtgagagttaaaaaccggttcgctataccacacgggccttgcacaacctggtggtggggcaatcattccttggtattggttcaaaaccaacttgggtgcacacctgaaggaacaattggtttccttttttcagctgtgtcctttaaacataaagggaaatgtgtttgtgtgccacagacctcagaagtggggttcacactcaaaccgctanggggttacttcacatg

SEQ ID NO: 3192 - DNA, 790 bp, Homo sapiens
cttagggcacctcagaacatacatctaaggaaagattcacttaaaaaccagccaagacacagtcatataattgggatctccagggccctgagtaaagacagtctcctcccacttcatcgtcggtaaatcaaactctccacagatggtcagtcaagaggaagaaaaggaaacttgaggcaagggaagatgtgaaacaattcaaagtgatgcatatgactccagctgctgccgtgtgaagtaccaccgtgagatacagcagctttctcagcaggcttgtctacgaaaacatcagggactcccctggaaattgtgcaaagtaaaacctcagagtcttttttggaagatagcaaagaagaaaattttatttttgtcatgggtcaaagtttaccccatgaggggtttaaccccccaaacacatttctgattggcatcatctcttcccttctgtgacttaaaggatgccaggatcctgaccttgcctttcatcgaagtcttaatgtggtagaaggctccaggtgtgtggctgtttggctggcatcgtctcaagcccagacctatatttactgacttaaaatctatattgtaacaagggggtgatttgtgcatacattgaggtttaaaaaccgttactctataccacacggttctttccacaacctcgtgtgggtcaatcatttcttgatattgggtcacgaaccaacttgggtgcacacctgaaggaacgattgtttcctcttcttcggctggttccttaaacatcaggggaaatgtgtttgtgtaccacagacct

SEQ ID NO: 3193 - DNA, 856 bp, Homo sapiens
ttaggaatggttgcaaaatcttgtctgctgtggcatacggggtcgtggcaggaggcttaaaaatatcctgaagttttggatcggaaaattaagacttccagggaatggagcatctgttgccaattaggctcatcagcactctaccatggagtccccgctgatccactcactcttgttagtggatcagcaggggcatatggctgcttgggatgggattttaacctccaccctgccagggtccatgcaggaaccattcatcccaccgcagtgatctctgagactaagtacatatgcgcatcaaggttctgatgccatggtaaccagtgggtaaggaagtcactaagaacacagagtagtacttggaacttctgcacattttcatggctgccagctgagagatgcaaatactgttttctaaacaccacctacagctactaggagtcaacaggaatatagtatttaatcaggaagtagtatttcggatcaagacagaaaataccattttgtttgcacttttatgaatatttgagaagaaaccttttgctatgtattatgatttttgctacatctcctctatacaacatttaaacattctcatatattaatatttaggtatgcctgttatgggataaatatctttctaatccctcaacgctctgtggttcatatatcatatgatagatagttcctacttttgtgaagtccacataacttttttcactcgaattctagattatcatactaggatatgaacatgtgaatattacatattctaagctccttaaaagggacgtataaatcgacctaagcttctccgtgcaattgttgacaccctatgtttccttatgctctttat

SEQ ID NO: 3194 - DNA, 261 bp, Homo sapiens
gttcagaagaaaaacaaacaaaaatcctcgaagagtttcaccatttatttttaacatgaacaaattgaagaaggaagattatctcttcaatgaaagagtactgtcttcaatatattttgtgacggaaaatgatttgcaactaatgacaaattggttgtaattataagttagacaattatatctatatatttaaatttatgtgcagctacctatgccagttcctttgattaaaagtatttttaaaatataaaaaaaaaaaaa

SEQ ID NO: 3195 - DNA, 987 bp, Homo sapiens
cttagggaccctgttttcagctgttatcaccacctcaccctgctgatgagccccagcgagccctgcaggagtgggtgaggcacagcaggttcctttctcggcggcggctccaggccccacctctggcaagaccagccttactctcagcctccctcctcccacatggctccaatgaggtcaacaatgtggactgcacttaacctcaaatccaacgcaacgtcctggccctgggatgttcacagtgaccaccatgccactgcctgggccgccctgtttgtccccaaccctctcttcaccatgatcagccttcgtgtatggtgtacccatgacataactaactccatcttagaaaaagcctccatttcttttcatagagcactctgccaacaaggagaagatattttgttgaataaataaataaataaataaaggctgcatccagccagataaggacacgcgcacactcttccactattggttctcaccagagggccctgtggccatacaagattaggcctgaacagctccaaatggccgtcttaactgccactttattgcagtcactcgtgatgagagcttgacatctgccgccagaagctctgctaccttcaagattttcttgtaagactgatgaatccttcggtccagactgggactccttttgtcttcttggcttcccctggactggttcattaaccctttctcctatctctttttcttcttgatgttaaatgttactttgtttgctgtggaatgtttaccttacaccatttataggttaggtatactattatgtatggtttgcaatactgactgacttatggagtggcatcagcctgtgtgcccgcagctctggccgcaaagtagtgggaaatactacggaaaattgcctccttaggagctccatgtagctcatggcttttgtgattgaatcacaatcaataaaagcctgacactgtggaaaaacacaaaaaaaaaaaaaaaaaa

SEQ ID NO: 3196 - DNA, 472 bp, Homo sapiens
  misc_feature (1)...(472): n = A,T,C or G
aacggttcgagggatctcctccccatcatcctttgctggatgcagcggtgcaatgacagctcattgcagccttgacctcccgaattcaagtgatcctcccacctcatcctgctgagtagctgagattacaggcatgcaccaccacacctggctaatttttaaaatttttttttgcagagacagagtctcactgcgttgcccaagctcaggtcatccttttatacctggctgtgttacaggttgatagccagtctatgactcaagtcccatggtccagaatggaagctaagggattgggtgggaatgtgaacggagctgtggatgaaacccccttctttgcactgaagtttaatgatggcaagtcatcatctgttcatctgggagagggattgagcaggagcatgggaaaacccgntgccctcttgcctctattgcaaataaatgcttttgtctttctgaaaaaaaaaaaaaa

SEQ ID NO: 3197 - DNA, 945 bp, Homo sapiens
  misc_feature (1)...(945): n = A,T,C or G
caggtaacaaccccagtgttgttctggacaagaatatgctcactttcaaatcatggattactctatgacaataaaaaaaattctggtttgcagtttgccagcctctcttgccccagggaacatgcataagtcacagtcttgccccataagactaaactgaactctgtgagcaatgccctcctttatgtttttgttagtcctgctctaaatgtggctgtgatggctagagctgcaacattcattttacaaccatgttcctgcaagcagaagagtgaaggcaatatgctaaagactgaaaataaagaaaggatctggacttcaaagatgtcatcaacagctgccaacctctaaatatttgatatgaaaaaaattcttatttaaggcactgctagtttggtttttgtggtaacttacaattgaattcaatctcaacagataattataaacaatcccagtagacacacatcaacatgagaaagggggttagggttgagctgtacagagagaaattgcaggctccagagcaagagaatacttccttctgtgatcatacttttggacaaggttgcacttttgcgggacatctaaactgtaagtgccataccaaggccgtacatgggttctaaaagccagctaatgaagcagccataaacatcacttatctagcacacnagacttgatgctgtattccgtttgaccatatgtgactgggcacatgttgttggtggtgatttttaccacaaaggttttgtatagggccaagaccttgggctacaagtaagaacatttggggtctatctctcggctattccccttacctggatgaatattttacctcagatagggcttaatgtgctgcaataaaccaatagtggtaaattaaataaattaccttataaaaaataaagggccttttggcctacgggggaacttgggccgcttctt

SEQ ID NO: 3198 - DNA, 873 bp, Homo sapiens
  misc_feature (1)...(873): n = A,T,C or G
gtagaagaaacatcaaatatggacagctacagcaaacaacatactcagttcactgatggctgaaaacaaggagcactaagaagtcaatatccatcatcctttctgttgtttatttgtattagttactgattggaccatttcccttttcataattaaacaacactcttaatcatcacctcagttcctggaatcctttatcaagagcaaggacaactctgtccaggctgaacaaggaaaaatatgaaatatatgctaatatttaaaagcttattgtttaccctaccagcatctatcaaggaggtcgccaccaaataatttgcatttggagcatgtggacttcaattgttcttgagtgaaagaattgccttccagtcactctggaggatgacagaggccagtcactcacacttgggctattcaatggccttcctctcacatcatctcctggtttctgggcttcaccaccaggatcctcttagagttctgctcgtcccacaaggaanaccaatggctacagagacatgagcccagggaaatgagaagtttcccagaggaagcgattctaaactgccctcgcagtcaccaccctgcattaggactaaataaagctgatcagcatttatcaatcccgaaaaaaannnnnnnnnnnnnncnnnnnnnnnnnnnnnnnnnnnnnnnnnnnnnnnnnnnnnnnnnnnnnnnnnnnnnncncccnnnaaacaanangggcgctttgggcccacgggggacctctcgggcgctcccttatagggggtaaataaaacactcccactatcctccgcccgggttgggtgggggagggttccccttataggggtaatggttcccaaaacaggggccccagaaaatgtc

SEQ ID NO: 3199 - DNA, 443 bp, Homo sapiens
ccagtccctgaactctgccgagtagaaaatgtcaatcatctggaaagggattaaatcaacccagccaagttagaaatcatcctttctgattgcactcgccttgaaatctgaatggagttccagggaaacaattgatactgttttccttattccttctgtttgaaactcatctgtggcaagatcagtaaacttatcctcaactgcatgtgcaggttgaaatggtcagttttcaacaaagaaacaatggttcttggctgtcaatgcagatggcttttcttattaaagctcctctccccaagctccttaaagactcttaatggatttccagatttctaaatgtcatctcagtttacttcttaataagccctttacaccctctgttcattccttaaacaagccaagggtttgcagccattaaaaaaaattatttaaaaaaaaaaaaa

SEQ ID NO: 3200 - DNA, 1039 bp, Homo sapiens
ctcagaatggagctgtccagaaaatgatacccttggagagtactattaagtatccccaaaagcggagcactcctttccagaaacattctcccaggtagcaagttctgggatgagggccactgccatctttccttggacccttgaagctgtttggctgttaggaacacataaatgttgaccctaagaagcttctccaatcctttctctttctgtggatgacgctcatttcttaacttccaccaaaaacatggagatgggactggggtcagaattgctggagttaggccaatcaattctatgcatggtaatattgtgtagaagatgttaaattttatttgttcttgctgttcattatacctgatcttgactgacatcatcatcttctcatccttctggtacagcttagataaaggtaaacagttaattccatcaataagtgtttacttattgccactgaaattcaatcacagtattaggtactggggcacaatgggaagtattgaataggtgtttgctattgttaccatccaaaaagatgattctttgacatgtattggtttctatatttttttgcaatggaactgactgtgacagaatttcactttgtatgtgcactgaaggtcttcttgtaacagaatgaacattcatatatatatacatatatgcacctccaaatcaggattttataattcaattcaaagctgaacagaagagaaacttgttctatccgtatgaagaaatattacagagccaaaacaatttacaacttatgatattactgcaagaatagttgaatagataaataaaacagaatgagtaattcagtgtgtaatttatataacaacttcatgtgtgataaaggaggcatcatacattaacaaagaaagaatagagtgtgtattacactgtattgggaaatttgctatttggatgagaaaatcaacatatgctcttttttcaaagcctgtaaaaaatacaatccctgtggtttaagacccaaatattaaacatatatataagtacaaaaaaaaaaaaaaaa

SEQ ID NO: 3201 - DNA, 408 bp, Homo sapiens
cttcaggcaagcaagaaatgatagataaattggtctatagtcaagtaaattgccactgtagagacaagagatacaacttgtaacacagctggcctggactgacagaagattcagtaacaatataaaatagcaggaatgatggagctgtaactttgtgtgattcctcaacatctacctggaataatcaaccatcttcaggattgcaagccccaccactcctgtgttgctttataatcaaaatgacacacttgggcagtttctccaactgcctgataaattcagttttcaaatactaaggtactatatggcatggtgactttaccattactccagggtgggaagtgactttccactgtttgcggattaccaaagggaataaagcatatttgacagtcaaaaaaaaaaaaa

SEQ ID NO: 3202 - DNA, 975 bp, Homo sapiens
acggagtttcgctcttgttgcccaagctggactgcagtggcgcgagcctggctcactgcaaactctgccttccggtttcaagcgattctcctgcctcagcctccggagtagctgggactacaggcacacaccacgcccagagaaaaacagatcttcaacagtttttttgatggaaataaacaatttcaagttgagacaacacatcagcttcatgcattccttcagcttgaagtcaactgggcctgggttgaatctggttctgttttgttgttgtttcattttgttttttagcatttgactatgtacagtctctatttctaagtcttgatttcctcatttataaaacaaagcaactaaatgatatcaaatacccttgttttgaaaatcatagaataagcacggcacccaagacaactttttgtatcacaggcacacatgaatgcttttttccttttccttttcttatcataaaaacctatattttatgacttttacatttattcctagatgctctcatatgcattatctcatttttacaataacattataaatataaactctgttatgctattttacagatgagagacttgaagcacagaaggctaaaactacctttaacttctaaagaaattttgtgagaagcatctgagactcttgacagttaaaatccctatcatttcagaaagtgcaactggggatcacatgtattttaaataattctagttgagaatagtcaaaagtcgcatttacgaaggaagattgacatttttaagcttcccaatgatttcatcaagcttatttagtactcctagcctcagtttcttcacttgcaaaataagaataccaaaaacaggagcttcgtggattaattttaagaattaaatgggaaaatgtttatcgacattttagcacaagcctgcttacaataaacattttaaaaagttatctatcttaataaatacagatgcggtccgg

SEQ ID NO: 3203 - DNA, 616 bp, Homo sapiens
ctcagaatctcttatacctgacagtagtcatgccaattagagatacttgtgcaagggcttggataacaaaagtgaaacagaaactcctccttgtttatggcagctgatacacaaatccccaaaatgaaagcatttacagcagctagaagatctgttcctcaggagagtcacgtgtgtgctgggtgtgaggcagtcaggacaatggttgcaatggagcaataacaagaggggcccctgacatccagatggcaagcccagagatcagatcttgaaacatatattcagtatttgctcctttatttctgatcctgtccttcaaaatactttaaactttattgtatttaattccctatagcttaaaatacagaggatggtttttgtttgtattaaacctttactgacaataccaccattcttatcattgcatttataaagtgctagactgtactttctttaagtagcatttctttttacaattatatataaacactatcatgtagtacatgaacagaattaaataaaatgcaaattattgtttgacagaatcgaggagttatttgatattatgtaaaaaaacaaaaaagatttatcaaagtggaaaaaaaaaaaaaaaaaa

SEQ ID NO: 3204 - DNA, 743 bp, Homo sapiens
tatctgctgccggtggacttgcactataataaagacaattcttcaagctgaaggataatagcaccagatggaagcttataaatgccaggacaaatgaaggtcattggaaacaggatgtgaggccaatctggctgggacatctgccaccccatggatctccagggttgattcggctgatctggctggctaggctggtgtccccttcctccctcaccactccttgtgtgtctgtcccgaagctgtgcactctaatgaagaggacgaccatcccagacagaggaggaccagtctttgttctaggatttctttttcctaatgacttgctcatttgtcaaactggcactaatgcaagaactctgtgattaactgatgttattgaagactgctttagactgactgactgtcagcatgcctccaaaattcatatgttgaaagctaattcccactacgacggtatttcggaggtggcgcctttggcaagatgaccaggccatgcggatcaaaggcactagcaccctctccgacaggctccacagagcctgccttgctctttcctccatgcaaggacaccgcgcgaacacaatcgcctatcacgtatgctgcgggccctcacacaccccagccctcctgatattctgatcgatgacccccgtgtctctacccactaactgccccctgctctcgcccatcttccccctgcgtcttccttgccctccactgcagcctgccgaccattcccttcc

SEQ ID NO: 3205 - DNA, 595 bp, Homo sapiens
ctcagataaccaaaagcagcagaattggctgctggtggacttgcactataataaagacaattcttcaagctgaaggataatagcaccggatggaagcttataaatgccagaacaaatgaagatcattggaaacactgtgcactctaatgaagaggacgaccatcccagacagaggaggaccagtctttgttctaggatttctttttcctaatgacttgctcatttgccaaactggcactaatgcaagaactctgtgattaactgatgttattgaagactgctttagactgactgactgtcagcatgcctccaaaattcatatgttgaaagctaatccccaataagatggtatttggaggtggggcctttggaagatgattaggtcatggggataaaagggactagtagcttctaaaagaggctccaaagagttgccttgctctttcctccatgtaaggacacagtgagaagacaattgtctatgaagcaagcagtgggccctcacagacaccaaacctgctgatatcttgatttatgacctccccccaccccaaaaaataaatgtttactgttcaagccaaaaaaaaaaaaaaaa

SEQ ID NO: 3206 - DNA, 748 bp, Homo sapiens
tttttttttttttttttgacagatcagtcatttttattcattggtcattgaaatcttttctgataatcgaatagcacagaagagacctaaaagaactgaaataatgggttctagtgtatctggggaaaacgactcaaggtaaagggaaccatcatctttttcagatggcactcagagccataagaggttcagatagatccacccagcagtgagtgcagtgggtttttctaggcagaaaacacagaagaaacatcaagaaatcacatgattggcttgccatgtccaagtccttttctaattttgtttttctttttaaagcatattttttgcctgctaccatgacttgtaatttttgatgatgttgttgaaagctgatgtattcatttgctatgcgtaccatagcattctggtagtttgatgacaacctttggcattccttggcttgaagtagcattacttcaatctattcctttatcttcaaaagataatattcctgggtgcatgtccaactttatttaaataaggacaccagtttcaaaggtaaagcccaggcactggttaaggtagtgaggacagattttaattagtaacatatttttgggtatttgtgggtttttcacctaaaatgaatcttacacaggctgtagattatatctctgtttccaggaagccccgtgtgttgctttgtgtgtgcatcaatctttcgagaccccctgtgatcaggaggctacgttccagtgactatagg

SEQ ID NO: 3207 - DNA, 752 bp, Homo sapiens
tttttttttttttttttaccacttaaaccattttatttctcaacatctacatgcccacaactgtcatgaatactactatgaagacaaaaccaatagaagatactatctgtatcattaaggagcttaaagtacagttgggtagctagccccaaatatagcaaacactagaaacaaaaacaagtgtgtaatcttgtgatagattgggtggaaatgtaccatctgggacattggagtacaaagaaaacaaactccagtatgttctgaaccttaggtttcccatctgtagaatctatgctaatgctcacctcacaggatggttatgaagagtaaatggtataattatttgttctaactaacagtcgggaacattatatgtccttaatatacattagtggaaacatcattcaggcttgatgtaatttaaaaatattttttccacacatttatatgaagatactctgttacatggaaatcaagatattaagtgtacaatgatgaacaaaacgaaagtggattgtatgttcatagagctgaaattctagctggaaaagagagaaaataattacataagtaaacagaaagaaaatatcaagcagtgatatattattcacaattttcaaaaccacagtaatgtgttgaagagagagaaagagttactttagactgggtggtcagggaggccttctgaagcatgatacccgaagaatgatttaaagctgaagctgaataataggagctactacttttgatat

SEQ ID NO: 3208 - DNA, 658 bp, Homo sapiens
ctggtttgcactcaagactgacatttaccgtaatggaagctgttcatatgcccccaggaaagaatgaacaatttaatagaaaatgctaaaggagtgatattagggggagttccatgtctccagaccttgtgctgatgatctctgccctgcacagtacgttgctgctcatttccagaagagaccaagatagcttctcagacttctcaaatctacttgccctacttgacaacacatgttggctgggctgactggatcaagattctataagcaggatcctcacggtttcaagtccttgctgttttagatgagacagaggctatttcctgctcccataaccactcacttcttgctgtgaagctttcctaggctgttcttgctaatactaacaaaattaattatgcttatctgatgacaagtatacaacttaaaatgccatctttataaataaggcaatattcaatggagtgtgatttatggcctttcatttttcctatacaccctatgtgccatataaaatctggctttacagtttcatagaggctataatccccttcagagggaataaatcatttccaaacataatataaaataaggagttatattcacatactggcaaaggaaataaattgattataaaatgtaaaaaaaaaaaaaaaaa

SEQ ID NO: 3209 - DNA, 733 bp, Homo sapiens
  misc_feature (1)...(733): n = A,T,C or G
agaggtgcagctctgacttcaacatcaccattactaacttgatcaccgaacacttttaccttcttggagctgaaatgtcaagcatcaccacttgtgtggagggactttgtagagctaaaaagcctactggagttgtttcagaacaacaaaaaaaccaccccccaacaattgttgaagagtatttcatttgcgctcataagagctgaaaaaataaaagaaaaaattttttatttttttttaaaattgatagtgatagagggggtttttttttgaaatcctccacccccaagtcccctccccccctccttgccaccctacgctcgccctttgggtggcgctttggttgagcccgcatgcccctctttttctcctttattatctttgtggtcacctctcgccgtttccaatnctcttctttgtcttcttcttttttgtggcggtggagggctgccctggtagtgcataacattcttgttatcgataggggtcgttttcttttctttaatttctgtttctatttttgtttttctttttcgtttnttttactacgatatttttccggtctctccctatctcttcgttctatcttccacaatactcttcnctatgtattccccttcgtcttctcccgccccctagtttatttgtattcccccccccctcttttttttatcttttttttcctcgcatgtcctttccgcgttacccgcatatcaaatcaatacaaaaaacc

SEQ ID NO: 3210 - DNA, 295 bp, Homo sapiens
tttcagatgacaatactgttacaaaatgatgaagttacttgttcagaagctagtaaaatattgaacctggattttgcaaccagaaatgtttgaagctgacatctacatattttatttaattcattgcatatttcttcatttttatcagcttttgtttttttctgaagctcaagaaggggaaattgacttgccttatgtggcaggactttgtgagaatagtgtcctcatgcctccaatattcagtaatcgtgtatggaaataaataaatataatttaagatgtaaaaaaaaaaaaa

SEQ ID NO: 3211 - DNA, 761 bp, Homo sapiens
  misc_feature (1)...(761): n = A,T,C or G
tttttttttttttttttatctcttcagtatttattgatgtcttaaggcagccaactctaacatatattaacaaaagctgtataatcattttcttcactgtgttgcagtcatttgagaggaaacatacaaaagaacaatcagctaaacagtgtattagattccagccttgacccagttactagttacttttcaaagagaaaagtcacatttgctttctgtcattcacactaataaatgatgaatgtggaacaaaatgttagctctcccctaaaaaatagcatatttgttgtaggccgggcacagtggctcatgcctgtaatccagcactttgggaggccaaggtggatggatcacaagatcaggagttcgagaccagcctggccaacacggtgaaactccatctctactaaaaatacaaaaggtagctggtagtgatggcacacacctataatcccagctacccgggggtctgaggcaggagaatctcttgaacctgggagtcaaaggttgcagtgaattctgaggtcacgccactggactccagcctgggcaataaagcaagactcttgtctccaaaaaaaaaaccaaaaaaaacaaaaacaaaacaaaacaaaaatatttgttaactgtgtgtgtgtgtgcgtgtgtctgtgtgtgtgtgtctgtctgtctgggtctgggtataagtttccaaatttttgaacctgggagttaaaggttgcagngaattctgagatcacgccactggattccagcctggg

SEQ ID NO: 3212 - DNA, 775 bp, Homo sapiens
ctgggtctactctgttccccagtgctggagtgcaatggtgcaatcatagctcactgccaccttgaactcctggacttaagcaatcttcctgcctcaacctcctgagtagctgggaccacaggtgtgtgccaccacgctcagctggatttagctaatattgaaccattgttcctaacactgatttaacaaatactgaaccattactgccaagtggttcagaatctactaaattagtgtttgctgcaactttacagaacataactactgggaataatgaaaatcaacttcattcgtgcatgtgtgtgtttattagtgattgaaaggtggctcccaaaaagatatgtacatattctaattcatggaaccttattcggaaaaaggttccttgcagatgtaattaagatgaaattatcctggattatcaggataggccctaaatccaatgacaagtgtccttataacaagcaactaaagacagtaaaggagaagaccatgtgaatttgaagagtgttatcgtttcaagccgaggaacacctggagcaaccagaagctggaagatgcaagggaggattctccccagagccttcagagaggcacaactctgctgacaccttgattttggacttctggctgctagaactgcgaaataataagttactgctatttgaagccactaagtttggtggaatttgttacagcagccttttggaaactttatccgcagaatcagacacccgcacacccttagaaacccacccccccacatacgtaacgg

SEQ ID NO: 3213 - DNA, 400 bp, Homo sapiens
ctcagactccctcacggcatagactgacatgttagacaagttcttaccaatgagataaagtgaaatttttcccacgaggctaccagaaaaaactttgttttctgataaaaaagggacatatttatccggtgtgcaccttttccccttctgtcctgcctggaatgtggctgagatgtctggagcagcagcagctaccttgtgcatgtggaacagctgatgtaacaggattccgtcagacaacaaaaatatatgggaacatagggtttcctttggcatcatatggtgttcgtaccagtcctttattgcctaacttcaaactttccactaaaagaaaaaataaatgctttgtttgctaacgtaaaaacaaaaaaaaaaaatggcccccgctggcctcagccgg

SEQ ID NO: 3214 - DNA, 307 bp, Homo sapiens
tgaggccaacgaggccattttttttttttttttgagggttgagaactccatttattgtttaactccaaatttagcatgttctagttaagaccttatatcagtcgttaaatcttggtgattaaatttccaagaaaaacaaacaaacaaacaaaagcatttcctctgtggaaggcaatatgctgtattggttaagaacacagacaggttctggcagcagatttagctgtgtcaccttgagtaaatttcttactctccttctgtctcagtttccttatacatgtaaccaaacaccatctgtttcccaata

SEQ ID NO: 3215 - DNA, 1340 bp, Homo sapiens
  misc_feature (1)...(1340): n = A,T,C or G
cttcaggtcttccacttgtcatctatagcctgggacacatgactattcaggacactggagaacagagggaaacacctggcttgtggtctccaatcagtcttttcattcatttaaggaaatcatctgctccagcctactgctatgtaacagcgggctgcgctgaatctttagatccagactcaacatggcagtcctattcctggcggagctctctgtccagtgagtacgcttgtaggaaacaagtgaaatcccaggaagacagtgaaagagagtggggagcagttaatacagataaattacttcagagaccaagtggcagaatagtgctacagcgttaataatttactaccatgacatgaagtcatggtagtaattgtgcttcttctcaccattgtcctaagattaaggggtaaacgcccttgcgtgtctttgctgaactaggaagctcctgaagtagccgccttccccctgtccctcagaaactggaaccggattaaggggcaaacgcccttgtgtgtctttgctggcctaggaagctcttgaagcagccgccctccccctgttcctcagaaactcaaaatggctccctccgatggctcgactccggcttgtcccgggagcctccaccaacctggccccgaaaggtagtgtgaactagccagcccgggcccttgggttctcctcgccatgggcagggcaggctgaaccgcagggctggcagatgcaggagcctcccgctcctgccttttcccgggcgggcgcacaccggcctgaagtcggggggctcggccagaaaacagcccaagggtccagggccaatgtgtctaagcgagagcgtgactcccaggtgcactcgntgcgctagccctgcagcctctgcaaggaaggcccccgcccacgcggcccgcgcagactcctgctgcgtccactggatcctgagcgccataggtaggggcggcccacgcgtggccttcattctcctcggtccgcccgtgagcactgcttagcccttcagtgccaccggaacgaacgtctgggcgctttggagctgcagaggccaaggacggctgcagccccaggtaatcacgatggatgatggggcccggggttcactcccagaaaccatacccgggcgacccccaatgcgaactccagaggtggcaccattataagttaggacgtttctcagggcttaaagtgaagggtactgaaactgacactcctgttatttaactaagttttccctcccctgttttaaataagtttatttagacagggagaaaagactcctctaccccattttgggttaaaaacataatccacaaaaaaaaaaaaaaaaa

SEQ ID NO: 3216 - DNA, 449 bp, Homo sapiens
aaaaaagaaactaccatctaaatccagttattccatctgacttggtagcagtgatgtttggagtttaggacctaaaggtgaaatggggaaaatctgggtgctcggaaagacaccagaagcacacggaagaagatcatatgaagacacaacaagaaggtgactagctgcaagccaagaagagaagcctcagaagaaatcaaacgtactagcaccttgatcttggaattccagtctccaaagctgcgagaaaataaaattctgttgcttaagctgccaagactatggtattttcttatggcaatcttagcaaaataaccctattagcaaacaaatgcatacaaaatctctgtaaatacagcaggtttcctttttaaaaaaactctttattttgaaaaattgtagttctacaacaaataataaaaaagatatacaggaaaaaaaaaaaaaaa

SEQ ID NO: 3217 - DNA, 911 bp, Homo sapiens
ccccccatccctcccctcacaataaacccgcatgtcctcagcggacacactaccaacactttataggagcccccggatcttatcaggctcagcctagatgagcgaatttatgtgaaaatgagaaatgaccgagagcttcgaggcagattacatgcttatgatcgacatttaaatatgatcttgggagatgagggagtgggtcggctggcgtccgcgcgagttagcgggcggtctctgcgtccccctccggcttgaccggcaagcgcgagaaaatttttttttgttggcaggcaagaacggagcgttgattgcgggagttttttttgtcagggtgcccagtcgtcatcctcaccatgcctcgaggtgcgccgtccctctagcgcccccgtctgcctttccccgcccctagcccccaccatccgcagagatagcgcgcgtcggctcgcgccacgcgccacgccgctcaggccacccgaccaaactgacgctgctcctctcgacggtggctacccagctgccgtagtgcgctctcactgtcccgacacgcttcttttcatacgtgctcaggccttatgttccggtgatcgctgtgtgcagtcgttttctcgtcttctggtgtctatactgcttttcttcgcgacattcttccgccgtccctccccgcatcgcccccaccgcgtctcggctcctgccgcctggcgtcctctttcctcccgttcgaccgacctctcatgctctcgtcggttgcgcaggtttctctcccctccagcccttctttcctccccttcctccccttcctccgtccccccactctcttctactccaccccgcgcactcctctccgctctccctattccccccttcccccccccccgctgccgttccccccgcccgcgtctcccccctccccc

SEQ ID NO: 3218 - DNA, 1210 bp, Homo sapiens
gtaggggccttgccttagagatgtctctgaacaatttggaccctgacaagaagggtcaaggagaaatcggatactcttgtgattcccccagtcaaccactgttccagttgcttatctgctgagacagcagttcttgaccccagctacacattaagcttaaaaaaaaaattactgttgcttggaccctagcccaacttgtgaaccagaatttctgggggtgggtcccagccactggtgtttttgaaagtctccctgggtaattctaatgtatattcagtattgagccccactggcctgacactttcattcccactgaaacagaagtaatccactacagaggagagaaggttgttccattctaagccataggagtttttagttatcatagctccaaacccataggaactggcgtgagagcattcttacgtgggtgatggatgtaggagctccaggatgccttggaacgtcttgtcccagtatgtttctgcttgtacaggtattcaaaatgagggccaaacccttctttggaatccaactctgctctaggctagttggctgcccccagaccaggatttagcaccaacaaactgagaatgtgatcagaggactggggccactaacataactggaaaagaaaagcagaaaagcattctcccaactgctgttcaattaattcaacaaatagctgtggccttggctgcaaaggtaccaaggtgcaatgactaagaactctagctttggggtcagatagtcctgcgttctcatgctggctccacaaggcccacaagctgtgcactctgggcaaggtaccatatgagcctgaagttcccatctccccctaagaaaatccccagaaaagagttttcttgtagtgaagcccttacaacacctgtcatattatagggtgccccctcaattactttacttggaaaaagaactatttgcttcaaatgtacatcaccttagatgacctcaattaatgcaagtttggggtatctatagaggccaaaaaccaaacaaaatcagtttttttaagtgacagagaaatttttcaatttttaagtgtatgggaaattcataacatttatcataactgttttaagtgttaagtatgttttcattgttgtggactagatctccagatcttgtagaactgaaactgtgtactcattaaataactcctttttgcctcttaaaaaaaaaaaaaaaa

SEQ ID NO: 3219 - DNA, 902 bp, Homo sapiens
  misc_feature (1)...(902): n = A,T,C or G
ctcagtaaatgtataaaacgataatcatggacttctggtttcacctctgtcatgtgaagagctcggatgctatcacttctctcctcacaacaagaacaaagcagagcaaactgaaaatcaacaacctttcttgcacccatcaaagaattgaggtttcaaggtaaaccagcaccacaaaatctgaagagacacgcagagattcatagcggagatctgttttttgaagcaaaaaccactggagccttacattggtggatgtacctatatggtgattgtgttgcctcgctggaggctgagtgtggactggttgagagtgagaactcctaatggctgagtcttaggacaatcacacattcatgggtcttatctctaggaatcccactaattcagggagaattacatttctagcaagaaatataattatattcctatataatttcatatagcaagaggaggagaaagctaaccattttgaaatactcccagaacattttccattttaagaaatatcttccctgcaagaaaaaagaccatcaaatccttatacaacttgggaaaaagaaatcatacanatccagtcccatctagccttcttgtatcaccgaaggggaggggaaaattgataagaacatttgtgaggtcacatnctcagaacccaggcccactcaaaacnaactgacattattataacattatagaatacttcctttggcccatatctcatcaacacatcaacaaaaccttcagtataacgataatagggtatagcttaaagaacttgcagacagagtctatttaagagaagcgcttngttccttntgccaaggtgatgggcagaccaattgcgacctaataacctaactggtgccctacactcaggaacgttttccagtcaactctgc

SEQ ID NO: 3220 - DNA, 764 bp, Homo sapiens
  misc_feature (1)...(764): n = A,T,C or G
tttttttttttttttcgcttagaatgttgcaaatatttattaatcatatcttttgttacaaatttgttaaaaagtttaattcaaaataaacgctttcttttgtgctgggtcaaagtcttcaaattttgttctttcttgcctttttagcctgccttgtaattttcttgctgacagctagacataatgagtcaggaactgtggtaaataagtnntttttttttttttttttttttttttttttttttttttttaaacagagtctttctctgtcacccaggggggagtgcaggggcacaatctgggttcaccacaaccttcgcctcctgggttcaagggattctcctgcctcatcctccgagtagctgggattacaggcgccggccaccatatccagctattttttgtatttttagtagagacaaggtttcaccatgttggccaggctggtctcgaactcctgacctcaggtgaaacacctgccttacctcccaaagtgctgggattacaggcgtgagccaccgcacccacccggaaaaaaaatctttaggggtagttcttatgctaatcctgctaggagttgaactggggataaacgttggctgaacttgttagtgccaccaccttaggtttaataagggccggcatttgggccggcccctcacctttggcaaagggaaccaaagcgctccttctaaaaaaaccctggctggcattttttaaacttttaaccatcttggttaacctgaattttgggagatgggggg

SEQ ID NO: 3221 - DNA, 709 bp, Homo sapiens
tgatacctgaaaaccatatgacatcgcatctaacaattctccttccatggacaagtgtgtgacttaagtaactgactattacttgatgatgctgaagaactttagccatatgggcctggctaaaatgaaaaggtagattactaagtgaaagaagtcaatctgaaaaggctacacattgcatgattccaattatacgacattttggaaaaggcaacactatgaggacagtaagaagatcagcatttgccaaaggcttgaggggagggagggatgaatagtggaggacacaggggtttcagggcagtgaaactgttttgtaaggtcctataatggtagatatatatcattatacatttgtaatgcccacaaaatgtataacaccaagcgtgaatgctaatgtaaactatggactttgggtgataatgatgtcaatgtaggtttattgactataacaaatataccacctggtgtaggatgttaatagtgggaaaggctatgtatatgctggggaaaggaatctatgagaaatctctgtacattgagcctaactttgctgtgaaccaaaaactattctaaacaataaagtgtgtctgtgtgtgtgcttgtaatagaacagccttaaaacttgatttgctcatatgttcattagcctttctgcaagtcacagaataaaagaaatatgatacttcataaaaaaaaaaaaaaaaaa

SEQ ID NO: 3222 - DNA, 891 bp, Homo sapiens
  misc_feature (1)...(891): n = A,T,C or G
aggccaagatgcagctgctgtgcatggaaggttctggagcacacaactgtgagccccaagagcagagtgcaccctgcagctgctttgtaccgatgcatgtcggcgggctgggctgccagaagaacctgttctcgatcttcacacagctgatctctgcacttccctgcagcgcgtagccagggtcacactggaacactgtggagtcgccggcttcccaactgtcaccactccgactcccattctgcgggatcccagggtcattgcaggacgttgctgtggacactggggcaaggaaatagaagagagggtaaggtcagctgggtgtatgccactcaggaggctcgcaaatcatcaccctcacggattgccatcatccngagcattgcgacaaccacccgaaccctgagctcatcatcatcgagatgaagccacagtgccactattctcactcccggtactatacctgcctgccgaccaagtgggatcacaattgtcactcgcactgatattaccactaccacttcttgcccncccttgcacctttactgtcatcttgccggcctgaagaagctatgagggaagcatgattatactcgtaataattatacaattggaatccaggctaagaatagcagcctttgtgacataaccacagcaatggggttatgcgataaggcacctaacatgagccgaagagaggaaggacctgaaaacccagggctaacttccgtgcgccacgggaagggggctcagtcccataagtccacgccctggggagggcacggacgagagggaacttagggtgcgggaccccgagaaccgctcgagcacacagcatagccacgccctctnaaaacaatanaaaatagcggcgtggggaaaggcacctaa

SEQ ID NO: 3223 - DNA, 481 bp, Homo sapiens
caagaagagaatagaggcaaagcaagccactccagaagtcctctagccagctttgtctttagtttgatggccagaggtgggccatatggacactctgtagctgcaagggtgctgggaaagcgagtaacttctgagaatggcaggagatttggaatgattcatggattggccaacagtctctgctacttgaggctaatggttacacaagatttaacctttaaccagacatcaacaaatttttgagggcctattattcatactccaaaataaatacgaaagtcagggatccaagaaggctctttcaattcccagaaaggggataatatatatgctatattccatagtacatagtggataaagaaaaacaatatactatattttttgtggtattttgatcctctgctcgtttacctgcagcaattatcagtaaaaaaaaataaaaataaaaatataaaaatacttttaagaaaaaaaaaaaaaa

SEQ ID NO: 3224 - DNA, 472 bp, Homo sapiens
gggccggggttgcttttttctggccactgagtccaaccaagcctatctaaaatagggctggtgatacacacttctctcatctggagcttcatgggtgaattccaaattcttctgtcccatgatctgcatcaaggcatctaatttatacttaaaagcttttgttactaaatttggactctgtccaaaataaccactcactgcatgctgttattgcctaccattatttttaaaaaaatacttttcataatctgaagctatccggtattgaatgtttaccatgagtttcctgctgctagaaggtaaacttagtgagaacagagacacaaataactttttttcactatcgcatcctcattgcctagaagagtgcctggcgtacagaagacagtcaatagatatcagttgaataaatgaatgacctagcatagtagacattcaataaatatcagttgaatggaaaaaaaaaaaaaaa

SEQ ID NO: 3225 - DNA, 832 bp, Homo sapiens
tttttttttttttttttttttttttttttttttttttttttttttttttttttctttttttttggacctttcacaaaattttatttttatcggttggccttatccaaaaaattcaggggaaatatttatatttattttggacccagaacacctacctcacctttttttaattttagaaactttgggggacatagttaagggctttataattggaaaattctttcaagtaatatgaaaaaaaagggatatatctaaaaatattttaacaaaattcccatgatttttatcaattttcaaaataatccctaaaaagtaaaataatgggccctttcaaaaccgaaccatttgtaaaaatacaaaaaaaagaaattttccggatgaaaaaccccaagttaaatattcccaaaataaaacgttgggatcgcccttcccagtattttaaaaccctcaaaaggggttccctcctttattaaataaaaagggatcttcaagttcgctaaaaaagaaaaaccgggttttatgctggatacagaaaaagaggagaaaaggcgtatataccacattagaaaaggtgcctcagccggtttaaaaaaaaaaaacacgcgaaagtgaggacttgtaccaaaaaagcgtcagatgtcctctaaagttctttagacaaacagaagactctcgctgataatgccataccccaacggcactttccgagtccagagacgtcagctttaaaaaataagaccctttttatagcgcactcttaacaacaaataaaaataaataaactttatcggcagaaagtctgggactaaaagaaccacactacagctaaacg

SEQ ID NO: 3226 - DNA, 135 bp, Homo sapiens
ttttttttttttttttcttattaaaatgaaatgtattttcatatatataaataatttgtattaatttgtagaagtttgcttattgataaagtagacagtcacatatttattgacattttcattttaggggacaca

SEQ ID NO: 3227 - DNA, 783 bp, Homo sapiens
cttaggctacacaaagtggtgataatcagaagtcagagaccgtgacttggccttgtgttgctggaagcgcaagttggcagagccacaggttgcagccctggcaagatcaagcaaaagtttcctgtctatcacatttgaaagtcttttttcacatctaggactgggcatgtagattcttttgtagtctggacaaatcagtagttgtgccatcttttgttaggatttcttggcaaatcttttgtatcctttctttcaaaacttctatatccttatattttagatgtggctcttgtgaacaacatatagctgaattttgtcattgttttatccaagctggcaatgtttttctttaaattagatcactttcttcatttacgttaaatgaaattacttatatatgtggatttaaacctaggatcttattatgtgctttctgtttgtcatgccaactctatgttcctttttctctctcatatttccttctattaaactgacttttggcaattccaattctttcccctctaccaatttagaggctatgtgctctatttctaatattttcatggttactttttaacatgcatgtttaatttatgaaaatcgaatattaattgatacctttatttttacccatgaaaatgcaaaggaattagaatactttatcatccctcctgatatatatattttcgtattttattttttatctttttaactttatagacaaaattgcatgtatttatcaagtaaaacatgatgtttgaaatataaaaaaaaaaaaaaaaa

SEQ ID NO: 3228 - DNA, 586 bp, Homo sapiens
ctaggggaagtcagctaccatgtcatgagcacccctatggggagacccatgtggccagaaactgaagtctcctgcaggctgccatgtgagtgaagttgggagtggatcctccagccccagtgaagccctcagatgagactgcagccccaggcaacagcttgactgcaacctcatgagagacctaatgagcagctaagccactcttggattcctgacccccagaaactgcatgagatagtaaatgtttattgctttaagatgttatgttttgggataatttgttacattgcaataaataaccaatacgtggtgctatcaagttagtgtaattataataacagaggtactcaaacttggaaactgctaagcaaattatgatatattatcttgatgaactcatggatattgttaaaattacaagcatttttgtgttttctccaagcatgtgtgtacaaaatggcttgaaaaaacagagtgcagatacatgcactaattaaacaatatagaaagtatgcatgtatgcattttcttaaagatcactgaaaatttggaattaaataaatagctacccttaaaaaaaaaaaaa

SEQ ID NO: 3229 - DNA, 804 bp, Homo sapiens
cccggtaagtaaacctgggcccaagtatcacagagcacacagctggaattcacagcaagacctgattgacttcgaagtcagtggtctttcccctgcttcccacgagacaggttactacatgaagagctgggactggaatacaggttttctatgttcacctggggatagcttttccatcatccctcctgagtctgtgaggtatcccagtttttaagccagaactttgaaaccagaagtaaatggttaagtttatctgtctatgcctatgtgtattctagccaaataaaccatgacacttaaaacaatttcaatatttcaaagatgtagtaaatttccttgaaccttttttattgttttttataaattaaaaattatgaaataattcaaacatttttaaaataggaaataacgtgatatgcatgtaccccatacccagatttaatagatgtttacattatgcagtatctgtttctttttttttttttttcttgagacagagtcttgctctgtcacccaggctggagtgcagtggcataatctcggctcactgcaacctccgcctcccgggttcaagcgattctcctgcctcagcctcctgagtaggtgagattacaggcacgcaccaccaagtccagctattttttgtgtttttagtagagacagggtttcaccatgttggtcaggctggtctcgaactcctgacctcgtgatccacctaccttggccccccaaagtgctgggattacaggcatgagccaccgcacctgggcttaattttttgatagaagaagacatccaggccca

SEQ ID NO: 3230 - DNA, 359 bp, Homo sapiens
cctcagatctccctaagatacaacacaacagtgcctagcctggaagccacaaaggacttcaaataacacagagaagtgacccaccagaattacctgggaagcttttaataagttgtggatgttgcttgagaatctgtgcttttgttatgcagtgttcttgcagagattatttccacttgcctgccgtgcatagttttgaaaaaagccaaactagattgtgagctccctgagagcagggacatactcctttccctcaaaattatggcctttgtgtctcgtataccttctgacagatattaggcactgaataaatttttgttaaatgaaaaaaaaaaaaaaaaatggcctcgttggcctca

SEQ ID NO: 3231 - DNA, 744 bp, Homo sapiens
ggcacctgtctgtgagccaggaagagagctctcaccaggacctgaacatgctggccccttgatcttggacttccagccttcagaactaaaaaccacaggagagagaccagaaccactaactccttgagagactctaaccaggagcccagctgaagcactactcattatacacacacatttcttgatttaggaaaatatctaacaaagcaggatggctcaaatctacttcaatgggagtggaagaagagtgtctttcccattgctaggctgttatatatgctgtttatttctaaagcctgccagagaaggagaaggagtctaggcctcttatgccatggattaacatggaagaggcgtgggaacaacttggggaattgctactaagaaagtttatctaaaaataatgtccagccaggtgcagtggcttatgcctgtaatcccagcatattgggaggctgaggcaggctggttgcttgagctctggaattcaaaccagcctgggcaacgtggcaaaacctcatctctacaaaaattagccggtgtggtggcatgtgcctgcagtcccagctacttggaaggcagaggaaggaggatcacttgagcctggaggttgatgctgcggtgagctgggattgtgacaccgcactccaacctgggcaacagagtgagactttgtctcaaaaaaataaaataaaaataaaaagcgtcctttttacttcatgatgcgcgaaaaaaaaaaaaaaa

SEQ ID NO: 3232 - DNA, 1025 bp, Homo sapiens
gttagagctatctcacaatagcaaagtcatggaatcaacttgaatgcccatcagggatagtctggataaagaaaatatggacttttcctctgttcagctaaagacgagggtcttgcccatcccacggccatgaaaatttaggcttgcagatggtttaagagactaattatacaacctgtcatggagaacctcagtattctcatcattacagtaagaagatagaactctgcaatcttcaaatttacttctaattcttagttgctgcaaagtagtgaaactaccaacaccagctagtctaatggaccccatgaggagctgaccctccaaagaatgcagttttcacagcctgatgacttcatctcccttatcttgaccaatctatggccccacttttgcaatcctttacccaccataatacacttatgaactccagccctgaactcctggaggagatggatttgagggcctcttcctgtctcctcacttggctgccctgcagttattaaacattttctctgctgcaaaccctgctgtttcagtgtactgatcttttactgtgtagtgggcttacgaacctgttggtcctgtaacagtatgaagaaaagaaggcataagaaggtaaagtaacttcctagtgtagtgttcatatatttagtaagtacctgagttgtaaactgccaccttcaaatgcaccaaggaattacaccattaatcacaaagacacagaaagaacacatggtatgggggataaatttttaaaaattctaaaggacttttaggtttttctcaacttcttaacttacttgagaactgggctaatttgtatattcagaacgtttataaccaaaactttttagaaattttcagtttaatcatactctattacagaccgaatacttgtatatactcaaaaattcatgtcataaattttgtgttttctaactgtaccaaatatattaaaagcctatatttatcatgtcaccatttattttaaataaaatgacagaatgtaaaaaaaaaaaaaa

SEQ ID NO: 3233 - DNA, 666 bp, Homo sapiens
aaaagtatgatagttgtactttattgtgctctagaaaaagcaataaacccttctgcaaacttcataagatagcacagtaaaaggaactctacaccaagaggacattttcccttcaaaataacaaagcagaacacaaagtaaatcaaagcatataaacggagaaaggaattccgttgcctttgaaattgaactccagaaataatttacttaaaaagagttcctcagatatagcttgaagtctaaagacaatcattgatcatcaactggtattctcttactccatcagcactccagatacaaagcaagagaaaacccagagtaaaaaatttaaatggacaatatttcatctgcaacctggaaagtcttctatgcttgctgttgtattgactttcctacttatctcagaaaattgtgcatttaatcatctctctctattttctttgactcttttccagtgagagagtataagattgtttacctaaagacctcgaagtctagcaagatgggaagcaagttgttacttaagcaggttgggggggcattatgggcacaatgaaaatcaatcattggttctctttgcctatcaaaatacatcgttcacataggacccctttccccaataaatttagatcatgcctactctagaaaaggaaaaaaaaaaaaaaa

SEQ ID NO: 3234 - DNA, 250 bp, Homo sapiens
cctaggtgaagaaatggggacaagtagaattgattttttcagcgcaactccactgttggtgaaaaaacctttcagagaatttaatagattgctggttttcctaataaatatgcccttctggaaatatttaagttataggcaggcatgcttatgaagacttccccatgaccttaatacaaatttttcagaatataaatataactggaattaaaatacatctattatagtatgatatgcaaaaaaaaaaaaa

SEQ ID NO: 3235 - DNA, 378 bp, Homo sapiens
gtgaagttatggacataggatctatctttgatcctgctgagaggttctagggagcgaacaatgatgaggccccctgatactagccccaatgctacccaaaaagtcgaaggacaaaaataggactaggcctctcatatgaagaaaagactgtaaatgtagtcctctggcttccagggaaaaagaaatatctgccatacctggttgaggccctttaacacctaatgaattccagcaaaaggtcacagaaaactctctgaagactgatacaaaggttttgaaagaaccctaaatatagcctggggttggtcttcacacctctgctgatacaacactttctctgacgtcattcacgctcctttggttgcttgagaggaaaag

SEQ ID NO: 3236 - DNA, 832 bp, Homo sapiens
agggtaacccattcccactggggaaagccatgtcatgaacagccctatggagaaaaaacatgtggcaagcagctgaagctcctgccaacagcctcatgagtgagattagaagcgaatactccagctccttcagaaactgcagcactgcctgacagcttgactgcagcatcttaagagactctgaaatcagaaccactcggctaaccattcccagattcctgaccctcagaaaccatgtgagatcataaatgttcattgttttattgttttaactggctacatttgggggtaatttattacacagcaatagataaataatacaggtagctagtctccaaagaggctccttcctgtccttacatactgctcctcacatcaagagatggagcttatttttcctttctttacatttgagctggccccgtggcttgctgaacaatagaatgcagtcaaagtgacattctgggacttttgagaccagcttttaagagaactggcagctagctgcctcttggaatccagacacatgctgtgagcaaccaaagccacatggatcgggtatggagaggagaccagagctgctggttgggcactccagctgacctccacccacagccacgcagatggttcgcttgcagtgagccctctgatgcccatcaatgaccccccagggactggagacccaccacacctagggaagagaactgcccgcaacccacagactggaaacacaaagggtggattataagcacttaatgggggggcgcttcggcggactccgcgccccccgctcccccagaccttccgttgctttttgctacgacgcgactct

SEQ ID NO: 3237 - DNA, 924 bp, Homo sapiens
ctcagactcaccaccaaacacacgtaaatgaaacataagatgcataaacacaacccttgcctttgaagaaaatttgcactaatggcagagatgggtgctgtatgagtgagctgtggctgccatagcaagacatcatagattggatggcttaaacaacagaaatttattttttcacagttctggaggccagaaatccccaataaaggtactgactgattaggtgagggctttatttctgctgacagacaaccaccttcttgttgagtttttatacggtcttttctctgtggctcatagggagagacagagagagctctggtgttttttcctcttcttattaggacaccagtcctgtatcactaaggctccatcctgatgattccacttagccagtaactatgggaattagggcttcaacatactaatttagagaaatgtgattccgttcataacaggtgcttaactagaattctgtatgcacattgttttatgaaaaagcgacatgagacctaaggatttactgtctgttgtagaatttctcatataaagaagaacctgaggcaagtacagaaatgttacctccctaccttctcattggaaagcagctcacagagaatacaatagttctacccactatgcccgtataatgcaatgatatatatccgtcactaaaatctccatgcttgtctcacccaacgtctcaaactatgctataactattggcggatctcacataattgagcaatctgaatgatggaattgtacactagttgaatacaggagatactattttacatagcacagcaaagctctcccataactctacaaatagggctgaaaaaatcaaatacgtaaaatgcagcgtcatgttattgcatggttaataaaattactgactcttctcagctaaaaaaaaaaaaaaaa

SEQ ID NO: 3238 - DNA, 879 bp, Homo sapiens
cttcagaagcacgaactgaccaccatgtacatcagctggaacctttctggaatccacacagtgtaataatccttaggaaaagctacctgggattcagctgttacaatcagaaggccacgaacactcaactggaacctttcataatcccagtaaaaggaaagattcagctcttgtcctgattgcagactttgtgttggtattttaaaatctgtatcggtgaataatttcaaattttaaatctacctacatagttgacaaagactttggactgtgatgattttaatgtgtatctatgaattatttaatactctttccttcgaagggtagaatacattttcacttttcttaagtgtggggtaaacttaatgactcatttgtaaaaaataaattgaagtatgcatagaggtgtcacttctaatgctaggtcataaaagacgttctgttttctgccctgttctgtctctctctttgatcattcaggctgggggatgccagctgccatattgtgaaaaccctcaagcatccctgtggagaggctcccatggcacagaaatggactctcagcccaaagccaacaaagaaccaaggcctcaagccagcagccattggaatgggaatgtgccatcttgaaagccaatcctgcaacccccagtcagcccttaaatgacagtagcccccacccattatcttacccggatcttacctgaagactctgtccctgctcgaccctactaaaccacctctacacttcctcgaccttcaaagtagggagaaaaaaaacctgccttccgtttaacacgcctagctttaagggtggttcagtcttccatcacacaacctatactgaagccagttcaccccgcgccccgccactcctcg

SEQ ID NO: 3239 - DNA, 876 bp, Homo sapiens
  misc_feature (1)...(876): n = A,T,C or G
tttttttttttttttacctttggttaaaatttgtttaattttttaactggtcagcatttataccacacttttagtaccccaaaatttaaggacatcagcttcagtgaaaaaagttattatcggatttagaaacatgatacagtataaaggaagatagatatacagaattttatgactgcatgtctctctattgatgaatgtttagcataatagaaattgagtacactttcttaaagtacaaacacgttggtatgagacattgcacaagtggatgggcttttaggctaaatctgcctgtatgctcctcaaatctttctggttgtatcttatataattttcactgccaaagctcctttttaatttgtaaatgtgaaatggttggatcaaagtcttataagattcaaggattctaatccaatttgatgtagagcaaaacacgatttaaaatctaaataattcccaaactcatgaagctgctttctgatctacattcttttccaatcatcacanagcaagactccttctgtaattctctcttcccaacataggcatcttttccatgcatctctttggcaaccttgaaaaaattacccttgctctggttcatttgatttagtggtctggaaatttgaaaatgaggagatatgttaaaggtgaccccctgcagtggctttggcagcatgaggtattccggagctggaacaacaatggcaggaagcctcttgaaagagcagcagtgctgacatgattgggcagagcagcaaaggctgatttcctcacactgaagctctcctgccccaggcgtcttcctctgactgtcaccctattaatgcacagcgattgctaggcaagctccaagtcatcgtctccctagcg

SEQ ID NO: 3240 - DNA, 586 bp, Homo sapiens
ttcagagtactcaacaaatattaccttgatttgaagacatgctgcttcttggatttacttttatctacagaacaaactggacaatgatttccatgtcataaagctttcaatgatttggctccaaactttcttttcaatatcatcatctatagcttctttcatctacataccctctgattccataacagtgaacatggcataaactttcaagaaaatcttgtgcctttgtctacataatctcttaacatggaatttccgtttttttctgattatttttcatctttcaagactaagctgaaatgctctacatcttgaacgttttacattttcttcagtgtgagctatttactactactttcacatttttgcaactctaatatgtcaacaaaattcattctagtattttgcagtaatattgtagatgcttaaaataaatgatgaatgaattcataacagtcaaagattttctaaaagatatggaaataattattcatataagtgtcatatcctttgacttaaaattttaataaaggattaaaatttatttttctcaacactgaaaaaaaagaaaaaaaaaaaaaaaaaa

SEQ ID NO: 3241 - DNA, 534 bp, Homo sapiens
atcaaacccaggctagagtaagactaatcactataaggcaccaggtactgtatgagtgagctgtgtctgccatagcaagacatcatagattggatggcttaaacaacagaaatttattttttcacagttctggaggccagaaatccccaataaaggaactggattgaagataagattggaggaccacaatttcaccagtacgttacttagaataagcaacctaccgtcctcacaacactccctattttccagatgagagtgttgaggctcagagaggtaagcaaattgtttaacttattccagctctcaagtacacacactgaaatatagccaacacctttgtaaagattacaatcgaatatattcttgttttggggttggcaaactttttaggtaaaagaccagacgttttaggttttgcaagccacctgatctttgtcttaaagactttcaactctacctcttgaaggcagctatttacaaaatgtaaatgaataaatgtgactgtgttcccaccaaaaaaaaaaaaaaaaa

SEQ ID NO: 3242 - DNA, 297 bp, Homo sapiens
tgacctacagagaagccatggccgcagcctcatggagatgctcctactacctgagacagattctacaggcaaagagcctcccgccatcataggtggagtttctctcgaggaggctggaatagtgctgtctgaagcagcttgttttggaacttctttctatgagtgatgctaacagcagcaacaacttcatctaggtggttggatatgtgggtttcctgtgattcttgcatatttttatatacattgtcttctaattctaaaataaaaaacaaagatgttaaatgaaaaaaaaaaaaa

SEQ ID NO: 3243 - DNA, 633 bp, Homo sapiens
ccctagacaaagcaagaaagaaaatcatgcagaagaattgtttgaagagataatgactggaatttttttcaaagtcaatgaaagacattaacccacatatacaagaagctcagagaatctcatgcaggacaaatactaggaaaactgtattaatttggggaaacaataataataagaagaattaaagcttactgtcttgtcatcataaaaaatggaagccagaagaaagtgatttggtgtcttaaacttctgcaacaacaacaacaaaattcaacctaaaattctataattatccaaaaagtccttcaaaattgaaaacaaaagtaattcatttttagatgaacaaaatctgaggcagtttgtcactagcagacctgcactacaagaaatactaaaggaatttcaggatgaacagaaattattccacatggaagcctggaccttcaggaaggaaagaagaccccaagaaatgaatatacagtaccatttgtaaacgtattcactttactgattaagcaataaaatcaacaatgtgctatgaggtttataagatatacagatgtatatggcaaaaataacacaatgtcgtacaaggaaataaatggaattacatagctcttaaaaaaaaaaaaa

SEQ ID NO: 3244 - DNA, 745 bp, Homo sapiens
aatccgagcgatggttatcgtcacaggctcaggcattggtcccggtagcagtcaggttcagggctcgagaaatcgactctctataggcgtcaaggtcagaatatcagatccaaggcctcagccagtaagtcaaaggtattcaagtctaggaagtcagtattttggaagagatgggttcagacggtggatgtacacttatcaagccctgagtggagtaagattctggagagattcagcaggatggtggctggaaatgaaaaaacagcaatggaaatttttccagaggaaaaaaatctcaacaaacagtgaagcaaacagccactggaaatggcttatgaagctcctggaaataatggatatatgacatcatagttatgttacaacatcttcaatggcaagcggtacaaagcaaggaaatgctgaagtttcatctgaatgagttattccacactaaatattcttaattagtatcacagaaagcatggaaaacaggttaattatttacagaaataaaacaataaaatcacctctaacaagcatgcatatagtatatcaatgtacaatttctgctggaaaagcaaatcctctccaaattagaaggagttcagaaagactctgagagaaaaataagactcttgaataactagttgcttacacctttattcctttcttgaacacttatttagcacctgttatatgtaagattctttgttcattgataggactgcaaaaaaaaaaaaaaaaa

SEQ ID NO: 3245 - DNA, 799 bp, Homo sapiens
gtagtattattctaaacagccgtgatatggaatcaacctaagtgtccatcagtgaatgaatagacaaagaaaatgtggtatatatacacaatggaatactattcagcctttaataagaagaaaattctgtcatttgcacagcatggatgaatctagaggacattatggcaatcttctattggcatgatgccagaatttcttcatctacttaaaacaattgcaatggaatgcaatggactgaatgcagacacagatatgggaattcaactgttttttttaattaatctaaatcttaaattgttttttattaatctaaataataaaaaggtttcccaaaatgtaaaataatgttattcttaccaataatcttttggttttggaaaatgtagttatttttcataaaatatgtttcttctattaatggacaatgggtttattatttttaatcaataaacattttaatttctcagttttaaacacaaaaaaccacgaaacaccaagacacaaataaaagagaaaaaagaaccatccatagggaaataaaccgcaaaaattgggccctcttggcccaaagaggggaccttttgggccctttccctttaggggggggtatccaaagaccctttttatcaacccccttccctcgagctatcgggttacgcaaagcggaacgccccaccacaaggggcgaaaacgggttatcccaaaaattgggggttacccccaagaaaaaacgatgtgaccaaagcgcccgcacaaggccccgagacccggataaggggcccgtggtcgggcgttt

SEQ ID NO: 3246 - DNA, 806 bp, Homo sapiens
ctttcagtcgtcccaagagactaagctgcttacgaggaaacaaaacgctacagacaaatatggacttcctctcctctgagcttccggcctgtgttgctctgcaagggcagagattcaaacaaaggcaataaaagcatctgctgtttacacatttccaaagcaggaccgtggaatccattccccctcactggaataagatctccatggtgacgctgacttcagggagctgggccagtttctcagcagggcctaggcaaggatattttctttacaagagcgccctcttcaaacgaaacaggggatatctctgcagccctggatgcatttgaagccacagaagtcattgtgtctttatcaggtgttttccattgtatcagagacaccaaaatattttgctgtcatccatttaaataatatattttaagcaagagaataaaccatcacagaagtaaaaacgaataaattcattccatctattgcaattatcgagtatggcacattatttctgttttaactttctttttctttaaaatacttcatttgtaatttcttaaacttcttaataccagttaaagatggcaggcttaaacgttctgtagctaacagtttaattggaatgcttctctaccaaaaaagaaatgcttaccactggcttttttttaaaaaaaaatctagttacctatgtttctaaggtgcccagtcaacacccttcctctttctgcacaattcgtaatgtgaccattataattaacttttcagttaaaactttgcacatatgggggctccttcgcctgccaaaactaaat

SEQ ID NO: 3247 - DNA, 453 bp, Homo sapiens
cttggtcctcccatctcagaggatgcatcctcatgagtgcaggtttctgccatcgatggaattcataccttcattccctttctgatcttgagagttccaactaaccctcctgagttgagaccatcccactttaatctgggaagcattaagcctccaatcctaatctttgtttaaaacgtctgtttggaagttgtcttctgggtatcctgctgcttgcagcttctcttttctactctgaactacaccaatcctcatgggggtcaagaaagtccacacttcaaggacatgaagcctggttctctcctgcccctcgccccagggatgaaatgcctttcattctttttaggtgagcctgcagctgagaaaaactagacatggttatttcctcaataggtcattctgctacaattaattctcaataaatcttcaccatgagactgaaaaaaaaaaaaa

SEQ ID NO: 3248 - DNA, 588 bp, Homo sapiens
ctcttcattcaaaaacaactgaatcatggtcaatagttgtgggtctccggactacagcagaggctgtgatttcctaccagtatgcctattgcctatattccccttatgtaatagactgaattatgttcctcttaaggaagataagtccaaatctgcagttcttccaaatgtgaccttctttggaaacagggatattgcagatgccacaagttaagattagttcatgttgcagtaggatgtactcctaatctgatatgactggtggccatgtgaagataatcatgtgaagacagacacacagggagagctccatgagaagatggaggcagagattgaaatgatgcatctacaaaccatggaatgctgatgattgatggctatcacccgaagctaggaacaggcaaggaaggattcttccctacatgtttcagaggaagcacagacctacagataccctgattttgaactgttagcctccaagactgtgaaacaacagatgtctgttgttttaagccacccagtttgtggtactttgttatagcagacctaggacatgaatacactttgaaaacaaaaaaaaaaaaaaaa

SEQ ID NO: 3249 - DNA, 250 bp, Homo sapiens
agcctcccctacccatcatcctgtgcctataaagaccccagacacagtcagtagaggatagagaggtgacttgacttcagagagacagctggacttcagagcagagacaacttgacttcagggaagatccagctggactttgtggggagactgcctgcctgtcctgtcccctctcctgctcccctgtctgctgagaaccatttccattgctaaataaaattatccacttttgccatcaaaaaaaaaaaaa

SEQ ID NO: 3250 - DNA, 318 bp, Homo sapiens
cttagttctggagggctggaaagtctagggtcaagatgctggcatttggtctgataagggccttcttgctatctccttacatgacagaagacagtcgaacaaagtgtacaattgctgagagatagaagcaatgcagccccagaagaggaagaaaaatgacaggaaatcccgatccacacttgaccaaaatcatcaaacaatctaggcaactggttttcactcgtatgatagttttttaagttgtcagcaattcttggcaaatacaagaatagaaaataacttcagtaaaactctgagctaagaggaaaaaaaaaaaaa

SEQ ID NO: 3251 - DNA, 413 bp, Homo sapiens
aaaaggcaagggctcatgtctagataagataataagaaaatacctgggtcgctgttggtctagccttgcctcccgcatacccagtctagagcctggccacatgcccatcaaaagactctcactgctctgcctgccttcttctgtcctggcgtctataccctcagaccagccttgcatacctactcctgccagcctcctccaggaagccttgcctcctcaactctcctgcaccatcctcacatttcacctggccactgtcactgccagaggaggcaccactgacctgcctcatggcccagccactgcacccatctccaaccagacccttggtgtgttccccacccaatccatcacaagccactttcaagctttagggaagtgaaaagtactgcctgccctcaaaaaaaaaaaaa

SEQ ID NO: 3252 - DNA, 852 bp, Homo sapiens
  misc_feature (1)...(852): n = A,T,C or G
agggattttcgctgtgtttctcaagcgggcctcgaactcctgggctcaagtgataccccccacctcagcctcgtgactagctgggattaaaggtgtgcaccactgcaactgactttcaattcctttctgaccaaaatcttttatttctaaaaagaaatcaaagaagttaaaattctataaatgattagttactgctgtgcttaatttaaatgttatttatgattatttttatagctaagatcattgtttcatctttagacatcaatgacctctttatatattaatgctataaaatgtttctttgataattatttttgatattgcttttcctaaatataggttccaaacacttcataataaaaattttaagatattaccaataaagtcaaagataacactacttactaaccaacactaatattaaaaaaatatgtacacgaactttctgtcacaaccaataaataatcctgacgcccccccccccgtcacggcgagaancccaaattcctcaaatcctgacgtcctcgtccggtcgttttctctatttttctaaattttaaagaagcccccctacacgcgttctcgttatcgctcttccacttctccatctttcccaaatgtagaacaattacactgtttattttcacccctattcttaatacgactcggattttttttgttttcagncacttaattaacgtattctattttcctgccggcatctttatattatccttcttatacacctctaccaaccacgacaacccctagccttccacaaccaaatccctnnaaatcatatatttttatatagagcccaatacgatttttatattccacaccatcctattt

SEQ ID NO: 3253 - DNA, 781 bp, Homo sapiens
cagatagatgagatcataccagggcatgacccgctcaaaagtacaagagacttgttctttatcacaggaagccaccccccccactacgttgatgagaggagatctccagccatccttgtacccatgagaagctgactcctcaccagcgtttatcctacaacatctctaaccagatccagatgatacaaaacgcacatgctaaaatatgatcccccagccctgtacaagcagatgtggacttcaccaagcccacagcatctgaccaagctgattctcctttgtcgctaaaggggcatcaagcacttacctgccactgcgcgagaaaggagagatgctttacgacaggcacccatatcgcgtatcctaggcacaatggcgagatgaacggtgattgcgaagccaccgaagtgcgtcaatgcgcggccggtgcggcgagcggatgaagcgaggcttgtcaacggcgatgggtacatagacgcgaagaagacgaggcgacgtaaaacgcgattagaccgagataacaggtgagtatgcagatagtctggagtggcgccgtgacgcgatggcccgcctcctctaacgcgccactcaccaggcaagtctctcaccatctcaccccccccccacccacacatcctatataccccccccacccaagcgacgccctactgcccgtcctcgacgcccgcgcttatcttgtcaacctccccgccctcggagtactgtcaagacccccaaaccacggcccccaccactcccacgagtcagtcctcccaccccg

SEQ ID NO: 3254 - DNA, 287 bp, Homo sapiens
cttcagatggctgcaggaggagtcgtagctggaggaaaaggcgatgtgatgacagaagcagaaattggagcgatgcactttgagatggaggaagaggccacaagccaaggaatgcaggtgcccctagaatctgataaaaacaaagggaatggttttccctcagagcctccaggaagaaacacagccctgctgacaccttatctgtctcagggaaaaatctgaaatcttgacctccgtagctgtgtgacaataaatttgtattgcttaaagccacaaaaaaaaaaaaa

SEQ ID NO: 3255 - DNA, 280 bp, Homo sapiens
ctttggatggcatgcaggaggagttggagctggaggaaaaggcgatgtgatgacagaagcagaaattggagcgatgcactttgagatggaggaagaggccacaagccaaggaatgcaggtgcctctagaatctgataaaaacaaagggaatggttttccctcagagcctccaggaagaaacacagccctgctgacaccttatctgtctcagggaaaaatctgaaatcttgacctccgtagctgtgtgacaataaatttgtattgcttaaaaaaaaaaaaa

SEQ ID NO: 3256 - DNA, 793 bp, Homo sapiens
gaaacatgatatatgttagagttaatgttttaaacaaaaggtcaacctctactagtatcatccttagagtataagcaacagaagataatacccaaatgctgactgccgttgtggaaaaaactcacccatatcctgcctgtagttaacggcagaggtactgcatcctgcagtgttggaatggtctaaggaggctgctgagttggatctcactggcttacatgttcatctaaacctctttcctatggattcatgcgtatgcctggtttttgtctaatgccagatctgaggtagagtgaatgtgtgcccttccccattacaaacacttggattgatatcttctcttgggttagagaatagaatttccttctgaggataaagtggacagtgtgcattagatctatcccatgaagttcctgctggttatggtgaatgggaaccaacctcactagggtgaaagttaaaattcaccactgattgaattagaacaattgttcatgctgttcaagagcagagaacagtctgatatctaaagagtttagttaagccccaaggagcaatttttctctcctgttctaagttttcctcttgagtttttcccctgtgggaattattatcgtgtttgcaacattgaaagttttgattgacatttcctacacttgcaggtttttaacacaaacttcagtttgatgacaatataaccaaatcccagggacatgaataaaacactccttttaaattttaaagaaaaaaaaaaatggcctcgttggcatcagcggtggagctctgcgccaag

SEQ ID NO: 3257 - DNA, 787 bp, Homo sapiens
  misc_feature (1)...(787): n = A,T,C or G
tgacagaatacccgggagaagtttcctttccctaaatatacctgcaattttcaagtccttttaattcacgcctttaaatgaaagggttgagtatacaagaatatcaataagttccaattgaagagcggattcttttgcaattcaggcatgtgccggcgataacgggcgagttggcatgaagagaggcagagatgggttaattatgcagagaacatggaaattctgcttatcatcggctagcaaaggagcccggctcacataatcagcaaacgaagggagaggaaaaaataacaatgcaatggcaccttccagcccatcatcaggatttcttctacccccttgtaattaaaaaataacatacacttatagccctatctcctgtgcaggcaaggagtggatgtccacaaaatgatcgcactgggatattagagctggtgacacgggctgtccattccggcttgctctcttgctcaccctctctttctcttttggcctctcaggcacattgcttctgaacccagtccaaatcagagagacgtctcaggtgacattcaagctcggtttccaaaaatcccaaattggtaccttatcatgatccaagcaaacatacatacatatatgataatatttggagggctgactctagaggaggctntggaactgatcacctgtggactatctggtcagtttcattttttatgaaacatgtccaaatagccttcattttgcanagtggctggattaaaatggtggctgtgcaacggctgtgctatcttctcaatcattt

SEQ ID NO: 3258 - DNA, 999 bp, Homo sapiens
tctaaggaatgcaagcaaaaggccccctcacacatttatatctgataactggtggagcctaaagacctgaggatttcttcctagctgcagcagcaacacgacagaatacccgggagaagtttcctttccctaaatatacctgcaattttcaagtccttttaattcacacctttaaatgaaagggttgagtatacaagaatatcaataagttccaattgaagagcagattcttttgcaattcaggcatgtgccggcgataacgggcgagttggcatgaagagaggcagagatggattaattatgcagagaacatggaaattctgcttatcatcggctagcaaaggagcccggctcacataatcagcaaacgaagggagaggaaaaaataacaatgcaatggcaccttccagcccatcatcaggattttttctacccccttgtaattaaaaaataacatacacttatagccctatctcctgtgcaggcaaggagtggatgtccacaaaataattgcactgggatattagagctggcgacacgggctgtccattccggcttgctctcctgctcaccctctctttctcttttggcctctcaggcactttgcttctgaacccagtccaaatcagagagacgtctcaggtgacattcaagctcggtttccaaaaatcccaaattggtaccttatcatgatccaagcaaacatacatacatatatgataaatatttggagggctgactctagaggaggctttggaactgatcacctgtggactatctggtcagtttcattttttatgaaacatgtccaaattagccttcatttttgcaaagtgggctggattaaaatgggcggttgtgcaacggcttgtgctatctttctcaaaataatttaacttaccctacaagttttttgtttctattccctttggcaaactcattttataaatggtaaagttaaatgattgccaatgcctgcacctacaaaacagaattcct

SEQ ID NO: 3259 - DNA, 562 bp, Homo sapiens
gaggagaacaatgcactggtgtgcagccgagcaaggaatgatactgaagaggcgacagctcctgggtctgaaaagtctacagagacaacagaacaaccactggcctggacctctccacagatgttggtgtgagcagagggccctgaggacagagccacactgcaggccactgaggtcctcttcccttaggtccatatattgaagaccaccagccgcaatgaattatgctgaactccatggtggttttgtgacagtaacatatgaagaccagaatgagaccacaaagtccacttgaaacttgaagttagatttcagggcttgatttttagcaacatgtatgcctagctggatgcagcagtctccagatgtatttgacagatattgtatccctgcttttgcaatccttcagcttgtggtggttattttttttccctagagcatctcaaaattgtaattagattccttgttgttgatggcataaatgggtttcaaaaagtgcttgtagcccttgtttaatttcctaatgaataaaaccaacagcacacgcttaaaaaaaaaaaaa

SEQ ID NO: 3260 - DNA, 541 bp, Homo sapiens
cttcagagcacatgtttgataatgaatattgaccgcttgagaaagccccttataaactgtaaaatacaatgaagaccaggccttgtctaggagactgcagaatgcccacaacttgttgcagctcttcccactcttcccatcaagaggtggggtttttgctccattcttcaatctgcgctggccctctgtcttgctttggccaacagaatgctgcagaatggaccttacgtgagctccgagtctgagcttcaaaagattttctatgcttctgctctcactcttggaaccccattaactgtgacatggaccagcctgggctaatctgctggatggtgagaaacacccccatcacctccatcactccagccaacagccacagatgtgagtaaggccatcctagacatccagccacccactgatggcagacacacaagcgagtccaggtaaaatcagcctggcccagatcagcaaaacacccagatgaccacacagattcataagcaatcataaatggccttgtgttaagccaaaaaaaaaaaaa

SEQ ID NO: 3261 - DNA, 266 bp, Homo sapiens
cctccggataaagtttgatccagcatattctaaaatgctacaagactgccagcaagtttcaaagacacatcagagagaactcaacggcctgacctggagaccaggaggatgacattctcgttaggcaagagatgctggaccttctgcagtaatgagaaatgaaagtcaccactctgctctaaaagcaggggctatttacccctgacctgacacacttctcaaagctctcacaataaaggcacccagcatccacaaaaaaaaaaaaa

SEQ ID NO: 3262 - DNA, 615 bp, Homo sapiens
ttctactgctcgccgacaagaaacaacaagggaggactttcagatttaacaatgtacagaccctggagtttctctttatacatcgtatatagtacctgcttctggttctaccatctgagaaatggatcagcccatgccagaaaagtgttgctaaatcatttgaactgtaaatttcaattcatcgtatccacttcactttgctgacagaagtaacattgagtaagtttcatcaactcaattttactaagttttatgtcatccttgtttaaatattttaaacaacatatgtaatcagaatacctctggactgtttgaggcaatagatacattttccaattgtgcattatatttttacttatttttatttgtattataaattgacaaagtataaatgtatatatgtttatatgagtataaaatgatgatgatatgaatgctaattaacatattcttcatctcaaatgcttaatactttttgtggtgagaacatgtggattttactcagtgattgtgaaatacgctatacataattaattgctatattcaccatgctgtgcaatatatctcaaagtaaacaaaaatcttattcctcctgtttaaaaaaaaaaaaaaaaa

SEQ ID NO: 3263 - DNA, 538 bp, Homo sapiens
ctcaggagtcttctgcagagagatactcgggttgttgtttaatcatcagagacactcagttgtagctggagacatgaagacatataacagacacgtctataaacttcatcatgaaagctaccatgaaatgtattccaagaagtacaaaatgttcatctattgatatgttgacaagataacttttactcatagggtgggaattcgctggtaatttgttttcttgaacactgcttatgataaaatccatgatggcgcaaaatacatacatactccagcttttcaagtgaattttcttatcctaaactcattttgaaaaacaccagtgctctggtatgcaagtacaatgttacttcagttaaatgagtctttgaagaataacagtttataatgaacatcatcatttgtatttaagatctgttctaaatttatattcaagttaaccttcagtgtgagttatttccaggcacagcttctgttgtccatagcccaattgatggtatataaagtactgacgactttaaagggaaaaaaaaaaaaa

SEQ ID NO: 3264 - DNA, 134 bp, Homo sapiens
caatcacttggaccttctgaaaatcagcaggatgggagtattcatttgcaaggaggatcactaatatttctgaacaatagtacactgcatatgtgagagtggaaataaaaattctaacaggaaaaaaaaaaaaa

SEQ ID NO: 3265 - DNA, 747 bp, Homo sapiens
tttttttttttttttttttctttttttttttttttttttttttttttttttttttataggggaaggatttattgagactgaacttgcagcaaatttaggggatatgaaacaaaaaaaaatctggtaggagtttttgttattttcttatctctaccaacaagattatatggcttaaaaaacacaagttataaaggaatatctttgttacaggttttacagatgtaacacagatgtaagcaacatctaaaattattgcaaaactgggtttgacataagtaattcctccatttaaaatgacaattctagatctttctaaaggtctttgtttaaaacctgaagaaatttcactataacctgccttccaaatattatagcatttttggttgtcctgtgtgcatgcaaaaaaatctctgatccctggaaaattctgacatattccctggccattttttggccctgaatttcttgagctgaactaataatatctgttaataactaatctaccttttctctatagtattgacctgcacaaaatgttttctcaatatcttccctctacaaagctctgtataagatagagggaaattggagagagttgtgattgccctgtaagacctggtaaccctctgattagcttttcttgttctggaagcctgttgattttacccaaaaatttcactcgttctgttcctcctgggggcctctctccttgcccccctttcaaacattctcctaagggccaaggcc

SEQ ID NO: 3266 - DNA, 189 bp, Homo sapiens
ctcagaggaactgtgctgggagttgtttgaaatacgaatgagtctttcagagaagtttatttaacttgtaaaacttcaggtcctttcacaccatttcagcgttggatcacagacagctcttcctttatatcccagcaacttgagtttatttttcaaataaaagtctgttttcccataaaaaaaaaaaaa

SEQ ID NO: 3267 - DNA, 927 bp, Homo sapiens
  misc_feature (1)...(927): n = A,T,C or G
ctctcctttccaacaccagactttgctctgtttgttttctataccttttttagagatgcctacaatagaaaaaagctatgacatattcaatacatctgaaaagtttgcattaccatagataagaatgaattatctgtttataaagaaaaaacaataaaaatatgaaccaagaaagcacagaaggtagtaaccacatttagatgtttatcatggaatcatctttataatccatctgttacaattctacagagcaaattacaagtaattgtgaagtgtcccctcattttataggtttgggcttataaggcatacaacacaaattttaattacttttatttttggtatttggatcttaattnggtcaagtggccactgggtagatgatggagcctcttgagacatacagtcttcttctagctttgttggtgtgaatattactgtgtatttttcattcacttattattttacaaggcatgcttcattaaaaaatatatcagcatctcattgacaaatcacaaaatttaaaaggcaccagaaaaaaacaatttatttaaaacattcctgtgtaaaagtagtcaccactcttactattcttcaaatatttttattatatttaaaaacaagcctagttttatctccaagtgcctgaccttgatgaatttggaccttttaaacctaaaaaaatggaaccttattggaaatttcctacagaaaagcttttctaaatgcccagcgccttgtttctacccaggtgatgaccagcatttggtcctcaaggattctggccttggggtaatatcaagtatttaataatggagttgggcctgatgagaaccccgctaaatgctgggggggactggtgggcttaaggtggccctgccaaaaggtggaattgagggaaactggcccctaaagaaaggcaataac

SEQ ID NO: 3268 - DNA, 588 bp, Homo sapiens
tctggacttctctgaactttaacttctgcatatataaatgcaaataataacacctactccaaaaggttgtttccaagaaaagagaaatgaactctgacaattgccttgaataagaagtcaagaagaggattgagaataaaccaacagaactgagaggctgaagatttgacgatcttgacaatggtggttttgatggtgataagactgttggtttaatagtttatataagatatgtttattttgattaaaataatttgagttttatcatatcatttcaatatataatgcatttctttctttttccttaaatagtttaatgtttatatacaaattccttacttttattattaggtgcactttgaaattctgagacttgaactaagtcactatgactttggaaagccttaactatggtaaaaagcttttagcacatatctttttgtatcttttcctttttacatcctgcactaagtaaattttgtttctttctaaaatacaattttcctaatgttgtttacagtgtttagaaaaataatgccaaagagcagctacaattaaaaatgagaacaatgcgcaaaaaaaaaaaaa

SEQ ID NO: 3269 - DNA, 499 bp, Homo sapiens
atcaggtaatcaataatccactggcagccctaggcttcaagacttcatgttccttaaagagaagcatcaagccggttttccattatttccccactttgtctactgaataacacccactcaacttacttttaaatattttgaaactgtttgatggcctttggaccaaatactttctgagtcaactgctcatctagtattttggtgggtatgtccccacacctttttgtataccacatgtttctatttgttaatttctacttattcctggttgagtcaccttctcaaaatgttgagtaggaggggaacatgtgtgtccttgcatgtctgaaaatgatttcactttgtttttatgcttgattaataattggttcgaaaagttcaaggctcaaaataggttttcctaaaaaaatgtaaagaattttcgtgtccgtggcatttcataagaaatacacttgatggaataattttccattcaaaattaaaaaaaaaaaaaaaaaaa

SEQ ID NO: 3270 - DNA, 820 bp, Homo sapiens
cccctctccatccgattaaaattaataatggacccacccacctacatccgtcttttgttggctttgatgaaacaagttgctatgttagagagtcccatctggcaaggaactgaagatgtcctccagtcaacagacagcaaggaattaagccttttacatcaacaatccttgaagaaatgaatcctgcaaacaacacctacgtgggcttggatctggatccttccccagtcagttcttcagatgagactgaagcaccagttggtattttaattgaagccttgtgcgacaccctgaagcaaaaaacccacataagaaaccaacagaaactgaaataatagatgtgtgttgctttgagcaacaaagttttagggtaatttgttatggaaaaataaatattataatgtgcatgaataaacttttgttattcaaactaaccattataatcattgtctataatgtagtcttaaatgggagaggcctttgaattgacttactttgaataatcttttgctgacatatgttttccatgctggcagaattaatacttaatgtatagtaattcctttacttgtaatagtcatacacatttccaaatgacatgcatttattggaatattttgaatcaataaagttaatatgaagaatatttgggtttaactacttgattgctctatttgaaaaagttattacaatttaacgaatctcgtatatttgcataggattttcaattcagatttctttgtaaaaaaatattgtaaatgaagtaatcctctgacaaataaatgtggattttgtctgaaagcaaaaaaaaaaaaaaaaa

SEQ ID NO: 3271 - DNA, 218 bp, Homo sapiens
cctaggataatctgtagcagttgccttgggggaacaggcccatggagctcctgatttttcatgctggaagtgggacactgcacgccctctatttttaacacttaggtttttggagctttgattaatttgggcagagaaagtatattacacaggtcatttctttacttaccacaagcaaaggaataaaagattcaatattctcaataaaaaaaaaaaaa

SEQ ID NO: 3272 - DNA, 438 bp, Homo sapiens
tttttttttttttttttgtaggtgtgtacctttatttctgtgttctcttttctgttccattggtctatatgtctgtttttgtaccagtaccatgctgtttgggttattgtagtcttgtatatagtttgaagctgggtaatacaatgcctttagttgtttttacttaggattgttttggctattcaggctctttttatttgggttttatatgaattttagaatagtttttttagttctatgaaaaatgacattggtagcttgataggagtctgcagattgttttgggcagtatggccattttaaccctattgattcttgcagtcaatgagcatagaatatttttccatttatttgtgtcatctctgattccatccagcagtgctttgtagttgtcctcatagggatctttcacctcctttgttagatatttttattcag

SEQ ID NO: 3273 - DNA, 528 bp, Homo sapiens
cctcaggtaaccaataatccactggcagccctaggcttcaaggcttcatgttccttaagtgagcagtggggacacattatatcttctgagtgctgtcataactggaagatttctataaaagatttctcttcacatatttttctaaaaagcatatgtgtttttgctcttaaaaaaatgatctcaatatccagtagatatccagggtagatttactatagcatggtggatatactttacgtagttgttagcataaatgaaaataattttattatattatttaattccttctctaatgttatatttaatatgatcaaaattttacataaacaaacttgcctttttgatcctctctgtacttgctcctgatttcaacaaaccttacctttattttaattttttaatatttacattctgttccataagcataaatccataatgctttgagtaaaaattaatgctcaaaattgaaaataataacaaggagaataaagcttttattataatactgcaaatataaaaaaaaaaaaa

SEQ ID NO: 3274 - DNA, 765 bp, Homo sapiens
  misc_feature (1)...(765): n = A,T,C or G
ttttttttttttttttttttttttttttttttttttttttttttttttttttttttttttttttttttttttttttttttttcaaaaaagggggggttggtttataaaaaatttggcccaataaaaaaaaaccctggggggggggaaaaaaaaaaaaaaaaaaatttttttttttttggcccccccccccgaaagggttccccccccgccttaaaaaaacccccccgggaatttccgggggactgggaaaattttttttaaaaaaaaaaaaccactctttttttaaaaaaaagtggggaaaaaaaattttttaaaaaaattcccccttttcgcccccccccaaaaaaatattgggggccccccgggttcaattaagaaaaaaaaaacctgaaaccccgggggcgcgagggggaattttgggccccccgcgcccactttggggggggcttattcccccgccccgggggttgtgtgtcccccggggaccatacggggagagggggaaaaaaaaaacagggtcttaaaaggggcagaaaaaataaattggatccaaaaaaatgtgggggggggccttttgggcaaaaaaaaacggggtagcccccggggtattttccccagaggcataaaaaaacatttgggggttaaaccggggccataggcctataaaccaccccgaagaggagaaaaccccctcttttcaacccggaaaaaaaacgccgcgcgntttcgccggctttttaaaccttctccccccagagaaagacc

SEQ ID NO: 3275 - DNA, 511 bp, Homo sapiens
ttcagtggtcaccttggggaccccaaccggtacccctcggaagttgtacaggcccagtgtaggaacttgggctgcatcaatgctcaaggaaaggaagacatctccatgaattccgttcccatccagcaagagaccctggtcgtccggaggaagcaccaaggctgctctgtttctttccagttggagaaggtgctggtgactgttggctgcacctgcgtcacccctgtcatccaccatgtgcagtaagaggtgcatatccactcagctgaagaagctgtagaaatgccactccttacccagtgctctgcaacaagtcctgtctgacccccaattccctccacttcacaggactcttaataagacctgcacggatggaaacagaaaatattcacaatgtatgtgtgtatgtactacactttatatttgatatctaaaatgctaggagaaaaattaatatattcagtgctaatataataaagtattaataattttaaaaataaaaaaaaaaaaa

SEQ ID NO: 3276 - DNA, 381 bp, Homo sapiens
caggcatccttctatcagacgagaaggtactggccaacgctactagaagcattgcaagcttcgaccttaatctcctgctcatgcatgagaacctcgcctctccagcacaggagggcaggaagagagcgagagaaggatgacaagagaataaaactaggtccctatcgcttgccttctccatatataataccctaatggattaaagacttaaggctaagacctcctactatgaagctactacaagagcacagaggagaaaatcttcaggacatctgcttggggaaatatttcttaagtagttaatatcccacaagcgcaggcaaccaaagcaaaaacaaacaaatggcatcaaatcaagtaaaaaaaataaaaaaaaaaaaa

SEQ ID NO: 3277 - DNA, 259 bp, Homo sapiens
tctgctgtaacgcatttgctaaccacacccattgggctgcacgtttgcgcttttccttgagggttcccattgcctatttctgttatgcatgggagagactttcatccaccctcacctcaggaaatcctctattttgagctggaaaaaaaaacgctgctgagcagaaccaccagagtcagttcttttcaggaaatagcaaaactgtgcccgttgtatacttccttaaaataaagaaggctatacatcaaaaaaaaaaaaa

SEQ ID NO: 3278 - DNA, 509 bp, Homo sapiens
accagtttccacagttaccagtcactgggcaatctgcttctaaggggtagcttatgctgttggacagagcgcgggtggtgtttacaccagaggagaccatctggaaatgcaatcagagacctgagcctcgggggattattggacccagtcgagcatgaaaggaagatctgtgcccagagctctttggttctgccatgaccttagctccacgcagctataattttgaccctttaatgtagctaatttgactacagttacttttgcaggctccagctcagtcaattctcttcaaacagcaggagctatattgaagcaggtgacaaaagagtaaaaagcaagttatttcccaaactactacagtcactcatcgtcaattattgatcagagaaggttttgtaatgtatattctacaggtctgtacacatgtggtagataatgccataaatacacatcacagacgaatgtgattttaaaatggaatcatatcaaaaataaaaaaaaaaaaaaaa

SEQ ID NO: 3279 - DNA, 722 bp, Homo sapiens
catttctccattttttattactagtatttgtgaagtttccccacaatttatacggtctggtcttataaggcgatacaacacaaattttactcaccatatcgtaaaggaaataaggatcgggggtggcacaaccccccactggggaaatgatggagcctctcgagaccgacagtctttttatagctcccttgatgcggatgggactgggggtctcacaaacacttatcatgtcacacggcatgctggatgggatattcttcccgcatctcagtggcgaggtgcagccattatctgtgccccgtataaagacatgtgttgaaaacatgcccgacacaaaataccacccccttcttactcttctgaaataaaaccacataaccattagtgtcccccccctacgctacaatctagttttgtcagaacgtcacctacattcgtacacgagaaaactgacttaactccggcgctgtgattgaaaacacccacgacagactcagggatcctgggacaacttagcggcgtgttcgccgctttgtgggctacaaacaatacaatagctcgtttacagggatgcctagcctcatgccaaacaacctctttatctcatacccgaaacatcctctcagatctcaaccacctctaaaattcctcgcttgaaacacgcgagggtcacatcgcttgattctctacaagcgtagctaccgcatggcacgctaagggcc

SEQ ID NO: 3280 - DNA, 825 bp, Homo sapiens
  misc_feature (1)...(825): n = A,T,C or G
gtgctgggtacgactgcgaagagtcaagggggaagcagatgatgatgatccactggcacttagtgtgttttgagatgacaaagtctggactcgaggctggagcggagcagcacaggacggccacgcaattgcaccactgagcaactgtgcagcagctagaaccagcaagagaagccccttcctccggcagtgtatgccctctactgagtacggttagcattctgctcactgcataaaaagaatgcttaagatagccagtccaatatcacagctggtgctgaagggcaaatgtgcagctgaaaagcactaaattaatactggcccaggagtagtgtctaattatggttttaacttgcatttctctaatgactaataatattgaacaacttttcttgtgtcatttgtatatcttcatttaagcgtccaaatcttttgttaccctccattttttaatgatnatcttcatattttctagtagtaaggcttattcatatattcgtcatatattctttgtatatattctctatatattttatatattctttgtacagttatatattcttggtatttttgtgtgtgtatatacatacatattgcatatgtgtgtgtgtgtatatatatatatagcatatatatgtgtgtgtatatatattgcaattctttctcccagcctgtgatttgccttttaattatcttaagaatatcttttgaagaccattaaaaaaattcaatgagttttaatttatccattttcttgtttataatccaggcttttaatgctctattaaatagctctttaccaaagtcaaaaaaaaaaaaaaaaaa

SEQ ID NO: 3281 - DNA, 697 bp, Homo sapiens
  misc_feature (1)...(697): n = A,T,C or G
accccgctacaggttggcaggaatggactgctccattttcagtgcagatacagggaggctcagagaagtgaaggcccttgctcataaatggtggaacccgaacggggaagatagaagtcctccagagtcacagacccagagctcccaggcagagtcctgtggaattctgggtattggacactttcaggaaggtatccttctgcagtttgggggatctgaagaaaagctgagcagatcagaaatgaactcagcagaattaacattagaaagagagaaacaaggacaccaagaagcaatttcacccaggaaagcattctgttatgaaatccaagctctctttacatgaagactcagcctgcagacagctccctacacatgcaccccacagggaaggctgcttgtcaccagcaaccatctccatccacattccccccgccctgcccccacgagaagcctgccttcagttgtcccaattacagggaagcctgctgaggaaacagaactgtctgaatgcaaaggaaatttanctcttatgaatatgaactctcaaccaagaatcaccagacgtttaagggaaaaccaagacacaaaaagagaaagatcaagattaaaaaaacagctgggcgtggtggctcttgcctgtaatcccagcactttgggaggctgaggcgggaggatcgcttgagcataggggttc

SEQ ID NO: 3282 - DNA, 462 bp, Homo sapiens
attggaaaaatttattcagaaatatacactgtctcaagtattaaactggattctaaatcatcctatgtccccaattatttcagaaatactccatctcactttaaatgagtagatttgccctagaagaattaggagcattaattacatttgcaatattatcgagtaaacaaagaaaaaaaaatgggccaggctcagtggctcacacgtgtaatcccagcactttgggaagctgatgcgcgctgatcacgaggtcaggagatccagaccttcctggctaacacagtgaaaccccgtctgtactaaaaatacaaaaaaaaattatccgggcctggtatggggcgcctgtagtcccagctactcgggaggctgaggcaacgagaatgatgtgaattgaggcggagcttgcagtgagtcgagatcgcgccactgcactccagcctgggtgacagcgtgagactccat

SEQ ID NO: 3283 - DNA, 574 bp, Homo sapiens
  misc_feature (1)...(574): n = A,T,C or G
ccgctcaggatttctttgatccaactcatgtccagcaggcatcatgtctgagaagcagggaccctggaggagttcaggacagaccaccagctggacgtttctctttgagctagctatctgagactgtttcctctgaaagtgtatttatgtgcccagatgatataagagcacttacataattatgtgagtggattctgtgagttgactggagatctgtggacatctggctctgaaacgccacaaaccaacctggactccccaaggggctcaggacggagtttcgctcttgttgcccaagctggagtgcagtggctcggtctcggatcactgcaacctccactaccctcctgcctcagcctcccgagtagctgggattacagaggtgagggtctcactacattgtccagcctagtcttgaactccnggcctcaagaaccgtctcaccntggactcctaaaantgctgggatnacagaactaaatgagattccattgtccgaatataccacagtgatttgttcattcaccccnctgaaggatatcntggttgcttctaagttttggcaattatgaat

SEQ ID NO: 3284 - DNA, 771 bp, Homo sapiens
ctatttcagccctagaaccacccttgctggagaactagtgtggtcatttgtctcttgggggtccaccacagacagatgtggagccactatcaatcagtgtgattggcccaggatggagcatctgtgctataggcccaagctgggagagacttgcctggtcgagttgtttccttgatgaatcccaatgtgtctaccgagatgttccagttgaagatctagtaattaaaggtctctttacaccagagctaagatcacgaataaaggagcagctttgggtttgcagagattacacaggaatgtatgtttctggcaggtcatttgccatctttgcaaggagtgtacatggatgtcatcattacaaaggatgtgagaggctcatcggcagaaggaacttgccttgtctcagatgagactttggatatagacttttgagtaaatgctgaaatgagataacactttgggggactgttgggaaggcatggttggttttgaaatgtgaggacatgtgatgtgggaggggctggaggtggaatgatatggtttgactgtgtcccaacccaaatctcatcttgaattgtacctcccacagtttccatgtttcctaggagggacccgatgggaggtaattgaattataggagtggggtttcccctctgtcctcatgaactgaataagtcttatggaacctgataggtttataaagaagtattccctctaaacatgttcttttccctgcccccatgtaagaagtgcctttgctaccctttacct

SEQ ID NO: 3285 - DNA, 850 bp, Homo sapiens
  misc_feature (1)...(850): n = A,T,C or G
atttttatattcatccaaacagctatttattttcaattattggaaaaacatttcttgaagtttcagtactttttagttggnttngttttgttttttgttttngttatcaatttgtttttttacatataggattattgcctttacttctgtggggtctttgtaaggtcttacacaacatctgataatactcactgatgaaatttctacaatatantgagaaaagactggngattttctagccaacctaanttctgaaaaactcttgaaaaacttaggctatatgtgaataanaangctagatgactttcacttttagcaataacccaattcacttanngcnttttccnaaaactttttatngaaggnntnncaaaanaggttataanaatttaaaaaagtcctggaaggattaanggagggggatttanncttatttttttccacnccntttggaancaaaacccccnaagaccnggggtaantntnattctcngnaaaangaaggtcttaaatggnncttncnnnccccaatgggcttngnnanggcncttcaaaantttttcccccacaangntnaaaggatttcccaaanggcncnattttnnangcggcncgggaaaaaaancttntttaagnggaccccctcttttaaacccnttngggnttanggnacnttttncggcttcngggcccggngggaaaacccccttngnntncatcccccccaagggncccnnctngnanntngnaacntggggnnccnccncaagaagnttttggctggcncnntnaancnnttntttcncccngcgcctttcnaanccnggcncccttttaaacccncnctcct

SEQ ID NO: 3286 - DNA, 694 bp, Homo sapiens
gctagggcgtacgggacctctttttcagttcacctactcctggtctgaaaccaaaatgaaaacaaatagaatccaagtgtgctgtagctcctgacatccctccgtgggctcggccagcccctgcatggaagcctccacatgggttcaccaggctgttcttcgggctctcccaaagtggctgcttttccgtcaatatgaatggcatgactggccacatctcccttttttcttcgggtgccaggaagcctggactgttgagctaactttacggtccaaccatagcaactatgtcagtgtgcagataactgaaggtgcctttccctccctggcttggcttctccctcttacttctcttcccaagctctcaatttgctttatttttgtatattttaccacgatattgtctctctgtgtgtctttatataaaacttgagttactccagttctgccaatctgtgtaatcacttggcatttttatttgtgttcataattttcagccatggagacatttgaaagacaacaaaatcgatcctggagaaacagagatgtgggcactattgcaatttatagaatttatcgtaaaattggactttgatgaatctttgccatacatattctgttgcttaagattttttgtaacaatttatgtgtctattgctttatgtgaaagacgcttttcaaaattaaaatcaat

SEQ ID NO: 3287 - DNA, 355 bp, Homo sapiens
  misc_feature (1)...(355): n = A,T,C or G
ttatgtgaagaactttttgagaaaatcaatgacaactgtaatgaagaaatgtcttactctgtagagaagctgttttggggctcatacctgtaatcccagcacttcgggaggcgaatggatcacttgaggccaggagtttgagaccagcgtggccaacctggcaaaaccctgtctctactaaaaacacaaaaaattagccggctgtggtggtgcacacctgtaatcccagctactcgggaggctgaggcacganaatcgcttgaacccnggaggcagaggttacagtgagccgagatcatgccagtgcaccccagcctggagtntgtctcaaaaaaaaaaataaataaatacccat

SEQ ID NO: 3288 - DNA, 741 bp, Homo sapiens
tttggtttaagcagaacatacaacggaaacgagaaatgttatgaaccagatgccgaaaaagtcccagtggcaagaatcagaagagggcacgaaggtgtgtttttatttaaaaactacatgagaaacagacttattggaagaaatgccttttttttattacatcctcttaacaaccaagctagtaatctaactcaagttggcaatatggcccgctaaaagtccttgggggacatgcactaatgggcagatgagagtgacttgttgacaccttcattgttttcatcctacactggacatcagtcgtttggcccatttttcagagacccacttgaactgtctgaacctatgaacttcccgaaagtctggccaccaaactgcattaggagagtcatggctgcacaaccgaagggcattcattttattccctgccttggtgcaagagtctccccaaaccaagatggacacatgtacttcctttcaagaggccacaaacaagaacatttcattccattctgagataatgatcctaattggttaaaatcacttcagaatttgcttgtcttcttattagtacagagaccagagtggagctttattaagaaaaatgtgattttgataccccattctccatgatgtgcttatttcacattgcatgcctatatcaaaacattgcatgtaccccataaatgtatacacctactatgtacccacaaaaatgaaaaataaaaaacgatcggcctg

SEQ ID NO: 3289 - DNA, 779 bp, Homo sapiens
cttcaggagaccttaagatagaaaaactgccaggagggacctgtaggtctgctttctccactcatgtttggagaacacgtctccaaagaaattcatctgaacttgatgcagagattcctggactagattcctgagaaatctaatgtcagctacagaaatgccccaactgatgaatttcgtcatgaagcagagcctcagagcaaaagcacatcagctaagcatgccccagtatgagtggctgagtatgccatattagtctttcatagtctaccatagaagactttcaattttttgcttcatactacttaaaataatgtagaaaaatctatgtagttctttcacattaagttaacagctaaaattttttactctaagtttaatttgttgaaaatgatgcaatatcagtctaattgtaaatattaacattaaaacaaactattgaatcactttaatactttttcaatggaatcttaatacaataacaattcaatggccacaatatttaattgaaaaatacgtggacaaggtcattttaatagtcagaaattttctaccatctatattttttcttgctgagtccattttccattcaactttctctgtaaaggattttaattgaatataatattttgtgttcctgaatatcttatatggatcaggtatattttactataaaaattatgtatattgaattgagattttacattaatttttttctgtgaacgtttctaagtaataaaaagttattctgaatggaatgtactgtaaaaaaaaaaaaa

SEQ ID NO: 3290 - DNA, 310 bp, Homo sapiens
ttagccaaatccacatgattggtgaccttataagaagaggagaagagacagaggcagacatacagagtgggaagatgatctgaagattcacaaatggaatgcaatatgacgacagaagcagagactggagtgatgtgtccacaagccgaggattgccagcaacaccagaagcgaagagaaaggcatgaaacagattctcccctacagccttcccagagaggcgggccccacccacaccttgatttcagacttctagtttcctaactgtgagaaaataaatttctgttgttttaagtcaaaaaaaaaaaaa

SEQ ID NO: 3291 - DNA, 585 bp, Homo sapiens
gtcttgctgtgtctccctagctggagtgcagtggcgtgatctctgctcattgcagtcccctcctctgggggtcaagcgacccccaccacctcagcttcccgagtagctggaaccacaggatcccatccaggatactgcactacatttagatttcgtgtctcctaggatattcttggctctgacaagttctcaggctttccttgttttggatgaccttgacagttttgaggagtacagatgagctattttgtggaatgtccctcaatgtgggcatgtctgatgttaccatgatgggactggggttatgggttttggggaggaagaccacagatgtaaagtgccattctcatcacatcatgccaaggctgcatattgtcaaatgacttatgagtgatgatgtcgaccgcaatcacctggctgaggtaacgtttgccagccttctccactgtaaatccctcctgtccatattgtggaagtcattatgtgcagcctgcccttaaaaggcagaggtatgttccagctccatgggggttatctacataaattatttggagctttctgcatggcaaaaaaaaaaaaaaaaaa

SEQ ID NO: 3292 - DNA, 657 bp, Homo sapiens
  misc_feature (1)...(657): n = A,T,C or G
gggcaaaacccttttttttaaggggggcccctaaaaaaagaaaaaattttggggggaaccccaaaaaacccccttaaaaatttttttttcaaaccgggaaggaacccggccccttttggaaactttaaacattcccccaaggggcgtggggtttttgcccccccccaaaaaaaaagggggaaaattttggcgctccccccccaaaggttttaaaaaaccccccccccccccccaaaaaacccccccctttcaaaaacctcttttaaaaaccaaaaggggaacccccccccccccgggaaaggcggggggtttttaaaaaaaccccccccccccccaagggggggcgtttaccccccccccgggttttttctccccccgggcccaccgaaagaccgggaaaaaaaaacccccgccccaaaaagggggggaaaatccatattgtcccacaaacaacgcggggggggggccccgtggcccaaaaaaaccccggggatcccccccccgggggatacccccccgggcggccacaacaaaaccttggggggcgctttanacaaggggggggcagggtgccccaaaacacccccgcggatgggggaaaactcccccccctcttaaaccccgccgaaaaaaatcccccccgctctaacccccccc

SEQ ID NO: 3293 - DNA, 368 bp, Homo sapiens
ctcagtggtaactatttaagaaaccactgcctaatccaaggtcatgaagattaacatctatgttattaaaatgaagttctgaagaagctggatttatatggctatggtaaatgtatctttaaaaactcttgaaggaaaaagcaataaaatctacactaaattattgaagaagtcaaaataacaaatgcacttatggataatgttaaaagtctcaaaaatgtactagcttcattgcagtctgaaaaatccagtttgaaagtgagatttcagagcttcagcagaaacttagtcattactaaactgcatcaataaaataaaatgattatgcacaacataactaaataatcaaaatattaaaaaaaaaaaaa

SEQ ID NO: 3294 - DNA, 751 bp, Homo sapiens
tttttttttttttttttgtttttttttttttttttttttttttttttttttttttttttttttttaaaaaagaaagcaggtttattagggaagtaaaggaataaaaaaatggcctctccataaacaaagcagccctgagggctgctggttgcccatttttagggtaaattctggaggatatgctaaacaagggggggactatccatgcctcccctttttaaaccatataggggaacttcctgacattgccggggcatttggaaactctcatggcactgatgggagtgcaccactgaggacgacaagaggttacttttgcggccatcttaagttttggggggttttgcccaacttttttactggaacctgttaaatcaacaaggtctttatgacctgtatcttgggccgacctcctgtcccatcctgggacttaaaaggccttaaccatctgggaatgcaccccaacaaatttcacccttattttacccaaatcctattcaagatggaggtgctctggttcaaacttctgtgacaaaacttcccatgcttttgggatctgatatttgaaaataaaacaaccgtttacttcctcgaaacataaagtcctttgactcccttaatgggtggagaatcttttcacttttaaaaattcccaatttaaatttggcggggccaaggggggttgcgggaaaatcctggcctgaggcatattgttaaaggggaaaaagcccccaatgtttaaaccggttgc

SEQ ID NO: 3295 - DNA, 789 bp, Homo sapiens
aatacctcataatatgactgcatttggagataaagagaaaattaagttaaaacgatgagatccttagagtgggcccaaatccaacagaactggcgtccttccaagaagaggaattaggaggcacagatcttgtgaagacacaggaagaagacaaccatctaccagccaaggagagaggacccagaagaaaccaactctgccaaaaccttgaccttctggaacccagcattgtaagaaaatgaatttgtgttgtgtaagcctttgtctgtggtactttattaaggtagccctaacaaactaatacacataggcagactgtttaatgtcgaccctgtatcttattataacttgagccacaaagcttttgagtggtggcagagtctcaatcagcaaatcagatgcgagaattgcagccccactctacccctgtggctgccgaagtcgcctggtctcagccagggtctcattttgagtccattcacattaggatgcagactggagaagaaagatgatacaatctacattcattaccacaagagtggccaccaaagcctcttcctaggaatgccagtctgattcagtatttaaaaagaagaaatcgggagtgtcttccattatgaattaggaaataaaataattcaccccaaatatatttgacatattttgaaatgggttggcgcagggccagtagactggaaaggtccctgaaataccgggttttgtggaagaaatttacatctggtccaggatatgggggaaataactgggagaattggcccttttcaagtt

SEQ ID NO: 3296 - DNA, 464 bp, Homo sapiens
cttcagttggaaaatgtgtaatactgaagtggattaaagatagacacaaatttttgacactgttctcatcaaaaggtgctgataaccttcagaacatggcagctgctttccttctgcctcccagaactcacaacttccctttggaccaactccaatctgaaattatgtagaaagggagagtctgaaaaacatagtcccaaacataaccaagtagacaatagaacaatctggcacattgattggtattttgacttaaccgccagatcaccagcagctcattgtaggcaggcgcaagtaaatatctcacctcaaatgcaacaagtacaaaatgaatgcatcatagtgtcccaggcttccattaaacaaaaacaaataaataaaacaaacaaaaagcaatcttttatccctcagctttattaatgcataactaacaaataaaaatggtatatagaaaaaaaaaaaaa

SEQ ID NO: 3297 - DNA, 609 bp, Homo sapiens
ctcaggtttcgtatcccttatcctagagcctgggaccagaagtgttttggattttggatttttggatttgggattacgcaacctgcatctcatttgatactcacgacagccctatgaaagagaggcactgggctacataagcaaatatcactttcaagagctctaatagagaccctttctttggatggagtgggaaaacttgcataaatctcctttgtcttctcaacatttcatgtcccaggaataaggattactgaattgtcaagagttcgtgtgagaaaaaaaaacaggaggtaaagctgaaaagaaagactgaagaaaatatctttaacagctcaaaagaagaagagtgaaaaatatgtgtctaagtgaatgagatcataattcaaaagcgtggctatagatccaggaataagaaaaatacattcatctcagctgaaaactaaaaactgtgctttctagagtaatagctaatttacattttaaatttcagccattgaaaccttcttgatgaataataaacaacactgaagttacagttgtttttctttttcttttctgacttcaaattatagaaaaattaaagtaactgaaccaaaaaaaaaaaaa

SEQ ID NO: 3298 - DNA, 808 bp, Homo sapiens
agctttaaaacttctgagcttaaaggaaactaccaagaaaaactaccaagaaaaagaagttgaagatgttgaagttgaagatgacctttctcttcacaaggtcttcataaagaaataataagtctaataaatttaacgatgtgtgatcatattctaaaatgaaataacagttttagatttttgaatgaaataggtaaaatggagcaaatcactttagagttctgcattctgaagaacacaaccaatctccttacctgtggtgtatcatagatactttcctcaacagtattaaacaaatattattgcaagctctgtcccccaaaaaaaaaaataaaaacactatataaaaaaaaaactaaacaaaaaaaaaagctccctccctccaacccctaccctctctcccgccctcttcttcttctctcacttctcccactacccccccattaacaacccccaccgcctcctccctgatcacgacacccgccttccctcctcctctcgtaacagtcatcctagaaacgccccccttcactcaccccatcgtccctcgcaacttcgtttaatcccctaccttatacacttttttctcattaacgactctaccttgtcagacgcgctacctcttctagtattatgtcttccgaattccatcatatttttcttgggcgtcctcacgctttcctatcgcccttctctgctcttccaacaccccgatcctatccctctctctcacatcattcttactctcaatcccttatctttcgccctcatcagctacaccgccttctatattctccctctcctctct

SEQ ID NO: 3299 - DNA, 724 bp, Homo sapiens
ctgtggtagtatctgatatcacatcgccattctccctcttggccaacccctcctcagaagaagccctcaggcattagtcctaaccagggaaactatccagagctaggagggaaaacatcgcaaggcttggagaggggacctagaaatctcactgaaagctcatacccctgccattgctgccttctcattttctgaacacaacattgtgtcttctttctagagaaactgcgtatcttttcactacgatttaactatgacattcagtgggactgtaacagaatcgaagcatgaaagagtcctcctgaacaaacatgaggatcatttgcaaatggcaggatcagaaatggaacgtatctgatctgcttgaaataataagtactgtttcatgtatgcttgctctataccagctactattttaaataatgtgcatgtctgaacttgtttaatgttcataacagcactagggtttgagccattcaaaagaagaaaaaatgtgagtcacaaggatgttatgcaaatttctcaaggttactttaagtggcagtaatgggattcaaaaggtttgtgcttttaaccactacccctcactaccctctcaaagactccaaggagcttcaaagggccattttaaaaggttgtgtcagtcacacagcaatgcagttttagtaacctgaatgttttaatactaaaattcatgttaaatttaaaaaaaaaaaaaaaaaaa

SEQ ID NO: 3300 - DNA, 241 bp, Homo sapiens
ttttcttttgtcttcccgtctctcttatcttccccatatcttaaaataattctagtctggcaactacgaattcaagatcaaggtgactgtatttcgatgtctgaggatgcagtggcaacacaaggtgcaaggaaccatgatccctgaagtatatggaaagccatctgccaaatgcctgattagtccataaggagagcaagaaataaacctttattgtgttaagcactgaaaaaaaaaaaaa

SEQ ID NO: 3301 - DNA, 547 bp, Homo sapiens
agggaagaaagggcgacgcgttcttccttcagggagataactactacactggagcagagtccttcattcctgatattcaggagggaatgcatgccgttcttaattgtgcttatcaggagagaacactcttcaatttccactggttccggcaggatccggggagaagacttgtgtctttgaccttaattcaatcaagccagaaggagcagggagacaaatattttaaagaactgcttggaaaagaaaaattttatagtgtttggaggggggcagcctctcatctgggagattcagccacctacttctgtgctttgcagtagtgtctccccagcacctgcagcctgtaccataacctgcagccgggacccttgacacaggctagccttgcaggtgggagtgaagatttttttttttttgtatagagggaactttctttatgacccggatctccaaaatagaagggaaggataatgtatctttcttatgtaatgaaactgaatttatattaaattaaatttccttttggtattattgaaaaaaaaaaaaa

SEQ ID NO: 3302 - DNA, 755 bp, Homo sapiens
  misc_feature (1)...(755): n = A,T,C or G
ggcaaaagttcccgcgagcagacagagcccatggctcagttattcgcctccactatagggggacagatagtctctgccctaaaaatggcctgtatcgccataagcctccagtttcttactggctttggccaatgggaagtttcggcagggaatcagagagaagganaagcatgaggtcaggatcctcaactctttgattttcctcccagcaaagctggctagaactgactgtgttgccaccacaaagccaatggccatctcaggaagcctgctgtacttgctttcttcctcctggatgggggggggctgcttcccctctttttctagggcctgggaatggtaatgaactgactgcgagtaagactcaggtcatagcaccatcccctgagttcccctaagcccacatctctgcaaatcgtgcctgtgtcaagaaatccttgaactacttgagtttgagtgtgccatctatttcctgttgggaccctggctgatacatcctgtttatagatggagaaaccagcgtgggtggcaacttcttctccaagtttcagttttctcatctgttaaagaagatgtttggactgggtaatctataaggtgtcctctgttaacattttaagactccctaaatgatatggcaatggcaatgaagatttaaaaaaacatatatactttatggacccaacaacgttatcgttaaatatctttgccgtcctttggtttagtaattaaaaaaaaaaaaaaaaaaaaaaaaa

SEQ ID NO: 3303 - DNA, 600 bp, Homo sapiens
ctctcactatcgggcgtttttattgttgttagctaaattgtgtttttaagattaaaaactgcacattagaatgaaaatattttggcccaaagcagcatattatttgcctctttgaatactactgctttttttttttttttttttttttactggttttcaacccatattagatagcaaactctttacagtttaaatttgttaaattgcaacgggtggaaagtcaatatgaaaattcttgttctacttctaaaacatttttgttaaactgataagaatagatactaacacttgatcgtagccaaaaggccgagggtggtggctcacgactgtaatcccagcactttgggaggccgaggtgggtagattgcctgagctcaggagttcaagaccagcctgggcgacacggtgaaaccccatctctactaaaatacaaaaaattagccgggagtggcggcaggtgcctgtactcccagctacttgggaggctgaggtaggagaatcgcttgaacccgggagggggaggttgcagtgagtggagatcgtgccactggactctagcctggccaacagggcgagactcagtcaaaaaaaaaaaaaaaa

SEQ ID NO: 3304 - DNA, 501 bp, Homo sapiens
ttttttttttttttttttacctggtactctaattttattgtctgagttttgaattgctataatgatcaaggcaaagaaatatcataattataacatttgagtgcttatggcttgtcaaataagcagtttcctgcgaaacaatatctgattgaatcctcaaaacaactctgtgagacaatacatgagaatagtctaggttgtgctgcagttgggagaaaaagcaaatgtttaacaaaaagttagctctggctgcaggcaactctccaggcaacagtcttccatgcaacaacgtgataatcccggcagcttcaaccttgtggtgctgccatcttaagatgaatctttttccatggttgccacagtcgggaaagaaaaaaatttcatatcgaccttttactgccacatcctgaaggtgacacacgtaaaatctacagttttcactggccagaccaagtcacatggctccattcagttgtagggtcgctgaggaatacagtcaat

SEQ ID NO: 3305 - DNA, 906 bp, Homo sapiens
cttcagaacaacggctcagaagtacactattgtgatgaaacttagtaaaactgcctacatggaattacactggaagccctgtagtaagtggactatgaccaaccaaagctggaatggagatgtttgagagggactcacttcctgcgtcatcaaaccccatgggctgaggaacttttgtctaggctgccacagaagccttccctgttatgtcctgtgtgtgactgcttgttcccatcttcagtgccctccctctcctcttcaggaagaagttccaggcaggcggtacctcactgaggccgtgcatgaagccttgacacccctccctcccttggtcttgagcctgttagaagaatgctgaggttttgggcctccacccggaggtacccagcagtaacttcaaggagctaatgagtaaagcacagtaatgagaataaatcccaatgagcttattaaaataactgaaccacaactttggcaagggcaggaaccattgtctggaacttgttcgtccatttgcagagtattgtagcatgcctttgtatatcccctcaccctttcagaacagagagattagccaacaaaagacaaatttttcagaggtacccacagccgtgaattaatatccccgtctaaaaaatgtggggggaggctttcttgggatgtgaagagggtaccagcccatcttctgtgatagtgggccacctgggaccttaagcttgagggggggtggagaaacgaaaaacccctaggcccccttcctcttttttgggaagggcgtctttgaattggtctagggtttggaaaatcttccttcacaaaagaagaaaggggtcaaggggttaccttttttgtggagaggggttaccgcacctaagaccccgggtccttttattgggggagggaaag

SEQ ID NO: 3306 - DNA, 907 bp, Homo sapiens
  misc_feature (1)...(907): n = A,T,C or G
agaaggagacaccgaatcacactccaaatattcctctccagggatgcaggcagcaaaatacaagcagaagactgtatatgaaaatgaataatattaaaatgcctttttggattttgtctttagaaataatatttgcactacaaaggtgtccaatattttattagtatagtttattagtatagtttatctctttaatgtaaataataaagaggacatggatgttttaacagataataaatctgttaaataaataagtcacatatgatacaatttatccatttaaaatgtgcaattcaatgatttttgttatattcaagcacatatacaaccaataccacagtcaattttagaacattttcatctcaagaggaaatcctgtgtaactttacctattagcacttcccctgcgctaactcaccccagccctaagcaactatttatctccattctactttctagagattttttttctattcttgactttgtataaattgaaatcacatagtacatgattatttgtgactggcttctttcatttagcataatattttcaaggttaattcatgatgtagtattcattagtatttcatttcttttgtggctgaactatgttagattgtatgaatatagacagtttattntatcatttcatcccttgatggacatttggattgtttcaagcttttgtatattattaataataacgttatgaacattcctatgcattnttctttgaaaatgatatttnatttctcttgggatatagtaggagtggattactgggtggattgagcttatccttatctttgaggaatttagactcttcaaagtacaacctttggattctacacaggatgagggtctgcttcccatatatgcacactgtgtatcaatttaaatgcttatc

SEQ ID NO: 3307 - DNA, 895 bp, Homo sapiens
ctttttccacatctaggtcgtcatttctcaggaggacctggaagtccgtggtaaacacattgcataaccagctggaacagccacccttgttggacactgtttgattcagctttttattaatacgcagtcctgagatggcatccttatgcacacgcccacacatttccttaggtcaggtctatagatgtggaagccaggtcccacgcgttgggcatggctgtcaccctgaagataccgcagatcgccaacatcacattccccaccccagcagcgccagtgggcccctctcacctaaatagtcattctgtatccttgggaagaggggcctgtcccagccaggcagggggtcctggcagagcggcccctctgcagctgtggaggaggcggggaagccagccagagtaccacctggacagcgcggccatcggggacccttcagccaccttggagtggctcccttccctctgcctctgcttgctcccagcccaccgttcccgacctcatgggcagcccttgggtggcacccccagctgggcctgagccaccttggctggctctctgactctctcttctcacatggggatacaggctggactccaggccccatcacacgcttaatcacttgagcgttctcctcatttgcatgtccttaaagcgccttgattaatacccttcctagcgtttcctgcccagacatgaatgtctgattgcaagcggctcactcctttaaaataaaacaatcctccctaaaaaaataaacatggcctcgttgcctaaccgtggacctctgcgccgctcccttaaggagaggtaaggagagacctcctactggactcctggctcggtcttcgctggggaagcggatacctactgaaggcggatatggagtccagaa

SEQ ID NO: 3308 - DNA, 584 bp, Homo sapiens
cttagatcagaacaagtctcacgattctggagacaagaaagtccacaatcaaggtgctggcagatccggtgacagaaactcttatcaacagagcaaacagacaacctatagaatgggagaaaatatttgcaagatatgcatctgacaaagttctgacatccaacatctataaggagcttgatcaaattcataaggaaaaaacaaacaaccccattgaattttctgatgactaataatgctgaacacattttcatgtagacctacatgagctgtccagtcatattctgaatgtcaacctatctttccgtaaaacataactatcataggtaccttacaaacttcaggtttataagacgaggaattgtatttgatctgaaatgcctaagtggacacagttctgccaataatgtgccacatccacctttgagcaaacagaagggctggatggatctccataatgtataaaagaaaagaaaaaataactttttaataaaaataaaaaatagcacctgtattaatcaagattcttcagtgaaatagagcaaataaaaatttgtttttttcccccaaaaaaaaaaaaaaaa

SEQ ID NO: 3309 - DNA, 181 bp, Homo sapiens
ctcagatggcgaatcattcccttttcatttggatgcatctgaagaagtctttgaatttctgcaggtgaagaaggactgaagaagaaagaagctgtcagcagtttgatttcagaataaatcatctctatgactatcaaacctattaaactaccaagatgagaacctcttaaaaaaaaaaaaa

SEQ ID NO: 3310 - DNA, 351 bp, Homo sapiens
cttcagcaggcaccatctgaccagccaagtatagggggccctcaccacaacctggccatggcagcctcctgatcgtcgacttgcagcctccagaactgtgagaaaattaatttccgttaagtcacccagtttatggtactttctcaaactaagacaccatagaagtgtaagttttaaaaatattaatacatttagtgttattaattcctgtccctgcacatacaacacaatgttctgttataaagttaaaaacaaattagaatcttcctaattcagtatgttctaagaaatactacttgacaataatcaataaaataaatttgcaaaacttgtcaaaaaaaaaaaaaaaaa

SEQ ID NO: 3311 - DNA, 475 bp, Homo sapiens
ctgccagggctgaaaaatgaagcgtctactctgctggctacgcttgagatgctcccatgctatcaggacactctgcatattgactttggaagcaaggaagccacctccaattcacagagctggtgcctctgcctcattcatgaaaggacccaccaaaacctgatccagttaacaggttcatcaggccttgggagggttgcattagaacttcagaaaacacagcccagagccacgccgccatctgagcatctggggaaaaggcaggtgttcatcatgctcgtcgaacacaccctgtggcatttgctgtgactgtggctctcatacggatgtgtccactctggcaatttcctaagcagttctgaaacctgctgaagagcttttgctctagctgagtgattctttgtgtggtctgacttaaaaagaaaaaaaatatatattataataaaggatccaaacaatatcaaaaaaaaaaaaa

SEQ ID NO: 3312 - DNA, 364 bp, Homo sapiens
  misc_feature (1)...(364): n = A,T,C or G
ctccagtaggnatcttgctttgtcgcccagctggnatgcagcggcacaatctcgacttactgcaacctccacctcacgggttcaagcgattctgctgcctcagccaccccaggagctgggattacgggtgtctgccatcacccctgggtgagcacacagcaagaaggtagctgtctgcaagctgggaagagagacctaaccaaaacttaaccacgctggcaccctgatctcagaaactcagtctccagaactgtgagaaaataaatgtctgttgtttaagccacgcagtctgtggtattttgttatagaagactgactgagcagactaatacaaggattttgtattctgacaaaaaaaaaaaaa

SEQ ID NO: 3313 - DNA, 396 bp, Homo sapiens
atgcagcggcaccaatctcgattactgcaacctccacctcacgggttcaagcgattctgctgcctcagccaccccaggagctgggattacgggtgtctgccatcacccctggattcatatgtgaagccctaacccccatcgtgatggtattaggagatgcagctcttgagatgtaatgaaggtgagcacacagcaagaaggtagctgtctgcaagctgggaagagagacctaaccaaaacttaaccacgctggcaccctgatctcagaaactcagtctccagaactgtgagaaaataaatgtcagttgtttaagccacgcagtctgtggtattttgttatagaagacagactgggcagactaatacaaggattttgtattctgaaaaaaaaaaaaa

SEQ ID NO: 3314 - DNA, 368 bp, Homo sapiens
gtcctgcgtgaactcacggcgggagcttagctgcctttacatccagtcctgcccttcccttcaaacatatggagctgatgtccttgagtgagtttaaacaagggagacaacatgcaatttgattcctaaaaggagctcaggaaacttgaattcaagtgagcacacagcaagaaggtagctgtctgcaagctgggaagagagacctaaccaaaacttaaccacgctggcaccctgatctcagaaactcagtctccagaactgtgagaaaataaatgtctgttgtttaagccacgcagtctgtggtattttgttatagaagactgactgagcagactaatacaaggattttgtattcaaaaaaaaaaaaa

SEQ ID NO: 3315 - DNA, 547 bp, Homo sapiens
cagagacagcatctcactcggtggcccaggatggagtaaattggcacaattatggctcactgaaggaatagtctgtcagtctttgccccggggtagaaggctgctataaagcaaatgaaaaatgaggcatcattaagaataaattgtaggttttgagtatgttcctttattctcaaaatgggttttcttttttgagaatagcctctttccatttgaattggcttgtattataagctgattgtggcattctgttttcatctgagtctgcccagatgttcccttcatctacaggataaatttctacttcatatacaaagctctgtattttgaagccctatctgatgagttaggtttcaaaatcctagaaaagttctcagaaacttatgacagttatttttgttaaatttatgctgtcctttctaatatgaacataacttttgctaaatttttcttttaagctttgaaaattttttgcataaattcattgaattttacatttaaaagcagtatctttatattaaaaattgtaaccttaaaaaaaaaaaaa

SEQ ID NO: 3316 - DNA, 378 bp, Homo sapiens
cttcacgattcttgaataacttgtgaggcttgtctgctctctccagaaagctgcattatgtgagggcctgttttttgtgtcgctaagctccaggaatcttgcatgaagctgaagatgatctggctctcagcatgtgaaacctcacaaaatacccttctggctctcatcatccttcacctcagtgagacctcaactggctgctgctgaaaataatgcaacagaatcaggaaagagatgttctgcatgtattttggaacaagggagagcagatttcgttagaatttaatcctgttggagaaaatggattgatatagctgagttcaaagggagttgggaaaatagcattaaattttagagattataaaaaaaaaaaaaaaa

SEQ ID NO: 3317 - DNA, 796 bp, Homo sapiens
agatcaattgctgcagccccttttgttgaaaagactatcctttcatcaatgaatttattttgcacctatgtcaaaagtgttatctgcctgaatattcatgaatgggagactactgagtaaattatgccaccaccacaaaattgactactatgaggtcattgaaagcagagtaagaggagaaggaggagctggaggaagaagaggaagagatggaggaggaggaggaaggaagagaaaggaggaagaataatatacatataaagttatctacacagaaaatacctgtgaaattggttttctctggggaaaggaactatctgggaaatgaggtggaaggaagattttcactacattcctttcagtgccttttgaatttcatatcacatgcatgtattacccatatgaaaaacagaataacttttaaaagttatagtgcccttcattttataatcacaggctattgacgcctgttcatggtgtttatcccttccatatcttgctttcttgattctcagaacaagaagacagtgggccaagtcctcaggacaagtgatgcttgggtgttttaatttgttgcctttttgtcaaaagcagaaaagcaggtgagaagttttgagccaccccaaagagaggtttgattctgctggtgctgtcaaagatgactgcaatgatagtttttggccaaaggctcacaaaagttccctgagagacttagagacttatgtggtctgtggatcgcaaggggttatgcaaagggagccctgtatgatgagaactggccaccctaaagggtttt

SEQ ID NO: 3318 - DNA, 276 bp, Homo sapiens
atgggggtacagtatacaaagggaatattgagtgagacaagtgggaagagaagacaaagaaagaagggaccagacatggctagacgaagaggctggggcaatcaaggaagatttaagaaaactgaagcagagattaatactccactgatccactaattccacgttcccagaaacggaatgggccaaatgacaaacccttttggctagttttcttttcaaaataatcggtttcaataaatactgcaatgttggtctgcccctctaaaaaaaaaaaaa

SEQ ID NO: 3319 - DNA, 687 bp, Homo sapiens
tttttttttttttttttttttttttttttttaggttaaattagtttattacccactcccaagtcttagtgaacaaggagtatttgaacattggttgacattttctggatgactcgggctgctccttatacttcaagtagaatgctgcaatccaactttgccctaggagatttctgaaatacaggggccagtgtgccatggacaactgtggttttctgtttggtgtttccttagactccttcctcactcccagctgtcacttctgtgcctttagcagttctgactctgtctaatcatatcatccctttgataaccacattatttcttcaactatgaaaaccattcttgtgtcatccacgatattgtaactgaaacacaggttcagctgcatgccgcttgcagagtccaattaacaagagcaaggccaaagtcaaagaggttcttcagtgggtggcaatggctgcctctacacctcatttcctctccctcttgcctcattcactggctccagcctcctcttcttcctcttcctccttagactcaggatcttgacagctgtcttagtgttagctattctctctgcctaagatgttgacttctatctcacagcaacttatatgtggtaggttattgtgaaaagctcaatctcttgattcttgggattctcttcattaagtgcttcttccta

SEQ ID NO: 3320 - DNA, 1005 bp, Homo sapiens
ctaggtgagcctggggggttggtgtgctactttatccagtcaagaaagccttttgttcgctcccgaaggactcctatactagagactgcaggacaatgtgtggatggggaggattgtgaatgctgaggaagggccctcctgcttctcttccccactccaccctgcacctgggcaacccatgagctgttttctctgcttctggaaagaaaaaaagatttgaagctcagcctcaggacaatcagtgacgatttgaaatagatttgaatgatttgaaacaataccctgacataccctatcaactaagaaattcggggatcaggggacatggggaattgctcctatgtgttcaatgcagacagcctggcagtcagaggttgtctgcagtcttacatctatgactggatgctgtgaaagaacaatgtgcaagagaggtaaaggcggggaagaagccagtattagagcaaatgccttaagtatttcctgggcaggatccgcgccaggccttaaagtctttttaaggtctggtggcatgcacattgcccaggttcatcactgaatacttcattaaaaaaaaaactcctgaggttggtcttacactgtctccccacctctacgtaattctcctgaaaaccggaagggcagacgagggatcagagttctcccaatttcctccactcttcaaaagtgatggtaccccagttgttgacccactctgcagcaagaaattgaaattgaatgagaaggcttggtccactttgaacacacaatatgataaggagactttagaaaaccatcaaatggggattctggttatttgacctgcttgagatggaaatgggcatctcacacacatatcgattgtgcagctttacccaagatgtgctggcccaattgaagagaaagtccttcttcaaaactcccttgttaagttatgccaacaatgattccatagaaaactctgaaaaataaatcataaccgcaactttttctcaaaaaaaaaaaaaa

SEQ ID NO: 3321 - DNA, 845 bp, Homo sapiens
  misc_feature (1)...(845): n = A,T,C or G
gtaaagtttaggatcaggtacgcgcgggacaggcgcgtgtttagggaggattgaaatagacattttctccaaagaaatggccaacaggtacaagaagcaaatacaaatgccaaattatgagacaaagacaaaggtaaggtaaggtaaatgcagccacggagcaagagttaaggaccaagatgagactacgacaaaaattacgaggactttggccatcaacagaacaggatattatagttctctcataataaatgcatttacaattgttacaagtgatttcaccatggacttggttgtaacaatatagtctacgtggaatacaatatatctttgttagtgacttttttctatcttatgttattttgttaatctttttagtatttttttttttcttattttaagtatgtttttttttataatttataattatattttaaatggtaagatgataattttcttatatagtacttcttttcttccttcttccctttttctaaatttcctttatttttagtattacaaagctcgttgcatatttttactagtcgctcttttatattttattttctcttattatttctaagtaccaccttaccctaccacttattgtcttacgctgactaactattattagattaacttttattagtttttttatattatattccatcattttgttcntttgtgtaatctttctctttttgacatctcacgggtttctaagttataacgaaataaaatttagatattagatatctccctataacaagaattgatatgtcgaaatgagagcaccaagtatggagatttgactacgtcattcgtctgagctgttcaataagata

SEQ ID NO: 3322 - DNA, 891 bp, Homo sapiens
ggtgtgaagatgtggggggtcggcgcgccggtccacatacaaaatgatgtcaggacaaaaagcaaataacagcaaattcaaaagattttcttatttgagtgcattttgggtgataaagcagcacgagacaacctgcaacatcagcaatgcgtggcggaccacgaactgcagaccaacacacacgagcacccgacacccagccaaacccaccacggccaaccacaaccagcacaccccgcccgccgcacccgcgcaccccccccccccaccaaacctgctctctgactcacgcgaagccgactccacgcaccccctcgaccgccccaaccccccaacaccccccgccccctcgcccctccctcccgcaacttgtcaatcgccttcgtaccctccccacctcttcccccctccccgcacctgcctcatataacttacacacagctacattattaatattttgttaagcgcaccccttatgccccaccagtgccccgccacactcccccccgccccttctcctatcccttcccctgcccccccacgacaacaccaatcatacggccctgacacttcagaaaatacgcccacgccagctagcagcgctcccccctctatgtatccagctgctcctctgcgtccccgcgctccacgaagaccccccactccccattctcactattatatctcccatgatcgcgcccccctctcaagcccgcaccctacgttgaaaaccatacccccggaacacgcctctaccccacccgcccacccgcgacgcgccccctcgcgcctagcctagaccgcacctcccgcgcccgcggcgcccccgcccacggcaggctagcgcgcatccgagcccgggcctcacaggtgtcctcgccccccgcacct

SEQ ID NO: 3323 - DNA, 849 bp, Homo sapiens
tcagaaatgtagcctggcaaaaaacgtggggtggcctcagcagaggaaatgctgccagctgaaaacaccgggtgtaatcgagaccacaagagacacagacttagttataaatgtcgaactaaaaagagtccaggactggaacctgtttcacctctccttgcctaagggatggccctgtgtgacagtagaatgcagaagtatggctgagtgactttcagatctgggcctgaagaggctttcagccaatcaccctgtaaagaaatctgggctagtctgccttccagttagaatccacatggaaagagaggctgtacagaatgagaagctacacagaggagaatggaggcactccagtcaacagccagacaactgtgaggcatgtcaatgaggccatcttggacattcaatccccagctgagctcccaactgcatgcagctgcctgagtgacccagccaaagtcaaatggagcagaagagccacccagctgatcccagccaacccaggaaaatgcaaaattttaagtcatttttaagttttaagtcatttttaagtcattttaaggtgttaagttggagggaatttgggtactccataatagataatttaaacaatcatactagcaaatatgttcgcatcatggtctaatatttttaaaagccttttcatccactatttcctatagccataccatggcggggggaaactagatcaaagggtaaatatcctggccaagatcttggagtgcttaaaaaccatacaaggttaagagagaagaggttttcttaagtaaggctattatccctaattttctccttttatcttagggaggagggattacaaaatatcag

SEQ ID NO: 3324 - DNA, 634 bp, Homo sapiens
tttttttttttttttttcccttttgaaagttttatttctagttggtctttattagcataaagctcttagttcaactatgtaattaaaatttaataatgggcaacttataggaaatctgtgaagctggcagttcagcctccagccgatggcatcctcagcaggcaggcaggataaatctgctcacgtacgtctgtgtcctgttagctgcttccgtacgttcactttccagaaaacatggaatgctcagtaggtatgccgacctcaatgtcgtccctttgaaagagacaaattcacgctggtgaagacaggcctgaagggcttaccagaggcggccaggagggcccccgcgcgtcttcctggggtgtgtcccttccagaggtgctccggagccacagggcccgtgccccaggctatgcttcctctgctcttggaaggggctcctgcttacaaactccaggcaaatttctagtcccagatggcccgcagcagagctccggatggcttctacacctagcagatgaatgtggggacttcctgagccaagatgacaactgggctcccaagggtggctctgtaaatgtctttgtcttctggtgtctgtcgtctaaagagaacttcacttgttgctctgagc

SEQ ID NO: 3325 - DNA, 540 bp, Homo sapiens
cctgttcgtacctgcttatgataaccacccatggggctctcagggatgaatgctcagagccctcactttctcctatgcccccatcccctgctgcagtgcctttccatggccagccttccagaagcggacacaagcataagatgacatagactgctcaaaacccgccatgaaagctaaacccagagcaaagctgactcccgtctctgagccacaggatgccaaggacaagccaggtataaatcacttcttccctagggcattcaggaaaatattaccagcaaagaaataatttccatcaccttaggcattgggtggaaaatggaaacagggttgggaggaagtgaaggcaggaaataaagctgccttcatcctgccatggggcagagagattaaaaagatgaaagaaaaaagcttgaaaatgaattccttaaccttggaggactaaaagaaagagcctacagggaagacactcagaatgtggatacagaaaaccaaataaagcaatattaaaatagatttccctaaaaaaaaaaaaaaaaa

SEQ ID NO: 3326 - DNA, 637 bp, Homo sapiens
agattaagaaatatccacacatccttcctacctggggtggggtcaaggatgaagtttaggagggcaaagttgagtggtgcggatcaggatcccagagatcacaggaaacacctagagcacagtcagatatggtggtgggttggaaaccgatcaattagagtccataaagcaccaggatgaaaaaggtgaccaaaaggtgataatgagctaagtcaaggacacaggatccttgaacaagtagagtctggaaactccacttctagaagacaaaggcagaggttgttttgaagacatctacagccccatgctatggtgtgaatgtctgcgtcctccaagactcatgttgaagatggggtatttcagaggtggctgggttatatttgctcttctgtcttgaaaggaataacccattcacggattagtagactaatgggttatcacaggagtgtgtctgttataaaagccagtttggcattttcttgtcctcttgccatgtgacaccctgagctgccttaggaccctgcagagagtccccaccgggcaagaaggcccccatcagatgcaacccctcaaccttggacttcctaacctccaaaactgtgagaaataaatgtcttttctttgaaaaaaaaaaaaa

SEQ ID NO: 3327 - DNA, 525 bp, Homo sapiens
ctcagaaatgtctgcctgcaatatttttgctgccacatgtggcaactcaccaggttattatgggagaaagatgcaggacctgtggtcatggcaaaatagaaacatcttctacagagcctggcatcagaagtacataaatgcaaaaggaaaaccaagatgtgaagtgtacaaagcctgaagatagtctgtggaaaactcttcccatcaggagggatccaaatatttgaaattcaagcaccacaaaacttgaattcacccctgcctacctcatgaagcggttgtgaagattgaaggaatctgcatatgtaaagcacataacacagtaaatgggagccattgaagctgctgaaatttctgctctggttgtactcatcacactccatggagatttcctcctaacttagtctcttttcttatcagattgcagaggctgttgaccccatcacctagaacatgcttggcattcaggcaatgtatacatgttaaataaagaagtaagcctttttcttgcgaaaaaaaaaaaaa

SEQ ID NO: 3328 - DNA, 338 bp, Homo sapiens
caaggaacagttaaacaagctgtaaataaacaactttctcacacccatcagagaactgaagtttcagggcaaatcatcacctcaaaatccggagaaaaggaacatcccagaagaaagaggccagatctgtttacctggtggaaaagccactggagccatagactgatatgaacactcaaatagtaattttggccaattactggggaatgaggatggactggagtgaatgtgagaaacacccgggagccagtcttgtgggggcttccacaataccacagactcctttttggtgaagatcgaataaaaactccttcctgactctttcaaaaaaaaaaaaa

SEQ ID NO: 3329 - DNA, 230 bp, Homo sapiens
ttagggttcttgcagtgccaggtgtggattgagattcagccttgtaagacttactcactgaaaactggaatttgcttagttccaaggtaaccttttgtaacagatgtcattggctacctatccaatagtcattccacttccctttgtttttccttggaggagaacaagattttcttcattatacacaataaaattgggatgtccgtgtgtaattaagaaaaaaaaaaaaa

SEQ ID NO: 3330 - DNA, 385 bp, Homo sapiens
agtaacaagatgtttagcctgggcacatggccactcaaaatgaagacttcattcttggcctgccttgcaggaagatatggccacgtgactgagatctggcctatggaatgtgaatagaaatatattgcacctccccctttcttcttcttctgatcattttatccagtttcttggaacttggatcggctgctgaaactccatctcatattatgaggggaaaggccatagtccactagagttactggtataggaagctggaaaaagcctgtgtccccaaggaattttttgagcaacgctatcatgtcactcctggattgactgcctacaagacatttttaaatgtgagataaataaaccttcatatttttaatcaaaaaaaaaaaaa

SEQ ID NO: 3331 - DNA, 324 bp, Homo sapiens
ccagtcccaactggaaaggagtttggaaattatatttctgtgagatacctctgcttcctgctgcccctatttcagaagtcaatggattttacaagaccttgttcaaagttaaccagtggatgttccaatacatgctcagtatactcattgtggaggaaacaatttggaggaaaaaaagtgtgaagagaacttgaattatccagaataaatgcattcacaaaccctactgacttataaagaaaacattgcatattatatgtcatttccaaaagatgttggaccaaaagttatgaaaaaaaaaaaaaaatggcctcgttggcctca

SEQ ID NO: 3332 - DNA, 867 bp, Homo sapiens
  misc_feature (1)...(867): n = A,T,C or G
ctttggtcctcctggccctcagcctctgtttctgaaccagcctcttcatgctcctgttcttcactctctgggagaagactgatatcttcatctttctttcactaaccgcattctggaagcacgtggtcaaggaaaacctctcctagatgtgacatctgagatgaaacttacagacaagtatagtcttataaagattgggaaacatgtattccaggcggaagaaacagcaagaacaaattctctaagatgcaattgagcttggtaagcctgaggaacaaaaaagtgagcatggctatagcgtgaaggaggcagaaggtgaagttggagagactgatgggagccaaattctgcagggctcaaggctccacaatttgccaggggtctgcaactcgtgtccacgtgcgaccgcagtcgcacccgagcccgggatctgtgcacttacgtgaggatgcactcgggccagccagtggctttgcccacctccctcagacaccgctccggggtccgtcagcgccaggcccatgggccatggctgtctgcaactcccgacacaagctgcaaggcaagagagccgctgggaaaccgcaccgcaaggatgccggcattggaacaggaattaaaagaaatgaaaaaatgtgtaagcaaaaactcagctgtacggtaaaaaaacccaatttcccctgagaatgagaaagagccttagtcctttaaaaaaactacctgttttcctatggctagtgagccttatcgttcctttccaggcattatcaaaaccctaattccctaactgtgcacctgcaaggtcactaaacaaacaaatggcagtcacanaacaatattttcctaaaaacgttaaaaaaaaaaaaa

SEQ ID NO: 3333 - DNA, 646 bp, Homo sapiens
attccttattggtttatgacatctgctagaaggccaagcctgccttctgtgtcatcccccaagttggtgttgaagataccgatgtggaggacagaacactgtagcatgcagcaccctcctccctcaggttgtcagcccttgaatctctcacgctgtccctggtcttcacagaatcccagatccccagtattagaaaggatctcgggttccccactcactctatcccagcctcttggctcaagttttcatctatagaagtggtgccagccttggccagaggaaagtggcatgtgtggtcaagtgtctgttggcagcttccagcatcaatgttcccattctcctgccactagcacccatatttgacttctccattctaggctgccatttgctgcagtgcttagcaagacattatggaaggttctggtataacggaagggatctacaacatagagtaccaccaatggttacctctggaggtggctgtgctcagagcacctgggcctgggagggaaagggtgtctcagaaagaggcatgtctcctcctttaatcagggttcctcagagattggcatttgaaatctccagactgagtaaggaatattcaccttcaccccacgggggcagacaccatccaatcagtcgaggg

SEQ ID NO: 3334 - DNA, 892 bp, Homo sapiens
  misc_feature (1)...(892): n = A,T,C or G
ttggcatctaatagatgctaaaagttcaagtcagaagacagaatacatacatggaaattatttatgagttcactcaggacagaacttttaaaaagcacataataaatggaaataaaatggataattagactcaaaaattataaaaattgggatctctccaaatctacaagttataaaataactagtatttacattgctcattttcgatttggctgagaaactcaatgtggatgagaaatggaccttgattttaatcaagtttattgaaactcttactttcacaaaacttcagttttaacaaattattgtgtggtcctgcttctaaaatagcttgctatgtttttaaagattatactgncatgtaagaatcacttgggaatcgatcattttaattggctatcctctgcctcagtctgtcgaaccttggggttcaatattccgggtccttcgtgtgtgtagctgttttcctctactcaggaaatgcctcctggctctcgtggcttctctggacagaggcacctccgccgattcagccaccacctgggcttcatttctttcaaacacaccaccagaccttagggcttctgccaactgtggcttccacctattcgcttctctctgcttctcacttgctgttccttaactgtcttccagatgttcttccccaactgtcttataggtgctttgagatgctgccaacagatgctgttgtgtctattcaaactccctaaagtgcagatctgaacactcaatggcaaagtttggagccatcaccaactcatcctgctcattcactgggggccagtcaggacagcagggttacagcatttctagagctgtttgcagttgcttgctggagcagcaggggcctgggcatatcagtccatggtct

SEQ ID NO: 3335 - DNA, 553 bp, Homo sapiens
  misc_feature (1)...(553): n = A,T,C or G
attttaaatttaatagttagttatactttcaatgtgaattagggaactataacttgcacatcaattgcgtgatttcatggatattattcagtatgagaataagtattgtgaaaaaatagtccatttaacatttgtgggacctgaggtgagccacttaatttattcaagcctaagttatcatctaccagtgatgatgatgcaagtctgggagaggaggtcctttggaaagaagaagccaagatgcagttcaaagtacgagatgtttgttggagataatgcctttgcaggtctgggtgaattatctggtggtgtgacccacacactcattcttgaagggtctgaagggggaaacaatccaaatcccatcaatggatgaatggatgaacaaatgtggtatatccgtaacacggagtattattcagccataaaaaatgaagtactgatacatgcgacacatactgacctcatatntgcncagagctgtagtcaagacaccagttggtgagcttgggggttnttttttggnnattcccagnnnnttttttctntgang

SEQ ID NO: 3336 - DNA, 879 bp, Homo sapiens
attttaaatttaatagttaggttatactttcaatgtgaattagggaattataacttgcacatcaattgcgtgatttcatggatattattcagtatgagaataagtattgtgaaaaaatagtccatttaacatttgtgggacctgaggtgagccacttaatttattcaagcctaagttatcatctaccagtgatgatgatgcaagtctgggagaggaggtcctttggaaagaagaagccaagatgcagttcaaagtacgagatgtttgttggagataatgcctttgcaggtctgggtggaattatctggtggtgtgacccacacactcattctttgaggggtctttttatcaaggataaattacccctgcaaaaagggcaactccttcctgcccgcttggtgcttaaagactccaaaatgcctcaacagcagccacagcttgtagttcaataaaacccttgctctgccccagataagaataagcctcctttggagatcagaatggtaatcaagcagaaccccaaactgaaagggggaaacaatccaaatcccatcaatggatgaatggatgaacaaatgtggtatatccgtaacacggagtattattcagccataaaaaatgaagtactgatacatgcgacaacatagctgaacctcatatctggcatcagagctgtagtcaagatcaccagttggttgagcttgtggtattctatctatggtcaatctccaggatgcttctgattcctgcaagggccatacttttataccatcattcctggtctttgtaggggatccatcactgatattaggatgatcttgattcctctcaccagagccttcctgagagcattggtaaattatgtgtcctctatgactt

SEQ ID NO: 3337 - DNA, 186 bp, Homo sapiens
ctttgagagaagacatggagaaaagccttaaaatggacacccgacttgcatattcaaggaccagcaaagaggctgaggaaacgaacagccaggatatgtggagccttgtagaccactgtcaagactgacttttccttgagtgaaattgagaatgattaaatgtttttgaatagaaaaaaaaaaaaa

SEQ ID NO: 3338 - DNA, 863 bp, Homo sapiens
ttgtctactctctaccaaatgctgaagttcttcaagaatcagtcctttggaggtgatgtcattgaaaatgatgagtaggaaactccaagagcgcatttctccacaaaaccagtgaatacattggcacaaattgtcagaatcaattttatataaatactgcaaattagtcaaaggtttatagtaaccaagggaacatctttttaaaaagatggctgaggctggatgctgggcttatacctgtaatcccagaactttgagaggcccccgcgagcatagcgtttgcgtcatcagttcgagaccaccagtatacactcctggcgcttcttggcggcacctggattcccccagggattcctgacgcaagagaatcgctccgcaccctcaccaatgtacctgcaccgagccacgatcgttccacctcatcccacactggtctaaatagaactactccgccctcactaaaaattcacaagccctcccgcgcccctcctctaaccctttctcactgttaaattccccgacggcacacccaccctccccgtcgctctagttctctctcttcactatcttcttcgtaattattttatatctatattccattgctccaatcacatcctccctcccgtgccccgtatctcataacccactcattatcctgttcgccttaaacatactctcctctctcaactacccatcgtcttatgccccccctcacccaaaacccccttcattctcatatccactctcccacggacggttatattcaccgacacaacctactcagcatcccgcatctaactccatcccatcttacctctccttttttacctcacccttccatactctctgtcaccgcttccttc

SEQ ID NO: 3339 - DNA, 408 bp, Homo sapiens
gtctgttacctgtgcatccggtaaaaagaatgcaagctaagccattacataagaagtccttcctagccttcacattctgggattctaagaagggtacaatgtgggcatccctctgctcaaacagcaattcagagcgggacagctcgggtgttcctgttattggaaagagactgaaagcactcccccaaatgcaaccatgaagatcttcattaaacagtcaggaaagctaagtgattgaatatgctgtgcagccctgagaatgaagggattatattgtcaagtgagactaaaagcttgtaattaaagctgactgaattcaaaaagacactacagagaccttctgtgtaccaataactttgaaatgagtctgtgatttgctattttaaggttcaaaaaaaaaaaaaaaaa

SEQ ID NO: 3340 - DNA, 592 bp, Homo sapiens
  misc_feature (1)...(592): n = A,T,C or G
ttaggtgcaaagggaacttagcatattccacagttaccttcagcaacagcacagaaccacatcaccaacaccacagtcttggagaggaattacaactcggcctgctctttaggaaagccagtgtgactaaagaaaagatgggacttaactgcaaccactacacttgggagtaagcaagtctctgcaataggtctctaaaatataatgatgtggtgtatgtaacactggaaaaaagacagggctctgcactcaagaacttaattcaaggatgcaaattagaactacaaaatacctgtgcgcacacaatcttcatttatgaatgaagatgaaattataaaacatttatcaggtaaaacatgaacccgtatctttgcttcgaataattccaaatggtttctaaattttaatggatggataaacaaacttttctaataattcatgatattaaaaatagtgaatgtgcttcttttacatataaacagtaagatgcaaaaaaaagaaaaaatggcctcgttggctacagcggggagtgtgcggccacttctcctnnctcccctcttccttccttctnncctttcctctcttcctttcc

SEQ ID NO: 3341 - DNA, 418 bp, Homo sapiens
tagatgatttcagccattccgataagcataaggaaaagaaaaaccaccagtgatctcataatacagacattttggaatatttgaaaagatcacaccactgcacttcaacctgggacaaagagcaagactctgactataaaaacaaaaaccaaaaaaaggtgtgcactatgcacatatgtacatttttagaaaattgtttcttaccctatgtagaatgttatagcctgcttttaacatttaatctgcaccatgagcaccgttctgcataataagataatctttggatatatcattttaatgactatatagtgttttatcctatgaatgaaccacctttttttaacctattgattaacattgcaattgacttatgttttgctctcagatataatgctataatgaacattttgcatataaa

SEQ ID NO: 3342 - DNA, 305 bp, Homo sapiens
ctaggtcaatcccatcatctttcataggctaccttcttctcaaacgagtgcatgaaccagagctgtgaatttgcatcactgagttttgaaagaatttctgtgctacgtttccttcgcaaaattgttcatcttctctcaagatcacattgagacctcttcagtggcatttctgtttctcatgaagcaccacaaggtcaatgataatttttccctttatgtgttgtatatggtattgcgtacaaaaatatagatagataatatatttataataaagaacatgtccatcatcctcaaaaaaaaaaaaa

SEQ ID NO: 3343 - DNA, 983 bp, Homo sapiens
cctagagaaaaggtttcagagagattcatatgcaacagtaagggaagaatggaaaaaccctccaggctagccagatcagccaaagcaatccagtgtataatggcagagatgctccatggcccacaaaaccagattgcccagactcttgaatttaagggaaaagggaacaagtgcctagcttttgacaataattgtgagcaaaagtgatgcatcatttacgcaccaagtcaattgagacagagcctgccctgtctgtgctatgtttcttcctgcctcaactgctagctgcatggccccagagcaatctggaagcactacactgagcttgtcagagttacagagaaattaacaaccacgaccaccctgcattagatgatgtcacgggaaaagataagcctttattgtgttaagcaatgaagattgtaatttaagagttgtttgttagagcagatatcattactgaatctgattaatatgctctcatatacaaaaatatattgcatttatttagtatccttggttttttcagtcaaacttataacatgaatcatttcccataccattatttctgaaaaacataaatttactgtgtgtattaaaaaacctactgatagccatgttgtatcttactttattttttcgggatagctagatgttcataatttaaaatatttggtaaaataatgccataattaatattcttgcttaaaaatcagtgtacatatatctggttgtttagcataaatttatttgggtaaaattgatgaggtaagaatttttccaaatttaaagctcttgaaaaaaattgtcatttgcttttaacacaaattgtataacttacacttctactagtatatgagtgcctgttttattgcacttttgccagtgccaactctgaatacaggcatacctcaaagatattgtgagtttagttccagactcctgcaataaagccaatatttcaataaaaaaaaaaaaaaaaa

SEQ ID NO: 3344 - DNA, 331 bp, Homo sapiens
ttaacgcgagatccagctgttgctctggagtttttctctgtgaatattttttcatcttgttctgctatttcctaccatattccccacaaggaactttcactcagcatcctactggaattcaacattgtgggttaatgctatgctccttgtctgcagtggtgaaaaaattcctcaagagactttgactggaaacttgattgctctgcttcaatcaaacacagtggctggacctatctggacaatgggtgcaatcattatgattatggtcaattaatatcaccaacccattgtttgactaaactgacaaatggctgaaataaaaaaaaaaaaa

SEQ ID NO: 3345 - DNA, 225 bp, Homo sapiens
atggaagaagaaaggcaatacttgcaaccaatgataaagaggtattctgactttcatctgcctttgtgttaagcgtgagagagccagacagaattgcagcaggaaccagaaggagcaaagaaaaagattactgtttcttttataaaatggtttttatcctactggtgtctctttaaaaataaaaatcaacaaataagtgtccatttaaattgaaaaaaaaaaaaa

SEQ ID NO: 3346 - DNA, 412 bp, Homo sapiens
aggtgagcaaatttaggtgaagtaagcaaagtgacctgcataatgtcaaaaaactgggaagcgacagaacagaaatttggagattgacttgaacctaaaagggacacattttgtataataacatgccatctccctaagtgttgattaaaaatttaaagatgtataactatatttcaatgaagagatctcttattttgatttatatgtatatgtagatataaatcaaatctatcatctatctaaaatattccagaaattgtttcctaagccaagaagctctccattttgcaaaatgcaatagctgaaaaaatgcttttagttttacatctttttttaatgcctaaaagtcaagattattaaaatcaagtcaaaattaaaattaaattatccttcattgtcaaaaaaaaaaaaa

SEQ ID NO: 3347 - DNA, 752 bp, Homo sapiens
ttttttttttttttcaatttttaaaaatctatctttattagagcaataaatgattatataaaagatttacatattgaacaactcaaaatgaattcagggcctctaatgatgaaaatagataacctatcttatgataaaagcctatcctcattctgacagttgtctacatcagaacactgacagggtgcccaaaatccacagggggaatctaaactccgcttttataaatttgaaggcctatagcaatttgttctcaaacaatctttgacaccactgcattcacctaataatttcacagcagaaaacaccagcctgataacaacatatttcaatgagttttgattgaataactctccttcttggcacaagctgtaatagcttctacattcggtagcaaatggcttttgatgctaagccaaggaaagtgttatcaagggatagaggtaatgtatactttgggaaaatccatctgccacattagagtaatcttctaaatctcagtactaggcacgtcacatttgtcttcaaaaactttagtgactccccttcatctaacaaataagtccaaacgtgaagcataggttaggatagtttaagagcacataaaactggatcctgactattaaggattaataaaatagggatttttttcacatattatggaagccaaagttagtaaagggaaggtaaaatgggttcaaaacatgaaagaattaaaaggttttttctgttgatcataagaaggctttggt

SEQ ID NO: 3348 - DNA, 773 bp, Homo sapiens
ttttttttttttttgaggttcagcaccactttattaatgaatttcagccacctcagaaagaccaacctagagggtagctgggctgagcactgatgaagagacatctctggtctgcaagtttgtaatagagtttgactccatttttgatgtttgactgttgacagctttcaagtaccatcacttcttctcccactgccccatgtgggcaagctgataggaaagcccaaatgttccctcctttgacaccatggcaacttggagttcaaagcacacactttggcatgaaagacaacctagtgaaaatcttgacgtgctcctccttgggcgacatcaggattcaggacagaaggaagacatcaataccagattgcaaggaatggcatgcattacctttattgttgatgacatttaacacagaaaacctgggagagttccacaaattttcatgcaaagcaactgaaatataaatataagatgatcttatgtcactattttctgaaaagcctggaaagaaacagctacggaagttgaagaaaaatgacaatcatattttttattccctaaaatacagatttaaatatgtgttaattacttctgcagttaataataagaacgattatttctggacctcgtagtctagcaagaagtcttcactaattcacaataagaagtcatcaaatgagtgcttttgttgaagcgagcaactaatattttaatagtattttgtagcctacatatactctcctatttacccttccctaaaaaaaaaaaaa

SEQ ID NO: 3349 - DNA, 590 bp, Homo sapiens
cctaggaaccatgcccaggcagaaaaaagttactgtaggtgatgaagccagtgctccctgaaccaaataaaccctatcgacgttaccgaactgccgggcaaaaccagagcaactcacttacttggaaggtgaaaaacacttcaacatactccaggcggcaaccgacacttaggggccaggcagatgaaacaccatttgtttaaaaagtctattatttcactgtctcttcaacaaaggtggaaaactgatgattaaacactgaataatgccacccacttactaaacctatgattcactaataagcaggttcaatgcaattcataactttaaagaatgaattaccgaagccccttgcttcacaaattcccccaagaaacagaaagagcattcatcacatataacccgacaaccatttttactatggacacctacagatggcttctcttcctctaaggacacaatttccttcacaatcccacatgtaatcatttacaataccagaaacaaactccaactcagttccaccaactgggtttttaaaaatccttgtgcctaagaacgtcttttttccccaaacgtaaaatgtccat

SEQ ID NO: 3350 - DNA, 768 bp, Homo sapiens
attgatttcaagctgtgtatgaacacaggtaaaaaaatcccaggaaaaaaatcataacatcttggaacaaagaacaaccatggatttacttggaagccattcacaaacataacagacctgtgggaagatgtctaccaacagctgctttcacctagtaaaatgtttttgaggttcatctacattgtagcctatatttgcagtttattttattagtaaatagtattgcattatatggtaaatagactacattttgttttacccgtttattatttatggacattcggattatttctagtttatggccattatgaatactacttctgtaagcattaacaaatatgccttttgtggatatatgtttttatttttcttcagtaggtctgtagaagtagaattgctgagccatacggtaattttatatttaacatgttaccaaaatcagactatgtaaggcagcacaggggatttttaggacagtgaaactgttctgtatgatatagttatggtgaatatatgtcattacacatttaccaaaacccatagaaagtataattccaagagtgaaccctactgcaaactatggtcttggggtgatattggtggatcagtctaagctcatcaattgtaacaaattgtggagttacaataagtttcgtatccttgcacaggtctggttataactccataaccctgtgtctaagttttgtttaatattgatttttcaggcggcagacggaaccgtgagtatctcctgccgtttttttggta

SEQ ID NO: 3351 - DNA, 626 bp, Homo sapiens
aggacctttctcatcctgtcctgaagggagttcctcctaggtctggtcgttcggacctttgtatgcacttaaaatatattgtcatccttcacttcttaatacttgagaaaaagaacatccttccatgcctcttgatgaaccaccaaggagatccacagcagtcatgatggggccccagcatgagaagaccctgcactcaagtttcctaggaaactagaaaactggcttaatgtgttgttgggagcaatggcacacccatggcacatgggagaacaagcatctgggcaagaagcatgaaaccttcagcctgactccagaattctggctctaatagtgaaggaagttgcctgaaataattatttttttctttttttgtagagattttctctttcaatctttctctgtccttaaattttacgtgtctctaaaaatagcatatcattgtatttttttaatccagtttgaacactgtttaactgaagaggttcatttacctttacagtgatttctgatatatttaaattacttccaacatcttatatgagtagggtaaacaaaaagtaccaaataagatttaaattaatacacttattaaatatttatatacacacacaaaaaaaaaaaaa

SEQ ID NO: 3352 - DNA, 352 bp, Homo sapiens
ctcagatatgcagtaaatagttattaatgaatgattgaaaatgatcaaaagaaagaatggaatgaagcaagccagcaacacttcgccatgcaaactctagtcctgtccgttatgggaaatctccaaacccaaaagagatggagaagaggaaaataaccactaagagggttaattcattaactcaaggaagaaaatttattgaggtcctactcagtatgtgcgctaataccataagcaagagccaaggatggtatgtgcaaggtggtcacaggactctaagttctatcagtttacaattctttaattgtgcataaatatcagtagtaccaaaaaaaaaaaaaaaaaaaaaaaa

SEQ ID NO: 3353 - DNA, 735 bp, Homo sapiens
ctactggttacttcctcctcttctaataagccatacagaataaaggaaaaatctacagaatattggcaattgggatgaccgttggcctctaccttgcctagagaggaaagaaaggcccaaggaccttgagatttcatgtgcagcagcatctgatgggccggttaccttctttgccctgcacattttctctattcctctccccacagctctctgccctgagaggttgacctggatgagctgcacccacaagctcatttgtcctcaggtttccagttgagttccaccaatgggaggcaccatcaggagatgcagacttcaagaagagtgaagctgggatgtttacttccccaactcgctctaccgagctgcgtgtgagctggcagggtacttcggtgaagtttgcagctcccatcggcgcccttttctacatcagcctccgtagctgcccaactttcttttgccattgcagccagttgagtggcaaaactggccccctcaatattttactgttccttgttggcttcattttagcctgtccccacttttgtcaattaccttttctttaaactctcaatcacctatttgaacatgcccccggggatgctgctttgatcctgcctgacaaccttggtttctagtttaatattttctcctctcccctccgccccacactatgctgggttccacgcatccaggaaataaaagattgccttcatggaaaaaaaaaaaaaaaaa

SEQ ID NO: 3354 - DNA, 636 bp, Homo sapiens
agctttgaaaatctaccattcggcccttttagtctttccggctgatctttcccatccacaaacagatgttgctcactggattcagcacttccatcaaaatccccaaaagccttcatgcttagaaatgaacagacatcaaaaaggcagcaactgtcctctttactgccatttcctcttctagggcctgtgacatgacaaggataatacaggaggttaaaaaaaaaaagcactcgtgctgatgaagatggggggcagagtagtcacaaagaatgcagtgtgagtcaaccctggcatctggaaggatctgaactggctgactggagtgaaaagaattcttcatgtctgtaaattattacgaaatgccctgaggagcccagtgactagtcactgagtatcaaacccaggaaagaccacgaaccagcataagttctagatcaaacattgtagtctgtacaagccacacttctaacacatctaggttcaatctgccttcagaggtgccagtggaattcaaaagcatgttatagcacttttcattttccagtgctcttgattatgtaagctgacacatggccattctcctctctgaacatctctgcaaataaaatattattcctatttttaaaaaaaaaaaaa

SEQ ID NO: 3355 - DNA, 281 bp, Homo sapiens
agcataaagtgaagtcttccagaagttatgtaatgtgtgatccgccaccagattgaatgcaaaagaagagccgagaatccaccggttttttattaacccagccattaaagggatttgcagaaggtaaaccaatccccctcttctcattaaatatttttgttttgaaaaccaaataattaaggtaatcaaaaaaattaatttcaattttaattaataacggcgcattattgctgtctaataaattaataggcagggtattatgccaaaaaaaaaaaaaaaaa

SEQ ID NO: 3356 - DNA, 933 bp, Homo sapiens
ctcaggctgcctgtgacttactcgttgcctcgattggcccccttttggtactacgccaaggttgagctggtacctcccacccctgcggagaggcctagagctattcagagcctgaataaaacagtcaatagttgctcacactggtagctccaaacagtctacagctccacgaagctcagctcaatggttccggcggccactgagttagttggcgcggctccatcacacgacagatcttacccaaccgggggggtgcattccctctcaggctccgaccatcccacctcacctcgcctacatcccccccgcctccgtccctctccggtccctcatgtggtctgcgccagcgcacccccatctgtcactcgaccaaatacttcgcaactccctcgcgtccttttgaattacaaccacagtacttaccgcccgcgcctcgccgcccacccccaccccacttcctccccatccttcttagttcaccgacggtacgttcccccgttccactcccacctctccctattcacttttctcactacgtcttactccaccaagcgacctctcccgtccccccccctccgaattctcatctgtcccgcccacccggccaccacgccctctcccccccttgcgtacgaactcgtatcacccgatataccctcctagtcgcgccgccccggctcctactcctgcccctacatcgccatcacactaactaggcttctcctcgttcccccgctccgtcattatgccgctaaccctcctcccgcatccgcccacatccgcaccgatccgagctactccatccgagacaacgcaattcccactgccggtccacctgcgctcccaaggtgccgtgtatattcacaccttccggctcacctgtttctgaccacatgacttcggagctcaattgcctctctgtattctctccat

SEQ ID NO: 3357 - DNA, 166 bp, Homo sapiens
agaatttatttctataatgtacctggttcaacatcggcttcctctgagcatcaccccgacatctctgcctcaactgtatttattattcttattactcctacctcagggcctgctgcataggagacccttctggaataaacgcacttagcaaccaaaaaaaaaaaaa

SEQ ID NO: 3358 - DNA, 446 bp, Homo sapiens
cttgggtcctgccattttctactattagcctgaccaaatggactcccccacagggctggagttctggcaactcttcctgagatctgatacaggccaacttcttctgcctagatgaatcaaacccagtctgcccaaagaaaatgtagcagatcttctcggaaactcaaatgccatcgccctgaggaaaacttttccattcaacaattgttatttgctctgtattctcatactaggtggcctatgcttttgataactgctctttcatatttccttgtttacattatttgtatggccatctacataactagactaaaagatattcgagggagaagttatcctactaatttatgtatcatccaaaatttatctattgaagactacttttcttaatctgtgcttgtaaaaatcttgtactcattaaaaaacactacccaaaaaaaaaaaaa

SEQ ID NO: 3359 - DNA, 584 bp, Homo sapiens
cataatgtagatgcctctcctggagactctttgaatctacttcatgagatccatgacactgtctgctatgtcgttgcagagcttcttgcatggaatgatggactgcctcatccttctttcattggctaacacatggactttgtcaagttcaactgccgatgtcatcccattggccagaaagtattcatggaaggagagaaaattctctcctctggaacatgtgagtggtagaactcaggaaaatgcaggatcagttatatatgcatacatatgaatatttcatacataacattgactaataattgtaatggccttttatcaaactgatgattcatgtacctaaatgttttgctattgatttaacaattattctatatttaatctgtgaaattattgagttagaattgaaatacagttataactgcttcattaaagaaaatgttacacttgctatagttttttatttagctctacctgtatatgcaattgtacaatcaatattattcatataatgctttaatatttttgcaaccagaaactattaaaaagcaactatttaaagagtaaaaaaaaaaaaaaaaaaa

SEQ ID NO: 3360 - DNA, 593 bp, Homo sapiens
ggggtctaccatgttgtccaagctggtcttgaactcctggcacaagcgatcctcctgcctcagcctctggagcagcagggactacaggcgcacaccaccacacctggccatatacatcacatgttgtttatacattcatctatcgatggacatgggcatcacctccacctttttaggctggtcactgcagcctaaattctgtttaattctgtttttaattttaattctgctcctctgagatgagccagcttgtgcatgaagcaaggcttgaaggagaacacggctgcgtggatcgctgggccactggactgaggtgctttgaaggtggcaatccatgaacctttggatttgtggatctgtgtgtggatctgtgaagcaatgagtttcttcattgttgaattgaggtttaggtctcttacagctatgagccgcctagatgatgcatcttccgggaagttgcccagtttcaaaaattacagaagaaaacaaaaatgaacagaaccacagagaagtgggaattattttgctgatgtgaatgctggacaaaaacattaaagtatgttttgtagcaattttaaaaaaaaaaaaaaaaa

SEQ ID NO: 3361 - DNA, 443 bp, Homo sapiens
tcaggttagaaatgtggcaaacgatttttaacctcccactcccagtctgagacgcatgtgagtagatgaactgtactcaggtcttttacattagatatagctatagtcattccatattgcaaaagttttaggcccagcatggtggcctatgtctgtaatcccagcactttgggaggctcgaggcaggcggattgcttgaggccaggagtttgagaccagcctggccaacatggcaaaatgccatctctattaaaaatacaaaaattagctgggtgtggtggtgcatgcctctactcccagctactcaggaggctgaggcatgagaatcattgaacccaggaggtagaggttgcagtgagccaagatcgtgccactgcactaccgcctgggcaacagagtcagactctgtctcaaaaaaaaaagaaaaaaaaaaaaaaaaaaaa

SEQ ID NO: 3362 - DNA, 879 bp, Homo sapiens
gaaccggttatgaaacaaacatatcacccacaatatctgcactggctatggcatgaagcctggtactgggatcaagaggcagggagacaccagggaaaaatcctgcctcatatcacagcgaagcctggtgctcctggctgatttgggagcttgtcggtaagtctcatctggtcaagttcgacaacccccaggtggcaagctttacgccacaaagcccattggactgcaggaaacaggaaagatggacagctctagtcctcggccagaggcagagctcgtcagtcagtctcatctggtctaatcccacaaccgccgagtggcaagctttatgccacagagcccactggacttgcagaaacaggagagaccgatggctccagccctggaccagaggctactatccctgtagtacctctgaaaggccatccttgtagcacccctgaaaggccagatgcagcctcttattttgcagaggagcgcccccacagtggccacccacaggaaggctcacctggcctctgttgctgaatcggaaaaaacctgcaccccagccacatatgaccctcttcacccacaatgggcagcctgaacagaaagactccatccaaaaagatcaagctgccgtcccaagccctccgacagacttttaattcctgggccccaaacagggccccggaggcctttggtgctctggccacccaaaagccttagctccccttctcactccgcccggcactgaccccgttcgcggactcgcctcccaaaatgatcccatttccccccccccgctttagcaaaggcacttcaagttacgccactggcgcggccctccagtcctgggggggtaggcccccccacctttgacccggtggtaattgt

SEQ ID NO: 3363 - DNA, 875 bp, Homo sapiens
gctggagtgcagcagtgtgatcatagctcactgcccctcaaacttctgggctcaagtgatcctcctgcctcagcctccggagtcactgggattacaggcaagaatacccacatcaacaattggaagcagtctcgtggagtgctgtggaaaggcggtggatgaagattgacttgggaactttctcttcattgttaatctgtttttttttttaaatcctgcgtattattatctaactaatttcctaaaagtaaattccactttgttaaattgtcatttgattgtcatcttaagataagctataagtatcttaaaaaataaactaaaaggtcttcttatcaaatatatgaatatatcaactcccccattctctcatacattcttattgtttccttatagttaaagaaaattattcagatttggaaatccacactaggaagtgtcatatttaaaacatggataacatatatgcaataaggtgtaaatggctgaagagtaatttgcaaaaatgaaagaaatacagagaacctttatttttcctattttgcctttatggcgcaatgggatactagtaaatgtttaccaactggctctctgggagggaaaagcccgtattcacggcatttgcagaattctgtggtgcgaatattcctaccattgcctattttaagctagtgatgaaatttactaaaacccggttttcgaggagctgggaagaacgcacccagttggctctccagactggggaagcagctcaacactgctttcggttgggtaatcttctcttctcttaaccccatcagactttttcctcctccaaacatttatagagaagtataattcctgcctactattctaggctacacttcttattagaa

SEQ ID NO: 3364 - DNA, 1203 bp, Homo sapiens
tggctggagtgcagcagtgtgatcatagctcactgcccctcaaacttctgggctcaagtgatcctcctgcctcagcctccggagtcactgggattacaggtaccaggcaagaatacccacatcaacaattggaagcagtctcgtggagtgctgtggaaaggcggtggatgaagattgacttgggaactttctcttcattgttaatctgatttttttttttaaatcctgcgtattattatctaactaatttcctaaaagtaaattccactttgttaaattgtcatttgattgtcatcttaagataagctataagtatcttaaaaaataaactaaaaggtcttcttatcaaatatatgaatatatcaactcccccattctctcatacattcttattgtttccttatagttaaagaaaattattcagatttggaaatccacactaggaagtgtcatatttaaaacatggataacatatatgcaataaggtgtaaatggctgaagagtaatttgcaaaaatgaaagaaatacagagaacctttatttttcctattttgcctttatggcgcaatggtatactagtaaatgtttaacaactggctctctggggggaaaaagcccgtattcacggcatttgcagaattctgtggtgcgaatattcctaccatggcctattttaagctagtgatgaaattttactaaaagccaggttttggaggagctgggaagaaacgcacacagttggctctccagaactggggcaggcagctccaacactgcctttacgtcttgtgttcatctctctccttctacttcaacacccaatccagacctttattacttcctgcctaaaacattataatagtagaatgtcataatttccttgccctatctatttctcagtgctcactcactgctttattagtcaatcaataaaaatgacgctgaggcccgatgagcaatcttcttcgcacattaaaaaaattaattttaatggctacataataggtgtatatatttatggggtacatgtgatgttttgatacaggcatacaatgtatgataatcatatcagggcaattggggtatccgtcacctcaagcatttattatttctttgtgttaggaaccttctaattccactgttttagttattttgaagtatacaataaattattgttgattatagtcaaaaaaaaaaaaaaaa

SEQ ID NO: 3365 - DNA, 816 bp, Homo sapiens
  misc_feature (1)...(816): n = A,T,C or G
tcagacaaatggaggcatgagcttccttagaattaccccttcgacgcatagttctgtttcatctggacttttgaggcttagtatctttctactacttagctttcctgactcaaacggaaaagccatttggacagctcacctgaatataacatttcaggttgggaatgagatcacatcggaattaggagagagtggagtgttcgggaatcattctcctctggaaagggtgtctggtgtggtggcacttcctgaaggatggaaccagaatgcctgtcatcctttgaccaatttcagcaggcccaaacaggcagactcatggctggccctcatcgaacgtggaggctgtacttttacacaattgcctacttttacttagattgcgtctggagacttacacctagagtgcccaattctttcaccaggaggcgaagtcaaataaagacagatgtgaagaaatctattgaccagcttcaactgcgagttctcaaagaaggggatgaggaattagacctaaatgaagacaactgtgttgtttgctttgacacatacaaaccccaagatgtagnacgcattttaacttgcaacattttttccataaggcatgcattgacccctggcttttagcccataggacatgtcccatgtgcaagtgtgacatcctgaaaacttaagaaatctggagaattttctgaagatgtaaccagatctttccnaatncaaagattagataaattgtcttattgnactttatgtagagagaaaatttcagcttctctacccaagtatgaacaagggtgaaatttgtgttttaaaaat

SEQ ID NO: 3366 - DNA, 783 bp, Homo sapiens
  misc_feature (1)...(783): n = A,T,C or G
tgtatttgccacctggccctatacaacagaactgccatagtgaacatgaacaggaggcagagtgggaagagggggtgcctgtgagatgacatgatgaccgaagttctaccagctgttatggatcatgcgatgtcccagaggaaggaaaccacacccttggatgggcccatgttttacagatatgatgttatgatctatattttgacacgactgtgaggaaacctggatggaggaaaatgccaccatcatttcctaagtgccgtctcaagacataaaaagcttattgttatagtctgaactgtgccccgccattcttatgctgacgtcttaactcacagtatctcagaatgtgactgcatttggaaagaggttccagaatctgactgcatttggaaagaggtaattaagttaaaattaggtcattatggtgggccctaatccaacatgattggtgtccttataaaaagaagaaatttgaacacagacaaatacagagggaagaccgtgtgaagacacaggcagaaggctgcctcctgctagccaaagagagagccctcaaaaanatcaacccctaccagcaccatgatcttgtgcttttagtcttcagaaatatgagaaaatacatttctgtttaaatcacccagtctgtggtattttcttatgtnacccctacaaacaatatactcatgtggtttttgcacaggagaaataatattattaaatgcattgagtnaaagggatgaagggaaagcaattctttaaaaaaaacttagttacaactgg

SEQ ID NO: 3367 - DNA, 495 bp, Homo sapiens
  misc_feature (1)...(495): n = A,T,C or G
atgcacatgaaatttggtgccgtgactcagactgggagacctcccttgggagatcaatcccttgtcctcctgctctttgctccacgagaaagatccacctacgacctcgggtcctcagaccaaccagcccaaggaacatctcaccaattttaaatcggatcttctcggcatagcggctgaagactgacactgcccgattgcctcagaagccccctggaccaacacagactctttcagtaactcttacagtggaagaaagtttcggagagggaatgagaatctgcacttctatcaagttcctatgtgatgatgttggtccaggaatcatacttcgagaaccatttgtctacagaaaaaaaaacttaacaggtacgcctgctgctcatctattaatgtagagaaccttatttcaagatgaaacacatcacagctttgtcaaatatcagttttcctaaaaggcnactcaccaaaaaccatatatataataatgaaaat

SEQ ID NO: 3368 - DNA, 405 bp, Homo sapiens
ttaggtcaacgtctggatgggctgtcaaggatatcatccagaacatcttacgacccaagttacagaaatgtggagaactgtccactgaaagactgcaggggccacgggggcagtggctgaagagtgtgccctgccaaaagacaaagagatttcaaaattcaagaaaaaatggactcaccaaacagagtcctgctgctctataaattacacactagctctatagtgctagtgtactatacaatataatatatatagtacaagccacctgctctataaattacacactaaatattaatagtggttgcttctgggtggtgagatttgggagttaccttaattttaaaaagtgcctgcccatagcccttagaattgtaagtattttttgactgtgaaaaaaaaaaaaaa

SEQ ID NO: 3369 - DNA, 791 bp, Homo sapiens
gggaggagggtggtgagagtggttaggagggggagtgggagccggccggagaggggggatagtgggtcagagtcatgaagggggcgcgagcgaatgggggggggggggtgggcggggcggttgtagtgttggtggcgaggggggggcgggggtggacgcggggtgggtcgcggggtgcggggcgactggcgtgggggggaggaggacgggccggggagggaggtgatgggggtggaggcaggggaaggatgggggcggacgaagtcagggagcggggatcagggatttaccctcggtaaagggaagcgcccgtagaggctccggcggtgaggtcaaggagcccatcttggtctgtttttggtcgcatgagggatcgggggttattctgcccaaaggaaggtctcctctatgacaatactgtgctcctttatagcatattatggggatagtttcagtccacatactacaggatggtcacagtcctccaagatatttcttttgatctttcccatggtagattaaaaaaaattgtttcctttttcacacatttatccagatgtgtggataaatctttttttttccctcatttgtctctcactcttctgcggttttcctcagaatcataaaagcagattttaactcaccttggagtttagtatatagttgagggaaaatcatccctggcagacgtttttttcttctgaattcctcattatgccttggcttctggtattcacaggactgggattttgcaatgcttccatgaaacactggatggctctgagtttagt

SEQ ID NO: 3370 - DNA, 772 bp, Homo sapiens
cttcaggctacgttcacacgctttgaaccgtggacaactcacagtcaagactttccatctggtaacactgggaccacagtcacgagctaccgcaccctgctctggtaactttagagaccataccactgaactaagtaaaaacttccagaaccctaataaagaactgatgcattcatgaagattgtgaacacaacatcaagcagaacaagaattaattacgtgggacagtatccgataggggactaaaatgatttttatgacttttggttgtttgaaacgtggctgactctttttatattttgtttactagaaacaagaaaactttttcttttgagctatttataactcacagcccttgcgcaaagcatacttgtgtgaccaaaactggaatatttaccttgctctctaccctgcgttcttcaaaacgtggtacactattggtgactatctgttattttatcgcaataccgtttttctcttaatctctagaagactatgtatgctattgtaactggacgccgctaaggacatatgtacattaaaccaacggcctccaccgctctgctacactctaaaacccaccaatactgctaagccgaattgcagctaattttatccgacgacatagaaaataccttggcaaccaagccttctacctcggcacgtcttgcctcgctgacatcgctgcctaactcgggccgacgcaacaaacgcaacccacaccaccattcacccctgtgcttggtttttacgacttaatcaaagaaatatt

SEQ ID NO: 3371 - DNA, 450 bp, Homo sapiens
ttcagatccagtggtgaacaaaagattaatcttcaagcaaagtaccaagaaaaagcataaacataccgattttctacctgttctaatgaattaaacattcctttttggagtagaacaaagccgtcactgcttttgaatggcctggagctaatatagtgatgtacacttgatttttttttgctaagttgatttattacagttcttcatcatgactgagaacccacttcaaattaaattatttcactactgtcaaaactagaatgtaccaaacaatatttaaaatgcaaaaaattttcagatgaatccttaatgagtcattatacttttttttaataaaaactttgtatgctgaagcaaagtactaaggatctccttggagttttgcatgcaattaatcacgcatgtatattctgagaaaataaatctatgcagtttttaaaaaaaaaaaaa

SEQ ID NO: 3372 - DNA, 838 bp, Homo sapiens
  misc_feature (1)...(838): n = A,T,C or G
tttcaggagaaatgcttccaaaatgtaatgcttgatataataaaagaagagcaatgctatccatatgactatgatgtgaacttaatcaagaggataaaagtctccaaattgtaattacagatgaattactccacggcttgcgattttcaagaggaatcttgtttctaaatcttgacacagtgggaccaaagaaacctatctgtttctattactgggaaaaaagtgaatctcaaaatgaaaaacggggtgnggcttcaaagagagagagctgacagcaaaatatttgaattaattagagaaactacaggttggtcattggcgggttctttttgcaggcatattctgaaacatctgtgcttggttccagggagatgtagttggtttattgtgttgctaatataccatatgaagctgaaaatattaaagggggctacctgatggaaaactaatattatgcattttcaggacatttcaggagaagctctaccttctgtccccgcacagataattcaattcttgcggaactttgcaagtaattatcttaatctatttgttgaacagtggcgactggttagcttataccaaggaaattggattcggaagccatggtaggattcgtagtctaagaggtgagagatatgataggtcggctctccatttgtttataaacaggtgtggcttaggtgcgagtctgtcttaggacgtctttgtatgacatggggagtgcatgattgtgggtgagtgttttggtgtatgcgcgctcaatgttgttaaattttattcgtgttgagagagtttagcctgggggggtatattgtattgtgcggcgggggcggtg

SEQ ID NO: 3373 - DNA, 784 bp, Homo sapiens
agaaacaattgatcttgatggaataatcttgtttttatataaaatttcaagctggtgatgacatgtgtaaaaggaaaagtgctgcaagcagtaaatgctgttcagtttgcagtccattacatcaacatatctaaatgatcctctttagcccaaactatcagaatgaattttccacatcagccacaagaatgaccttccggcatacaagacacttcttaccatgtaatgcaagggaaaaaaaagttcaggtacttcaataggatgttggaaaagaagacttgcactctaataggatgaaaaaatgatcatttattgacatgattgtgatttcttttaatagcgggacatggagtgtccggaggatcgaatatgaaactcgatcccctgctggtgataaaactgcgccgcaacaaacacgctgagacaccgacagcgtgcgctcgtctcgcgaggtgtcgccgcgcgcgagatccgatggctcacgcgccccccccgtcttataccccgtgcgccggcgtgcctcccctctcttctgcgcgggcccccccgagcggtcacccatcacgacgcgattcgacgggcacgctttgcgcgagaagcgcgccttacgattgcctgcctctcggttgtccctgacgactcagcggcgcccctccctgcgcccgccgtgtgagccggccaatcgctccgccgggagcgcgcccacctcacatatgtctctccaggccgcgaggcccccgcagatgccccgttgccgtcgccacgtagtcgacctagcgggccg

SEQ ID NO: 3374 - DNA, 902 bp, Homo sapiens
ctcaaaatggcttaattttgtcacattatggcttctgaagagcaagaaagaatggaagggaaaaaggaataactgaaagtggaagaaagaaggcaagcaggacatgggaaaggagggagagtgcgttgtgggtattaaatgtgataatccttgcaaagtactgagtcaatctctggcctatagtaagtgctcaaaaaatatcagtcactatattcattgttacagagagcctataaccgtgtcgtactaacctgcaatgcacacttgccatagagcagggaatgttctaagggcttatcacatattaattcatttaatattcacaatcctatgagatattaggattcccattttacaaatgagaaaacgagggtacaaagagattctgtaaactatcaactacccagtcacacaactaccaagtgagagatctgagattcaagcccaggtagtctgacttcggagctcaccttttcattggattcaactgcggctattaaagtgcagcccctggaacccggaacttctcagatttgcaaattctctggtccaccccagggcctaccaaatcagaaactttgagacaaccgaccatcaactggtcctaaaccccctaaggagattctgacaacaccacaatttgagcccctctgcttaactacatctccgtgcttctcccccgcatgcctaccctacgcgcacacaaaacctcccttcctccccaaatctgggctcacccggaatggagtaaggcaaaaaaactcgatatcacctctttaccgtaaaggcctgccatacaacgtagttagagcaacgcaccaatcaccttcctttctagagacatcacatacgtttctcacatactttcacacacaaaccccgttaaccacctgacgtccact

SEQ ID NO: 3375 - DNA, 300 bp, Homo sapiens
ctggtcataacaccctcatttagtaaagggtcctgctccatacccagaaggaaggaagcctgcactgaagaatctggacagacaggccttttggggcttcctcattcagtctaatagattatgaaaacgtaactcttgtgtccaatcacagttctacatggccatccattctccatcaaaactaagtattaaaatggacgatttctcttgtatctttgggtcttcattctgaacacatcaatgtcatgtaagactatgaccaaataaattgatatgccttgtctgttaaaaaaaaaaaaa

SEQ ID NO: 3376 - DNA, 724 bp, Homo sapiens
gatgacacttaatcaacacagtggcatgagctctacacacaaaactgatcccatgaaatctttgatgtttttgagtctgcatgtcctcagagagttgagttgtcaaaaaaatgcctcttcaacaaattatgagataatccaccaactcatgtcctggactgtgaaacttctggcagaattttcaaatggaaaaatgagagggctcacgcctatcactcaccagccaaaatatgactgtaggaggccagaatatgctaccccaaatatgtctctttagtatatataaataatttggaacaaactattttgagaaacatcagacaagggagaagctttgaaaacagagtagaagttacccttttgtaagagaagtttacatctataaggaaatatccatttgtaagggtgtctccctctctgctccaggaagagaaggatgactacatctctaaaatgtgttatcagtggggaaggcattgattgaagtccacataacagactttgttctttttcactgtacttttcctggctatttcccaataattaccctttcctcatacccttctttctttgtttcagcaagggatggtacttaatcccaaagtcaaagtgacctctttgagatctactctggcaatatagtaatttatctgggtcatctctcttgtatgcatgatatacacattttaataaacttgtttgattttcaaaaaaaaaaaaaaaa

SEQ ID NO: 3377 - DNA, 597 bp, Homo sapiens
ctttcttccttaagaaaatggaaagaatgacaggaaaatttctaccatcaagtctattaaatctcattgaatccatgttctttgtcttcctttccaccacaatgaatacactgtttgctttcttatttaaggcaaaaatatccactggtacgctgtatcccttcccttttccaccatcacttcatgaactgtcctgtcttctcccttcctcccttccatccttcctgacttccttccttcctcccttcctatgaagctggctgggcttctgggacggatggggacttggagaacttttctgtctagctaaaggactgtaaacacaccaatcagcgctctgtgtctagctaaaggtttgtcaatgcaccgatcagcactctgtaaaaacggaccagtcagcattctgtaaaatggaccaatcagcactctgtcaaatggaccaatcagcaggacatgggtggggccaaataagggaataaaagctggccacccgagccagcctcgacaacctgctggggtccccttccatgctgtggaagctttattctttcgctcttcacaataaatcttactgctgctcaaaaaaaaaaaaaaaaa

SEQ ID NO: 3378 - DNA, 248 bp, Homo sapiens
aaggtgaggaaactgagcaacatgagcagtaagcagtttgccgaagatcagacaactcctgcatagtgggtccaaaagataaattctattactctgatccagaatcttgctctgagacattctgttatctatttttttgtgtatacctggtataaactatatatatatatagttgctctttatatgacactcttggtttctttaatataaaatatgaataaaatgaataacaaagaaaaaaaaaaaaa

SEQ ID NO: 3379 - DNA, 526 bp, Homo sapiens
aaaattcgagagctggaaaattcactgcatgaagctaaagaaagtgctatgcataaggaaagcaagattataaagatgcagaaagaacttgaggtgactaatgacacaatagcaaaacttcaagccaaagttcatgaatcaaataaatgccttgaaaaaacaaaagagacaattcaagtacttcaggacaaagttgctttaggagctaagccatataaagaagaaatttaagatctcaaaatgaagcttgtgaaaatagacctagagaaaatgaaaaatgccaaagaatttgaaaaggagtacgtatttgtcttaatttaatgtgattttaatagcttaaattttcttcctaaactacatatacttttcactagttaactttttaaaatataatttatgaaaatattgttacagctctttttttaaaaatgtacacatccatagattttaaatatactggtctcattacatatgcaaagtttttaaaactaaacacaattctgatcaattaaaaaaaaaaaaaaaa

SEQ ID NO: 3380 - DNA, 963 bp, Homo sapiens
cctgatatcctagaaagtgtaatcataccagaatcctagagaagtaaaagcatgaaaggaacctaatgtgtgagggaagtggacctgagtgatacaaggaatgaagcatagcagacaacgctggtgttctgtccagatctcctgggtttccttccattggttcagcatggccattctccagctgctgcaggttctgttgctaacagctcacacctgcaatagtctcaggaggattgcccttggcagatcgaagcaacaccaccaggaggtgtctggaagttatgcactcatctctgtaacagcctgtaaacaatgactgactgatgcttgatatggaggtacaataaaagcctcactcccttgccaccaggtaggaatgatccctcagtatttcggagctcctggacatttcaggctaatgctatagctgaaactatagacttgcttcccttgacctcttctgttttcctcattcccccacagatttctcaggtaatcatgcaatttctctcttaataaaatgcttgattatctctgtcctgcttttgtaaagttcattcggtaatttctccctaatatctaaaattggaatccttagttcataattctgagcctttttgcttatttgagaatatgtaatgatccattttgctcaaagggagactttagcaacattcttcatcattcagttctaagaattaatttccattatgaattttttggcccacaaatacacttaaaaatttctaaacacccatggggggatttctatttgtcgttttgttactgatttttaaacttacttttatggctgtcagataagtatgatactaattaaaaacatttattaagttgtatgcattgccacaaatattttgttttggaaaagaatgtatattctgcagctgttgaatacggttttcattaaacttgttaattgtgttgctcaaaaaaaaaaaaaaa

SEQ ID NO: 3381 - DNA, 447 bp, Homo sapiens
aaatggtgtaaaatattttaaaagttcaatttttaactttcagggtttttttttaggttcagggtttttttttttagattcagggggtacatgtgcaagtttgttacataggtctattgcatgatgctgaggtttgggcttctaatgattctgtcgcccaaacagtgaacacagtacctgacaggcagtttttcaactctcgcccctctccctcaacttttaagtaggataccaaattgcatttagcctaatctcaattttataaaaaaccatattaaattagtacagtattgtatgcacacaaaaaaaagactagaaggaaaaacaccaaaaatcttaataatggttttcttggtattgggttttaattttcttgtttatatgtttatacatttctgattttctacaattacttgttgaagtggaaaaagtcaaaaaaaaaaaaaa

SEQ ID NO: 3382 - DNA, 749 bp, Homo sapiens
attccccccgtccaccccgaggaaaaaaaagaccttcagcagtcccttcccagtcttagcagcaatcagccatcaaaatacagaatcctgaggtttggaagacaaggttcttattgcccaccccggctcccggaagtcatcccagggaatagaggcccaccattttttcagatgtcatgctgtgggaatggaaagtaggaattttaggcactacctacaaaaccaaaaaatggagttctctcctgaatgttgaccatgttaacttagaccccaattccacaataatgactgggaacagttcctgacaacgcaatggttgttaagtggaaagatggctttctggcacttcctaatatacccccacctatgacatcactccatttcttttcattgccaaagcatattcccttgtgtgcttacatcatattcccttgtgtgcttacatcatattcccttgtgtgcttacgtcgtattcccatgtgtgcttatatcgtattcccttgtgtgcttacatcatattttgtttatttgttcatctggtgatagacttttgggctgtttccaatttgaggctattataaataatgctgctatgaacattcccatatacatttttatgtggacatgttttcatttatcttggatatatacatacgcatggaattgccagatatactgattttttaatgttaaactacacttgcactcctgtaataaactctacttggtcatgaaaaaaaaaaaaaaaa

SEQ ID NO: 3383 - DNA, 328 bp, Homo sapiens
ctgcttaaaagccatgaatttgaaccaagtcatggaatgtgaagtttgacagccacaaaaaactatatcactctgaggggggttggcactcttcgcggacatgggaagaaaccctcttatcacctatactttttataattgggggcgagtgcttgtcattaccaatacctcacttaggttacttttagcttcagaggatctgagaaatgccattttaaaaatacacttgccctgttgtaacagagaatttaaaaggaaaaaggaagaaatgtcataaacaataaaccgttttacagataaaaaaaaaaccaaaaaaaaaaaaaaaaaa

SEQ ID NO: 3384 - DNA, 227 bp, Homo sapiens
agctgagacgtggatcttctctcgcctttgaagtcagacgtggactgtaacttatgccatcagctttcctggttctcaggaatttaggcttggactggaactccaccattggcagtcctgggtctccagcttgctgactgcagtccctgggacttgttagcttccataaccacatgagccaattccttataataaacctatatatattcatgcaaaaaaaaaaaaaa

SEQ ID NO: 3385 - DNA, 748 bp, Homo sapiens
aattcaagagaagtttaattttacattggataacgtattgttaagattatccttggtcctttacaaggcaaggtagataggggcctctttatactttgataactcacaaaaagagcgagtataaaatatttttgtaatcgattcaattcattacagattaagggataaagaaaatgtggtgtattccgcaaaagattactattctgcctttaaaaaaaaaaagaaattctgccttttgttaaaaacatgagtgaacctggtacttcatcccaagcgagataatatagacaaatgctacataattccacttttataagaaatctaaaatagtcatattcccagaagcagagaataaaatggtggttgccagaggcttgggggaggaggaaacaaggatgtattagacaaagtgtacaaagcttcagtcatgcaagatgattaagtcctagagatctactatagagcataatgtgtatattcaataattctgcatcacacacctgaaaacttcctgaagggcagatcttatgttgtgttcttatcaccaaataacaataagtgaagaagataggtagaaaattttggaggtgatgaatatgtttatggcatagactgtggtgaccatttgttttatgaatgtacacttatctccaaactcatcaagttgcatacattagatatgtacagcattttgtatgtcaatcttgcctcaataaagtgctttaaaacaataaaaaaaaaaaaaaaa

SEQ ID NO: 3386 - DNA, 431 bp, Homo sapiens
gtaaggggaaagatgggttcctggcacttcctaatataccaccacctatgacatcactccatttcttttcattgccaaagcatattcccttgggggcttacatcatattcccttgggggcttacatcatattcccttgtgtgcttacgtcgtattcccatgtgtgcttatatcgtattcccttgtgtgcttacatcatattttgtttatttgttcatctggtgatagacttttgggctgtttccaatttgaggctattataaataatgatgctacgaacattcccatatacatttttatgtggacatgttttcatttatcttggatatatacatacgcatggaattgccagatatactgattttttaatgttaaactacacttgcactcctgtaataaactctacttggtcatgataaaaaaaaaaaaaaa

SEQ ID NO: 3387 - DNA, 703 bp, Homo sapiens
  misc_feature (1)...(703): n = A,T,C or G
ttgtagagataaggagaatgatattttaaaaggtcaaataatttgcccatggtcatgtagctaatacatttcataactgagatataaactccatacaaagcattttctcattcagtgtgccaggtactgtgctacatgttggaggcacctacaggccccaatctcacagagcttacaatataccaggaaatataccagaaaagaaagggacatgttatgatagaagaaatacatggtgctgtatttctaggagccaagcaaagctctttaaaatagtaacctggagccaaaatctaaatgaagagtgggatttatacagatgaagggatggggttagaatactcaaggaccaagggagagctataaaggngggccccagaagttgcgaaacaaatatgacttggtttaaggagttgatatcaattcagtttgcntttancaaagactgcaaanggaangngtngaacncggaaccntttnttgnacacagaaatnttaaagaggttttngaaatttttttnaggnatttgggccttatttttaaacacaggaaaaaaaanattttnttttttaacggtttttnaggttggaaatttnttttaaaaaaanttttttaatttaggaggnaaaaaaatnttcggggaaattaaatccggggaccttttaagntgttgtgcttccaaaaaaaaccagtttttncttt

SEQ ID NO: 3388 - DNA, 863 bp, Homo sapiens
tttctgttgtgtttcttggaggatgacggagattcagggactcaccaagttgatgcgagcagagtttgatggtgcagcacactgggatgctccttcctggacccatccacgggggtggggggggctaaaccaaatatatcatctacatataatagggccggggccacagctacagccagcaactcctgccatccaagtgagagagctaccttgatgttccagcctccatagatctaagagcttccatacatttaccaccccaaccacaccggggggggcaatgtcccacaggaggctggaagaaaaaaaaaggctattcttctctaaaaaaaaaataaaaaattggctcctttacgcttcacgggggagctttggaaccatttacctttaggtggggttattgatgattcttcctcaactactcgattcactataggcattccgttctgagaacggtatctactctatcaaggcctggatcttgtttgctaaagtcggggaggaccggcagagaactgtgtacatatggcgcctaaagcgtttatccgttataggcccagtgtattcctttttattaaataaccccctgaatagcctgagagaaatctatttaggtataggtggttaactgcggggcattattgaccgccttcagactgagactcgtatggtgtacgcggggcgccctggaataacgagacagaggaccgtgtattgagaacagggactttctatatattccacttatgatataaaacgctcagagagatgagaataggtaagataaatccgtgaggatgtgacgaagcatacgtcagagcgttaatcgccgtatagaccggttagtcagagaagggaaaaag

SEQ ID NO: 3389 - DNA, 189 bp, Homo sapiens
cctaggcacacaccagggactaaagaaagatgatggtaacaaactggaagaaggtggtggctatctgcaagccaggaagagaagccgtaccagaaaccaattctgaattggctggcatcctgacatcagatttacagcctccagaatgttaaaaataaatttctgttgcttaaactaaaaaaaaaaaaa

SEQ ID NO: 3390 - DNA, 556 bp, Homo sapiens
tttttttttttttttttatttttttataaatttgatttttattgttatcctcatcactaatacatttacaaatcacattttaggtatttctgaaaagatttcaacaagtatcttctctcatcatttattcattcgaaggtattcattacatagatgactgcattaagttctgagggtacaatggagaaccaaacaggaatggtcccaaacagaatgcataaaatcacagaggttgcattttactgtgggaggaagatttgaataaaataatcacacagatattgttataaactgtgataagttctacaagagaacagtatggggtgttgtgaatgcgtaatcagaagaatgccgtctaattgggggaattcctgagtaagtgaaatcagatggctgatgaggtggcaccaggcccaggagggactctccattcaagaatagtgttccagccaaagggagcagcatgtaagggggcgagggcagcactgataagtaggattagcaggtagtcagggaagagcagcagagggaaccacaagtccacggggcaaaccag

SEQ ID NO: 3391 - DNA, 1068 bp, Homo sapiens
tttttttttttttttttggaacaatggatatattattttagtaatatattttagttcaaagacctttctttgtaaagtataaaatcacaccaaaattaaagtggcttaagttatcaagaaagtctattcttaaattagcataaatcaataaggaggtcaaagcacttttctttgaaatagtgaatctttaaacactgttacttccccaaggtaactggagtctagcagccaccttgcctctcatcagaaccaccatatttaaccttacttatctttaacaaaaattattactgaaaaatttaaaaatcagatattaaactttatggtttatagtttaactttgtaggttatctgcacaaactacacatagcaaacctcaaatttgaacaggaaataaaatatttttcaatgtttgagctctctacaccttttttcctttagttgattttacaaatgtcttcttgaagtcactcttccatctcttcagagtggattattacaagaaattcagtaccaattcagctaaatatgtaggccttgatttatgcgtacaaagtaaaaacattatctgaaatctaaattaacggacagatatctccattataaaattcaaccgatttaaaaagtattaacaaacacatccgatagttacattctgtgatttaaaaaatgtaaatagcatctggctgtactagttttccttgagaaactcattagtaaccaaaatgggacagtgttcaaagagcaattgcctgggtaggaactaatacacacggtattcatgaaacgacattggccaaaatatgctgggagaaacatgttgctttgtaaaactcatttcaaggacaaacttacagcctcttcatcacggtctaatttccccacctcaagcttctatcacaaggaatgtccttctgaaagcaagatctgtagcagcacctatgtatttgtgatgtggatgaggacgcatgctctgccacagtaggcgacaacatcctgagccagtcctggtgaagcgaccgtcatcagcaacagcatgcaatcatgtctctcttcatttctgatggg

SEQ ID NO: 3392 - DNA, 501 bp, Homo sapiens
cctggaaagcaccaacctccatgttcttattcaaaccagaagccaaggataatcctttagcagtattgatcataatcctgaaaatggggagaagtaaaagacgtagagctcatttggggaacatttcaagtcaagtgagagagaattatgaccaagggacagttgaaatgaaggttgagaagaaaaacctggcccttgttcttagccactttaatgaagcatcacttgccacagagaggggaaaatagcaatttgcattctgagataatttaagactaacctttaactatatgtgcattaatgtacggctaaaaatatgtatcaagattttaaaattattaaaggaagcttacagatgataaagaagataaatatttgaaagaaaaattaatctttgaatatatagtctgctcttaacaagaagcactatgtgattttattctttgatagcaaagattgttataattattaaaacactctcactcaaaaaaaaaaaaaaaa

SEQ ID NO: 3393 - DNA, 736 bp, Homo sapiens
aacactctcccaaattattactaaaagagaaagcatcttcgagatcaccgagcatctcgtctcacaactacatgaaaaggaattcaggaggaaacgaggagatgatgaagaggctggagttctgtgcctgcctccacttctgtcaatagtttggatcagatttgttttaccattcattcattgaatttgcatgaaatttcattaaaaaaattcccatttccagaagaaagggagggagagaggaaagcgggtaaaaaggaagaaggaaaaatacacaagccactcttttagagctttccagaatcctcattctcaatggatccatcattgcactcaaaaactgtgcaatcgaaataatatatgtacacataattaatgttgacaaagagcttaatattatcatggcatttagaaaagtctgttgaaaaacttaagacatgcattaaataaaattaaaagcataagatagagaacggcaataaattatgcaatcactcaggattatatattttcctttaaaacttgtttgtatggttttccaaaaaccaacccgggattttttgggaaaaagctttttaaaggaaaaaatgagaacagatgtcatgttgaaataattatggataaatccatttaatctttggaataaaaatggaaaatggaaaaaaaaaaaaaaaaaaaaaaaaaaaaaaaaaaaaaaaaaaaaaaaaaaaaaaaaaaagaaaaaaaaaaaaaaaaa

SEQ ID NO: 3394 - DNA, 258 bp, Homo sapiens
tgagaaacttggatgaaagtcactgcaaatacttcaggaactcaaaacaccaacagaatgaattagaagccttcttttctgctgtgggacccagagtcaaaaatactggtcaattttctaagatgggaaaagtaaaactgagagcaaaactctattacagaaaggaacttggaaatttggcaaatatttgtataatttctacccccaatgagatctggttatggattttatattattaaaccaatggaaacattaaaa

SEQ ID NO: 3395 - DNA, 181 bp, Homo sapiens
ccttcaggagaaagatggcttgtctatgacatttcaactacccagtgttcttgaagacagtaagaagaaacatgttttggtagtagattccacattatttttcttttcgtttgtgataataagacttgttttccatgaatttttggagaaaataaatgtcaaaggcttaaaaaaaaaaaaa

SEQ ID NO: 3396 - DNA, 235 bp, Homo sapiens
ctattaagaccttcatgagagaaatgtcctcgctattcctggaggaaaggaacaagaatgttcatatccctgaagacacagaaacataaagaaaaatctgaacaaacaggccttgctaaattccccccagtttattgccatgagattgtacacttgtgttttccaatcatatttctccatgactgttcactcttcatcaaactaagtataaaaatatacatttacctgttaaaaa

SEQ ID NO: 3397 - DNA, 760 bp, Homo sapiens
ctagccgtactctggacccacattggatctctaacggccgaccgaaacctggtgaagccctttgggcgattggtgatcacctctagatccgtgaaagctggctgcccccccatccgggcaagcagggccaaggtggcatcttcacattcctggaacccacccagtaacagcagcaggtatttcttctgaggcaatgatggcttcaatgttggcaccaccattcaattttttcctggaagactgcaaagaccacagcctacttacacaagtctctgaagaaaagtctgagctaaacgtattaaaaagatatctgcatgatgatgcagtctcaactttctaaccccacccagacaaagttcaaagccaatctcaattgacattacgtatatacactaactcttaagtacatggtcctttgctaagtacattagttttacaactaaaagtccttgagaaagcctggccacagggaaggtttagcagattagcagagctttgaactgaaaaagtcaagagacctaacagaccatttgggttcaaattttgagcctgagcctgaattggtgtcctggagaagtgggaaaaaacaggccagtattgcacatatttagtggattgctataaaaggcacctgaatgtcgtatgactgatttaaccccacagcgggattaccgagcctatcctccttttttctgcgtgataatgggaacgagcgctacaggacacgcctgtgcgtgacggtatgattcgtaatgataat

SEQ ID NO: 3398 - DNA, 389 bp, Homo sapiens
agctggtttcaacctatgaagaaaggacacttcaaacgacgggtgaaacaacaccacagaagattccctgaagtttttatgactgagatgcagcgtcatcagatatcacgaacaaccaagcaactgcagcatctctgacatcgcctactttgacagtttctggatttagaatacattttatcaattattcaggttcctttgttctcccgtcaatggccaattgccttttagcttttagcattgtcattagaaaataaaaaaggacgcaaatttgctccactttcttatatttaataaaaatggctttattgtgtgtgtgtctaaagccatgaactgtctgtaaatacattaaaaaaaaaagactttcccattttataaaaaaaaaaaaa

SEQ ID NO: 3399 - DNA, 588 bp, Homo sapiens
atggagtctcactctgtcgccaggctggagtggagtgcagtggcgcgatctcggctcaatgcaacctccgcctcccgggttcaagtgattctctgcctcagcctcccgggtagctgggactacagtcgagcaccaccatgcctggctaatttttgtatttttagcagagacggggtttcatcaaattggtcaggctggtctcaaactcctgacctcgtgatcctcccacctcggcctcccagagtgctgggattacaggcttgagtcactgcgcccggtgctatgatcattattgtacgacatgtaccactgggttcaagccctcttctttccccatgttcttcactgtgctctaatgtctgatgggtcactgacatctcactcagatgccaggtcctccatgccgcattcgggactcttactcaacattacctcagcttttatgactgttattttctttgtgtaaatataattaccataagatataaacaactagaacatatctttattttagaattccctatatgtattttgtgttttgatgctcacaaaacagtcgaataaatcccgatgcgccgccaccgcggg

SEQ ID NO: 3400 - DNA, 563 bp, Homo sapiens
ctggctgttgtcactcactcctggacgtacgccaagctaactttggggaaaatttagtttatagtttaaatgataataggccttcccaaaaactaaactacccttgtaaaactaaagaaaggccacaaagttacaaggatgagagggtcctgaactctactacaatgtaggcacagttaaataattaccaatcattactgtggagctcccaagacttgtgtcttccccaattacttctgcagacagcatcactactgtagaacctaagactggctttttgagatgtcttttcaggcttctgcatttctgacaaccaaatggccccactgggactcaccagtagtcctgtggccccacccaggaaccaaatcagcacaattgaacagcctcaactccgtatgatttcatctcctacccaacgaattcctggctccctacccaccaagctatctttgaaaaacccctaacctctgagcctttggtgagattgatttgagtaataattccatctcccacaaggcatggccggcctcccgtcaattaaactccttctttactgccaa

SEQ ID NO: 3401 - DNA, 527 bp, Homo sapiens
tggcttccagagtttcaacataatatgagctgttggttttcaaggttacgatggagctagacagctgggaatgggactaagaacaagagccctatgtatgaacaaaagaagatcgacctccaagtaatatgtgctacaaatactaccttcgccttatttgtggatgaagactgcaataggttcttaataaatgcttgctacgtgactagtgctcagtaaattgctgtccttaaataatttttctgaggcatgaatttattgcacaatcataagatttattacattcatgtgtctaccacatgttcactggtagatagatgaatctccataacccccattctactgcttttcggattaacacatctgggattatgttcctaagtacaaagagatgcctattaaaccagatctgactttgcgctaaattccccaaatgtgctgacttcatttgacactactgtcttttgacaggagagtcgcagctttctgaataatgttaagcagggaattacaataatgtggatgcg

SEQ ID NO: 3402 - DNA, 437 bp, Homo sapiens
attaatatagtcatgaatcataagaatagcttctgcttagtccgacaatataagaatcaggcggtgagcttgcttgcctaactgcagggtggaacaaacaaccacaggaagtgtgcggagcctctaagcaagaaagcttgcttattgctcaacctcccacttgagtccctgaacaaaggtcttgtgggaagggaagcgacccctgctccattccccagaagggaacagcaggaggttgcttgtaaaagaggagaagtcctctgaggataaggggaaagtcttctatctctcgctcgttcccagaggcagagagctctgctgccctgctgatggtgcttggagtggaccgctcctttgatgcacaggcctgtggtctgacgggctgtctgctttcacgtcctgttctgttaaccaattagttggactttaaggattat

SEQ ID NO: 3403 - DNA, 154 bp, Homo sapiens
tgaagagccaagacagcagattttcttctgccttctgcccaatccctgagcccagcaaggacccaactctttcttgcctcctcaaaccctgctcaatgtgaagatgataagggatgaagaccctttatgacgatcccactttcacttaataaat

SEQ ID NO: 3404 - DNA, 739 bp, Homo sapiens
tatgctacccagctgccagagcggctcaaatataagcaggcagaaacatatgaaaagagagactggcctagcctcccagcctacgtctttctcccatgctcaatgcttcctgccctcgaacatcggactccaagttcttcagttttggaactcggactggctctccttgctcctcagcctgtagatggcctattgtgggactttgtgatcatatttttcacatgctatccacagcgcctagagatccaagcttttgtgaacaggggctgacttgtgaatgtgaacaagcacaacggaaagctagggatcaagggtggggcgcctctgaattctgcactagaatatgcccaatcaaaagcatagctgcagagtgcaaaattgtctgtctcactatggaagactgcttgtcaatagcaaatggaggggcagaatagagcaaaggcagccctcagctgatcaaacttttaacttttctctaaaaacatcctttggaaataggtctatttcccctttaacagaataaactgcaggaattgttggacaatgggtgcatttggaagagccacgcgggggcactgagaagtgaaatgatccagctccaaaaataaaggtgatacacgttaaagtaataaattggaaaaaataaaatagatgcaactcttagttcgcatatctggaaaagctggttatattgcaaagaccttattgagaatatttatgtatatgtgctacgcataat

SEQ ID NO: 3405 - DNA, 273 bp, Homo sapiens
aaaccaaccatggggccttccagagagtatcaaggaactgaaactcattagatcattgcatctggacaatgagatagcagacctctcacctgccacgattgcctaactgaccacctgcttcctgttggccaactcaacttccttacccctctctacttcctgtttttccatacttagttacattccttaccctctatgtaaccccacaactgtagttgatcagggaggtagctgtgagactgatctcctgttctcctcagctgcagcacccaa

SEQ ID NO: 3406 - DNA, 297 bp, Homo sapiens
acccctgctgagtggagaaagattatattgctgccctgcaggagaggagcagccgtattctccttccttgaaatgctagagaagaaaagctcatctagtccaacaccatcattttactgaggaagaacatggaaatctgagaggcaaagtgtctaatccgagatttgacagaaagtattgtgggacagagatgacaccggtgcctcatcgggaaattgtaaggccctctaagacaaaggctatgatttgtacgtctttgaagcaccaccatgcctagaatcctatattgcttataat

SEQ ID NO: 3407 - DNA, 486 bp, Homo sapiens
tacaggcaggatgccttctctaggaaaagtattgttctatgaagaaataattcatgcaaagcatttttcacaacagccaagatatggaatcaaactaagtgtccatcaaaggatgaatggataaagagaatgtgctatatatacacaatggaataccactcagccataacaaaaagatatcgtttgtgacaacatagataaacctgaagaacactacactaagtgaaataagccacgcacagaaagacaaatgttgcatgatctcactcatatgtggaatctgctaccataaagagatacaatcctcttgtagaagtacagattaggatgatccttaccaggggctgaggaggttgaagggaggccaggatttggggacatattggtcaaagggagatgccttttcaataagagttgattcttgatttctttttttatacatgaacacatgatgtcagaatttccttctaaaacaaataaataaat

SEQ ID NO: 3408 - DNA, 228 bp, Homo sapiens
agttaaaaagagaattcatcaatttgacatggggcatgagttgaaagaatggggcagaaatctctttgaagggcctcctctcactctcacccagtcctgattgacaccgaggatgaaggtgcatctcacttcgtctttcccttagcggtccgcacccaagtctcttcattacatcttcaattatcccagttgtttgagccatcttttattgaaggagatgatattaat

SEQ ID NO: 3409 - DNA, 534 bp, Homo sapiens
gttgtgtagtcactagatcagccatctaagctccaaaatcctttcaacaatgacaacatgctactgggaaaaaatgggaaactccaatcttatttcataccaacttactctgacttttggcaacactctccgaagcgtctcagtgggattctgtcgcatcaaaaatgggagatttgcaatcacacttgttccttggacatcttgaccagcacttacaaagaaaacacaaatttaaaatttataattataagctgaattcctctgcacagttataaaaagtatggactaattggaaaaatgactgctttgaatgttaagcactcagacttctaagttttaagccagaaatacatcatttagatataaaattaaaaccaaaactgaaattttattaagcaaatcttataacaaatacatgaagatattaattatgcttgtgctgaaacaagattgtctattgttttatatgtcttaagtctaaaagtttcgagactattattaaatacatattttttaattctaaaaaaaaaaaaa

SEQ ID NO: 3410 - DNA, 485 bp, Homo sapiens
cctaggaccctctctgcagtgcctgtcatacagcagaaactcgctaaatgaagtctgcgtgtttcatatacgaataactgattgtcatgaccggaggtaaactgaacatctgaaaaggacctaattaacattgtgcacaagtgaaagaataaatgaataaatgaataaaagaatgaatgagtacggatgctgagaactgagatgtggcatttccatactggcagaagctccgaaagaaacagtcatcacttcctgtcctactgcacgcaatgtgttaggcagtgctttgctgaaatccagaatataaagttaaactttatgagttaaaagtttgaacttttgagcgagatgtaattaagcacaaattagtttgtagaatcctaaatgtcagtgcatctaaacaaagtacatctatgtttatttgaaagcaaaaaacgatgacacatttttagagaattaaaataaactgatcattgaaattgaaa

SEQ ID NO: 3411 - DNA, 247 bp, Homo sapiens
tatgaatttaagaaagtgatacattccctcaagagggtttagcccaagttcatctctcttggaccatggaatacctcaccagtcactgaaagcctcatgtcttttgactgtcggagattctacatgaataatccttggacatgaagctatgtgtatcaaatctatgcttctcttctggggcattagggagtggcgagttatgtaattctaatgttaaatattcaagacatacactaataaaacagga

SEQ ID NO: 3412 - DNA, 358 bp, Homo sapiens
aattaaatcaccagaacctggataagttcaaagttccttcatcttcttcatattaataaaggccacaccatccatccagtagctgaagacaaggaatcattctaacgtctcactccatcccgccaatcgaatccactgcaatgtgtggtctgctttacctctgaaatatatcccgaaatcatacacttctcttcagatccacagttcaagctactatcatcttcaccgggctactgcattagagcctaattgggctcaaatgttctattcatgtccctcctccatcctcatacccctccattctctgtataagaactgaattctcttattaaaatgtaaataaacaatgatcggccag

SEQ ID NO: 3413 - DNA, 497 bp, Homo sapiens
cgtccatgtctgtctgcacctggatggcatcgcctctccatctcgaggacgccatctggaggggacagggcagggtggctgatcccctgcaggccccagccctgtgactcagccaccaaagcccaatctccagcccaagggaaccaagggtatcttcttcatcatccttccagtcctcttccccttcgccgggctccagcctcagcttggccctcacctccactcctctcccctctcacccctgcccccattccacttcatctccctccctcaccttagggcacctctgcctgctccttatgctggagttgattttctacaatctcaactcagccaagagatctcatcacctaaaaaagtgatgtgaaccttaagatcacatatgtcatatgggggtgaaggtgggggtgggaggcactaagggcagggcagcaggtgggtcagccccaggtgctggcaatagatgggggtccaggtcagcagagaacctaaaaaca

SEQ ID NO: 3414 - DNA, 192 bp, Homo sapiens
aaaacgtcctaataagaagataaggtgaccgaataaggggattacttggcagagatatgagagaactgggttcttgaccccactttgccatgaacttggaatattgtctgtaggagagtgatgtcagcaagacggtgaactaggaggcccaacactcatctcctccacaacaaaaaaaagaataaaacctga

SEQ ID NO: 3415 - DNA, 596 bp, Homo sapiens
gcatctgtgctgtgcctgtcattcattgagaacagtttgttttctgcttatggaatcacaaaaatatttaatctgaagcttcagtggtgcagccgtccttgaggctgcagaccataggatccttccttctctgtctggatgcactggagggccagcattctcggaggtggccagggtcctctgagaagccagcgcccaagtggtacctgagtccagtgaacggcaagtttcttttctgggagctgctatcactgaatacataaagaaattgagcctatatgatttcaatcttcaccttctgatgctggtgaaacaggattctatgcagatggagcctcactctgtcactcaggctggagtgcagtggtgcgatctcagcttactgcaacctccgcctcccgggttcaagtgattctcctgcctcagcttccccagtagcagggactacaggaccacagactcctttggcatctggtgaggcctgtggattcattctcagaatcacatttttaaatgcacataataaaatacatagaattgcaaaggaagttaattatatttgaaatacagttatcaaaaatataaataaatacccg

SEQ ID NO: 3416 - DNA, 557 bp, Homo sapiens
ttcttttctgggagctgctatcactgaatacataaagaaattgagcctatatgatttcaatcttcaccttctgatgctgatgaaacaggattctatgcagggttgctgaatggagctgagcacagagatggctggaaagtctttcaggtctagagccttctgtggagaatgtgcacgcatgttcctaaggtgttagcaacacctggtatttctgtactggctgagccaatgggaagagccagctgttcttcagaagaccaaggatcaagtcttgcagcttctttcttgaacatacttttaaatatactgttttggttgttgtttgtttttgtttctgtttttgttttaaggacttaatctatggagctccatcatgcaaccaaagcaatccaagtttaatctctgagcattcatctctcaagttcagatttttcttcccgcttctcagctggagcattccctaacttctgaatgtctaaaaatacccagcgtggttccctctacaaaacaccagcaccctgccagctgttaaataaataaagctcgatgctggccag

SEQ ID NO: 3417 - DNA, 234 bp, Homo sapiens
atgtgtcagcagtacctgtgaaacctgctgtgagtagacagtaccgcttgtagaaggcacgcacagatgtcggcttgtggatggacatcatgttagtgaatggacattgtttgaaaaggttggaatccatatgcataattcagggaatgttttagacaaagttggttgtgcctcgggcgtacttctgcctgaattatggtaacaataaaattaaatttattaaaaaaaaaaaaa

SEQ ID NO: 3418 - DNA, 481 bp, Homo sapiens
aaagcaccctttgaaatgagtttaacacaccagagagcacttctaacaactcccagaagaaattcaacatcttcttcaagactttatgatcttcatattatttgctattgagcagacaataacaagaagctattctgaaatctaatgtgtgctttaagttttgtttgtttgtttgtttttcctcactaggctgaagtgacactgaaagctaagaattggacacgaggagtcacaggcaacggtcttccttaacttatgaagaaaagaggtttatatggcttattgttctgcaggctgtataaaaagcatggcaccagcatccaattcttgagggtttcaggttacttccactcccggtggagggtgaaggggtgccagtacatacagagattacatggtgaaagagagctgcctgatccttgagtgaaaatatatggagaataacaatagacatgtaatatgagtaagaaataaaccttga

SEQ ID NO: 3419 - DNA, 973 bp, Homo sapiens
  misc_feature (1)...(973): n = A,T,C or G
ccatccctgctgaaccacttcttcaagtataagatatatactcacttgtccagggacatcccaaggaaggtgaacttgcccaggcatatgcgatacacagcgctcagaggaatgccgtgcagcttgcacacaactcagcgtgaaagaagtcgggttgcagattaagagagtctgtggctgggaccagtaaaattctctccttcgtcattgctccatggggctatgcctataggaatcatcctagcaaataaaattgatgacccagcctaagttaaaagcaatgaccttcacatctctcntagcacagaaaacaggtgaggtttgatcaactcagaagagagaggggctgagaaatacctaataccacaccactaccccactcagtctggtcccatgactaaagaagaaggaaaggtggaagatgatggagaaatattttatcatcccagaactcaaagatagttgattacccacgatggaatccattaggggaatacccagtgtgtgttgtgttagcagtcaactgactcatacttcccaacattttcccagttctctagaaaacttcatagaggacatcttccttcatggacaccaaaaatatctctttgttctagctgaatccgtaccacaaatttactcactacgaactagcctacactaatttccgaaggttgcactgctgactggaagtaagtcggagactggaacacaggtccgctgtcttccaagttatctcattcctatttgcagctcatcctaccatatccttgtggtagaaatgtagtgaaacaagtgaagtgagatttttatgaaccagagtaaagtagataagtagataaactagataagtgtttactgaattaattggcctcagatgtgagagccttccaggacacacatgtaacattctgactgagaattcagaatttctccaacagagagaacagaaataaaaatagatcggccggat

SEQ ID NO: 3420 - DNA, 409 bp, Homo sapiens
agaaattctttgatgtttagacactcaaagttaagaaaacatgagagagatgaaagttatctgagaaaataacaggagaaaaaagaaatacagtctcttggaactaaaagtatataaggaacacttcctctgggatgagagaagtgctttgcctgagtcagccatggttcaccatgaaaacacgatgagtcacacctgcatcacagttgatcatgatctctagcgactgatgatattaaagcaaagactgggtcctttgctgattatgttttcttcctggcagttccagtgtcttctgcagtgtcattgagccctccaccatcccatcacctttgtttctttgttaatcgtatctgccaacacctgttttatttagaaaacacaaataaataaacatagatgcggccgg

SEQ ID NO: 3421 - DNA, 399 bp, Homo sapiens
tgtcacttgctcctatttgccttctgccatgactgtgagacctccccagccatgtggaactatgagaaaattgaagctccaaattagtttgtgcaagatcacaaactattaagaggcagaacccatttgcagactgcgtcttgagatcccacgcagaacctcgcagctgagtgtccactgtggataagatcacctagaagcaaactagcactcagctgagcccatccagggccacctactgaccctcccctaccagtcctgcctctcacccccctactctctcccccagcggaacaagtctgtcttttgttccaggggcatgtttctgccctccatacacttgtggcttagtcaataaagacaagatagctctgtccacccaagtgaaaaaaaaaaaaa

SEQ ID NO: 3422 - DNA, 401 bp, Homo sapiens
cctaggagacccagttgccatgttgtgagggtgctcaaggaaccctatggagaggtcacatgacaaggaaccaaagtctcctgccaacatgtgagtgaatgagccacttggaagcagatcctccaggctgaatcaagccttcagacaactgtaaccccagctgacctcttgactacagtctcagggaggaccctgagctgggaccacccagctaagctgctcttgaattcctgagctgtagaaattataaaagataatacaagtttatcgttgttgctaaattttgggggtaatctatcgcacagtaacagctgatacattctccacaaattcttggtgaatgaatgaatgaataaaaaatgaatgaataaatatgacaaggtcttacaaaaaaaaaaaaa

SEQ ID NO: 3423 - DNA, 885 bp, Homo sapiens
cttcagtttctcctgagacgtattttttaaattcaagaagacagaagttcacagcttctatgaatgtggaagtgggtcctcaccagacactgtatctgctggcatcttgatcttggacctcccagcctgcagaatgacttgttcagtctgttaggaatcgactatatgtaatatgtgagaaacagcttgcagaaacactagattcacagatggaggagaaatgccaactcactaacaagtttagtgctgccaaaaaggagttagatgcttacaaaaaggtgaagatagagcccaacgcaaagctgatggaggcgttccctgccctggttcaagaattgaaagaagagaggttcaaactgtcccaacaacaagggaggctggcagagatgctaacaatgctgtagtccttagaagaggccatgagagtcacacctgcacaaagagctctgccaaacctgccaggaagacaagatccaagccctctgctcacttccccaggagtgggcctgggtcttaaagcagcactgttccctcccctccattcaagcctcccaagctgcccagctgcattctcccacctggactccatcagagggtcgctgaggcaagtggatccagggaagcctctctctgagctggagtttctctgccctcacatgctgacaccgtggccaactccttcatggttgattcctcaaatgtaaagatacaggagatcctggacacactaggaatgtgagactttctctctcttatagaaagattagattctctctcattagcagtgaaagaatgctgtattgagagcctattttttactcaattggatatcatcacactgattcttagacatggctataatgttttatttatataagggacagt

SEQ ID NO: 3424 - DNA, 929 bp, Homo sapiens
cttagtgcactagtatgatcatatctcactgcagcctcaaacaccctgtctcaagtgatcgtcccactcctcccacctcggcctcctcagcagctgggactacagtgatgacatcttttggggaagccatgtttttggcagttactgtgacaaaaagcaagtgccacaaggaaatcagtgtggaacaggaaatgaaggtggcagtgtccactctgattccgaagtttaaggagttgcacagtgcccagcaggccacacatcccatgaatgccatgaaaaaattactgaagcactaagcgttctgcgaccaaggaagatttggaaacttctggtctggtcaagtcagccatgtttcacagctcccaagaacttcattggtacctgatcctatgacaaagcatacctgggtcttggttttggttatcgtggttgtttcatctcagagacttttacatattttcagtgctaaatgtgcctactacatggggcctgtgcagccatgtgcctcggccagcacctgcctcagactccctgggcatctctccctttcctctgcgcttaagtcacaccaacctcctttccgttcctccaacccgccaagccctctcccattgtaggggcttcttactgattctcatcctggttcacctgtaggtcccaacttaaatgccacctcatcagagagccctcccctgtgattctctgtctcaccacccattcatttccttcatagcattttgtcctctgcacatatctatttagctctatgaggacagagtccaggtctgatctgcttactacattcacagaatttagctgggtgcctgatatgtaattgtcactcaataaataacccgcaggttaacaagtgtcagtttaaatcatacacacattttaactggggccctgtgcagcccaaagcatttcag

SEQ ID NO: 3425 - DNA, 1062 bp, Homo sapiens
cctagagatgacgttctcgctatgcttcccagtctggacctcaaactcctagcctcaagtgatccttctcccttggcctcccaaagtgctgggattacaagcatgagccacgatggccggccctgaatttggacttccggccaaaaaactttatggaggcttgtgttgatgtggaggtgcagtgatgtggaagtggcctgagatgctgagctcacaggttaacatcagatttgtcttttgaaagagcatctctcaacctagtgtgtctggaattggtgggttcttggtctcgctgacttcaagaatgaagccgcggactctcgcaattcattcatagctgctacacattcatctctatataaaacctactctcccctctgaaaaagcagcataaccagtcaacgaacaagtatataggattagcacattatgaagaataaagagaagctttcagctctccgtcatggatgatatttatcacattttccacgactggctctaataacagtgcagagataaaataggcttgatgcatctttcctgtacagagaattttacaacagcaactgtaagaaattcaggagatgaaacacttctcccctcttgcagtttttattagtcttaaaaatgggaggtgggtgtgtgggggaaacccccccacaaaatcggtctaagacccaaaggccggcaacccacgacacgacacccgcggcccccgcgcagcctccccccggtggccgggccggcgcaccaggccgcgccccccctcgccccgacccgccggggagatggacgcggcgcccccgcccggccggcgcgccgccgcgcgatggggcgacacgcggctcgcgcgccgcgggagccggcccaggttcccactataacacggcgttgttcgcccggcgagcggtggacgccggcaggacgcacgacgaccgggacgcgcgcggatcatacgcgcacacgcacctacggcaggtgagtcgcgaccccagccccgcccgaccccaacacacggccggagacgcggcgccgcacttgggcaggacccacggcgccggg

SEQ ID NO: 3426 - DNA, 296 bp, Homo sapiens
ctgggcttctctctgtctcccaagtctggagtgcagtggcgtgatctcggctcactgcaacatttgcctcctgggttcaaacaaatcttctaccttagccttccgagtagctgggattacagagacagggtcttgctatgcggcccaggctccaccttgcttcagtaaatgctttgatttagtctgagttggcgtcattactcctaagacatgaagtttttggagtctgaatttgggtgttacctttatatccaggatattcaataaaatttcggtactctggaaaaaaaaaaaaa

SEQ ID NO: 3427 - DNA, 645 bp, Homo sapiens
tagggcttctctctgtctcccagctggagtgcagtggcgtgatctcggctcactgcaacatttgcctcctgggttcaaacaaatcttctaccttagccttccgagtagctgggattacaggtgcacactaccacattcagctaatttttatatttttagtagaaatggggcttcaccatgttggacaggctgatctagaactcctgacctcaggtgatccgcctgccttggcctcccaaaattttatattcttttaaagagtcttaaattctgtttagacagttaaattaccagatcaccttccttccttgcttctccaggctggagtgcagtggcacaatcatagttcactgcaacctcaaactcctggacttaagtgattctcccatctcagactcctgagtagctaggactacaagtgtaagccaacataaaaaataaaataattttttatttttatttttttgtagagacggggtcttgctatgcggcccaggctccaccttgcttcagtaaatgctttgatttagtctgagttggcgtcattactcctaagacatgaagtttttggagtctgaatttgggtgttacctttatatccaggatattcaataaaaatttcggtactctggaaaaaaaaaaaaa

SEQ ID NO: 3428 - DNA, 796 bp, Homo sapiens
tgattgggaaactaaggcccagagcaagaaaaaggaagtggtcaaggtcattcagctaaaggacaagagggacatttgacaatacccagacacatttttgatcatcacaaccagagggacccctggagagaaatggggacaaagggcttcctctggctagaagctagcggccaaggatgccgttaaccagccaagaacagccctgcacaacaaagaatgatctggatcaaaatgtcagcagtgcggagtctgagaaacccagctctggaggatacacatgggttgaaatttctgagttataagtgtgccaacttcaaatttacaagatagtatcacattgcttgccaaaatgtaccaatttctacaccaacaaggagtatgtaaatctcatcgctccatattttatccaacacttggtactgttagcttttaaaaatatatatattggccaatctagttggaataaaatgggtggaatatagtatctactactaatgagatgagcatcttttatatgactgttggctatttatgtttcctcttctgtgatttgcctgttcatgtatttttcccatttctcttttaactatgtttgtttgcattggttgtatagatttctggatttttaagaatatttttgtatattaatcacaatgtattaattatatcacaaaaatcttcctccaattttgaggaatttagaggttcatttttttttaattgtgcccttttgagaacagaaataaattctaattttgatgtggttgactttatctattgtacatcagacttatga

SEQ ID NO: 3429 - DNA, 734 bp, Homo sapiens
gactggaataaatgcagtggtgcgatctcggctcactgcaacctctgcctcccggattcaagtgattctgctgcctcagcctctgaagtagctgggattacaggtgttggtcttctctgcagcatatctccagatcatcgacagcaggactgagttgaacaaattgaggaaaacaacagtattgcttttcagattctgaataatttgcaatattaaatttgtagatcaaatcagcatttaaatatctgtcaaaatgattgctaatacaatttggaattcaggttgaattttgaaattaatgaaactacacaagcttaatgaacattagggattaaaatgcaagaatttctgtactatggaaggacacatgcacaggcctgctttttacaagatcacagggggaaatgaagggaattcttgaaatcaaaaacgctgctaaatacagatgtcaaatcttagtcatcttcttacttgaccaatgagcagcattagacagagttgaatgctgtctactctgtgaaacattttctttacttggtttccaatacacattttctttgatttccctcctccttctctagccattccttcttagcgggctcttcctcttcctctctaactcttaattttagagtgctccagcgctcagcccctggacctcttgcctttctatctatactcagttcctttgtaacttcagatagtcttcttggcttaaataccatccacagact

SEQ ID NO: 3430 - DNA, 470 bp, Homo sapiens
ctcagagacacagtctcatgatgttatccacgctggtctcaaactcctggcctcaagtgatccacccggctcggcctcccacaatgtgctgggattacagatgtgagccaccatgtccagctaggctacatttctgaatagtaatttcttttttaaaaaattatttttttttggagacaagggcttgctctgttgcacagtctagagtgcagtggtgcgatcgtagctcacagtcactttaaatagtgatttcttattagattcagattattttttaaaaagcaaagatgtttaatctcatatataaaatatatttctgtatttcaattacagcttctagtctttttataagtgatgaaaactccatttaaagactgtacaattgcccaaattctaggtttaatatcagttaatgacaatgtaaacatgtattatataaaaaaaatctgttacccataaaaaaaaaaaaa

SEQ ID NO: 3431 - DNA, 791 bp, Homo sapiens
cctagaaacacttttatatttaacagtcaccattccccaatgatgaatgttcaagatgcttccagtgttttagccacttcaaataatactgcaaaaatcaccttcaaagaacactgaaaaaacatttttatacatacatctcttttggattccttttttctaaattgttttgtcatatattttgtccattattttggtttttttcccctccaattattactttgcactaattatttgtataatgaagatatttacaatgtgtctgtcatatacatttcatttttcctcagtatatttattggttagcttttggcattttaaaattacatcttcatccagacaatttttaaaaattgtttacatattcaaatgtatcttctcttttatgctttctgtgtttcttgcttaatataaaaatatagataaatagatggatggatagaggtagatggatgaatacacatttatgctgctgaagcaaaaatatttttggaaggtactatggattgaatgtttgtgtctccttctaattcatgtgttgatcctctcatccccaatataatcatattgggaggtaggaccttttggaaagaattagggttacattacgccaagagggtgaggcccttatgacgggattaatagcacaccaacatggcacaggtatacatattgtaacaaacctggacattgtgcacatgtaccctaaaacttaaagtttaaccattatattaataagggagagaaataaaatttctcttccttgggattaaccaagtaaaagccctccc

SEQ ID NO: 3432 - DNA, 811 bp, Homo sapiens
  misc_feature (1)...(811): n = A,T,C or G
ctcaggtccactttcattagcacctagtatgagaacagatattacagctacgtttattactcaagattgtgcctttcatatgggcgtgggggatggttgttatcgaagactgaatgaaatgcctcatatcaagcacttttcttggtgactggtccattacagtgagaaaataaaagagttttatccgaagaatgcccgtctctttaatgatcaagcccagagagacagtcgaatgagacaggggggattttctacttccccctttgagctatgtattcatctcttaaaattgcttgctattgtcacaagtagttatacattaccctaataatgccacaccagacactataacccacacctatagcttaacaacgtatagccaatcactgatcaatgttatttctgtaaacctgtcggaatttctgatatacaactttgtgtcagcctactccctgtttcccttattttacttttaagaatccatttgtaaactggtgctaatcacagcgtatatgtccgggcaccttatatcttctgtttcacgtttgtagtggtcaaggcttggcacaattaacatttggttagattaaattaggctttagcttcttccctttgaagacacngaaatgatgccaaccaaatgttaaatccctttccttgctgctgccgaagaaggggaattcaaccaagaatctgttcgatctccaaggtatttcgcattctagttggtgttactattgaaattctaacacgatatttattgcctcgctataatgaaaaaaccccattgcaaaactaagcggagacnctg

SEQ ID NO: 3433 - DNA, 793 bp, Homo sapiens
cctagaggatgaaattgagtctctgaaagatttgtgacttgcccaagttttgcagaaccaagaagaagtggattgggcttggatttccatcttaatctaactccagaggacatgcacttaaccagtgatctattccaattgtttccttttgttaacaaatgactgcctttttttttttataagaacatataatgtgagatctatgctcttaacacatttttaaatgtatactagttcccctttatctgctgtcttggttttacagttttagttacctgtgttcagccatggtctgaaaacactaattagaaaattccagaaatgtacaaattagtaagttttaaatggtgcactcctttgagtagtgtgaaaaaaatctcgcaccggaaagtcaatcctctgtttgtccattcccgctgcctagaggtctcctccctacctgggaatttatgcatctctatccattgacatcatgccttttacctgatttgctttgacgaacaaaatgtttgcagaatagactcctggtcctttaaaactagacatttaaggtataggtccccgtcccttcagtctctattttttcactgctaggagactggcaatatcctagagagggccttctccacaaacaggcctcccttgactggaaacatggagccaggccggacaatggatttacagcatattttaagaaaaaacttggcttggatgatcctgactctgaagttggagaattatttttgacccggcaagaactagctttagctcctgaaacaaattttatctgaca

SEQ ID NO: 3434 - DNA, 523 bp, Homo sapiens
cttgggtccagctccataatgtctcattatcagtatttgaatatccccaaatttgaaaaattcaaaatctgaaacagttctgatcccaagcatttcagactcctaagagtttatacgaagtagaaagagaagttggagttaagcagctcgttccagttctgattttgccatttcctgtctgagtgacctgaacatgtttcagtaacaaaaagtgaaggaaatgtggcaaattagagaagagagaagaaataaaaagacagcaagcaaattcacataagcaagtgaattacagtgaagagtctagagaaaggaattacatttatactttacacaggacaaaaacctgggctcagagagatgagagaacttaccaagtgaatgaaacacaggtaagtgttcttttgggcacttgacatccttagttaccctcaatatagcttctaaacaagaatccaaggttccagccatttaaatgtgtacttgggaataaagtttacaaattccaatgaaaaaaaaaaaaaaa

SEQ ID NO: 3435 - DNA, 952 bp, Homo sapiens
  misc_feature (1)...(952): n = A,T,C or G
cggcttatgccaaagatacagaaagcaaggaaaatttcagggtaacggctctaccacctttgatgaagttcaccggcatgatttcagctcactgtaaaactccgccatcagggataagtcatcctcccacttcagtctcctgagtatctgggactacaggcacgtgccaccatacctggcttttttttttttttttttttttttcgggggagacacagtttttccatattgctcaggctggtcttgaactcctgggcacaaggtttttgtcagtcatggcctcctaaagtgctgggattgcagacgtgaacccctgtgcctggctgacttatttttaaataacttctgaaaatgcacaaagcttaattgtgtagattggtttatttctacaaatgtatacactttctgtaactatttccctactcaaactaaaaaaaactaacattttcttcgaaaataagcagggtgtccgactgttgagtttaataatgaatagttatggaaacnctacactctctgggcttttttcgtctttggtgggaatctcggcggccgtatcctttatggggggttaatagaggaccgctctaaaatattttctttgcctgaaatttgcgtttgtgagaaagttctttcctattgatagggggatattcgttttccatatcagcggggatccgctgcaccaacattttgtataaagtcccctagtggctttttttcttaagcgcccggtctttcgcctttttctatggcttcacccgtggagcacttatcataaanaccttcatgcnaggcggcaactcccgcagacttttacatcccgctgcctccagtgatctcttttttctctcttgtncactgctgtcttacgtattccctcctttttctttttcgtgtggccctttttaaccaattgttgttgtnccggggtcagcctctttcttctgcg

SEQ ID NO: 3436 - DNA, 468 bp, Homo sapiens
cctgatcagacttttctgcatctttagttaacggtggcagatggcaacccagctcccagttacatatcttcaattctggggccaactgagctctcaccaaattccagttccaaatccccagggaaaggaatccaactggctcttcggaaaaggccctaagaagccatcaaagatatgtcatggaggaagccatcgaagaggaaagaggaagctttgtaacagtttaccagggaggaataacaagctgccatatgaatactgatgagaaaggaggtgggagagacatttgatcatcaatcaagttatgattatgaacactcagttaagaaagaaatgtgaagtcagtgttcctgaacatgaagaacaagaccaggggttgggttttggagtcacacggactttttttgttccagctcatttgtctttttacccattaataaattaatctaaactctaaaaaaaaaaaaa

SEQ ID NO: 3437 - DNA, 821 bp, Homo sapiens
cagttgggaaatgtgcacattcttgagttctggaacacgagcataaacttttgacaactcaacaatttcatcaccaaagaaaagttccctcaactcccttcccattcattccaaaccctttataatcaactgtcacttttctatcaacattgagtagttctgccattgttcaacttcatataaatggtcaacttcatataaatggaaatatacactaagtactttatcagctaattttcttttgggatcatttgttaaatgtgttgtgaaaaagtttgtttgattgtattattacttcctacttttttttattgtattcaccagtgaatagcttaaaacctttatgccttagcttaaacttttcttatgggaaggtttttgatgctggagtatttgtatttcctatttcttcctgggccaggctcgattaccgtcataactcatggaacctgcccaattcatctattcttctaatacaaagatcacctaactttatatttatcgagaagacatctcccttaccgctccagaaacactctttcttaaattaaatgcatatgatttaatattaactcttataatatacttgcacctctatttcatcttaagagcaagcaaacctagacagcaccattcacatctaatagcgcgatctaatcttagtcaactatacatgctcactctactctcgtaaaaacatctatcatgtcagacagacaaccacccctccgacttaacatctgtgtttctagattgctacaccaacccactatattaatatatctcttatgaaatctgcagaacgcactacttcacacggt

SEQ ID NO: 3438 - DNA, 1332 bp, Homo sapiens
  misc_feature (1)...(1332): n = A,T,C or G
aactaccagactcagaaatggaagagtggggatgcctttggcttccggacgagccaaggatggcagctctgcctggttacaagttccctgtgtgtggacacctggtcgacttttctcactgctgtgtctccatgagcctggttcacacaggtacctgtggcagatgctgctggtgtccggctccccagagcttccagcaacttgtctctttgcctgagggttctctgtgactgctggagcctgccctgcccgtgtggcagcccagaagtgccagggaatcaattcccccacagaagtaaccctcaaaccatgactgttgggaattggcagataaacaccccaggtcccttgtcccttgggaaagataactgtgaggcgtgctatgaaattgtgaaataataagaaatatatattttgggcttctggacagagctcctaaaacctttgtaatttcttaagtgataggggtgctaggaacattntttattctaataatctagaagcatcttttattctaatatttattagaatatactaataaaatattttattctaatattctaatctgtgtcagttcctgacacagagctcctaaatccttcagaatttcctggggctaaaagcatttttggtccaatgaggctattcttgatgggctcctggataacttcaggatgggggggtgggcaccagaaaggcacagctgtgattagatcttggaactttcttttttttttttgaggcagagtctcactctgtctcccggggtggagtgcagtggcataatctcagctcaccgcaagctctgcctcctgggttcacgccattctcctgcctcagcctcctagtagctgggactacaggcacccgccaccacgtgcagctgatttntgtatttttagtagagatggggtttcaccatgttagccaggatggtctcgatctcctgacctcgtgatctgcctgctgcagcctccccaagtgctgggattacaggcgtgagccaccgcgcccagcagaatcttggaactttcatgcccaccttccctcctcctgggaggggagagaggctggaggttgagttcatatatcatgcctacgtgataaggtctctgtaaaaatccctaaagtatggggtttggagagcttccaagatactgaacacatccatgtgccaggggagtggtgctccccaaatccatggggacagaagctcctgtgctcaggactcttctggaactcaccctacggatcccttcatttgactattcatctgtaactgttattatatcctttataataaagtgtaaatgcaaaaaaaaaaaaaaaaaa

SEQ ID NO: 3439 - DNA, 579 bp, Homo sapiens
cgtgatctcacggttgcccaggctgggatgtaatggcacgatcatcgctcactgtagcctcgacctccatgggctcaggagatcctcccacctcaccctcctgggtagttgggactagaggttgcatttcttttttctggaagcacatcttttaaaagatatttacatgaaggtctaccagatatgaaattggagttctagaaagggagaagatgaggatggggaagaaacaatatttcaagaagaaatctctcaagaatttgccaagtctgacccaaaacatcaagcagttgatttaagaagtgtataagcccaagctgggtaaatacaatgaaaaccacactttggcacaccagagtcaaactgagggaaatcaaaacaataataaaacattgaaaatacacattaccttcaagcaactacaataagataaatagctaatttcctaaaacaaattatggaagccagaaaacaatttaatgacatctttaatgataaaattactgccagtttacaattctctgccaactaaaaatttactctggaattgaaggtgaaataaagatatttctagacaaa

SEQ ID NO: 3440 - DNA, 899 bp, Homo sapiens
cttcaggtcaaaagaagcaactcctgctgcattagcccttcctcaggcactggggacctgggtctgtcttgaatttccttctctctctacaccaagctctatgccaggagcatccactgcagtacacgcgccccccactcgtcccccctaggtccaaggtgaagatgaagggcaggtgactgcgcgtggaggtcgaggagtggctggtgggcctctggacctggccggctgtcttggccgtgggctgggggaggagctgtgctgtctccatgcccctcccgcagcagaggcgattcaaagccatgacagaggaggagagtgagtcgcctgccacccagcagctgcagcaggcctgatacatcacagcccacacacccggctgcctgtcacccacccagacaacgccccggcccggccccggcacggcccgtgtgcacggtgactcattgttgccgcctcttccaaacagctggcgggccctgtcttgccgcggccggctggcaccttgggctcctgttcttagcaggatcattgcagggaatgtggtgtgcacagcctcaccgtctcccaaagtgaggtggcccagggtgctcggcatccacgggctcctacgaccagcgccaggtgcccaaggtcagcctcagaccgtcactggttaaatgacgcctgcgggccgtgcagttaaacagctctgccacctactagcagagactctggacacatttcctagtgtctgagcctcagttttagctgctgtaaaatgggaataataatgacacctacttctggcagtgtcttaagataatgcttatgaagccctcagtgccacatgcttgatgcagaataagaaattaataataaaatagtgcaatcgctttcgtaaaaaaaaaaaaaaaaaa

SEQ ID NO: 3441 - DNA, 470 bp, Homo sapiens
ctcagataaagaaggtttttgagtaccaccaactgagggcaatcaaaccttccacagtctagaacctggagaatgggtcttctggaaatgccatcacaggaaggctgctcttgaaccttgttggaaggggccataccaagttcttctcacaacccacactgcagtgaagcttcaggaccttaaacgttggatccacatctcacacctcaaaagcgccccttcagactcctggaactgtacgcctgctggagattttaaggaaaatccatgggaccatacgcaatggatggctttagctcaagattatgctctaatacaaaaccattaattgttgggttagttagttaatgccaaaaaatcaagaaacaattacactgatgccaatgcctctcaacatttgcaatgacaatcaccttgaaactccaagggaagaattaaaagctatccttgatattctaaaaaaaaaaaaa

SEQ ID NO: 3442 - DNA, 1083 bp, Homo sapiens
ctcatggtgagaatattatatatatacttttgtgtctatatctataaagacatttaggcatgtatacaaagtcatttaggatgttggaggattctagaatgtaaggcagactctggtaaaataatcgaattgtattacagatatgtgaacaacctcaccaaatgaggttcaggaaaaggtgttaatctaagtaaatttggaaatgtgcatagtctgtaaaactaaggcaaaatttcttttatacagcaatgtaatctaattagtaaagctgtttctaatggaaatatgggttaataattctgaaaccactatacaaaatactggcattgaacaatcacataaatggatggcagatgatgtaaggcagggttctcactatcagaatggcagttacagacaaacaaggggataagactagaatgacccagatggtaatatatttgagttggacacctcagcatgagttcataattagcttagtataatagagatggtaatgcattgaaaaatttatagatatttatatatatacacagggtagcatacacatttatgtttccttgttttgtcacatgagagggcctcactcagtgccacaaggatacttaccatccacagatcttggtttctatgcccgtcttcaatcaaaggaatggcgagccatttggagaaattggctagttctgatacagaagggctggactcccagctaaaccccacccttaagcctggaatcgtggccctaagtgaaaacagctgacctcgtttttctgcccaaatgttgcctttttggctcgcctctatcctgttcccataaaagacttcaggtggcggagcaacacaagcagctgaacatcacggctacaagtggctgagtagtgagcagagaagcatcggagattacggatagacactgctaacttcagatggtgcagcttctaggaggggcccagccggagaccgccaggcttcagggaatgatcagcgtcccatcccctttccagcctccctttttgttgagagccacccactgctcaataaaatcttccaaattcattacctttcaaaaaaaaaaaaaaaaaa

SEQ ID NO: 3443 - DNA, 368 bp, Homo sapiens
taggaaatgctgcaaagtcacaaaccatccagctgctcgtcaagatactcattcagaaagcttctcttgatgactgcagcctccatcgatgtcctccattcctgaccagtggttttaccaatgattatatttaatctagatctctgtgtcctacagatttttaaatagtttcctgtgtacaagtttttatctccaatgaaagcataagtcctttagaatcagaaattatacttaccctgcatccttcgttacgacattatgtgcagagcaagggtgggcatgggatagacccttcagtagacccctaagaaatacttgttcaatcgagtcaacactaaaataaatttaaaggctgaaaaaaaaaaaaa

SEQ ID NO: 3444 - DNA, 760 bp, Homo sapiens
ggtcgagtatcgacccctatagggggccagggccaattgaagctcattagggtcttcggctgcatgccatctccagtgcccagcaagagataccaagaatgtcctaaagcagaatgtcctaacacaacagatgcattggagcaagcctgccatctgaagtaggctgagtctctctgcaaacaatcccatcacccctaccaatgagctttgcctatactcacccatctgagctccagccttcgcgtgtgactcctaacggtggagttttctcctaaatccattcatcttgccaaaacactgctcacactagcatagacatggaatctactacatgcccatcaatggtagactggatacagaaaatgaggtccatacacaccacggacaaccatgcagccataaaaaagaatgagatcatgtcttttgcagagacatgggtggagctggaggccatcatccttagcaaactagcacaggaagagaaaattaaatactgtatgttctcgcttataagtgggagctaaatgatgggaacatatgggcacatagaggggaacaacatacactggttcctatcagaggatggaaggtggaaggagggagaggatcaggagaaataactaatgggtactaggcttaatacctgggtgatgaaatcatctgtacagcaaaccccatgacacaagtttacctatgtaacaaacctgcacatgtacccctgaattgaaagtaaaagttaaaaaaaaaaaaaaaaaaaaaa

SEQ ID NO: 3445 - DNA, 761 bp, Homo sapiens
aggcacaacggaagactacatttctcagtctgattgtatctatgtggggctatgctaccagttctggcaaatggactatgtaccagcagcacgatataccacttcatgcctagcacctacaatctgcaagacagcatctgcattctcctctctgtctactgtaggattatcagtgtccagcaaaaccaggacattcaccaacatattttgtcaaatgacacagcaagaaggcccttaccagatgccagtcctttggtcttggacttcccagcctccagaatggatctgggtctttgttttctgctcaacaagctgctgagcagcaatcccagccccagggcccagagcaccttcctctgggagtccagcctcaggactgtgctctgcctgcccctactgcacaggcctcagagccacccacctcaactctggttcagccacagtcagaagcaagtaagatgctgtgctacgctgatgagctctacgaatctgcttttcgttttcaggacctttccatttggctcctgcttatcaatatttatcactttcattgattgatctgtatttattaatcttatttaggccctcattgccttactattgaattactgctccggcatcctaggtgcgttttctgctgaatgcacgctatctacttatgccaaactgacccttagattatatgaatcgccctttcgctgaactaccatgttggaccacagcagccggaccctgggacgggtgccacgcgatcgaggtct

SEQ ID NO: 3446 - DNA, 347 bp, Homo sapiens
agcctttgaaatggaagaaaactcaccatatgaccaatggcttacgtttgaagagaggattaagagagatcaaaatatgttgaaatactgatggggaagtgcgattgcataggcaagattggaaccaaaacgaaaaatcaattaatttacgtgaagagatagaagtgtgtccagaatacaaaagagatcatcttagacaaacgttttattctgcatttccttttgtgagtaggaaaggacaggaaacgtgatgatagatggagacatagtgataaaacgttgaggtggtttcacctgctgctgagtacaataataaaaatattgaatgtttaaaaaaaaaaaaaaaa

SEQ ID NO: 3447 - DNA, 640 bp, Homo sapiens
aagggggaaaaaaaaaaaaccggcccccattaaaaaaggcaaaacccggcccaccccggggggttaccgccaaaaaacggggggggagggcccccacccccccctttttgaggggccccggggggccccccccaccagggcccgggccccccggggggggcctcttcttgctttgggtctgccggggggagcggggggggccccaccccccgggcccccaaaaggggggggattatcccgggccggggcctggggggcccccgcgagcagcacccaaagccggggagaaaaaaaacccccggggggtaaagggggggaaaaccgaggggggaccaaaaacggctcgggggggggcccttagggccaaaaaaacccggggggaaccccccgggagacaacccccggggccccaaaagaaaccttgggggcggctctaacggggggccaagaggccctaaaacccgccgcgggaggggggatccccccgccctttaagaagcgccggggggaaaaacgcgccgcggtttaacccgcgcctatggggtttggggcccccgggggaggcggtcacccgggtccccgtgggcaagaaaacggggggcccggcatatgggaaaaccgccccccccgggaaccccgg

SEQ ID NO: 3448 - DNA, 230 bp, Homo sapiens
gacaggcagatggaaaggatactgcagagaagaccaagaaagagaaataggaagaaaatgcagagtgggttgtcatggaatcttcaagaaggaagctcattgcctgacccacttgtttcataatgcaatgaaatgctaaagaattttaactccataaggaaaatcagggcaagacaataaaagaaacattaaatattagtaaaagtacactcaaaaaaaaaaaaaaaaaa

SEQ ID NO: 3449 - DNA, 552 bp, Homo sapiens
tcattcaggagctctcttcatgcccacaatattcccccttctaattgaattctcaaagtagaatcagatcaatacagaaccctgaaggtatcgtgattgagaaggctctcagctgcacctgctactggaattatacctgtgatcagaagcccctgtttttatttcgacaaagaaatggaattcataaaatagagtaacagactgccccataaaggagagtatggtggtgaactctcaagaactattgcaattatttccttagaaggaaggagatacagaaatataagaaacgaatgcaaagaaggcaaggagagcaaaaaagaacaggaggaaggaagagtgaaaggatgaagaagagagaagaatatagtgttcattgagtatctgctcaaattaaggataaagccacatgttttcgtaaattttctctaatatccatagcaatctagtatccatagccaaacaaataagtgacttccacttaacaaaggaactgaagcccaaaaaagttaatatggacgagtcacacagcatctgggattgaagctgagt

SEQ ID NO: 3450 - DNA, 914 bp, Homo sapiens
  misc_feature (1)...(914): n = A,T,C or G
tgaaatgccttcagatttaatttgaaaggactataaataaaagagtgggctgcctggccaatcattcttacaacttcactccaaaatgaacaattttaattgggaaatgcaatggaatatattttggacctctttctcagaactatgcaagctggcntggcatttgggaaccttgtttgtaacagacatcactaaccnagtataatgaagcatatgcccatncgcttgatgaaatttcaactttttgaaacagataaaatatgttttttctatctcactaggttactaaattacaaaagtaatatttttatcaaatgttttcttatgtttgtgcntaaattcctttttttcccttgggtgatcgtnaaggtagcccattttaggatcaatgccatgtagggaatgtaggagagaggaagagaggaaactagtggctttattatttattagctggtagtcacggctggatccagacatgcaggtactctgaaagaattagtagttaggaatatcaagaatgctaataacatgtcattcatcaaactgattctctttaaaaaatgcgatgtttagggtggagaagcagcagagtaggactgctggcattggcaggatcggcatcttctcaatggttttcaaagtatgttctccacatcgacaacttcatcctcatctgagaagcccctagaaattcagattcctgggcctcatcccagagctgctggatcagaaactcgcgtatgtgagagctgagtgcctctggaaggcgggagctgatgagtcactgagtgtgctattgcaccatcataattgttagcatcataaacaatggtatatgacggggtagagcagattaaagagaatgaagtgtcttgtgcagttccctctgtagcggtggtnattaagaaagnact

SEQ ID NO: 3451 - DNA, 272 bp, Homo sapiens
aaaattggaagaagtgaatgccttattcaagaaatagaagttgctgtaaaaccagcttacctctcagttttttcctccatgaagaagacatagccgacaaaaatgcattccagagaaatcagcattaccatttttttccaaaaaggtattctacctagtcatgaagcaatagctcaccggggaggcattgctgttgcttcttgtgtttttgccactcttctgtaaagtatgcggagtgtatccctcaaaatctgcactattaataaaaaaat

SEQ ID NO: 3452 - DNA, 884 bp, Homo sapiens
  misc_feature (1)...(884): n = A,T,C or G
accccgctacagtgaatacaaggtgtcaaatctccacaaaccctggggtattctttattggaaaatatagtcattctcccatcagctttgttggtgatcaaatgggaccttcaaattcagacctgctgagaagagttctttcttcaagccctggccacctcaaaattgcctgctcatgaagtatctgaatttgcctctgcctcctcaggaaaataaattatttctatctttttgttttgcatggtttatgcataccgtctctggacatttttgtcttcttgagagatattactcaaatcaggacattggtgtttctgcaaataccaacacttgaaatttgccgaaattacctaagtgggcacacaagctaacatgcgtgtgctgcatccttcctgtcacaaaggtgtgaagaccaattcaagatgaggctcaacatgttgccacaatgttcctgccaaatggatgggagaggcatttggttgtatggttcctaaggataggacacttactaggcttgaattaatagttgaatgattaataaaaagaaaggttactttaacagagttgaaggttggataaggcttagaaaaggaagacagtattttttttattattataccttaaagttctagcaagagcctaancagtaatgtgaacaagtgtaggagtgtcagatactgtgaacaaatcttactggcttaaacaaaggattcagttaggaaacattaaaactgctacatgttttgtgggctttaggtatttaaacattgtattgtgtggttgttatgcttttaatcacaaatgtctaaaattcatccactcattcattgacttaaatatttacagagcatctgttattgcctatatatggagaagagaagaat

SEQ ID NO: 3453 - DNA, 718 bp, Homo sapiens
  misc_feature (1)...(718): n = A,T,C or G
accccgctacagcaaatcagagcatgaaaattcttcagtcagagtgttggcttcagaaattgacagagtgaaccttaggatttatgtgggagctgcatggcatatattcttctttcctgctggatttgaatctaagacactgtggattgagctgctatacctagctngcaagaggacaggcacaaacagaggtgaaaggaaggagccctaccanaagaaaatgttactaacgatgttgtttatgcccctgaggtcagatgatgtttgaggtcaacccatgagcttgtcatttctatgaaccattaaattcctttttttctgcaaaaattagcttgagcctctgcctacaaaagtcttanctgatagagatgtntagttcagcaagagaaagaagttaattcatgctccatactcttgtcataaaaatttgatcagtcatttccgtatttaataaggtgtacacatatttctcacttccctctcttcatttctctttttcttctttttaaatttctattatttctaatgtagaaaagttgatttttcctttgctgtacttgtgtctcatcttcaaccccaaaattattacttaggtatttctctaaacaaaagcagagtgacctgaaataacttgtggcgccagctgttaagatgttgcatttttcaccttgtttcccactatgcatagttgttgatttagttgttcatatctcccaat

SEQ ID NO: 3454 - DNA, 145 bp, Homo sapiens
accccgctacaggtaaaatgggtgtatgatcttgtctaagcaaagaaagtacatgtttgaagctcagagcctttgacaggctgctatgcacagtgttgaaataaactacctgggaaaaggcaaccatgtaataaactttaaaaat

SEQ ID NO: 3455 - DNA, 166 bp, Homo sapiens
attgcagagcacaaactggctgattgatgccccagaactaataccgtgagacagacccgaggcgagaaggacgattatttaacacagcaccaggggcatgtggggtcatcattcttgtgcatggtaaagcgacgaaataaaaagtttatgcccaaaaaaaaaaaaa

SEQ ID NO: 3456 - DNA, 392 bp, Homo sapiens
acacagatcaccttatctgggcaaagaaatgagaagatggcagattaaaaacataaagagacagcaagaccaagccctccccttcctcctcagcctgctcctcaacatgaagatgatgaggatgaagacctttatgacgatccaattccacctaatgaatagtatatacccaaaagaaaggagatcagtatattgaagagagagcttcgatgtttgctgcagcactactcacaacaaccaagatttggaagcaacctatgtgtccataaacagatgaataaagaaaatatggcagatatacacaatggaatactgttcagccataaaaagaataagatcctgtcatttgcaacaacatggatggaactggaggtcactatgttaattaaaat

SEQ ID NO: 3457 - DNA, 174 bp, Homo sapiens
gtacaggtcctgacttggtgttaagataaatctgaaatataataagggaatgaagcatggactgtgtgattctaccaggagcgaccccttggaagcttgtatttggtatcctctggacttcattcatgtactttttccctttcctgattttgcttttgattcttttgctataat

SEQ ID NO: 3458 - DNA, 662 bp, Homo sapiens
attttatttaatacacacaatcatagtctaagataggcactgttatcatcccattctacagatgaggaaatcaggcttacccaggctaaggaattgctcaaggttacaaggttaggaagtattggaggcaggatttaaatacagacaagtttactaactttaaagccagtacttttacccacaatcctaatgtacttcatttaacttcttcaggcttcagggttcctatgtatgaaatagagattatccctattttcactcttgtccctccagtattctctacacagtagatagaaagatagcagccatttgaactgggctcagcttccaggggcatgacataaaattaatgtctgcagtcagcctgtatgggctggtatggatgtactccacaaaatcctcagggagctgagcttcttctaactccacactgtccgatccagaggggtgacccttgtcttcatggtccaatatagcagctggtctatcaaccgtcacatctgcattcttctgttccataagctgcttcatttcctttctccaaatccctcttttgctggttggacaaagattgtttctgttgcactcagtagccagggcctctatttaggtgtcatctttctttggctgttactcttccagctttatctcaaatcacaaat

SEQ ID NO: 3459 - DNA, 804 bp, Homo sapiens
  misc_feature (1)...(804): n = A,T,C or G
ctgactggctcctctgctcctctgtgcaaagttgacaagcatgattgttcaatgctctcaggcatcgcatcctatagcttcagccattgaagagggacagtatgttgcgggaagtcagggaccccaaacggagggatcagctgaagccatggcagaagaacgtggattgtgaagattttatggacatttattagttccccaaattaatacttttataatttcctatgcctgtctttactttaatctcttaatcctgtcagctgaggaggatgtatgtcgcttcaggaccatgtggacagtactctttcttctcttaaatccaaaattctctggctaaaagtgtgattgcctccacagtgaggggaccattgccagacagacaactgtccaagttggagtggagctactcaattaagaaagggggtcatggtggagcaaaaccactaaggcacaacaggaactaaagtatcaatctggaagagcgaaggaagctcccagggactgagctgctgggcctccaagccttttccatctaatctcagcgttttgaattctaccatgtttttaacctaaagattcacaaaagctattaataaaatagccatataatttatcattcacaccaagacacttctgagagtgaaagtaggtaccacaaataattaaaattatattattttgaaatgtctatttattgactgacaaactggttttctcttaatcatggatctatataatcactcttattcagaaactattttcannaactaaatctttctttaaaaaacgtccaagccaggtgtg

SEQ ID NO: 3460 - DNA, 746 bp, Homo sapiens
tttttttttttttttttcttttttttttttttttttttttttttttttttttttttgggttttttttttttttttttttttttttttttttttttttttttttttttttttttttggggggcccaaaaatcttttttttacaacaaaaagggcccaaaaaaaaccggaaaattttttttttttcaaaaaaaaaggccaaaaagaaaaacccctaaagggacccctttaaaccccaaggggggccccaaaaaaaaacccaaaaattttttaaaaattggccccccctaaaaaaccccaaaaaaaccaaagggcccccctttttatcccccccccccttttggccttttccccccccccctttttttgggggggggttttttttccccccgaaaaaaggggggaaattaaaccccttcccgggggggggggaaaaaaaaaacacacaaaagggccccccccccccaaaaattttcccccccgggggccggggggggccccaaaaaaaaaacccccccccccccccccccaaaaaatttttcccaaacccaaggggcctatatgcacaaaaaccaagggggaaaggggggggccccccctccaaaaaacaatattgggggggggaaacccccccccccccacagggttttcccgcccccccaagggaaagcataaccccacccctgggtttttggtccccccgaaaccaaccgcgaaacgtggaaaaaaaaaccccgccccaaaagggg

SEQ ID NO: 3461 - DNA, 550 bp, Homo sapiens
agaaacaacctgttcagtggctgctgattaactccccaagattgatgtactgaagaaggatgacctccccttgacaccaatgctactagtcaataacgaccactgtgactcagaacaaattctctgggggcaggcagtgaagcttcttctcttgttgaccttaccagtccacaaggctgaaaatattctgtggcctgatgcccttaaattgatcatattaatacaatcaagcagaaaagaaattaattttccctctctctctctgtctatatatatacttactactatatatatgtgtgtatatatatgctatatatgtgtgtgtatatatatagcagtacatgtagatataattagtatatatagaagtagtaaatatataaaaatatatttgtattcctcttcagcttcatacttgagattaaaaagtatcctttaagagttcatacatctagacctctcttctgaaaagaataataatctcctgtttatctatgcacttatttgctaaataaagaagaatattgagcacccaaaaaaaaaaaaaaaa

SEQ ID NO: 3462 - DNA, 458 bp, Homo sapiens
ctaggtcttcaggaggctccaagaccagcaggcatataagcaaaacggaacatagacactggaagcaactttcctgtgttagtaagccagcagcatcctcacaccatgcgactttacaacaactgctgccctatcctcagagcctctgcccggcatggactggggcactcagaatggtatcccttgatataatgcatatacgatggcactgtctaccacctcctcatgcctaaacatttctcagttttcagatttagagtctcaaaactgtttccacagtattgaactcccagttttctaaaccccaacacgtttctttcttgatcacggatcgtcttttcggatgacagcatcctggcttgaatccagagcaaaaaaccattgaagtcaaattaaaacatacttttatgatgacaaatttattaaagttaataattcaactcacaaaaaaaaaaaaa

SEQ ID NO: 3463 - DNA, 682 bp, Homo sapiens
ggctctatcagtctgactggtgtcctcataggaggaaatttgaacacacaaagagacaccagggatgtgcatgcatggagaaaagaccatttgaagacacaaggacagggagaaggtggctgtctgcaagcccaggagcgaggcctcaggaaaaaccagacatgtggacaccttgtgcttggacttctagcatccagaacataagaaaatacatttctgttgtctaaggcacccattctgtggtgctttattatggcagcccttgcaaactaatacatatattaaaataaaacgagccagaagtggtggcctgcacctgcagtcccatctacttgaaaggctgaggcaggaggactgctttgagcccaggaggtcgaggttacagtgagctgtgattgcaccactgcactccagcctgggcaagagtgagaccctgtttctaaacacagacacacacacccctaaaacagatctatattaaaatgctttgtcttgatgtttttatcaggtctaaaacaaggctttcggcaacatgagactcatacttggtccagaactttgaagcagctgcatttgaaagacttttaggttttcttcgcttgtcaccataatctgttacaaattccaatgtgcaatagaatttgtgtattaaaacaaatttatataaaaaaaaaaaaaaaaa

SEQ ID NO: 3464 - DNA, 739 bp, Homo sapiens
cctcagagactcaaagtatggaagatgcaagtgcatggcccagaacctcagagctagcctggcacagcggttcacacttgtaacctcagcacttcgggagaccagggaagtggatcatttgaggacaggagttcaagaccagcctggccaacatgatgaaactccatccctactaaaaaaaaagaatacaaaaatcagcctggcatggtggcacatgcctgtagtcccagctattcgggaggctgaggcaggagaatcacttgaacctgggagatggaggctgcagtcagcctagatcacgccactgcactccagcctgggcgaaaaagtgcgattccatctcaagaaaaataaaatacctggttatttgttttcttactactgagttgtttggattccttaggcatcttggatattcacttttcacaagatacattgtttgcaaatattttctcccattctgtaggctgtccctttaccctgtggattgattccttggctgtgcagaaaagttttagcttaatgtaattccattcatttatttttgtttttcctgcctgtacttttggatttatatccaaaaataccattgccaatgacatggaggcttttccttgtttccttctagtaattttacagtttccagtctgccatttaagtctttattttgcatttatttttatgtgtggtgtgaaataaagttctggttttattcctgcataaaaaaaaaaaaaaaaaa

SEQ ID NO: 3465 - DNA, 727 bp, Homo sapiens
tagaaactgaaagtatggaagagcaaatgcatggcccagaacctcagagctagcctggcacagcggttcacacctgtaatctcagcactttgggagaccagggaagtggatcatttgaggacaggagttcaagaccagcctggccaacatgatgaaactccatctctactaaaaaaaaaaaatacaaagattagcctggcatggtggcacatgcctgtagtcccagttattcgggaggctgaggcaggagaatcacttgaacctgggagatggaggctgcagtcagcctagatcacgccactgcactccagcctgggcgaaaaagtgcgattccatctcaagaaaaataaaatacctggttatttgttttcttactactgagttgtttggattccttaggcattctggatattcacttttcacaagatacattgtttgcaaatattttctcccattctgtaggctgtctctttaccctgtggattgattccttggctgtgcagaaaagttttagcttaatgtaattccattcatttatttttgcttttcctgcctgtacttttggatttatatccaaaaataccattgccaatgacatggaggcttttacttgtttccttctagaaattctacagttcccagcctgccatttaatcctttattctgcctttatttttatgtgtggtgtaaaaaaaggtctcggtttattcctgcaaaaaaaaaaaaa

SEQ ID NO: 3466 - DNA, 528 bp, Homo sapiens
tagcaccagatagctcctcctcagaagactgacttcttgttcagacgctctatgggttattctttgtacagaggatgaagaaatccatgtgcacagattggacttctcccttgggccgcggagatgttcccaactgtctcccggacatttccagctcagagtcaacagatgattggagagttatctcatctgctacatatttacttagtcacatctcctaactgctccaatcacccaagagcaaaatctaagtgtctgccttaatagttcttatcaatgcatcaccattcacagatgtgcatgcacttatacatacactccttcaatccatcctacgtggtgttgattgtatctccaatacattcttcataacccttctttcttctctgccttctacagtccctatcctggacaagacactaataatttctgaggggtataattttaatacattattctctgaactccctactgacaattcatgttcttcacattgcaaataaagttctcgctctctaaaatggcaaa

SEQ ID NO: 3467 - DNA, 768 bp, Homo sapiens
tagaattgatcgtgccgaattttataaaaatcctacgattgtgtttctgaaagcccccattacattcgtgtgtaggggatggatggagggagaatccaggataattaaggacatcagaagtatccttaataccagaagaaaaaggaagaaaaacacaacttttttgaacctcccttgtgaaacaatttttaaaaatgaaccaaatattaaacaaccaatttctgagaacacagaacaaattgcttactcatggataattatgaacaaatgaacaaatagcaggcttggagattatgataaacccttaaaggagaaatgtaattaatgatgatgataaaaatgctaagtatttgtaataataattacaacatgtctgtctccagaggtcctagtttttgatgttccttttcagaaaacatcatcagagtttaatcaaaggcactgatggaaaatatggctaattttctccttaactacactgaatgtccatggaaaagctgttggttatcattgagagatgttccagtatatattgaaatggcccctgttgtgcatggggacagctgtctcattgtccagtaaccttaaatgctgggtgtgcatacaaagttcctttcctcctaagctgactttagttgatccataatagatctattagcccaggatttatctaaaccattttaaaacttatttatattgtgaatcttttttacttttttggggtgttcaagtgtttaataaaattattgagtttgaaaaaaaaaaaaa

SEQ ID NO: 3468 - DNA, 607 bp, Homo sapiens
atcccccctttttttcaaccaggaagaaggtgctttgtggtagaagtgggtctgcagagttagagaaaggaatgcatcaaagggaaatggaaactggaggaaacactgagaaaagacttggaatccaatgtgcctttatgtatagaagtcacagcagcaaggactacagaccatgcacagtgaaactataaactttgtaagatttcttaaaactccaaatgcccctgtgtttgtccttgtattatcttctgactgtttccccaaaggaatatgcagtaaaaacttgaaaaccaaaaggatatatatttgtttttgaatgcaccaagaaaattttgagctggagaaaggataaaccactgaggaggcaaatgtgggaggcaaaggagccccaagggaatgactgtgtagtgtctatagttaaagaggaaggaaaagcagactgggtccatggggaccacacaaggaaaaagaaaagaacggaaaacttgtcttcaccttagataaaccctggggatttcaccctctgcaatccctagtagaatgggatggcttaaagcgagcctgttgtaactatagcagctaaataaacaccgatgtcgcccggaaa

SEQ ID NO: 3469 - DNA, 706 bp, Homo sapiens
ctcaggcacatctctgcacatgtatcccagaacataaaataaaattttaaaaaatggcatgtgaaaggtcattctggtgaggtcctagacagaaatgacgttataggaaacaggagaaaaggcaactcttgttacaaagtggcaaagatcttggctaaattgtgttctgctatgtggtgaaaggtagaacttacaaatgataaaattatatatttagcagatgagatttctaaataagctattggaagtttgtcttagtgcctccttactgcttatagtaaaatgcaaaggagagaggtgacatgaagaggcaattgttaagcataaaggagccagaacttggacatttggaaaatccttaggccgccatagagcaaaaaatgggaaagtttgttcagaagagaacactgagagtgtagcaaacagctatctgatggtgagactcttggcagcctgagcagactaatatggttataaacacatttatgcaccttataatttaacttcttataatctcttggaatccatgctcttccattttctgaactgtgatgttatcattgcctctagtatttttctttttggaaatatccccttagtccttcaatggtgattcagatatccctagtatgaagattgttgttaatgacaagcctatatattaatcaataaactaattattcactcattgaaaaaaaaaaaaaaa

SEQ ID NO: 3470 - DNA, 943 bp, Homo sapiens
ctaagagaaggacatacgtccatctccagtgactttgggcttggccttgtgacttgttttgaccaacaaagtatgagcagacttgactcaagccaccttccaggggaggcataagctgtgcttgcatgcttcggctctacctctcatgttctgcccactctcatgagaacagcatgacacagatgaaagatgctccttcagtctgaaacctgaagagagaagctacatagagctaagcccagctgagcccagcccagccaatacagtgcattgacctgcagctatcttacaatatgagtcgggaatagacttttgttcttgtaagctcttgagataatatggttgtttgttaccacagcaaaagctaataaaccaccgttagaaaacagataaagtgttttaaatttttagaatatttggaaatgatgctaagtttgtgaagttccttaaggtatgcaaatgaaaaataatttaccttaatcattgtcataaacctgaatcaaagtttgaaataaaaatcatgcctactagcccttacttaagtgatttatagacaatgtaaatctttgtaaactacctcaaataatgtgataaacaagatataaagcaggctttcttttcatttgtctctgtgggttctttaacagctatacagccatactccctgtacttggatttaccatggaaaacattttccctctccgttattgttggcaaaagctgcatctttctggtctgttcagtactcgacaatttgtactgccaattatgctattacaatgtctcttaaggtttcctccactgctcctttattcttggtacctcctttgtgatttcagagtcgttttatgggattgtaatgtggctcttgacatataattgaagcatgttaaattaccctggcttaaataaacaacttaccatgtgaaaaaaaaaaaaaaaa

SEQ ID NO: 3471 - DNA, 650 bp, Homo sapiens
ccctaggaaacctcgacatgatgcaaagacagtcaagagatccttgtggcaacatcctgaagtgtcctgaacacagaaatgtgacgtctggggtggggccagatggaaacttctgactgttagagctacctagcgggtttcaaaactatgattgggatttcttactctttaagaattgcattcttgtctagtaatgtaaaaattcattttaagtgaattttttcttcagttcaccctaccttgaaacaaaaatagattataaacaacagattggtttttaaacactacctattgttaacattcttcctcatgtctttatcttacctttgcctcatgcctattgccctgaagaagaaggaaggcagtgttcatagacttcgtgcccctgtcaaatatattttctttatttactgccttctgattcacaaacactcagaagtttctgcaaggggtaggaccatggccagggtgtcatctgtcctggcttacacctgttgtcccagcgcaattattaataatgcccctttcactctcaaacatgtcctggtttgggcaataacttttgttgtcaccctaattatagttcatgtataaaaacacattttgactagaataaacttctggggtcagttgcaaaaaaaaaaaaaaaa

SEQ ID NO: 3472 - DNA, 564 bp, Homo sapiens
taggcagccctaaagtgtacgtctgctggagagatgagatgcccaggaaacaggctttgagaaactggacttcactccacccagtactgcagcaagtgcaccaaaacacccaaggtggctccctgtcattgctcttggtggacaagcatacatcagttccagcctccagcaccgttgggagggtcctggaggaccaactcctagcaccttccagtctgattcattcatatgagaatcatcagctgctgaggccccccaggaccagaatcccaggaaaactgccaccttgactggagtcccaccatattctatctctgcagagctgtccttctgtgtggggtcagttgcaacctttatgtgaaagagagagaacagattctttgctggtagcttttggtttcatcatatcaataaccataaatcacatcactgtctcattgccacaactgaacaaatcagagctgtctgtctcgttccccattgtattatcagtgcataaacagtgcctgacacatagtaggtgctcaataaatgttttttatgtccaaaaaaaaaaaaaaaaaa

SEQ ID NO: 3473 - DNA, 146 bp, Homo sapiens
ctcttggaacccatcacattccttatacagagtgggacagcattggctgagttctactagcaaatgccggagatgtggttcctgttggccttttaactgatgtgatgaaataaagtcttccataatttgacaactagttaaaaaaa

SEQ ID NO: 3474 - DNA, 248 bp, Homo sapiens
tagtctatcacagactacttgacacatccactggaagatgctggaattggcaccacggacttgcaggaatgcccaggaatggctgcagacgttttcttcctgaaaaattcatcatagagaactggtggacaatggaatctggttttcttcacttttttaatgctgctagtgttcagaaaactaaagatgtaaacaaataaacaaaaaacaggctactgtgtaaagggctgcccacaaaaaaaaaaaaa

SEQ ID NO: 3475 - DNA, 568 bp, Homo sapiens
cctagagtacgctgatagaatttagtttattgaaaaggaatacatgcacatcagtagtgtaaagaagttaagaagaaatatagcatgagaaggtgacctttcaacaggaattattgcctcaatgccagtggttgaagtgggatttctcaactgaaacatatcaatactgaaaaaattattccatgtcgtttacatagtgttagatgaactttgatttgaaatgattttgcaaatgagattgcctcaagcaataaaaacagaattgccatatttctctgatcccttttcatcaaaccaagctattaaaaaacaaatttactttgtgttactgcttaaaaatacaatggctcagatcagtttatgtgcagaaactattgtttggctgtgtgcattttttatttaataattttaaactgaacctcaaatggtataaggttagacgaactgtaattaatgattggcattcattgttgggcatgttcactattgaatatcaagatattgatattcataacttttgggaattaaataaccctttggttgcattttaaaaaaaaaaaaaaaaaaa

SEQ ID NO: 3476 - DNA, 366 bp, Homo sapiens
cttcaggtgactactcgctaccgttatgttgttataaagtgaaggtgttgtcagcagtttctttcttctaagtcttacctactctgcaccaatgcaactggtttctgtggttcagaactgccacgttggctgggatagtctagtttctttaggcctaccgtattcaaagcaataatagtgaaactctactgtaatttatcactctcctatgcaaaacaaacatttataaaatgcagctacatttctgtcttacctaccaaaaatgttcaccctgcttatatctttttgtaagccgatttgtacttcaaacattatgtcatatttttcagacagcaataaattaattcataagtaaaaaaaaaaaaa

SEQ ID NO: 3477 - DNA, 923 bp, Homo sapiens
  misc_feature (1)...(923): n = A,T,C or G
tcgttgggtcacgaatctcttcgtgtggttcaacattatctgaaacaacacagaggaagagaccgaactggaattgactgttttgacattctacgcttttgagtatttaaaaatatttattgattcaataactcttgtgactgaatggcttagtacttaacctgaatactacctgacattttaatagggttttaggatattttaaatggctatttaaaaatgttaactgngcttcaaaacatgtctataaaatagattcaggtttacatggcctagctatgatcgctcagacttacctactctaaataggtaaatgccttacttgaagctgttttaacaaaaggaaaaaaaaaatcacattaaataagcaatcaaaatatttttaaaataggaaaataatgtattttaaccctttgcctaaatggggaaaatttggcctttacaagatacacatgaagaagtcctgtatgctntcagtattatttagataacaaattctaggagttaaggattttcaaggggttcanaaagtcccaaagcctgaaagtggaagtagtcttcttatagttttggaaacagtaattaatgttctacaatgtcacaaaatatccttgatgtttgaatgcttcaaatttcaaatagtggttaaaatatcaaaattttgcatcttgatagtataaagttattttttagctatttaacantcaaaataacttttggacagcgatnatgatttgttcaaatatttatgactggctttgcgttaaactttatccactgttggggtcgggggaataatatataatcaaaggcttccttttattaacaaaaaaatcttaagggttaaaaattttaccacaaattaattttaaagttccaaactcacccttgaattaatattggggaaggggtttataatgatt

SEQ ID NO: 3478 - DNA, 740 bp, Homo sapiens
tttttttttttttttttttcttttttttttttttttttttttttttttttttttttttttttttcttttttttttttttttttttttttttttttttaaaagggggttttgggccaatttttttaaaggaaaaaaaaccggttttcggttttttggctaaagggccccaaaagggcaataaaatggttcccaaaaaaaagggcttccccccttttaaaaaaacgggggaaacctttgcccccccttttaagttttcgggcccccgggaaccctttggaaaaagggggggcctttttttttaaacaaaattcagggaatttttttatttccagggaaacctgtttcccaaatggcaaaaaaaaattttttgtttttaaaccttggcacttttaaccaaaaaaaattttccccccccattaaaacccaaatggtttccccttccacctttttttggccaaccattttggtttacctttggaaccctgggaccccccccccaaaagggcctggactttttggatttcccggccccttcccggggggtaaaagggaccccttttttttgggtcccaaccgggataaaaggtcacccttttgggggggccattggggaagggcgggacacccccggttcaaagagagggcgccaaaactaaaaataatatcctcaaacaaaaattaaagcggggggaaaaaaagtttcccaaaataaatatcctcccccccgggccactattttt

SEQ ID NO: 3479 - DNA, 324 bp, Homo sapiens
ttagaaaatacataccatcagaactaggcaaaatggaggttatctacattgtatccctctgtcttttaaattctaaagagtccatgttgtgagcatctcaaggaagtgaggcctcctgccaatggccatgtgaatgagcttggaagtggatcttccagcctcagtcaagccttcagataactgcagccccatctgacagtgtgactgcaaccctatgaaagaacctgggccagaaccacccagctaagctgctgctggactcctgactctcagaaactgtgtgaaataataaatgctttttgttttaacctaaaaaaaaaaaaa

SEQ ID NO: 3480 - DNA, 425 bp, Homo sapiens
cttcagttctctcagagcatccaaaaaactctccagaactctccattgccctctgtagctctggatgtggtgcctaccacgggccgttggcagtcccgattctgtgtctctgaccaggggttgctcaggccactgactctgcacacacatggggcagtgagtgtgccagggagccaacagcctctggaagcagcccacaaccaatggcaggtggcagcgggtggataaggaaaatgtggagtccccttctacactgtctcccagaggtgtccagccaggcagcaccagctgccactgcagtgacttgctcgacgatgcacccttcgttggttctcttccctcccttgtcttactttccactcctctgtcggtatttcctaggaccatttcccaaataaacttcttgcacttgaaaaaaaaaaaaa

SEQ ID NO: 3481 - DNA, 245 bp, Homo sapiens
ccccatggtgtgcataacccacatggaagaataagctctttccagccccacgggaagtcttctgtgccctatcagcaaatccaagagcaaaagtagaatattgaggtaggaaagtagaccagatttttagggaaagctcatatatttcagaaaaaaaaatgtctgaaactagagtcattacagtctttgataaattgttaaagaataatactgtatcatgcttattaaataaaattttactgtca

SEQ ID NO: 3482 - DNA, 744 bp, Homo sapiens
ctcagactccagtgacccttcatgtaaaagacgtgtctgcggtagccactggtccaaggagaatgaggaaatatgtagagcagctttgaacctaatcagcagtctgaagtcaagcccagtggattccagccaagcacagcagaaccactgccaatctatagaactatgagaggggaaataaatatttgtggctataagctattgagagtttaaacttgattgataggcagcaaaaactttcaaatcaattgttcttattaaacattttgcttttgttttgttttgtttttgagacggagtgtcactctcctccaggctggagtgcagtggtgcaatctcagctcactgcaaactccacctcccaggttcaagcaattctcctgcctcagcctccggaatagctgggattacaggcgcctgctaccacacctggctaatttttgtatttttagtagagatggggtttcaccatgttggccaggatggtcatgaactcctgatctcaagtgatctgcctgccttggcatctcaacgtgctgggattacaggcatgaaccactgcaccagcccttataaaatattttttaaaagtttatgctgatctggctctattggattgactagataactcatatttactggctgattgacttggacattatttttagagccatatttggctatcttcacatttattatgatcattctaataaaagatttaaataactggcaaaaaaaaaaaaa

SEQ ID NO: 3483 - DNA, 564 bp, Homo sapiens
cttagattcacggaagcagagccttacaaagaagtctcccttcgaagaccctggcctgactccatttgagagagaaaattggcccacatgtgggaggactgtcccgaggctcctgtgaggccaggccaagaaaccttgagatggccaagaacccttgagatggcaaagaatgctttctcctgtctgctaagattgccctcagagttctggtttcctgtctgaggacctacatcctcttccagccattggctggacagatgtggtctacccacagggctgtggtctctgccttgcaagcctctatggaacaaccacattagaacatgatgtgcataggaaaaattatcagtgcatataatggtgataatatcatttcgaagtccctcaactcgctgccttcttttacattttcttgtacttacctttcccccaatctttagaggtttccagttgcctcagggaggtttaggattgttacagtgggaatgcaaaaaaaaaaaaaaaaatggcctcgttggctacagcgtggagtgtgcgccgagtaaaaataaaaaaaaaaaaaaa

SEQ ID NO: 3484 - DNA, 408 bp, Homo sapiens
ctcagtgtatcccggagaaatttctttgtctggtatttccaagtttggagcctccctggttcatttctcagaagaattaactcttgactgaagcccggaaggaagcagagatggtcagctctttcaacacatgtgctttagaccctcaccttcctggcaggagcatgcaacacctcttggactcgatgaaagctgtcgccacaggtttcaaccagtcagtactctgaaagagcatcttgggggaaaaaaagcgtgtcagacattcatcttcgtatccagaaagtgaagtctcgcaaaggaaaaagacaagactaaagggaataaaccatcgttgtgtgggcttcttcttccactcagcatctcctcccttattaaaatgagagggataacttaagaaaaaaaaaaaaa

SEQ ID NO: 3485 - DNA, 629 bp, Homo sapiens
cctgctgggaaatcattaactgggctactttaggaagaggcaacgtggctatatcagaaaggctgccatatgtgaaacctcactttctgcctgttgaaatttttgtatttcaggtctcccagggacatgtccaccgtgctattgcgtaattttatcagcatgaacttctgctgaatatttttccttcttttcaaaatccatattttaatagaactaacttcaaaacttaatgttgcaacatctgtgcccatatacctgggagccatagaagatgtatcctgaagattatctacattttctattcttataaaatgctacaaaaagagagaaaaaggttatatatttttcctggtctggatttttttttttaaaggaatcactttctgcctccttaaaaggagtcttaaaataaaagagaaggaatacttctaaagctataaagaatatctttacaaatgtaataaaatactcatttgttttgtttacagataattcctaatacatatgtacgactttccattaagacactattttgtgaatacaaaatctggaactatagcctcgaaatgttttcaaacaagactttttaataactaaataaaaagaaaaaaaaaaatggcctcgtggca

SEQ ID NO: 3486 - DNA, 392 bp, Homo sapiens
ctcagactacacagcataagaagtgtgatgaagaagcacgagaggaagatggaggagaaaaccagtaagatgacggttatctgcagaaaagattgttttttcaaacacaattttaaaagtcttcctttctaaactccacatctgtctgccacttttcaccagagaattaagcaaaggcatcactcctcagtagaagaacatttttagttatctggaaatataacttcatggacgtacaataattatatctagtaactttaagaaaaactccagctgtgatctgacattaaactgggctcccagggtctaaatgggcttttgccaaaaattaacaatggtgaaacaacttacttttgcactctagccaaacaaaaataataaaaaaaaaaaaa

SEQ ID NO: 3487 - DNA, 857 bp, Homo sapiens
  misc_feature (1)...(857): n = A,T,C or G
ctcaggatacatggtccgagcagtctatcttcatcacatgcttgtgcaaccacccacgctggcatatactacaacactgtgtgcacatcccgcaaggctacttttcgtaggattactcaacagcacaaatgcaccaactgtcactctatgttctcctatacctacaggaggagtgtgcaggtgataatccagagaaggaagtgtcatctatcaaggcggagttcacagacaaaaaacaccgtacgtactctaagagcactcccttgctgacaacaaatctaagagatgagaaaggaggaactctcttgcctgcttttgtctggagacccttcctggattcagcttcctgataggagtgaggatctggggtgtggcgcgacacccccacnnccactnnccgaccttccacctccaccctaccctccgcaaaccggccacccttctgctgtacctcgctcaaatcccctccccacctacgaaagacagacggacattgcactcactttcttcgcctcttgatattccattcttttctaactctccagctacatcggatattcccttactacaccacacccgccatccaaccccccttctgccccccaatccccccccctcaatcccttcatcttcttcccccccccccctaaactacagttgccccaccctttcccaccactcccctcctcccttgccgcccccaccaccccttgtttcttgcccccccccctaccccacacacctccgcgcgcctctcacccccctcacgccccacccccccaccactctctcccccgacactaccgaggctcaacatcacccctccccacatccacccacccacccacccctgcccg

SEQ ID NO: 3488 - DNA, 742 bp, Homo sapiens
ctcagtatgccctttagaacttttctccctcaaatcaaatgaataccagcgtggaaaatagaaaagattgtggtagtagaggaaagaggagggcacccagtagacatcatctgttgtcaaagaagtcatttggaaagtaatcagacatgaagcccaatggatggaaaagatgtgatattgatttaacttgattgcaatttattgtacattatcgaggagatagattgttggtcttacaatatgttatattgtagatcaacccagtgtgaaagattaaaacgtgcatgcgtgtgtgtgtgtgtgtgtgtgtgagtgtgtgctggaagggggtaggggagaaggcagagattatgtggacaagcaaaacttttgtagctgaactctctatccagacataaaattagttgcccacaattttactcctggttaattccaacaaaaaggaaattgtaacagctctccaaaataacatatttgtctgcatgtttacttaacatttatcttacacgtttcttttgaagaattcaagatagaattagcaatgtctggaaacttacataattagccaaagatcttgcacttttggtttcagtgccttttaagtcaggcttgctttttttttgttttgtgttttttttttttttgcttaaaataagtattattatgttatgtacttattgcaaaaataaaccatctgtcttagtctgcttgagctgccataacaaaaaaaaaaaaaaaaaaa

SEQ ID NO: 3489 - DNA, 696 bp, Homo sapiens
ctcagaaggcaccaaatgtgatagatgtctctgtttatatatgtgattacataatggaggatgtggctttcattaggccaggggactctttcttttggagactgaagaggcaagctgtggactggaagctggtgtgtggtgaggaccccattgaaagcagattacagcagcctctatcgcacagcgacacccttatgaaggtgtagctctctatcaggttgccagtaagcagtctggatccttctattcttctgagcccctcttgcatacctgggttcaagcacatctaagtatcactaaatcctgctacacaaagagcattccattttactgaaaatagaagctaaaaaggagcccacaagagccgatttttttttttcatttttcaacttgcaggaagtatttttaacaacttcggagaatagagcagtcattttcaaaattttcctttccttcacatgtgttcaaattttctttttttcaaaaattttagtcctcatactgtgagttcttcttagtagtactgagagtttagctcaccatgtctctcaagacagtagagaccccacgggtacttggacttgcagtgccagccatgattttccaaaatgtttacagtggccctgaaggcttttactctaggcttttgctgcacatgaaataaaaagatttttagcataaaaaaaaaaaaaaaaa

SEQ ID NO: 3490 - DNA, 149 bp, Homo sapiens
cagaggcaggagctggcaggctgcagaagagggaaaggaggaaacgcagacttcagtgtgtcttcttctgtaccttgtgaatgtgctgcaagtgtgttattcctggtgcgttattgtgactttattaaaaacatatagataccccaaaa

SEQ ID NO: 3491 - DNA, 564 bp, Homo sapiens
caggcataaccatcttagatcatccagtcaccagtcaacaaacctccagctgagtgagcctaaccaagatcagccttgccctgtcccaaccagaagaaccacccagctgaccctaggctcatgagcaatcataaatgtttattgctttgctccaccaagctttgaagtggttttctttacagcattattgtggaagtagataaaaagtgatttagtaaatttttctgtttgatttgtgatgtatcctttttcattctgcttcttcacatgctacattctgtatcacctccattgttccttccatctatccagtctttttttgccaacaccaccctttttgatttttcacttttctgtatattccaatatttcattttccaagaaatgggtattaaattcttctgccactttctcagcatagaggatattgtatgttttttcttattggttctattgatgtaatgttatatattcatgatttaataaattaaactgctcatgaattcatgcaaataggtttttctcaggaattcatgagacaggtctcaaaaaaaaaaaaaaaaa

SEQ ID NO: 3492 - DNA, 699 bp, Homo sapiens
ttagaataaagatgtatcaaagaacagaaacaggaaaagcggttaatgtgatcaagaagaatcgacctgaactagatggaagaagtgtttagcaaaacataaaatatacctaaccagagaattttaattttcatttgtaaatgaaatcaatgtaaatgaaatgtaaatgtaattcaggagatgccttgagtgatggagctgcagaggtgtgaagcaacagacatatggatcaagttcaatatgggaagacaaacagactacgggaccctgtgcttctacctggaatgactacttggtatttggcacctaaatgggagtgggatgaactgtgatttggtcactacctgtgattctacctgacttcatttgtatgtgactgctgaggaatgttaataaggacacatattttagaagtctgaggccggtggatcacgaggtcaaaagatggaggccatcctggccaacatggtgaaaccccgtctctactaaaaatacaaaaattggctgggtgtggtggtgcacccctgtagtaccagctactcgggaagttgaggcaggagaatccttgaacctgggaggcagaggttgcggtgagccaagatcacgccactgcactctagcctggcgacagagcaagactctgtctctaaataaataaataaataaataaatacataaataaataaaaaaaaaaaaaaa

SEQ ID NO: 3493 - DNA, 755 bp, Homo sapiens
tttttttttttttttttttttttttttttttttttttttttttgtttttttttttttttttttttttttttttttttttttttttttccccaaggaaaaaattttttgggggaacccccttccccccccccggaaaaaaaccccaaagggaaaaaggggcaaaacccctaggggggtccccctttaaaaaaaaaaaaaaaggggggttggaaaaccccttgaaaaaaaggggggccccgggcccccaaaaaggaaaaaaaaaccgggtttaaaaaccccaaaattgggaaaagggtttttttaaaggggggcccgtccccaggggaaaaatttttccccaaaaaaaaattgaaaaaaaaattttcccctaaaaagggggctttataaccccccaaaagaacaagggtgaaaaaaaagccccctttttaaaatggttttttgggggaaagggggtcctttaaaaaccccccaaaaaaaaaatatggggtgggggggcccttttttggggggggaaggggtgaaaattttcccccccacaaaaaaggggggggggaggggtttaaaacggggaggggggggggccaaattggtgttaaaagaaaaggctgtgtaaaaccctgaaaaaaagggttttaagaaaaaaacccccccggggggggggggaaaaaaaaaaggggggaaaacctttttaaaaagaaaatttgggtaaaatttaaaaaatcccggtgccgggggtaaaaaaaaaaacaaacccc

SEQ ID NO: 3494 - DNA, 893 bp, Homo sapiens
cctcaggatcaacctattcttatttaagaaaaacaaaaagatagctacagcagatctcaaatcaagatctccagcagcaactaggacaaactgtcaccaagatgtctaataatgttaaacgaaaatgttgttatatgaaaaccttgttgatagttctatcatttataatgtacatattcagtgaggattttaataattatatttaaggatatttataattaagtatctttaattaatttataattatctttaattataatattttatgtatatttcagtaatatgtattatatttaagtatatgtaataataaaatatagataatatgtgcccaaagacatttctttatgtacaaatagtatgcattttctggcttatgcaggctaaactattctaacatctttaacgttttctgataatggtgaatgtttagattttgaattatttttgttgctgaatacaaatattctagcttttttcaaaattatgaagttcagagctagatacaatttttagtaagaacctacacacccatgtatggaaatgaagatacaatattttattgtcgttcttatgtgctatatttgtatcagagtatccgagtgtcatactaattcacattttgtcactgttttaaatgttatctcttgtacttccaaccaccaatggtagattttaacctaagtcttatgttaaatgttataaaagaaacattttcccatattgttataaatgtctaattgtttaaatggcttaataatattccactgtgtcaatgcaccataatttactaaaccatattcctttttttcttattgataatttggttgctttcttggtctttgctactaaaaataaataaaaacataaaacagtatataaaaaaaaaaaaa

SEQ ID NO: 3495 - DNA, 332 bp, Homo sapiens
aatccttgtgggtaacgaagctactgaccaggaggagatttgatgaagatttggaactgcagatttggccaaaacatgttttgcctcaaaaattggtatttgaactgaaacagtggacctttttgaactctattattgaaggatacattttcatatgctcaaagtgtattcacacgttacgttgaagacaaatattgatctagtttttcactgatttttgtttactactatttgcaatgagaatatttgtgaaattatgtctatttgcaaagtgcaaacaaaaatatttcaataaaatacatgagttgttagtgaacagaaaaaaaaaaaaa

SEQ ID NO: 3496 - DNA, 640 bp, Homo sapiens
gagacaccaaccaagactttttagctggactacagcattgattaaactcgctacctgccgccttctgctcttgccaccctccatacccaaagaagaaggaaaggaaacaaaccttatggactatccacaggataacacaagaagagagtaccacatctcaagaccacaagatggcttccaggggcaatggggaatcaagcttcattaccatattttacaggaaagatgttccataatgtcatctctagactaagcaaattcaacgtaaataaaaggtgagaaatttcattccagtagagatacgaggcaaaaaaatcaatatcaagatgatctgaagattattgaaaatgtcagggaagtgaaatgccttttccaaaattaggtttctttgcaaaagaaaaagtctaatatgatataaaccaaaatattaaatattttgactctataggttggaatcttaaggaattatgcttttatagtaattctacaagtgaattattacttctaaatttcaaaaatgaagagaaaggcagtttcaatggactaaaataagttatttcttttttaagaaaaggaaaaagtttaacagatgtctaacctaaatattctaaccaataaaaaggtggcctcgttggcctca

SEQ ID NO: 3497 - DNA, 837 bp, Homo sapiens
cttagaagttacctgtgcttcatcatttagagagatgaaatccattaccaggatgaaaagaatattttataggattggaaacaaaggaatctacaaagccatcagtgaactggatattcttctttcctggattaaaaaattattggaaagcagtcagtaaaccaaagccaagtacattgattttacagttattttgaaatacaataagaactgctagaaatatgtttataacagtctatttcttttaaaaactttttaacataatactgacggcatgttaggtgattcagaatagacaagaaggatttagtaaattaacgttttggatataagttgtcactaatttgcacattttctgtgttttcaaataatgtttccattctgaacatgttttgtcattcacaagtacattgtgccaccttaatctaaagtatgtaacccgaattaactcgcgtaatattcgtgtgaggagtgggatgcccgtgtattacataaaactacaaaaataaatcccaacattctacagacaccacttattacgtatcaaccagcaattcccccccaacccgctctctcactccgcccctcgaccacccttacatataagaccatacccccatgcccctccaaacgccaccccctcattcacaatcaccgtttgaattactcccccccaccccccccatacatatcaccaccactccacatgacaccacacctcgaaagtacatcttgtacattcgtgtatctgtgcactcacacccctacatgcagccctgacgccggacttattataacgcaaaccttcaaccacacacaaactatctgaacactatt

SEQ ID NO: 3498 - DNA, 723 bp, Homo sapiens
cctcagtccacaataagcaggaagattcagagcaagtggaggaggaaagtggaagaagaataaatgaaggaacgtgtcagcttgtctccctactgctgctctgcaacctgcggtggagagaagtgataaagaggacattacaccgaaaatattattggggctagaaattgtctttaaaaagagaatgatcttagaagcaaaatgaccccaaatcattgtgatttaccagattaaattcttagtcaattagcaaagaaggtatctctgataaactgaattaacagactaagatggcagagaaataaagcccacttaagaaacaatttgcacttcatttgttgggaaacaattttaaaaaggaaattaccatatcttatttaagtttacacccttaacaactggtcaagagtctgatacctaagtaaacattcagtatgttctgttaaaacagaataaatacatcaattaattctcctggaaaccaaaattaattatgaaacaaaataaacatgtgccttatcatgcttgcagaaagaggaaaacaacaaatatatgtgaagactgaagtgcagccatttgagaaatactattgttgttagacttgtgatttctcaggagggtaatcacactccagctacctttgaataacgtcttgaatttactagatgtgaaatatatttccctggaaaattaaaatctccaccagaaaaaaaaaaaaaaaaa

SEQ ID NO: 3499 - DNA, 547 bp, Homo sapiens
tcaggaaaaaacattatttttagaggcttatacatgtgatggaggaggaagctgaggaagagaaagaacaggagcacaagaggataaggaatggaaggaggcttttctgaagaccattcaggtgggattcaaactcagggttttgcagctttgacactgaagcctatgctttttccaaagacacatgcataataagaacaggaagaagcctgcagcctgggactactggacactgtggctttcccactcccagtagggaactaaagggaagaaacttctgaaggagacgttgcaggagcagccacatagagaacaggctcttctatagcaactcacactggatcccctgcttactataaaggagccattgacatcagcatggttatcaaaacaagctattgacttaatgtcatgtagtctaaaaccatcacctcgacttctgtcatctgaatccacacaaaggatggttcttatttcaaacttgaaatcagaattcctttaaggatgttgagatttgaatcacttgtatctggaaaaaaaaaaaaaa

SEQ ID NO: 3500 - DNA, 508 bp, Homo sapiens
atggcagcttacccagtcacatttaaagttatctgtgaattgtataaagtcaccatcaatttcgagcaatggcctctttgccttaggccatcactggaagcttcctgaggcctccccagaagctaagcagatgtcagtgacatgcttgtgtagcctgcagaaccatgagcaaattcaacctcttttctttagaaattaaccaatctcagatattcctataagcaacacaaagaatttctctgttataaaattctatttctattctattctatttctgttataaatttcttgtgaagtcatgttaaaatatattattttttcctgttacatctttaataaattgaaaaatttagagaatacaaaaaatcaaatactagattcaaaacaaaaaaaaaatcgaaaatgatgccactccagctaataaatttgtgttattcacatggctgtctttctttacctcataattcaaaattaaaatcattaagctataaaaaaaaaaaaaaaaaaa

SEQ ID NO: 3501 - DNA, 251 bp, Homo sapiens
ttcagggtgttctgaagttcaaaagataggcaatatctgaacagcacaaattcccaaggggagacccagcacctgccatgggatgcaaaggttttataaatgttgtcttgtgtaaagaaaatggcaaacattgtgaggccttttgcaaatatgcctgcctgcttctgtgtttgagcagaaatattgaacttctaaccattattattataaaataaaggagattattctttaaacatttaaaaaaaaaaaaa

SEQ ID NO: 3502 - DNA, 605 bp, Homo sapiens
  misc_feature (1)...(605): n = A,T,C or G
gtatttatttttaacaaacaaacggaaaccttgagggggcatttcactctcgtccccaggctgacatgtaatgatgcgatctcggctcactgcaaccttcacctcccaggttcaaaataataaaataataataatccttgctcaacaatgcttaggaatttcaagaaagtgcttgtctcttccagaagacagtgagcacttgcaaaatatttgctcagctctcgtgggtgagagcataagaatcctcagtcataaccacttgggcaatcctagcccaagaaaggccctgcagtcccgaccatgcttggccccctgtcaatgtgccacaggctggggaacttaggcctctctgtgcatttttggttcatatatataatacagaatgtgggaaaataaagaagtagattttttaaaatatatttagttctgtgtgtatggtaatgttcatgttttaatttgtaattaaaaggctggaataaacaatatagaattaatgttacaaatattttctccacacgccccgtatnattatattcattgtttgagtgaaaactttaacaatacaaaataaacaagaatcatcttgctgaaaaaaaaaaaaaaaa

SEQ ID NO: 3503 - DNA, 414 bp, Homo sapiens
ttagctacctcacatgaagattacaagaaggaagacctttatgatgatccacttttgcttagtaaatgtattctctcttccttataattttcttaataatattttcttttctctagcttattttaagaacacagtatataatacatgtaacatataaaatatgggttaattgatcgctcatgttatcaataagactgcagtcacagtaggctattagtagttaagcttttggggagtcaaaagttgtatgtggatatttgaaagcacagttgttcgtggccctaaccctctagttgttcaagggtcaacatatacatggcccaggtataccaccaagcattgcagtttcccagaactctctctgaaggtaggactattgtaataaaatatcatcatttaccaaaaaaaaaaaaa

SEQ ID NO: 3504 - DNA, 190 bp, Homo sapiens
tttttttttttttaccaagcaagatgggtgtttatttcatgatcacttaacagtgtgggtgtaagcagttcaggactgatatggcaatcctaaaatttgagggatgcaggctcttatcttgttgcttcaccatcttcagggtgtttctctcacccctgtgctttaggtggctttccacaacatccataat

SEQ ID NO: 3505 - DNA, 445 bp, Homo sapiens
ttagagaaacaagtaaggatcttagaatgctgactcacagttgatggctttcaataggtttctcagcatgaaactgccttcacctcagaaatacccagcctcaaaagcatattcaagcagttcttcatgactcccgtaaatcgagccctcatcattgagccatgggagcaaatgaatattctcttttaaagagtgaacaagcaaatgcttggaataaaaagaaagaattacattgaatcttttaaaagactcagttttccaacctgggctggctaagcagcagcctgaaggaactaagacagccctgcatgacctggccgctgcctgctattccaggattctctcctgcagcttctcgcctcgtttattctctagtaatgcagaatagcatgtggctctacccatgttctgacagactgaataaatactgaaagaatgcttaaaa

SEQ ID NO: 3506 - DNA, 221 bp, Homo sapiens
ctcagagatcgggtctcactatattgcccaggctggacgtgaagccctgggctcaagcaatcttcctgccttagcctcctgagtatctgggactacaggtgcacacaactgcacccagctcagggccgtagttgatgagacacatgagagatccgagggtaattcttaaaaagcaaaggtaattaaacgaaagacaattggaaaaaaaaaaaaaaaaaaaa

SEQ ID NO: 3507 - DNA, 151 bp, Homo sapiens
aggagatgacaagacctggaacagacccagagataaaagtaatgttttcaggatggaaaaaccaacctgtcaactatgaactactcacctatggaccagtatatgaggaagaataaactttgatgttgttgaaaacttaaaaaaaaaaaaa

SEQ ID NO: 3508 - DNA, 564 bp, Homo sapiens
ctttcagggtatactctggctgttcctttgtttgcccgtggtggccagcatgtttgcagttgggaggattcttcaccagtctaacacatgccacagttttctaggtgagaaacccagacaaggctggcactgcacagagatggaacctgatgaaacggccccatttgagcgcctgctgtatcgcgttggctctgcttcctgcagctgtgctccaagatgagcctttcagacatcgctccctaatagctccatctcccccagtccaggaggatgcgcattcctctcctcattcacatgcaccacttcaagccatctgcacgctctacaggggacttgccgcctaacatcctaatgtgcaaccccatccaaatcctctgctggaatctcactatttgcaccacttacgctcctggagcgtgaaacagaagggccagtcctcttgtctctttattctaagtgtttaatacagattccatggacttggtccataacaataaaaaaaaaaaaaaaaaaagaaaaaaaaaaaaaaaacagaaaaaaaaaaaaaaaaaaaaaaaaaaaaaa

SEQ ID NO: 3509 - DNA, 313 bp, Homo sapiens
ctcagacaagcatattgctgagatgttgcccagattggtctcaagctcccaagttcaagcaatcctctgaatcctctggcctcagccttccaagtaactgagattacaggcatgtgtcatggtgcccaatttatcaatgcgatgtgtctacaagtggagtggcacattcaaatatttgttgctgttgtcatttgtccattcatttgttgactcagtagcattaactgagtgtctattccaatgtgcagacactatgccaggtgctcgggtggaaggaggaataaaaataatggtcataataaaaaaaaaaaaa

SEQ ID NO: 3510 - DNA, 593 bp, Homo sapiens
ggtttaacatccagcaggcaataatgggttgccaaggagccatgagagatgtgtttgagacaaatagatcagagagacagaacccagactccggaacacccgaggcaagcccacgatgccatgttgagcagtcacagagccagccattgttgggagacattgggggcattaaggaaaaccacatacaaagccacagctgtcactgctcccatcatcccccacatgtaaggctgctccctccactccccgacccaccaggtatttctctgatgccactgcatatgtgattcccttggcccagggtaatctttgcacatctcttcctacataatagtcattctgaaagactctgctccaattgcaccttgatcaagaaaacttgtctgaattctcactctgcatactgggagaaccctaagctggcctctattttaacccccagacaaagcctcctacttatttgaagttttgcacacagactctcagatcctcagaacaagaacctttcttcatctctgcatgtccttctaagcgctgttccttgcataaaaaatgaataaacaattttcacgtctaaaaaaaaaaaaaaaaaa

SEQ ID NO: 3511 - DNA, 514 bp, Homo sapiens
atcagtttgagatcctccaatcaataaatgaatcccagggaatacactgacgacaaacttatcaaaaatacattaagaagtgaactattatgtgctatgtcatctgtgcctaaatgatgcctactaaagaaatgtcattcaaaatatatttgctggatgtataagtgaatgaataaacaaaattattttataggtattcactgtccaaaagttattcttgacagtggatttgtactgactactgttatttaaatcataataaaatatcaaccactgcactaaaataataacctttaatttaattggatataagtaaaaacataaaaatataaaacaacaacaatgaaaacattcaaggaatccaatggctgtcaacgtaactgttcttgattgctgcatagttaccttttttgtggggtggcaggggccgacatgcaactgtggagtcctctcctaattaagcagcttgaaataaatatttttaaataaaatgtgttcagtaaaaaaaaaaaaa

SEQ ID NO: 3512 - DNA, 396 bp, Homo sapiens
cttaggctcctccagatctaaaatgtgcttcaagctctagcaggccagaatgagagatctgcaaggtgtgatggacagatggataaatgccgatgcccccttcatcagttcctctgtggaccgaagctccctgcctggcccatggatcttttcagaccaggctgctcattgaagctttcccttcaccttctcccatgtgctggcctcattttagcctgacttctacttcctgaatcaaccccatgccttccagatgttgattttatgcttttgagcacagtggaccttattttattcagtatgtaattatttttatctgatatcttggaatacacccctaggtcttctttatgaattgtactccatttctgaatattatgaccaaaaaaaaaaaaa

SEQ ID NO: 3513 - DNA, 793 bp, Homo sapiens
atgaggacacatatctttgccaattttgcatgactaatttctactcatccttcaagtaactgttatgcagttcttcctctggctccagaaggagttgagcagacaagcagacgacgagacaaggagacaagcagatgaatggtataaccacacggcaaagagagaagaggaggaacgtctgaacgctgagaggtgtttgactgggggtggtcagagaggagttcggccgctggactccaggggaatatcatcttcccactccatccccgcttctgggtccccatccatcctactgagagccacctccaccactcaataaaatccccacattcatacttcaagtctgtgtgtgacccaattcttctgggacgctggacaaaagcttgggatacagaaagctgtcacactggccctctgccgttgcagaaaggcagagtccactgagctggttaacactcaagctgtctggggacagcaaggcaaaaagagcacactgtaacacatgcccagttgggctcctgcgcctctttgtctgcgtgctccccctcccataaggggtttgggcagtcatggcaacaaaacagatgagccactttccttttgcacatgctgagtaagggatctgggagctggccctttataagtacagattgctattgcgttttgggttccgttatcatgtgattcatgggtaaagtgactgcctactttattgttactggcaggggccagtggattgtttggattatgggttgtgtgttaatggagtcccaggtaaatctatgggtggaga

SEQ ID NO: 3514 - DNA, 168 bp, Homo sapiens
cttaggctacaaatgaagctcattgtgactgcctcttgcatctccagaagtttgaatgcagtgactccaatgaactctacaaaggagtgataattgcactatttttaaaaggctggctggatctattaataaaaaagtgtatattgtatatatataaaaaaaaaaaaa

SEQ ID NO: 3515 - DNA, 732 bp, Homo sapiens
gtctgacccagatctccctggactaaactcaagatgtcatcagaggctggagtgcagtggtgcaattatggatcgaggttaactgtagtctcaacttctcaaccttgtgaattcaagcaatcctcccacctcagcctcccaagtagccggaactacaggcatttaacaccacacccagctaatttttaaaaaaatattttgtagagaccgggtctcaccctgttgcccaagctgatctcaaactccatggttcgacctcctgatgcccaaatcctggaattacaggcataagcctctgcacctggctgctttcttcctctcaagagcttttcagaattcaaatggtttgaaactttattgagattaaagtgatcatttttttttctttctttctattttgttattattgttgtcgttttgagacagagtcttactctgtctcacaggcgggagtgcagtggcataatctcggctcacggaagcctccacctcccgcattcaagtgattctcatgtttcagcctcccaagtagctgggattacaggtgtgtgccaccatgtctggctaattttgtatttttagtagagacggggttttgccatattggccagccttggtctcgaactcctggcctcaagcgatccacccgtctcagcctcccaaagtgctggaattacaagcatgagccactacacctggcccaatttttttctttcatggctcaagcctatg

SEQ ID NO: 3516 - DNA, 899 bp, Homo sapiens
ttaatgacaagtaaagtaaggacaaattcaatacatttaatgttatggaagcctgtgctggtcactctttgggtctgtgctgcctttatgagctgtaacactcaccacaaaggtctgcagcttcactcctgaagtcagcgagagcatgaagccaccgggaggaaagaacaactctggatgcgccaactttatgaactgtaacactcaacgcaaaggtctgcagcttcactcctgacgtctgtaagaccatgaacccaccagaaggaagcaagtctggagatgtccgaacatcagaaggaacaaactccagataaactgtctctaagaactgtaacactcactgccagggtccgcggcttcattcttgaagtgagcaagaccaagagctcaccaattctggacacagcaccattattcacaacagccaaaaagtggaaacaattcaaatgtccatcaactgatgaatggataaactgtggtatatccatagaataaaatattattaggtaataaaaaggacttaagtactaacataagctttaatgtggatatcccttgaaaatattgtaaatgtaagaagccagaaacaaaaagccagatgattccattcatatgaagtgtccagcatagacaaatctgtaaagatagaaactagattcatggtttcttagggccgggagagcaggtgggaaaggtggggccatggggaatggctattaatgggtataaggtttcttttgagggtgatgcaaatgttgtaagattgattgtggtcattgatgtatagcatatgattatactaaaactattaacttgtatactttaaataggtggctgtgtggtatgttaattatatctcaataaaattaaaaataaaacagcaaaaaaaaaaaaaaaaa

SEQ ID NO: 3517 - DNA, 284 bp, Homo sapiens
ctgggtgctgtgtaaggttggcttgttggtagtgaaagtggcagtaggaagatgagtcatccagtaaaatggctggaatgtggacatggaaggggctcagcttcaatcatgtgcatgaggacagtactccaaggaatatcagagaaattggtgaaaggaacctgggaacctgaatgctcttaagcagagccatccatctgctgtggattgcctactgccatttggactcccttgtgaaagaaataaattaaattctctctacaatcactgtaaaaaaaaaaaaa

SEQ ID NO: 3518 - DNA, 555 bp, Homo sapiens
tttcctgtgacatgggatattcgaggtgaaatccaggaaactcccaggaaaaccagggtgattggtcagatgagaacagagtatcagtgaagatacaacttcaatatcacagagcttgaagaaaggcaaaatgtccagaaaaaatagagcacaagaagagagaaaagcaagaagagtcagaaggaatgacaaattgaaagaataaggcccctgaagagttcttatgcttaattcttgcatggtgcatatgtttccatccttttactttcaatacttctgtgtttttacatataaagtttgtattttcaagaaagtattgggtctaacagtcatattgaatctgccaagacttgtgtttttgcattattacattaatgattattatgataaagttatctttaatttttcacagtttatttagagttaaaattgaatgactttatataaaatgttacaactttgaaacaatactattttatttgcattcatattttgtactattgttgtcccacatattatatctacattcataataaatttcacattattgcaaaa

SEQ ID NO: 3519 - DNA, 796 bp, Homo sapiens
  misc_feature (1)...(796): n = A,T,C or G
ctcagagaacaggctgtaagaacttgtgacatgaagaagtcattttactctcaattaatccaggacttactgacccagcactgtctgagaattaagagactcaaaggaagctgtgattaccccaactcgagttgcagagaaaagaataacgtgccggaaagtcagaaaccaggcaacatcgcaacatcaggatgaataaagaactagactgcttgagtccctaacctggtctgccacttacaggctgtgtggcctaagctaggcaagttctttaacttctctgtgcctcagtttcctcatctagaacatggcaataaaagtatctatcttgtataattatgtgcagtcaatgacgtagcccatggaaagtattagaaagggcttggcatgaggtaggcacctcacatacaatatcggtatcaaattaactgtaagtgatgtgtggtcaagctaagtgctttaaggaggaagggcagggaaggcttcgtggaagctgtggcacctgagctagatatgaaagcacaagataatccagacactcagagggaagcacattccagacgtggacagccattactgcagaaagtcacagacagagtaaaaaccaggaacgcttaaacatcaatgaaggaaacaagctcaccaaagctgaaggggtatttggtaaccccacataatttgggagtgatggggaaggctctgcacacttgttgctgngcttctaggacttaacattcagttaatttttagtcacatgtcctatgtatgcaaacttggggactatggaagcaaactc

SEQ ID NO: 3520 - DNA, 578 bp, Homo sapiens
aaaaaatagagcacaagaagagagaaaagcaagaagagtcagaaggaatgacaaattgaaagaataaggcccctgaagtgttcttatgcttaattcttgcatgactgagaaatctggttggttggcaggtgctgaaatctctactgctgctctttcagccttccagctgttgcttatcactgggtcccttgcaaataccaaatgaagagaaaagcaaagatttgagtgaagtttgtatgtagatttagggctcactctctatatctgggttatctttctgtttcctctcaatcttataaatgcaaactttattctttaactattcaagccaaaaaggttgcaaatttttgtttaaatcctagctatcttatatttagtgaactggaatttgtgctgattgaaaatacagatctctctccattctcttctttcaaggatctagtactctttagtttctggtctttgttttctttccattgtcaatttttattgtatgttaggcttatagttcatattttacctataagagagtttgtttaataaaatctactatgctatcattggaaaaaaaaaaaaaa

SEQ ID NO: 3521 - DNA, 605 bp, Homo sapiens
ctaggactgccccagtctacacaaatcccttccttctagcagactgagtcacacaagaataaggagagtgaagtctacaagttggggactagagtgaatcgaagcttttctggaaggagctccgtgaacctggctttgagaatctataaaaaacaagccaagtaaaatgtccaagaggtagtggtgctgaagaatccaagaacttttcgaaatactttacaaaactatcacaaatgtattccaataaaacattttgcgatagcaaaactatctctctcaaaaaatttttgacggtgtgaatctctgtatattaagataattttacttccatttggagatccatccaaaattgcacctttgtgtaatacctgaacaaaggcaatcagagttaatttctaataatggctctaaagtacccacactggctacaaattattttgaaatatcaaggtggccaagacgttgaaccttcctgtatgaccagacaaagattaaatgtgtgtatgttgtcacttaaggcaaattaattttgctccaccgcacctaagctggtagaccataataaattataaaactcaaaaaaaaaatccggcttcttggcccca

SEQ ID NO: 3522 - DNA, 628 bp, Homo sapiens
tacttgatatatagttattattttaatatttcaatacccaatgtccctctatatttgtgtgtcccactcaggaactgtaaactgactcacagcagaagaaaactggaaatgagcagatatgtgacccaccaaagtcaggcctttgtcatcatctaattctcagcgctcagcatggtgtctggctgtgagaagatgctcccataaaatttatctttaatgaattactgctaaacagagagaaaaaaaaatcacagttatattgaagtaggcattgatcaatctcattgggagaggacttgaaacaagatattatttttcaaatattttgcaaataaagtcagtggtaaatttgattgtatttgattgtaaaatttttagttttacttgggaagtatttttatatttagccaactgtgtgtcctcaaccatgtataacagtttatctcaaaatttatatttccctctcatgtccaaataaaaatagtttagaaagtttttgaaatggtgtatatatgttggcaatttgtgcaaaactggttctttaacactgcttggaatcaaagtaaatcaaagtaaaatatttacagaaataaatatggttttaacaaacatctcaaaaaaaaaaaaa

SEQ ID NO: 3523 - DNA, 364 bp, Homo sapiens
ctcaggatgacgaggtgcatcacttgacatccagcccccgaccagggacctattcagaagcacgaactgcaggctgtgtcccaccatggatcacattcagcccagactcagctccttctgcaaccctgccaaagagcctacgaatgacggccccatagcccaggccactctattaatgaagaagagtgcactgggacacttgaggagaacctgttttgtctcatgtttttgaagcaggagtaaaaaatggaatgcctcaaaatgctacaatccctctatattcaggtgagggagattcttgtaattctgtgggttatgacatgatatccattaaattataagaactatggataaaattattaaa

SEQ ID NO: 3524 - DNA, 413 bp, Homo sapiens
ctgactttccctcttgttgcccaggctggagtgcaatggcacaatctcggctcaccgcaacctccgcctcccgggttcaagcaattctcctgcctcagcctcccgagtagctgggattacagacatgtgccaccatgcccagctaattttgtatttttagtagagacagggtttctccatgttgatcaggctggtctcgaactcctgacctcacatgatccatccgcctcagcctcccaaagtggtgggacacagagccactgagcctggcctatatgcttgtaatttcataaatgctggaggaaccattccaatcatggaaagctgcaaagacaacatgttaatgatcaacacctgtgaaaagaagggaatgaaaataaaaattaaagagagaaaaaggaaaaaaaaaaaaa

SEQ ID NO: 3525 - DNA, 903 bp, Homo sapiens
tgaggacaagaacctggaactcaccaacctgtgggagtgaaagagctgtaatgcttccgtttgccaagctgcaggcagcaggaataaaagagctgtaaccctctctcctgctcaatgaacaacaggagagaagaagctgctgggtgccactccctcctgcttgccaaactacaggagttaaaaagccccaacaatggtatccttggagtatattttaattcttccaagagactacttgaaaaggatggcactatttagatgtgtgggttcttgggatatttgtttaaataatgaatcttcatatgtctattatagatctagatcttctggaaatgaagactatccaaatgagaacacacaggtctacagtaagggagtcagctgcatcacttgtattaatatttagcagactcatagacaggtggaggagtgggcatcctccatggtaaaaagagaagcttcaggtatgccctgattggaggtcactggcataggccattcagagtcaggctaaatagaagtggcgcatcttatatgattgttttgggggaccatatttgaccttctctgagtagttcagagttacaaggggaggcaaaaaatagtgaagctgaccaccattgatcaagtccttattgttctgggtcaattgctgcagaggttgtgggtataaaccaaaaataaaattctaaggccctccagtcatctgagtggacctccttctgaatcagtgcactctaaaatttaccctgaaagactggttcaggccatgaagggaaggagagtcagacttgcctcactatatcctccacattcacattacacagacttaagtctgatagaaaccttacattattatttttgagcctgctactgaggctcctctgctataaaccttatctc

SEQ ID NO: 3526 - DNA, 763 bp, Homo sapiens
tttcagcgtcagagagatttctctggatgcacaattcccacctggcaacttaaaaccaagtactcgagcagcagacctataaggatctctctgggcctgccactgtgtgctctgccgaggatgacagaggacactgcgtttgctgcctttgggatatgaagacctagctgttccatagaggatggaaattggtgtagataaccaaagggtcaccagcttcctgagccgtgagacttggcgatgttctaagctttgattgttggagatgaaatgtttcctgctcacactgagcaaagagatagaggtctttgtgctttagcacaggtgtctgccaggggctctctctgcctcgctggcagccctactaacaaaccacctaaaattcttgctggaagcagagtgttatatgctatatgaacaagctcagagctgtttggattaggatcatataaggagaaacatacaaataaaaatacaggaatgaaccagaaaagaggaccatgtcttgagtttattgagatgaaatttctcttcgaaaaatatatttaaaagcaagataaatgaaaataaagaagaaagtttgatctcaaggaatatgtcaatgatgttagagatgttctgtgtggtgattactataagaaagccaagactgcgttcattagagtaattgaaaacacctgttctcccaagaaaaggtccgcatctcgatttattttccgaaataatgtggctatttttcccaattctgaatgctcctgcttat

SEQ ID NO: 3527 - DNA, 894 bp, Homo sapiens
ctcagctgtcggaggaaagaccttcagaagattttcttagatgttgatgcctatgaagaagactgagaaagaatggccaagggtgggaattgagccaagaagaaattctcctggaatccagcagcttgggggagtaaaagagaatttccatggagagacatggtctggctatgttgcctaggctgatcatgaactcctgggctcaagctattctccaaacctggcctcccaaagtcctgggattccagcagagaagattcaagaagattccagaagtggtcaagacattgatgttaaacagttaagtaaaataaggactgaaatacatatttgcctctggcaagtaagaagttactgcatgcctcaatgaaagtagttttagcagaatggtggactgaaagccatttataatgggttcaggagtaactcatctgtggaaatggaaactgctattatgaaatgtagttttccacttctaaagatttacttatgaatataaggaaaaagaaagtacaagattttacaagatatgttaggtcaaaggaaaatcgatgttctttcataaaaaaatgactaccaatctaataaacatactgaaaacctatagtaattagtacatcactgatgtatttttacataatgctatcatacgataaattacaaataatttctgtggttcctgtaattagaccatacagtatacgatggaactaaatgtgatgaaaaacaatatatacaagagagttttgcatgcaccaggaactttatcaaaggcatcctggagggagtagggcttggccattccttaaaattaggtggaatataaaaaaaaacacttggtaaaaaggacaaagattttcaggatggcaagaggaataaaggctgttcggccac

SEQ ID NO: 3528 - DNA, 598 bp, Homo sapiens
ctaggtttcactaagtaaatctggaacaccagaaggaatgaagaagtttcatctggtccatgccagtcagttggagccttcgtggcttgcagcttccatcaagctttctttctctcttcatacctcacatagacttttcttctcccaaaggacagatgtcagagttagggttaacctgagtctgggtagctaccttccagagttccactgcacaattctactgtaactatttcctggagttctcccgagtgcaggatacactgcgcagaagactttcctacatggcttggtatttcctgggccttaacccaggaagttagccatacattatctattttctccaatggatccataaacttaaaagagctacagattaggccttggtttggggtggaagatagggggtatggctttcaagtatgttcaaatttcttgtgactgccttacaactcttttctctgccttcttctcaaatagtcttacttagtctgagaatacaactgggtagatgagtctagtaaaaccagtacgtctctcatttttcagtctcctacataaataaaggcttttgaatataaatgcaaaaaaaaaaaaaaaa

SEQ ID NO: 3529 - DNA, 479 bp, Homo sapiens
ctcagtaaagcacgcggtttaaccgtgttatccaggatggtctcgatcttctgactttgtgatctgcccgcctcggcctcccaaagtgctgggattacagtgccaactgacatgaacaacccagcttactgcagcaaaacagatcatatagacgagaaggaaaccaagagacaaggtgaagaatatgtaatattctcaagacctaagccatgatgatgtttctgggactaaacttagattaaagaatctacttcttcttcatttgttttctgtataatttgttattcctttcaacttaaattattttctaatgaaatgttctgcttacattttttaccctcctacaatgagacaaataataaattcataaatattgcttgcataataggggaccaatatatataatgcatatattatataatgtatatataacgtcttttaaatgataaaggaaaaaataatttctaaaaaaaaaaaaa

SEQ ID NO: 3530 - DNA, 709 bp, Homo sapiens
cctgatcaaggtccaagtatgggcgtctgacccagttctggaaaatgagacgctcagggaagtctacttggtgcttctgggaaagctatttctccctagtaagagagagacaccctcttccttactgctggatcattgtggtgaggatctgatgactcacttagaagacatcacctagcgtgctgagaatgatggagcagacagatcaagatctgggtctaggacaacatcactgagtggttgaaacagatctggaagtatctgctttcctgttcactaacaatcaacctccttactctttaagccactgctagcaggttctctgttacttgcagccaagcatatctgtattagttatctactgctgcataaaatgaccacaaatatttcagccaaaaaaaggaaaaaaatgaatagaataaacatggtaattatttaatatgagtgatggatctatacatgcattatactatctcaactgttaattatattcacattttttatgatttttttaaaaaaaaaaacacagaataaatcacccgcaaccctaaaaaaacaaaaaatgggcccgttggccctaaggggggggacctctgcgggccgctctcctttaaggggggggaaattcaatggacctcccttcattactcgctggcctcggccgttcggttgggggaggcgggtttcacttacctcaaggggggattcc

SEQ ID NO: 3531 - DNA, 689 bp, Homo sapiens
tcagacttgcctggggctgcttctgcggcttcgtgttcattacctgcctttgtttttatctgctctgatgaagcggtgatgttctccaagattgatagaaagagcctactgatccaatttctacgagaaatgaagactatcaagcattctaaatttcctaaacattgtacaattgacagttggctggagcatccagaagtttattattgttgagttttatgggctgaattgggtccctccaaaatttgtaagttgaagctctagcccacagtacctcagatgtgactgcatttggaggtaggtctttgaggaggtaatcaaagttaaatgaggccattagagagggccctatccaaaatgactgacatccttacaagaagaggagattaggccacacacacacaggaaggccagttgaagacacaggagaaggggaccatctacgagccaaggagagaagcctcagaagaaaccaaccctacccacatgttgatcttggacttccagcctccaccaggactatgaggaaataaatttctgttgtttaaacccccagtctgcatggtagcctttgcaaactaacacagtgagtgtatgtgtcttagattcttatagaaattttgctatacatctcactctgcacttttaaaataaatttccttttataaaacaaaaaaaaaaaaaaaaaa

SEQ ID NO: 3532 - DNA, 484 bp, Homo sapiens
cctcaggtaaaggttttggtctactaagggatggagaaccacaacctacatgagaagagaagccaactgccatattgtaatgcatccctgtggaaatgttcacacggccagaaacagacttatcaacagccacatgaatgagcttgaagcagattctcacaccctccttctccagttgaggcttcagatgagactgcaacctgggcaatagctgattgcaacttcatgagagacctttagtcagaggcatccagttaagctatactcagatttctcacccatgaaaactgcgtgatgataaatgtttgttgttttaaaccagtacgttttggtgtaatttgtcatactgcaatagataactaatacagatttgatgtggatattatgtctctttagcttcttttaaacttgaacagtttcttgaacatttttattctgctttgtcttgaaacaaaataaatgttttgaagtaaaaaaaaaaaaa

SEQ ID NO: 3533 - DNA, 732 bp, Homo sapiens
ctcaaggatcacaatccactaagagaatcaagaactgctgcacagaaacctttgatagccaatgtcctaatacgaagaagaagtaaatgaacagaaggagacatagactcaaagctctcgcaaaattgaacaaaatatcaaggccctacattgaccaaacattaacattaaaagagcctctgcatgtcagcattccagccagcccaaatcgtcaaagagcaagaaagcaatgctgaagaacaatgtgaaggaatcattacatactgtttgaatagtttcctaaattcactcagtgctctatctattattagctatagcacagagaactcgtttcctattacagatggtagagaatttctagtttgcataaaatcaacatcctctaaagtcctgaaaaaaacatatgtttgcagacgcttacccaaagatagcaacagaacattcattattcattagctgtttcatttcaaattttttatgatctatttgccatatttcactgagtctaagatcttgtggacaaagtcgataggtactctctttgtaaaacagttaagatcagactttaagatagcatgttgtgttgctacatgtaagagttctgtaatctaatgcaatagatgacaaatattggaaaagaaaaaaaaaaaatggcctcgttggctacagcggggagtgtgcggccaagctatatttttccacttacttatgaaatattcctctataacacag

SEQ ID NO: 3534 - DNA, 1228 bp, Homo sapiens
gtttcagggagacacagcaatcaatattacggaaaaagtacatctggttcggagacacatcaatcaacatatggacgaagtacatgggttcggtctggaaaggcgggacaacttgaagcaaaggcaggaagactccaagcagggagggagcttcccggtttcagcttctactcctgccttgaaaaattcttgcctgcaaaccatttgggaggccaggatttgaagatgagctgtctggtcctgcttgtttggcaccctgaaaataaatgacttcctttctgccactgcaacctcagtgtggatatctggttttactgtgttggcttctgccacttctcccaggatcacatctgcagctgtcagggcaagtggagtgtgccagaatctcttggctagatcaccaaaatcaagcagagaaaataaaaattttaactcaatcctcccaagttcacagatggaacagactcctgtaactcgagactgattaacaaaaagaaaaataggtgacttattagcacatggcagtgcacatcacctgtgagaaaaggaactcaaagcagtggatctaggacttacctaaacaaagaaccataagttttataccagtgaacaagacaagaaaaggcagaccagacttccaaacaccagaaactgtgggaaggtaaatatatggagatacactaacgaaggaaaaaatctgctcacagattcctctgaaccatttctgagctgatgagcgttggagtggagaatttacatccgtgtttatgtgagaaaacaagggaaggataggaaagatgttttcttctatcaatctctgtcctgcttttaggcaaacagagagggaaggcagagactcttagttgagaatctaagttgtcttagagaatcttagttgtcttcagttcagtaatatttatgacaaagaggcatactttgaggtgacacattctggtttccttcagttcaaagaccagattttgaaggaaagacatgactgataaagattattcagggatttgttcctctctctttagtacgaaatagctataaaatttatgctgttcacaaatgctggggggtttgaagagttgctgaattttgagccaaggacatgtgtatgtatataaacaatgacatgtatatattttttctttttataaacttgtgaatttcttgaaatccaaaataaattcatataaatttgtcctccaaaaaaaaaaaaaaa

SEQ ID NO: 3535 - DNA, 159 bp, Homo sapiens
ctcagggggatggtttcctgttctccattcgtcctgtctgattcccaaggccacagagggcatggtgctggtgaagaagtcaggtttctccatgtgggacgccagcaaccacagactgcctctcaaataaagaacctggaaccttcaaaaaaaaaaaaa

SEQ ID NO: 3536 - DNA, 785 bp, Homo sapiens
cttcaggttgcaagatctataggctgatagaaatgcatccctctgcaacaacacacagcacatgtggtgggggaatgaactgagagaaaatccgcgggatggagactgggagcctcatgcctctaatttgtcatcacgctgaatcatccaacatcctcacctacaacaaattactgagactagcaccctgcttactcccttccccagctctgtgagagacaccttggcgccagatggcaggcaggagatggccaggcagataatacaggatctcctgtaggcatggaagcagtagaaatagatattaataataatcacctattgtgttggagctgtgacttgtatctgactcagtagaaagacaatggagatggctatggaattcctaaaaagtacaagagcagtatttgtgttctggcttggttttgattagctatgcaaccttgagcaaatggcctcacctgtctaagttagcgtactcacttgaaaatatggggagaaaataataaatgccctaattatcaaaaaatggtgaggtagagcttgaaggagataatggtcatgtaaatattcttgttaacactaaaatagaatagaaacattgtatttacaactgcttgttgtaagagtagcaaaagagacataaaatataaaatggtagattatacatgggtggtgaccttaaggcttctataaatttttataaaaaatctatttatattctctatggctatatacataggatgaaatgtaataaatctgcatatgcaaacataagaataagt

SEQ ID NO: 3537 - DNA, 386 bp, Homo sapiens
cctagaatggagaaactgaggttaattaactcacccaaggtcacacagctagtagatcgcagtgacaagacttgagcgcagaaaacctgattccaaagtccacgggcttaaccactactccatgctgccatctgcaggaagaggaaagggaaccgacaagctatttccagggcgtcacaaacacctaatgaaatgtggacatttcgctacataagacagctggctcacaaagacccaaccaactagttaaataaagggaaagcactgttttttgtgttatttctattttatgttgtgatgtattgctttattgaatgattaatgtttaaatgaccacatgcattaatggctattaataaatatagctggttttaaaaaaaaaaaaa

SEQ ID NO: 3538 - DNA, 616 bp, Homo sapiens
  misc_feature (1)...(616): n = A,T,C or G
ctcaggattgagaccatttcagatgagaagcacaatgatcttggtgttccacatgtcctgatggtggatgccttctctcaattcccaccagatacaacatctgcttttttctcctgcggctatgtggtgacaagcctcattaatgttggaagacagcctggacccaggacttccttattgggaaggatgtgccaggacctgtctctgcgatttacgatgcaaaggatgtcagtgtcaccaagctttgtgctgaaacttcatgctatgtttggactctgacaaaatgaaacaccaatattttcctccaagaatttgttctgtactttttggtgagcattaatgaacactgtgctgctaaaatagctgaatttagtttgctgtctctgataaaaattcttaagctggtgtaagatttgagtctccttcaggctcactgtcagctcataggactgtattgctctcctaagtagtcacgattgcaagtcttattgtacacacatagcanaataactccatgatcatccacatgactnttaaaatgaatacagtctacagaaatagaagagcttgctgaatatttgaaaataaatgccataagcttccaaaaaaaaaaaaa

SEQ ID NO: 3539 - DNA, 823 bp, Homo sapiens
aaacctgatgggacattaggagaaacaaccatttccaactgacgtgagtctccagacagctgttcctaccacagggctggctgctttattctggaaatgtcatccttctttagtctgttcattaccattgcctgtgtatggagtcaaagaggaatgatgaagagtgaacttgaggagccatcatgaatagaaatactttttccctatacatatccctaacagagttggaatgaaaaattggttcaaggaagtgtttcacagtgattgctcagtgggtcatctagttcagacattcatgaacagcgttctgtcatcacccacagcatattgaaaggttttgagtgtttcctgcatcacgtttttgttagagaacgctttttgttagaaaacaaaggctcttgctttctttcctgataccccgttcctacctcactcatatcttaattgtcttacacttttagagggacttttttccattcccctacaacattccattgctgacagaaaggctgacaaggcagctgacacagtggctattactttgagcagtttctaaacaatattattttgctgcccttctgctttctgtgaaattatagggtgctttcttttgtgtgcaacaatggagcctcagctcccacactaggggtcctgaacagattccatatcaacctgctgagctttagtattaatgtaattatcagctgaagatatcaattcaggcactcacgttgtcactatattggttcatcttcatgccagaaaaagcaggaatggagctctaaagtctgcactggatttatatgcgtgcgctgatgtatac

SEQ ID NO: 3540 - DNA, 945 bp, Homo sapiens
tttttttttttttttttcaattctaaaagttttaaataattttatttttataatttttaaatatctcctgaggttctctacctttttaactggtgcatctttcttcctaatgaatagattctatgacatattgtagttatttcaaaatctttgtcaaagaatttcaacatctgtgtcatctaaaagtttgtttctgttttcttttttcctcttgattattggtctcttttgcaaaggtgcataactcttaaccttttattacatgctgtgtgtatttttgaagtagaagccatggataaagtagaaaatatgcaatacatgcacacacacacacacacgtgcaaatgcacacacacatgcatttcccaccaaccaagggaagatgaccttccttctgcggggacgtgagggtgatatgtgcgtgaaaggctgatcaatttcatacagtcaatcaaaagatgtgttattttgccacctgaagactttaagactgtgagatgttgagtcttcttaacttcaaaatccatgagactaggagaccaccaggttgagaccatgagacactgacgccttgagaggaaagctctcttctgcctcccaattcctcccagccttggtttctctgcaatgttcccattaatattggagatctttgcattcaggcttgtacagattcaaacctgtagccccagttactccgatagctgagacggtaagatctcttgagcccaggaatttaaagatccagtgagcttagattgcaccactacactgcaaccaatttgattaggaatgctccattgacaggaagacaactcatcattaggaagtatatgtgtgaaataatctattgaaggcaaggactgaaaacattaaatgctgataataaggtttatggttgcttttttagagacaattactcatcccttgatcaatatggacagg

SEQ ID NO: 3541 - DNA, 911 bp, Homo sapiens
aggctggagtgcagcagtgtgatcatagctcactgcccctcaaacttctgggctcaagtgatcctcctgcctcagcctccggagtcactgggattacaggtaccagaaatgattaattagtgctccagcgataaagcttctattttccttgtcaatgacaatctcaaggcctctgagctgcctcttgcttgaccttggtttaaaagcacaaagaatagcaaccttgagactggcatcaacaagattcattctacggaaaccagatgcagtacaatagagaaaaaccacgcatttaatcttaaggttttgcagaaattgctctcagtatttcttcttcttaaagactgttaagtacaaacgtccttcatctcataaagggaaacattgccgtactgccacttaacactggccaaagcagtccttcggagacccctctgcattgttccttttgacggacacatggcagcagggtccacacaaccctgggagaacagctggatgcgaccatttagcagtaaagcttttattgagcggatcctgactattaaagcatgctgaaaagtatttcattaacatctgaccacgggaggttatggagctgtaataaaatcatacagttcaaatggagatgcatatgttattctctacttgaggggaaattgttttcattggcttacccagtgttcatttgaagtgcgcgccattttggactttggtacaaattgtttcttcctctcagcaagatacccactcacatttggaagcctctcggggagggtgcgaaagcggtggataagatgacttgaaactcttcttattgtaaaccggtttctttaatcctgcgtttatattacctacttccaaagcatcccttggtaatgccaaaaaaaaacaagcgcccgtgcctcccg

SEQ ID NO: 3542 - DNA, 320 bp, Homo sapiens
tgtaaaagatattatgaaggatacagatgatagccagattaagaggtatatagggtaaggtctgcaaagttcctgagtatgagctctgtcactgtggagttgtggtgtgccatcttcctggcacatggatgtgttcaccaaccccatattttagggattgttagggaggcttcatgatgtaggcgcgattgattattagctccgtattcagctcctctctcctccatggagaatggggctggggctgaaagttccaagcttcaaagcatgtcttggtctttctttcatgaaacccaacaagagtacacttgggcatttat

SEQ ID NO: 3543 - DNA, 409 bp, Homo sapiens
  misc_feature (1)...(409): n = A,T,C or G
attttttaattataaacattattttaaatttcccccaaagtccggctttcccagaatctcaaaaatttgacatgtagtgttgacactgggtttcagtccaaaagtgtgctgaactgagaggacatatctagctgtttagtcatgccacattcctggaattcaagccatcattggtccttttaaacatcccataactttcctgcaagccgtcataggtagcagggtgccaagaatcaggatgcccggacttggcccacgggtaagattcaagtggtgaaaggctttgactgctgagctcaggtgtctctgggttgtgaggctgcatctcagccctgccatcgtcggcantntgtttnttcgtggtagcctccaggaacctgagagnccttatgtttaccctggaggacat

SEQ ID NO: 3544 - DNA, 364 bp, Homo sapiens
attgcactctttatgtgggaagctctctcatgtgggaaaccctctgctcggcatggatatgcagagacaaagaaaacttagccttggatttctcttgaatgtcaggttaaggagttggaacttcatgctgaggagaattatatctttcaaaagtggaggagcttgaaagtagcatttttggatagttaacatggaatgtgattcttgtgacccaagatatgcattaagttaccatctcctagtggttgatggttaatgttgtgcctggagatgtgacccagattctcttgtaggtcattcctgacagagggtccattccaatgagtgaggaagaggagcttctgggctgaacttaatctcatct

SEQ ID NO: 3545 - DNA, 464 bp, Homo sapiens
ttaggtacaacagatgcaaccgttagaccacagagcccgcccactgcggggcagcaggaccgagcccagagccctcgggggtttcgtgcgtgacgaagggtctttcactcaagtaaaatggcagcgtcctccttcctcttgaaaacatggggacaaaaagggaccaggatcttcccagcaatcagcatcctcatcgccctctggactgcttggagcccgcccacctgtgcttttaactcatacctgagaaacacggctggtgttttacttagatttttaaatttaaaatgtctaatggaagataaagacttaccttccccaggctaacgcttaaagaatctcaattaactcaaaactaatgtcagagggaatggatgtgataagagaatcttgcattacatctaacaaaaaaagtaacaaacatgcaataaaatggacatttggatcagtgaaaaaaaaaaaaa

SEQ ID NO: 3546 - DNA, 1110 bp, Homo sapiens
gttggtgatggccttagaaagtctcaagaataaatatgaatgtcccaaacaatttctctttacaacttgagtgcaatttgacacaacaggatcggtgccatcatgctcatcaccaaagaacactcttaattgagattcctgacaccttacatagtacttttgggtttgaaggaagtttatgttgttttaactacaattgtaataattactggaattacctgatcttttaacaattaaaataaaataatgtatgggcttttattgagcaaatctcttgatggaaagtaattcctgatgcatcaatgaacagagaattggtgggacaaaatagcatcggtttttgtctacatagcttaatagttcagcaaaagtgatgctactgaaaaaacgcagtgaggaacaaaggaagataaagtgaactctgacatattttctctactcagagttctttggtccatcatggtgtaacctccaatccttaaaatttcagtggaaagtagtattgtaaaaaaaaaaatcattctgatcacccaaattgcccctctggtgatgaagaccctgaaggctataaagagccaaaaacaaatgaattgattcgcttctagtgcttctccagaaaatcttcaagtctaggtatcttagagatgcctaaagcagttgaaaacaaccctttttacctgtgttgagtagaatttataggaagttatttgtttaaaaatgaattcctgcactaggctcaacagaccaaaccaaactggagttactcatgctgaagtttcatatcaccaagccaaaaccgttttttaatctgactttccaagaaattaggagagattaaaagataatagccaagtccccaaacaggccagttagctgacatgataaggaaatcccccgggctttaacgtttacagcgaaagtaattttaaaacacccaatccacttttgttctgtttctactttctgtggcccctttctgcctataaagccaaactcctctactcactcaattcactggagcactcatttaattttataagaataaagtgttgtgtgattccagaatcacaaataaaagccaattaaaatatttaaaaaaaaaaaaaaaaa

SEQ ID NO: 3547 - DNA, 863 bp, Homo sapiens
tggcagaggagcctcatctcatggccacgaccaccacaggcccattgggagtactgccaggtgttcaccaatgtccacttaatgcccaagggctctttggtcagcttgtggtaaaggttgccaggcctgggactcacatttcaggatagtaggctcccctccggcccaggcagaaggatcggatctcttttggagccacaagttctgcagccaagtgttggggaaagcgtggcccaagcactcccttatgtgttcctgctggtgtctcagtaggctgcatgttcccctagtccactgactctgagcccagatcaatattagtactcatctacgagttgcaattcttgtggcccagactgtgtttcagtttattcaaagcaccagagcactgcagcccacagtggaaaggcttgctgaactcaaattctgaccactgggatgggcaattctcatctgtccagggtcagttcaaatgcttcctctgtgggcaagcgtcagctaagtacagcctagttttgctttacactgtaatagtgcagcatggagttaaatctaagtctcacaattactgagctctttctccctcagtgcacagattctccacaccacacagccctttcagggggatgggggaggagcggccttctccatccaggactggttttatacacctttcaattggctttcacaccatgacgtaaacccagtccgggcgggggcacggttgaacttggatcatcattttggggggcgaggggcggctcatctggggcagagtcaatcacccgcggcccccggataaacgcctgtacgaaacacataattacttggcgcgggccggcgcgcatccagaaaaaagggat

SEQ ID NO: 3548 - DNA, 190 bp, Homo sapiens
cctagtctgccttcacaaaatggtataaaaaaaggaagttaatctttggcaacaccataagcacagtctaaaggctcacaaagccactcccacttattttcatattctactttggataatggattttgggttctctgagtagaagctgaaaaataaatgctgtggttttgagaacagaaaaaaaaaaaaa

SEQ ID NO: 3549 - DNA, 851 bp, Homo sapiens
ggattaaagcaaccgtctacagcaaaaaacaaacttcaaataactcttttgttggctttgatgaaacaagttgctatgttagagagtcccatctggcaaggaactgaagatgtcctcgaggcgacagacagcaaggaattaagccttttacatcaacaatccttgaagaaatgaatcctgcaaacaacacctacgtgggcttggatctggatccttcccccaatcagttcttcagatgagactggagcaccaggtggtattttaattgaacccttggggggagcccctgaagcaaaaaacccacctaagaaaccaacagaaactgaaatattagatgggggtctggtttgaaccacaaaggtttaggggaattctgtatgggaaaactacacttatagtggggatgaataaacttttgggattcaaactaaccattataataattggctctaatggcatcttaaaggggagaggcctttgaattgacttactctgaataatcttttgctgacatatgttttccatggtggcagaattaatacttaatgtatagtaattcctttccttgtaatagtcatacacatttccaaatgacatgcatttattggaatattttgaatcaataaagttaatatgaagaatatttgggtttaactacttaattgctctatttgaaaaagttattacaatttaatgaatctcgtatatttgcataggattttcaattcagatttctttgtaaaaaaatattgtaaatgaagtaatcctctgacaaataaatgtggattttgtctgaaagcagatcaaataaatgtgtttggttatatgaacccctaaaaaaaaaaaaaaaa

SEQ ID NO: 3550 - DNA, 375 bp, Homo sapiens
  misc_feature (1)...(375): n = A,T,C or G
caggtgcataaaagccctgggctcggcccagcagggggaaaaccaaaggacagagagaggagggggataactacctncggggaggggcgggcgtcaatactaaaancttcaaanncctncaaaaacatctnaacaacctncctacaaaaaggagccacccccttcaaagcctcctctctggtgagaacancanacagcaggaggaccagggggcanagaagagctaccccctccangggggggggggtgctgacagcggaacactccatgggaggacctggctacnggggaggagctcccacttccggggtcttctgagccattctaacactaaataaaattgttcttcatcttcatgcaccaaaaaaaaaaaaa

SEQ ID NO: 3551 - DNA, 504 bp, Homo sapiens
ggaagggacttgccttgtcttagatgagacgttggactgtggactcttgaggacagctcctgcccaaactctgctgctgtgccatgtgccctagcctgggacaggaacaacctggagaaaacagcaccttttttttgattggttctccctgcgtggtgcttctttttgcagttcagctgtttgtaggaagtgtcttttctaactacacaaagactcctgacggctagctgtgactccgcccaaagttgacctgagcgaatcccttaatgatatcttggagatatgaacacagttcttcctccttccagctggacatgatcaaggaagcatggtgccccagatgccattggtaatgtcatattttcaccattgtgggagccagcctgagttgaagctgaactgaaaaaatcacagacaaagtgctaaactgctgcatacagcctcaagagtccacctacttgactctatatgataatataaaacatgtgatatgtatatgataat

SEQ ID NO: 3552 - DNA, 701 bp, Homo sapiens
aaccttggtattgtggcaatttttttttcattgacttgatggtttccattttgtatgtcatcaagggtttgatgaagtcaatccttctttcagttttgccccatcctaatgtctgctattgggcattcttatgtgatagtttgatggagtgttacccaggctggagtgccatggtgtgatcttggctccctgcaacctctgcctcctgagttcaagtgattctagcgcctcagcctccccagtagctaggattacaggcacccgccaccagacccagctaatttttgtagtttttagtagagccaatggggtttcaccacgttggccaggctggtctcaaactcctgacctcaaatgatctgcccccttaggcctaccaaagtgctagaattacagccatgaagctctgcacccagccaatactagcattttgataagaaaacttataatttatttaggaattcaaagcatatataagaacagaataatcttgaaggtcgaaagaacaactttgaagaactttatcttattttcaattcaatataatgccatagtaacgaagacacagttactattggtagtattggtgcaatattacataaatggatcactggaattgaataaagagtccagaaataaagcttcatatttatatctaattggttttcgacaaagttgtcaactcaataaagaaagatgcg

SEQ ID NO: 3553 - DNA, 600 bp, Homo sapiens
cacaatcattggcatctggatggaatttgttaacagtccctgtaagtaaaggacctctcccttcatcactccatgatgcctctgtcctacattgtcctccagcaggcagctgcagaaatgtaagctggcctaagagagatgaactgactgttcaggtcataactaaggatgatggagaagaccagccttaaaccagaaaacaaaatcttggagtgagtcaaatcagtaagatatgatgccctggctggtcttgaactcctggactcaagcaacccgcccgcctatgcctcccagagtgctgtgattatagacttgggccaccaccaccatgcctgactgggcccctaactttaatagagcccctaacttagctaacgggccactaagtttaaccattaaaatgacatagaaattatttaattcaatgaaaagtatgaattagataactggaataaattatttattgcctatacctatattagtatgatattcagaaaatgaaaaattcagttgaaaccattacaatatatttgatttgagattaaaaaataaaatgtttaaatatacctatatattagaaataaatacggagcggccgaa

SEQ ID NO: 3554 - DNA, 405 bp, Homo sapiens
  misc_feature (1)...(405): n = A,T,C or G
ttgggctggtgatttgtaattaatgatagttcaggaaaccttgacaactatcttagagttggggaaaagtagatacaggctggcttgtgaagcaacgagctcgttgtcattacatgtaatcaagcagaaattgaacagccattcaccaatgatgctgttcagagatttcacatcaggtgagactttaagaaaatagactctgcagagactcacctccctacctgtgagggagaagcaagggaaggagtggaacaaggtctaaggcagattctatactctcccttttctcctctctcctctttgaactggaaaaactcaggtttacttttttagatattagncagtccggagggcttcttagaaataagtgcttttcttctcctataaccatatgaatgaatgaat

SEQ ID NO: 3555 - DNA, 205 bp, Homo sapiens
aaaatggagtctacctgcttccacctgagagctaaagaaccttctctttgatcaagctgagttccagagttccaagtttcccaggattcagagatccctggcccagctgtgatatgcagtctcaaaacacaaaacatctggagagatgatatgaacagtacatctttccctatttatatttgaaggctaaggcaatgtttatgga

SEQ ID NO: 3556 - DNA, 667 bp, Homo sapiens
  misc_feature (1)...(667): n = A,T,C or G
ccgctcaggccaagagggaagattgcagccaactggtgccccatcttaaaactttctcccatcaaactcattctggtgaatcactcatggatttaagttctccaggggatttgatgcacaggaaagattaagaactcctgtgatgggtggatttgtggcagcacaagaagtccaaagcaacttgtggaggcattttccatgcagagagaacaacactgcacagacttttgaggcaaaaaaagcttgaggctganaagttctacaaactgccatttccaggtttttctggagaaccaggaaaatcagcagtgtaactcaaagtcctgagaaccagtggagctgatggtgcccattataaaggtgactaaactgaggcggcagcaacactctncatctcaccatcagtaccaccaccaacaccaccaccaacacaaatgcacatgcacttgaacttaatcatcttgctctttagaaatatnaggacaacagagaaaaaacttttccctgatagacaggnaacaaggatgcctcgacaacaaatactccacagagaagtattctgcgcaaanggcatttctgtttcagccnatggcntatatcaataatatgntattttaaaatcttacttctaccaattatatagaaaaaaattaataaatcctgatgc

SEQ ID NO: 3557 - DNA, 457 bp, Homo sapiens
caggtgccacgccaaaaattatacctctcatccacaaatcttagagttgcatcatgtacaaatacttggtttctgaagaattctggactgcaagttaaagaaagtgagtagttttactctaaaacaagtcaccaaaatataaaagagaatgagaagagataccatcttcaatacaataaggaaacagttacaaccacaaaccaaactatgaattatttctatcaataacagtgaaatgtgtaccaaactgaaggacactgagtcaagcgaagcttcttcagatcttgggaaggttaccgagtcctctaaaaagtcatgtttgcatgtgtgtcccatttgctcctttctctctgctgtgtcctaaaatccctaaaaatctttcagacgatctagagctgtctgggtaattcacaggaaaagcacctacagaactcttaacctcacactgcataagaat

SEQ ID NO: 3558 - DNA, 311 bp, Homo sapiens
catttatttctgtcagtggtttattgattatgcaataaaaggaccgctgggaagagaaaactcataacaaaggccctagtgggccctgaagccaccagcccacgactatctctgggtgaagagctggagtttcgtcctccgagacagctgtggtttctgctttgctctgtgatcctaggccctccaggagatctctctggaactgattcttcaatttctgtaattccagctacttgggaggctggagagcaggatggcttgaggccaggagtttgagacgcgcctggacaagatagcgaggcccctcgtct

SEQ ID NO: 3559 - DNA, 695 bp, Homo sapiens
acttgaatttttaaagatgtatctgagtctgaaggagtgcagatcaactgagatcaagagttcgagaccagcctggccaacctggtgaaaccccatctctactaaaaatacaaaaatcagctgggcatggtggcacatgcctgtaatcccagctacttgggaggctgaggcaggagaatcgattcaacttaggaggtggaggttgctgtgacctgagattgcaccattgcactacagccttggcaacaagagcgaaaatccgtctcaaaaaagaaaaaaaagatatatttgattttcctcttatgccccaactgaaacaattcccaagtgctttttattctacttctgccatatctcttaggtctcttaagacttatattgtcctctccataccctcattcagaaccttgttgttacttatctggactaaccccatagcatctggactaatgcagtagtctcataactgtcttgggtttccagcctctgcaatatattctatgcacttcaggttaattttcctaaggaacatgtctaaacatgtatctttccaactcagtaattttctttgactccctaatctatactgaattaaggccttgcactttctagtcccaatcaaccattgcaatttgccttggaaaccccttaatgctttacacccttcagacaagttatttaccttgtagtaaaat

SEQ ID NO: 3560 - DNA, 285 bp, Homo sapiens
ttaggtgttgaatccaacagcagtccctaccaagcttcctgcacagattctgtttcctggagaacctgatgtacaacagttaaagtgcagagaaaccctctgccaaactttggtgtgctttaaaagttatggcagtcaggctccctttactgtcataactggaacacctttcacttttcgaaagagctggtgtatctgcttgctgtacaactacaaatatatactttcgattaagaaagttgagaaaaaataaaggcagtttaatttagcccaaaaaaaaaaaaa

SEQ ID NO: 3561 - DNA, 283 bp, Homo sapiens
  misc_feature (1)...(283): n = A,T,C or G
cctagngtgtaagaatccaacagcagtccctactaagcttcctgcacagattctgtttcctggagaacctgatgtacaacagttaaagtgcagagaaacactctgccaaactttggtgtgctttaaaagttatggcagtcaggctccctatactgtcataactggaacacctttcacttttcaaaagagctggtgtatctgcttgctgtacaactacaaatatatacttttgattaagaaagttgagaaaaaataaaagcagtttaatttaaaaaaaaaaaaa

SEQ ID NO: 3562 - DNA, 460 bp, Homo sapiens
ctcagcgtctcgccatgtgacatgctgactcccctttgccttccaccatgattggaaacttcctgaggcctcaccagaagccgatgctggtgccatgcttcctgtacagcctacagaactatgagccaaataaacctattttctttacaaattacccagcctcaggtattcccttacagcaatgcaagaatggactaacacagaggagtacaggagtcagagtcagagagaaggcaatgcgacaaagaaagcaaaggaaaaaaggctatgcaatgtggagccaggagacaaggaacgccagctcccttgggaacctggaaggcacaaggaatggactcatccctagagcctgcagaaggagccaactacgctaacgccttgatcttagctcattttgacttctggcctccagatctataagataataaatgtgtgttgtttaaagccaaaaaaaaaaaaa

SEQ ID NO: 3563 - DNA, 310 bp, Homo sapiens
tcgctaccttatgagaggcctgtaagggctttttagggctgtactgaggagcaaatacctcatcaaagaccaaaccacttactttcatgagcactgggagactactgatttttttaaagagagtaacatgattaaagctgttttaggaaaattaatctgactataatcacggtttgggactcagacatgtttttatactcttaattcttcagcaaaaagattcagtggatatctgtctgagtcggttaagaggagtcaccgcatgacttccctttcaaagggtggagtctcccattcaaaaaaaaaaaaa

SEQ ID NO: 3564 - DNA, 212 bp, Homo sapiens
cagatgtacagatgtgtctaccatttttgaaaagaagttctgaaagtacatattccacttcctgaacactgaaaagaagtacagtattttactccatttgagcatatttatattcttaaagtttgagtaaacaaatgagaagtgaaaccaaggagaaagctaaggggaaaaacggcaataaattacttctgtgtgtgataaaaaaaaaaaaa

SEQ ID NO: 3565 - DNA, 160 bp, Homo sapiens
ttcaaagttaagaaaaaacagcaatccagaagaggacgagataatccacctaagcaggactacttgaaaagaagcaagtgtggaaactatgaagccttgtaatagattttttttttttttttgatgagctgcctctgctccctctggaaaaaaaaaaaaa

SEQ ID NO: 3566 - DNA, 980 bp, Homo sapiens
cttgcatctagtaacaaagaactgcatgttactcagtgattgtgaacacttggctgcaaatagatgaatggtgtccttataagaagaggaagaagagccatggatgtactcataggggaatacctgtgtgaagacaatgagaaagtgaccatctgaaagccaaaaagagaggccccaggagaaactaaacctgcagacaccttgaccttgtacttcctgtttccaaaactataagaaaataatttatattgtttaagctacccagtctgtagcattttgtcttaggaaacctagaaaaacaatacatgttttttttttaatgtccaaagggtttcaattttgatgaaatacaactatctggttttttttcttttattgcttaattttgttggtcttatagctaaagaattcattgacaaatctaaggtcatttggatttaatcatgttttcttttatggctttcatggttttagtgcttatatttatgccaatgatccatgttcagttaattttttatatggtgtgaggtaggattccagttttattcttttgcatgtagatattcagttgtctaaacattatttttgaagagactttccttttcccatttagtcatttggccctcttgatttttgaatcagctgaccataaacatatggaattattcctggactcccaattctattacattggtatgtctgtccttaggccagcactacattgctttgattactatagttttatagtaagttttgatacagggaagtgtgagtcctcaattttttttaaagattgttttgtttatcttgtgcctcttgcaattccatatgaatttgatatttgatttttacattttgcaaaaaaaggccattggaattttgatagagattacattgactctgtagatcacttttggttgtaatgacatcttaataaaatatgaagtctcacatcaatgaacccaaaaaaaaaaaaaaaa

SEQ ID NO: 3567 - DNA, 205 bp, Homo sapiens
acggggtctactatgttgcttagcctggccttgaactcctggccgcaaacagtcttcctgcctcagcctccggagtagctgggactataggtgcacaccactgtaccttgacctcttttctattcttctggttttgccttttctgaatgtatcgtaaataaagtcatgcagttttgttgtcgttttaatagtaaaaaaaaaaaaa

SEQ ID NO: 3568 - DNA, 503 bp, Homo sapiens
tgtttttggaccaaaatatggctatttccactgtaaagattataagaccaggtgggagagtgcttacgtgtggtgcatttctggaacgaacaaggtttatttcaaacaactctgttgtaaatgcctaaagagttttaacccttatcgagtagaagcaatccaatgtcagacctgctcaaagtctcattgttcctgtcctcaaaagaagagacacattgatctaaggaggcctcatcgacaggaactgtgtggtcgctgcaaagacaagagattctcctgtggcaatatttacagctttaaatatgtgatgtgacttgtacagtgtgacttgtaatggacccctgagctcttcttgtaacttactgtgctgtcttccttttttgcaacttggctctgacctggcatcggaaaatggctaggcttttgtactttttgtagattgtgtaacaattgtacaatgtgaatagaataaaataaatgcatgtgaactaaaaaaaaaaaaa

SEQ ID NO: 3569 - DNA, 942 bp, Homo sapiens
caggcttgaagaacttaatgggagaaattaataagattaaaaatgaattatcatcccttaaagaaactcatattaagttacaagaacattataacaaattatgcaatcaaaaaacgtttgaggaagacaaaaagtttcagaatgttccagaagtaaataatgaaaacagtgaaatgtcaactgaaaaatcagaaaacaccattatacagaaatataatactgagcaagaaataagggaagaaaatatggagaatgtttgttcagatactgaatacagagaaaaagaagaaaaaaaagaaggctcatttatagaggaaataattatagatgatactaccagcattaacagagttgctgacactttgaataactggagtatccatccagatcccaagggagaacccagtgaagagaagaatgcaatggcaaagactttttatgattcctcttttcccacagaacatgtgaaaacaaagcctctgatatcaaccccactacaaagccatctgcaggcaatcaagacgactaaaaatacttctggtgatgatgactggcagagcctcattacgaatcaactaaataaaagtgaaaatttactaagtttagaaaatgacaaccagccaaagaaaagaaaagcagaagagacgttggaaaaaaacaacagattaaaataatgtagataagtgctttcagtagtgaaattacgtaactgaaattctggtatagtttttactagaataaaatgactggtgtatttaaagctctacagtttgtctttgcttttccaagtttttctaatgtgaagaaaattgattactctacttctgtcttctctctgtatattatcctttctttaaagtgctcattgcttcttcaattatcctttttaaagaacagaatttatgtattgtatgacagacattgtgaccctttgtatttatt

SEQ ID NO: 3570 - DNA, 926 bp, Homo sapiens
  misc_feature (1)...(926): n = A,T,C or G
gggaggatggttatcgtcggacaaagaaggggtttcggataccccacaaaaatccttctggaggccattctataaaatgcatgagctgccttaatgtcaaggtcatcaaaaaaagggtaagtctgagaaactgtcagagaaaagagaagctgaaagagacatgaataaatataatgtgggatccaagatgagatcttgggacagaaaaaggacattagataaacactaagaaactcttaaaaagcataaacttaagtttaattaacaatgtttgagtattggtttattcattataataaatgtctcatacaaatgtaagatattaaaaatagaaaaaatgggcctttggtatattgaaagtctctgtattatatctataattttttctgtgaatctaaaactgttgtaaaatagtttattttanaatttaaaggcagtatgaatacttggtagaatgctgtaatagacctttatgaattggatagttcatcaaattagatgaactttaagtttctttgcatgattttcagttcactcatactctgtagaatttgttttgatactcatatatagaaaatatggaagaaatatgtacacatactaatctgacatttaaaataaataattaataaaaatcattaattttcctaaagagacaagcctttccagggagggactggacttataaattggatcacttgcagccaacgcatggttgccacataaacaggaaaggagaaaattagttaacattttaaatgagtttttaaaggccaagtgtgagctagagttagtccagaagagctggaaaaccatgacacaggggagcttgcactcacacaacacttgttttccttgagcatccaccagaagctcccaagatagattgggcataggataggagacctcaaaaaaaaaaaaaaaaa

SEQ ID NO: 3571 - DNA, 1010 bp, Homo sapiens
acatcctgactttataaaaaaagaagagctaatggaacaccctttgctgacaggccgacctggtctaccacagtgcaaagaaaggatccagatgcagtttgtcctctccagctgcatgagtggcgaggtttccccaggtgatggggaaaatgaccaaacctggcaaaggactgactactctgttttgatactcccttccccacaacatatacacttttgagtttatcattcaaacgcctattttaattcctgttttttaatgaacacctgtagtcatatcaaaacttattggcttttcccaacccacacagtggtattgccttgatgagaataaatgattggcagggcaaggctccgtattcaaggaaaaccccaatggaacacttcaacaccaatgcaacgcttcgcgggtccaggagctggatatgtttggatgatggaatcgcatcaggaaatgaactgtacagcatttccaaaaaaactgggtcctcagtttgaaaaacctgtgatttcagttgtacacaaacccctttccaaatgaggaccgtgaagaaagggcccaaagtatctgcacacacacagaagatgcccagacagcagctagtaacagttctgggtgccacttactaggatcctggagcagctgggctgcgatggagacccggcgccgctcacccgtggaaatgccccccaagctgtagttgccaatcagtcggtctgccacatggctcagactcagctctgccatgacggcctccacctgcaggagacacaaattacaggaaggctgggagtctctgtggctgctatttcaattcatgggctggggaggacatgaaagaggcagcacaccgcccaagaatccaagggccacttccagactcaccacaccctggggaaagcatgtctttgataataatatgatccaattcggcttaagtcgtaatacatatgtcagatttaaataaataatatgaattttttaaaacgtcaaaaaaaaaaaaaaaaaa

SEQ ID NO: 3572 - DNA, 298 bp, Homo sapiens
ctgcttaggtaaacgaagaaaattagataacaagaaggtttatgaaaattaaaaactcgtctctttttaaaaaatatgtttagtgttattttggaaataaatgtgaggactctcccaggaagtataacaaaaagtggaacaaaaaaataaaaggagagagaatgacaccgtaatctgctgtatctgatgaactgaaattttgaaaacggaaagaaaacacagtaagaagaaaaattgtaaaaaatgttcaataaaaaataaattctggtatttcttctaacttgtaaaaaaaaaaaaa

SEQ ID NO: 3573 - DNA, 218 bp, Homo sapiens
ttttttttttttttttttcttttttttttttttttttttttttttttttttttttaaaaaatccaaggcagcttttatttgtatttattggtttaagaaacaatcttttatattactctcaacttctcaaatttcttttccaattcttatatcttcattggcaccacgtacacacacttttgaaataaaggggatgtcaaatgtttattttccccaaa

SEQ ID NO: 3574 - DNA, 269 bp, Homo sapiens
aagccatgaatgtgagagtcaagctatcagggaaattgagtctcttttctactggatggaagtacatagcttcaggacctattagcagccagcttggcaccatgaaaggacagcctgcccagaaatggagtcatcaccaaggaagaagatgtcatttgaaccctggatcaagtttctttcaagaagaagcaagaaactgtttcactggcatatgagcaataataaagtcttttttgttgttgttgtttttgctgttaaaaaaaaaaaaa

SEQ ID NO: 3575 - DNA, 726 bp, Homo sapiens
gctgctacccgtccacaccattacgactatctttcgggaaactgtctaccatgttagcaatgatacattagcctgtgcgagagcccacattcgggaaaacagaggcctcctattgagggccagcaccaacttgccagccacaagagtgaacccccttcaaagcagatcctccaactccagccaagcattcagatgactgcagacctggctgacttcttgattaccacctcaagagagaccccacatcagaaatacccagctaagccactctcaagtttccaacccacagaaactgtgaggataatacatgtttattgttgttttaagccaccaagttttaaggtaatttgttacacacaatcaataactaatccagagggtatttctcatcccaatgctgcttcctcaaggaagaaatggtccgatatcaagaccaagacaactaaaactgtcatattcttgaccaagcaacttctgttataagaatctatcttatacaaatatatttaaaatgtaaacacacacacaaatgtgcaaaatgcttgtataaatgtgttcattacagcatcctctgtaatagtaaaaacagaaagcaattaacgttttcattaatagagctcaattatataaactatggagaaaatggaataattctatgtaagcgctaaaaattgaattaataataaaaaataaaattctatgtaagcattaaaaaaaaaaaaaaaa

SEQ ID NO: 3576 - DNA, 341 bp, Homo sapiens
atcttccacaaaccaacccaaacacagaaacctcaggggaacattcaaattatcttcttctttcattccagtacagaaatattaaatatattaacttgctgatgttaatagaagaaattataagtgacagatttatgtcctggaaatgtcagcaaacttctttcagcaaattaactgaagttcaggttattataaaaatggctacattttttcgtgtctagcatttgatctacatcatgcgtaaagatcttttcaacatatttattgtttatatgcgtaaataaaattcataacaaatgtctgtcacaaacaaaaaacaaatggcctcgctggcctcatcc

SEQ ID NO: 3577 - DNA, 261 bp, Homo sapiens
cctgggtgagtactcactgacaaatgacgttcaacaacttttcacggggttatttgccttctgcatacatccttggtgaagtatttgttcatatattttgccttgtttttaatcgttttgtttttattgaacttattaaagaaaacttattaaattttaaaaaaaaaaaaaaaataaaaaaaaaaaaaaaaaaaaaaaaaaaaaaaaaaaaaaaaaaaaaaagaaaaaaaaaaaaattttggccttgttggcctcaggggg

SEQ ID NO: 3578 - DNA, 637 bp, Homo sapiens
tgacaaaagataaaaagcaagatttgagagaggttcctggatcaactggctcaatctgcttagttctacaaagtggagtttctgggcatcattcttcatttctgtacacaaagtgctgtgaagctcaagaagaaatagctctgcacaggaacgatgtgcactgccctactgcttctttatctaagatggtgtttcaacttaaaacttgtgaatgtgaaatatgagccaaaagactctctcggccctgaaatgacctttgtagcagatgctgccagaggccccctgttatcctccctggactctccagctaacctgatgtcaactgccagtgtgtgcatctccttacctgagggctgttctggtggcaggagtccttgctactcacagaaatggccaccagaagtgccagaaaaattaacctcccttggccagcagtcctcaaccagctccctcgctgacactgatgtgcaggtgtctcctatgctggttgctggagtcaaccacggcagcagccttcttgacaacatacccttcactggctgccttcctttccatctctcttcttcactcccctacctatgtctcctaggctctcccttcaaataaacagcttgcacttaaaaaaaaaaaaaaaaaa

SEQ ID NO: 3579 - DNA, 639 bp, Homo sapiens
atttgactcatgtcattatgtcattttaagacaacatttgaaaatcagaaaattgcacacaaaagttcagatgttctggaaaataagggcaacggtagatgcctcataatcacagaaatcagccagataaaaatggtgccagacatggatgatgccattgaacattcgtgctctttccacttccaaacagcccttgccattcgtacgtgtttggcttagatacctattctgcattcttctcactcatttactacacctgactcctgtagtaatcaagctctgcagttccttttgcaagggtggagctgagttaaatacgtagattcctgagtgttaattaattgcttttatgtgtttaattaagcacgtaaaaacaaacacaacagtaattaatttcttctgtggaacattagtgaagaattgcacagcaatcattttagaagtcacagtgggagaggagatctttgtactttctctatactccttgagagccaagtctgggcatcattaggctttctcaaaactgtatttccaggtagccctctgtctttaaaggagaaaagaaggcagcattgcaagtgatggtatgcctattcctttgtagtcaatgttgtggagttccacctcagtgcattctgg

SEQ ID NO: 3580 - DNA, 458 bp, Homo sapiens
atacaacctagaagttttccaggttgctggaaccaggaaatatgagtcaagtatcacccccacccaccaccacctttttcatcaaagattctacccacagcaccatcctgcgccctccctgtctctcaccatttacaacatagacctcagcttaggtggtattaggcagccaacagacaactcaccaggcttacaaagacagtttttgaaagaactgctctagaactgccagatggtattgcatcaaccacctcaagaaaagggcatgaaccattggcatcgtctttcaatcatttcaactacagattttgcagcagttacagatgaaggcaactacaaccttggacaagatcacagccacatattcctctcttctctctacctgtcctactccaatcctgcttcaacttagagaactagctcatgttaaggggcttcttgatgtgtagctgttgaat

SEQ ID NO: 3581 - DNA, 704 bp, Homo sapiens
actggattcagcaccgcaaaactgaaaccgcctccagaaaagagcctcttgcgagaacgcagaggcttgcctttctctcctgtcgctgagagtccctggctggcttggggaccccatggtgctgctcgctcttgcctgttgctggtgggggcttcctgctcctgacctcatactacctctgcggcagagggcctgagacagaggggatccctgcccatcccgccagccctcttctcaggaagcttctggaatctccacccaaaaacttcactgacattctgctgaccagagcgtggtcatatggccaccccatctcacaagggggctggaaagatgcattttctctcagctgcggcaccttaaaccccacaggcaggacctacgggcctggtagtgagaaagaggatgggaacggaagttaggtcagcagctagcagtgttggccaccaggggagagtcacagccactttctgggcctggtggtgacttcacattggttgccaggaggatgattttgaagataccgcctgtcgagccctcttgtaactaatcttccagtgtctgccgctgaaggtgtccagtagctaacttcaggacttctgtcatccccctcttcatttgggggaatttcctctacttacttgaaacattcagattttccactgtcagttttgggtgaatgaactatgcttattacttttaat

SEQ ID NO: 3582 - DNA, 405 bp, Homo sapiens
agacaggatctcactctgtcacccaggcaggagtgcagttggttcgatcatagctccctgaagctttgaactcctgggctcaaaggatccttccgcttcagcctcccaagtggctgggacactaagcacacaccatcacactcggctacttaaaaaacatttttttttagagacaagggtctcactatgttgcccaagttggtctccaactcctgggctcaagcaatcctcctgcctcagcctctccagtaggtggaattacaggcatgagccaccacactggctaaagagctatttcttttatataaattatatgaagattgctaaaaggttttaagtcacactacatgtaaaaaccccttaggctcaaactcaccaggaggatcgtggagcttggagctaaat

SEQ ID NO: 3583 - DNA, 668 bp, Homo sapiens
cactattcacaataacaaagacatggaatcaacccaaatgcccatcaatgatagaatggataaagaaaatgtggtatttatatgccatggaatactatgcagccacaaaaaagaatgagatcatgtcctttgtagggacatgggtggagctggaggccattatccttagcaaactaaggcaggaacagaaagccgaatactacatcttatcacttcctaaacagcacagggcagcagcccatggctctgacggggcagctctcttcctgtttaccatcgtggtggactgctgctctcttccaagtcagtctaatgagatacaatgagtctcgggaaaatactaggaaactggaaatttgaaaacaagaaggtcgagtgacatgagaactctctagatgatggattctgagaaagtgagaatgctgacttggagttcaagaaagggctgagaaggctgagaggaaatcctgaaacggcctcctggaaatgggtctggctgtgcaccgtgtccaggactttccagcttgctgtctacagatagttccttgcctcaagctttgagtagtctatttctttttacggtgatggcaaatttgtgggcagacaatccccaatcaagcttccgacccctcattaatttgtaatatgttcaattgttgccactaaat

SEQ ID NO: 3584 - DNA, 471 bp, Homo sapiens
gacgtctgattaccctggcctgtcttcagaaagaatcctacccctgatgcttcctcttggtaattttccaaccaccgggctccggtgctgctcctcggctgtaaatttccacttgtctatgctgcattcggaggtaagggagaaaacgctgaatgatctctttctgctgatggctacaacactcaaacgattgacactatttaacacatgcttttggtctctccttctcatctgctagcagcaatacatgtgactgatctttgttaacttcctgtatactagtactcaataatttgatttttggcatgtatatttagcttcattgatccagggaaccaaaatctggggataacattataatctaaaatgaacagaggtagttctgggatatgctaaaagacatcaatcatccatgatgtattcatttaaataaagatcttttatgaataaataggaggagcccagagaaat

SEQ ID NO: 3585 - DNA, 458 bp, Homo sapiens
atttttattttttgcataaataacattatattcgtactattttataattgcagagttttctcacttagtgccccttggtttctccttccacccaggttaattactcccaccgagcaaatggtaactgatgctaatcccttaatattagtcaccttgagctaactagtatatcgaaccgctccaaaatgttagtgcttttagcacatttaagattttgtttcttgctcctgtcacagtataatcatggctgataggggctagttctgttccatgcaattattctgggattatcctccaatttcttggtaatctttccatttcagccggagaatagaaagaagctgatggttgtacatgggagggccaaacttggaggtagcttattacatcatttctactcacatgggttggcctgaattcagtcacaggactacatgtagctacataggagtctagga

SEQ ID NO: 3586 - DNA, 793 bp, Homo sapiens
  misc_feature (1)...(793): n = A,T,C or G
ccctccttgtgttcccagaatgctgtcaagctcgactgggacctcctccctgaaggcgtctgcatttttcatgagtgaagaggaaagagatgatgcgtcagaaattgcggtgccttaacaccagcccttaagtcctggagaaaaaggccaagttactggttaacactaccataaactagatggttccttccaagagtattaaaacccatagactgggcacaggtccaggggacccttctgagttgtaggtgaggtacctcaaacaatgatctgaagaatacatttcaaagtccactcagagacttgaggatgtgccactggttcacttggtgactcctattgataaactaaaatgggacatcatgtggagcttgatcaaaaaagatgctccttcctgaatgcaaagtgattttaaactcctcaaaagaaagcaacctagtgacactgaatacacaagacttgtccaggtggaactacacccagacttcttgtttcatcttatattccttcttgttgccctactctntgacatcgtggcttggtcatcattttccgagaaagaacatagaggagaaagggaagaactaaatattttgctgaatttttccaatgtgaccaagtattatggtagcacttaatatatcatgtcatttcatcatcacaataaccctctgaaatactactgcatttctcagatgaagaaacacagactaagagaaacaggaaaagacaatgagtgatggaaccaaatcaggtctgccactgtggggtagaggaaggcaagaaggtaaga

SEQ ID NO: 3587 - DNA, 453 bp, Homo sapiens
agacacggtttctccatgtttgtcaggctggtctcaaactttcaactgcaagtgatccatctgccttggcctcctgaattgctggtattatcgacaaaagccaccacgccctgcatcagactttgaaataacctgacttaaagtggatctaccaacaatgtgccacctcttcactgtgagttgtacacttcttgggattgcacggctgcaaatggatatgtcttctccaaacttaaagctgcagatacatctcaacaaccttcctgcagatagacgctacccactctgaaacttctctccactgaagccttcagtgatgttttaacaacctgcttcttcatcttgtctctcttggccctgtcttcactgagtgttgcagagatgcaggtatttcctgtttttgaaatggacttacccactttctgtctcctgaaagctgcgccatcactcaat

SEQ ID NO: 3588 - DNA, 545 bp, Homo sapiens
accggcgtagcagcaaagacacttcactatcgatagcacatagagcccttagatcttggttttcaacaccattcttcaatcaaagaaatgaaggcatcttagagaaatggctgattttagcactggtcttgggaatatacaaatgaacctgaagcatgtcacagtatcagaagattctgcctgcttcccttttgtcttccatcatgattttaagtttcctgaggactcatcagccatgcctcttgtacagtctgcagaacttgagttctcacaagatctggctgtttgaaagtgtgtagcacttccccactttgttctccctctctcctgctctgccatgtgaagatcgtgcctgcttccttttcaccttccaccatgattttaagtttcctgaggattccccaggcatgcctcttgtacagcctgcagaactattcaaagcaaacacacaaagacaaagagtgaacagaagagaaaggaatcacagcattataaaattgtttgacaaagttaaaattgcaatatttactcttatgagaagaaat

SEQ ID NO: 3589 - DNA, 525 bp, Homo sapiens
caccactgtggccgagcgcgaaccaagacgcagacaagcaaaaaaaccttggggtaacttggtttgtgtttgggcatccaacacatcgtcttaccactgcagtccatgaaaagtgcactgacaagaacattgggatctccaggtagttgtttctacccaggaagagacgagggaagaccaccaaagcagtgtggtagccgggaaattacagataaggatcatggccctgttcagtttcttcatccaccacccatgaagaggcatcgcctaagaagctgtgattctgtttcacccatgtgaacaaggcaatcctcaggaggtccaaaagcagctagaagaacatagacccctggagaactttgtggagaagggcttctagaagtctctggtttgcccttcaacagcacatttatatgacaaagaaaattttctatcttgcttaatcattgttacttggtctttatggtactaatcaaataaacatcctaactgaaaaaaaaaaaaaaaatggcctcgttggcctca

SEQ ID NO: 3590 - DNA, 561 bp, Homo sapiens
ctagttgtgttaagagtcggaatgccaaacctgaaggaatcctagcacctaccttatctggtgaaattctgaatataagaagaatgcccacccaggaaatgtatatatcagatggaaactgaagatgaaatagaacacagataactgaaaatacagaactctttcactacaaagtgctatatcttatgagtccattcaaatactaaagatttgctattagttgaatcagctaaaggacttttccaaaactatgaaccatataaaaatatgtgcagaaccaacttttcaatactttacactttgtcattctgctcattcaaccttagcagaacctaaaaatgctttaaacattcaccattgttactccattatcctgttgattttgccagtgatttagcacataaaaacattaggacatatgccatgagtatttcatcccatagccatcaagtaaaaatatagtttctagagactaaaatttatggatgacaagtaggttctacctatgaactaggtacatggaataaagtaaaattaaccatcaagaaaaaaaaaaaaaaa

SEQ ID NO: 3591 - DNA, 241 bp, Homo sapiens
tgacaccacacagaccaatgatttggctcaaccagttctgcgatcccacccaggaagggaagactgaaagaaaacctcacttccacctggctaagatttcatctctaacctgaccaatcagcactccccactctggagcccctacccaccaaattatccttaaacaatcttatctccaaatgctctgggagactgatttgagtaataataaaactcgaggtctcccacaaaaaaaaaaaaa

SEQ ID NO: 3592 - DNA, 455 bp, Homo sapiens
gctgaaatccacccaaatggaaaatgccaactgctatcacatagacctcggagaaggaagacctggggactgaactctggtctctgttcttcattctgcatttcttcctgaggggcctggagagaatcacacccttgggccaaaccaatgtctaacctccatgtattgatttatgatttttcctacaacttctgctctcctggaattgtctggctttcctgcactgggcaagaagaccccagtttggtttggtggcagctgtttatataaaacttcctgaaatccccccattgtgaacctgggagtcaacaaaaacaacaaagtgaagcaggatttgtttgtttgtttgttcgttgcttttgttttattttgagaatagagaggactgtgggggaagaaagatatacttgttcctattcccaaaaaaaaaaaaaaaaatggcctcgttggcctca

SEQ ID NO: 3593 - DNA, 565 bp, Homo sapiens
agacagagtcttgctctgttgccagattggagtgaagtggcgcgatctcagctcactgcaccctctgactccctgattcaagtgatgctcctgcctcagactcccaagtatttcctatatcttcctgtcttttccatggccaaaaatgatcaagtaaagaacattaaagaagaaataaattactacatattaaaaaatacatactgtaagatgttctttgtacaaaaatgtgacaacttcaataagagtaacttggacaacctgaggcattaattgaggatcaatatgatgactttacattgagaatcacatataccctctgaataaatttaaaaaatgaaattttttaattttcattaaaaattaaatttttttgagtgatgaaaatactcaatcacattattttcaaattgttgatatgcatggaaattatcagagaaccagaatattcaaggtttatctttcctgtttttgtcttaaatcacaactatgtgttaaataatttgtatgacctatttcagtggcagtaggttaaataaaattctgtttgtgaaaaaaaaaaaaa

SEQ ID NO: 3594 - DNA, 303 bp, Homo sapiens
ttttttttttttttttcttttttttttttttttttttttttttttagactaaagccattgttttaaccgaatggggcaactgagagggatctgggttcccagaggaaatcagcaacagctttcaggtactcacaactatttcccagtcagtataggtaaatattttgggtttacacagcacaaatgtatagtatcacacaaaatacgatattgttcgttttttagacattttggccggcaagtaccttgcagtcgccaacatgaagcaaggagtttttgtatgtagacattgggtccacttct

SEQ ID NO: 3595 - DNA, 849 bp, Homo sapiens
ctgtttctcagagagcagcactcaggagctgcccaagtcagatacttgtttttctggttgcagcttttggaatcctttacctaatgccctacccaactcctgatttgcctgtagagatggtcaataaaaagaagcagaggttcatgggacttccaggacaatgcttcatgattctaagcattgctgctaactagacagaacaatgacagccatttgagaattatgagacaaagatcaagagcatatcacagacttggccttgccatccttgagcagctaaacacacaacatcaaactcctacttccatacttagtattacatgagtatatcaaattttatgtatttaactctgcctagtcagattttttttataagctccaagcacaatttttagctaatttagtaaattcattcttacagaagtgataaaaattacacaaggacactcagataacaaaagtcagagtagggctgtgaacttcagtcttattaccttatgctcattttcttacactatatgccattgcatgagccttagaaactgggttctgggtcagtgttctgcagcagtttatttaaagctcatgaaatattataaagagtaggctgagattgaattagacaaggtgacagaaatatgcactggttaaaatcttccttaccttcaacctcagtccccacttttgcacttgtcttaaacattggattatttcaatcagcagatcactgtgttatcacttatagtaaaagactgaccgctgtctttattaaaaacacattaatgtacgcgtatagttgacgcagccatatcccaaagcggaatggttttagtgaaaaaaaaaaaaaaa

SEQ ID NO: 3596 - DNA, 137 bp, Homo sapiens
cttagaccctgccatataagaaaccaagaaatgaaaactgcaagctttaggatgtaataaaataatgacaattgtatttattttatgtgtaattttcaattcagaataaaaccttctaaaaatgaaaaaaaaaaaaa

SEQ ID NO: 3597 - DNA, 203 bp, Homo sapiens
cttgggttggcatgctgagggactgctgagtaagcttcaatcatggagaaaagataatatcctacaggaaggagaaacaatataacaggaacctgggtctctgaatgaacttgtgaagcagagctacctgtccgccctgggccacttgcccacctatgaggtgatagaaaaacaaacttccatctaatttaaaaaaaaaaaaa

SEQ ID NO: 3598 - DNA, 207 bp, Homo sapiens
cagagccactcttgatgatagaattggtgatgtgacagccaccaaaggaatgtgacacaaagtagaaatgagacctgagatgtggcctggacctttaccatggaaatgcccataaattgcgtccctattccttaagattttatttaaagttattttcagaatgttgtgaagtttccaatcataccaaaatcttcaaaaaaaaaaaaa

SEQ ID NO: 3599 - DNA, 789 bp, Homo sapiens
ttgttggtgacttctatttactctttgggagacaaagcaaataaatgtttttgaaactgaattggattgaagtggatccagattttcacaggaaaaaaaagtttccttttcccttagttctccttacacacctggctttgcaggaaaagaaactatcatcttggaaacacacatctgcctcagccacaggtagaaaaggcttggactacatgtttggtttgaagtttgaaaatctcagtccttccccaaccatcaaaaatatttacctccctcccttgtctcacaatcatctaagctgccttcttgaattgactcccacacctgttcatcatagaaggaaaaaaataaaagcaaatgccatataaaatctctcttcttcaacaaggtcttctgttttgaaatactgaaacagttcctgttctattacctcaccagctgtggtcttttatctcctaaagggaatagctgacgtcttaccagtcaaagtcattgtgcttacggacgccataaatatctcctttaaatccttcatgataaatttccctctgattggtaaagcagatacttgaacatgcaaagggggagcaggacagtctttgatgatgtaaactaagcccctggagatattccatccctttctccgaattttactttccaacaactggagcaacaaatacgggtgaaaatgttgcctggcttatctacctccattcattctttctcaactggtctcactgttggggaacctccattcactcacataaaaccacatccggtcattggtaccat

SEQ ID NO: 3600 - DNA, 303 bp, Homo sapiens
ctcccttcttacttttaaaaaagttgacactaaaataactcaggcatgtccttgaggaggtgtttcagaagaaagtgttattatcagaggatgacatttccatgcctgttattgcccctgaagatcttgcagtgggacaagatgtgaaagtggaggccgagtgcagtgactcatgcctgtcatgagtctgaccatgactcatgggaggccaaggtgggcagatcacctgaggtcaggagttcgagaccaacctggacaacaaggtgaaaccccgtctctactaaaaatataaaaaaaaaaaaa

SEQ ID NO: 3601 - DNA, 836 bp, Homo sapiens
cctgcttctccgctgaaaacagctttttgagtttcccgagttctaaccatgtaaaccatgctggattcaatggtggatggattgattttcatcctcattcaatgtaatggagaacatagactaagttctggaagctcgaaagtccaagatcaagatgccagcagatttggagtctggtgagcaccagctttatggttcatagacgaagccttcttgctgtgtcctaacatggtggaagagacagctgagctcccttgggcctctggtataagtacactaatccctttcttgaggtctccagtctcatcacctgattacctcccaaaggctccacctccaaatatagtcactctggggatcaaatttcaacagatgaattttaggaggacacaaactttcagtctgtaacacagtgtgaaaatatttcttacatactttataaaaataacataccacagaggaacagcatgggcatggaatgaaggagcatgaaacaatggaggtaacatggccgttgggagttcaaatctcaccctccttgtgtgatgttggaaactctaatttcctatctatgtctccattgtttttcctctttaaaatgacggaaccacacctttttcataaaattgttaccccaattaaatgagctaaattagtaggttagttctttgatttttttttttctaaaaattaattgttttggtccaaagaacaagacctggttactggttctgatctttcctagttttaaatgaacatccataaaaggcaaactgtcatatcacactgaaccttaatttcaataaaatgtgtatctcaaaaaaaaaaaaaaaaaa

SEQ ID NO: 3602 - DNA, 809 bp, Homo sapiens
cctaggcgataactgtttttgacatttgaatttagcagttttggtataaaaagccacaagagcattgcaggtgtgtttaagaacaggatgtaccaaaaagttttagaagtggaagatcagggaaatcaacagtgaatatgcactcccaaaaaaatggggcctcatcctcagtgagactggtgtaataggagacagcaggtgcaacgggagagttgaagatagaagggttagaatgtgtttgggtgaggaggcaaccagaagtgatagattcaagaaaatagcacttataagagggagaagttagtggaagtttggaacaggatccgttgatggaggtagctgcttccctggaggtggtgaaggaactgtagaagtgtggaactaattgcaagagcttctgtgaggaagttaagatctgaaattcaggtgagacctgttacctgaagtgagctcttgagctgagaaactggaaaagctactccttccctcacttcaagagatccttctttcagctgaaaaaatgtcaactccttcaaatatgattgacaaagtaattgtgtaactagaacatccaaagaaagatattctaggaaattaaaagggcaaaccaggaactgaaaatagacgcaaaacttccctgaggactaagaatacttgctaacaaaatattgctccaaagcagagaaaaattgtaacacaatatttcaacatgcataaaggagaaaatatgatgtaattgcagtaagggagaaaaacaaaaaaaacaaaaaagatctcagggaagacatgtccaaaaaaaaaaaaaaaaa

SEQ ID NO: 3603 - DNA, 734 bp, Homo sapiens
cttagggatggcgccctggattctactaaggtgctaatgaatttacaaagcaatggttgttctcattttgagtaagtggaataaggaagatggaatatggaatcttgtgactgaagctactccaaaggctgaggcaggagaatcgcttgaactcgggaggtggaggttgcagtgagctgagatagcgccactgcactccagcctgggtgacagagcaagactccatctcaaaaaaaaaaaaaagaggccgttcagtcgattctgggagtgaagcactgttgccacctactgtgaagagtgcggtaatgatgatgacaaaggaaaatgaacagagaccaacttctagacaatggtagcaggaattggaaggcaagaggaatggataagagaagtaaaggacagtttcagaaacgtgaaaaacatgtagattgggatcaactggggaatatttctggagaagatgggctgttgaatggattcttaaatttccagatgtgaaaaatgaaaagagataaaagatgaagataggtgaaccaagtaagcatgcatttttggaaagtgaaatatcatatagcaaataacagagatggaagacactcctatttctccttgaactgattttcaagtacggtgtagagcactctattacactagctactaggcagccacatgtgggtatttgcatttaacacgaaataaaattaaaagttaagttcaaaaaaaaaaaaaaaaaa

SEQ ID NO: 3604 - DNA, 913 bp, Homo sapiens
tttttttttttttggatgctttgaatattctttattttaaactatatgttaggcttcatttgggtttattgaatgcaacaccaccctaggacagaaatgtgtggatctaacatatatcatacagcgtcatgtgcctgaatttagaatcgtggcattttaggccaggaaattttgccatgagattattacatcaaatacctcccttttctgccttagtggacaggtgacaccagcagcagggacagtggtgcttcatcagcaacaacaggtggtcaaagcaatcaagtccagtacagaagctgactgttgtgggatctggcttccaagcgagagtctttgtttcttcattaccttaccaagtgccagtgaatgattcatggacctgtgtaaccttctggggaatcctggaaagtatttggaaggaaaactggaaaattagaaactatgctagtaaggcgagaagaattttcaaatttactgtaaactggtataaatataaatgggacctaacctgtagatgtcatttggctctgtgatcttttgatgatgtcttctatgactgccaaaatttttcaggacattttatttatgctattgtttaaaccaacagtataacttagactatttagagaataaaatgttctgtcttgtgagatttaagccaatacaattttagaggtttgctactaaaaatataatttgagacttctaatagtttatcttaagctatcccttggggtggtattcaatggtatagcaaagctagtgtaatcgcaatgctatgttatgataataaaacatcatgtttagcttcctgtttgctacagaaaatggaaatgggatattcatccaactcagagccaacatgatgtcaaaatataaagttataaagaaagaggtaaaaaaaaaaaaa

SEQ ID NO: 3605 - DNA, 282 bp, Homo sapiens
cctaggctcctccttgagttattggtgataagtaatgcttctcaataaagcttcgtgtcaacaaatctgaacatataacatctcagctagagcaagttactaaaaataggctcaatttgtaccttgcagtcatgccttcataaccacttttcaattaatcctgcttaattcagagaatgtataaatatgtaattttgcatcacttttaaggcagccattttattttgaaatgcaactaacattatatgcataaattcaataaatataaagctgttttcaaaa

SEQ ID NO: 3606 - DNA, 217 bp, Homo sapiens
ctaggtgaacaactgaggcttgtagacgcaatgcagcctgctcaaaatcacatggttaataagttgcagaactagaattcaaactccaagtccacctcctggacccaagctcttaacccctgtgctatgagctaataacatatggagaattttgattattttccttagcatttaccaccatataacataatatgcattatacttaaaaaaaaaaaaa

SEQ ID NO: 3607 - DNA, 427 bp, Homo sapiens
cttgatatattgcatgattaaatttctcaactagaagatatacaactatagactatatttcacacaaagacgctgcacaccctattacggaggaaaagtgatgattcttggtgttaccatttagacaacagagcacagagtatttagggaaagttatgaatcctaacattagagagcagaatgttcttgccatgtgaagcatgaaaagtaatgtgaacataaccttctcttcttgtctatgaaattgtgtttccaatggcaaagctttctcaatatcattaccctctgggggttatgccatgtcctaaagtaaagagtctgtactttgaagtcagcatggctttggatgactttcttaatagatctgaacttccaatttctcatcaataaattattatctttctcattggttttaaaaaaaaaaaaa

SEQ ID NO: 3608 - DNA, 778 bp, Homo sapiens
ctaggtgtgtcttatggtccaggacatggagtatctttgtgaacatcacatttaagctggagaagaatgtgcagtctgccgtttttggatggagtattttagaaatttgtcaatgagatcaagttgattgattgagagtgccattcagggcagctgtatcctgacagattttctgtctgcttcatctatcaagtcctgaaagaggtgtgttgaagtcttcaactacaagagtggattttgtccatttctccttgaattacatcagtttttgcctcacatattttgctgttcttttgttcaaaaataataaagctattttaacttcctattgattagtgttagcaaggtgtatctttcctcatccctttgttcttaacatatctgagtctttatatttaaaggggaagttttcttatagaacacatggagttaaatcttgcttttttaatccaatctgacattcttttaattgatatatttagataattcacgtttaaagtgatgatttacatagctggattaatatctactatattcgtctatattgttttctattttttgcctttgctctttgttgtattttccctctcttttttttctgcctattctgggttgaaatgagcagtttatatgatctttattttcctttctctcagaatgccaagtatgcttcttttattaatttttagtggttgttctagagtttgcaacatacattttaaaataatccaagtatatcttcaataacactatagcacctcagatgtagggccaatac

SEQ ID NO: 3609 - DNA, 792 bp, Homo sapiens
gtgtcttatggtccaggacatggagtatctttgtgaacatcacatttaagctggagaagaatgtgcagtctgccgtttttggatggagtattttagaaatttgtcaatgagatcaagttgattgattgagcatgccattcagggcaactgtatcctgactgattttctgtctgcttcatctatcaagtcctgaaaaaggtgtgttgaagtcttcaactacaagagtggatgttgtccatttctccttgaattacatcagtttttgcctcacatattttgctgttcttttgttcaaaaataataaagctattttaacttcctattgattagtgttagcaaggtgtatctttcctcatccctttgttcttaacatatctgagtctttatatttaaaggggaagttttcttatagaacacatggagttaaatcttgcttttttaatccaatctgacattcttttaattgatatatttagataattcacatttaaagtgatgatttacatagttggattaatatctactatattcgtctatattgttttctattttttgcctttgttctttgttatatttttccctctcttttttttctgcctattcccggttgtaatgagcagcttatatgaattttattttcctttctctcagaatgtcaaggatgcttctttattaaatttttaagggttggtctaaagttcgcaacatacattttaaaattatctaagtatatcttcaaataacactataacacttcacatgtcgtgcccaaaccttataataaagttttcc

SEQ ID NO: 3610 - DNA, 778 bp, Homo sapiens
ttttttttttttttttaacatttctaagtttatccactttatggtgtattaaacacagtatctcaaatcatcttttaaatatcagaacattatttttgcatgtttttttggtaacatcaaggagaaaaaacaatctgtaacacaatgttgatgttatccttgctttactatcaaggatcagacatttcatgtacatggaccccatcaacatatacacctactatgtacccacaaaaattaaaaataaaaataaaatagtatcaaccatcgggaaataaatagataacaggccaattctgaaataatgaacatttagcaataaaatacattttaatgacttaatcattaaattattttttagttgtcaactctggaaacaatgtcatgggaatttaacaacttgcaattcttaattcaataagatatcttgtgacaatggattttcttaagaatctatactttgattaacttgagacctttagtggggaaaattttttaactcctggaacaaatgtactttcctttgtcgaagggacaaaatacatataaatactaactttaccatgtattattggaaccataacatcttcctataaaatggattctatgagcacctaaaagttataaaaccagcctcaaatagaaaccatgcaatcaaactatatttgggacttttggaattaattaaattacaaaccttcaataaaaatcaggatggtggcttgtaaggggtatcaataattccagttagaaggcccaaggagaaacctaacagctt

SEQ ID NO: 3611 - DNA, 842 bp, Homo sapiens
ctgatctcatataattttgttggataccttagattccttggattggacttctactttctcttgagtcttgatgatctttgtcgctataaagatcctgaattctatgtctactatttcagccattttggtctgtttaagaaccactgctgggagctaattaatgcagtcatttggagcctattcaacatgaagatgatgaagatgataaggatgaagatctttatgatgatccacttctacttactaaatactaaatatatgtgctatttcttatgattttcttaataatattttcttttctgtagctttctgtatggaaagaatgcagcatataatatatataacataagaaatatgtaataattgactgtttatattatttgtagggccaacagtaggttattagtagtttttgggagtcagaagttttacgttttcattgtgtgggaagttgtcacccctaaccaccatatccttgaagagtcaactgtatatatgtgtggatttatttcagagttcttttctgttccatttatctaaatgtctatctgtatgccataccatactgttttaattactgtagctttgtaatatatattaaaatcaggaagtgtgatgtcttcagcttttttttcaagattgttttggatattcaggaacttttgtggttccatgtaacttctagaattttttttctgtatctaggagaaataccattgggattttgagaaaaattacattatgtctgtagattgctttgggttgtatggagattttaacaatattaagttaagttttataatttatggatacaggatagctttccaaaaaaaaaaaaaaaa

SEQ ID NO: 3612 - DNA, 448 bp, Homo sapiens
agataagaatacattaatcctctgagtttgaggctatgtccaacaggtggcaaggtctattcctgcacaggagacagctgctgggactaagggaagatgccagaaaaagggagcttcaggtgggaatccgcacagagcaattaaccttcaccctgaaacacaccggactccacttccaccactcacaaaggagagcacaacactgaaggccaaacactcaaagcatttcctagggcaaggatgctgaaagggtcatccagggaccagctgcaacagaatcccacgctcttctgtttgacaatgcggattcctgaaccccagcccaggcctccagagtctgaatatctgtaggtggagtagtcgctgctgccagtcactttctcttacatcatcccatgtattttcttcttcacaactaaaccattatctaaaatgaaaaaaaaaaaaa

SEQ ID NO: 3613 - DNA, 1042 bp, Homo sapiens
cctagaggaagccaactaccatgactttcaagcatgaagacattcaggcatcactcagacgggcccatgagtagaggaattgagatctacagccaatagccagcaccaccttgccagcctcaggcaagccccagctgacatcttgactgcgacatccccagagaccccaagccagaaccactcagccatgtcagtcctgaattctccaccttcagaaactgtcggagataataagtgtttttgttattttgagccatcatattttggttatgagcaatagataaccagtacctacagcctgacatataggcatgcaggagtgtgtattgggtgtatatatgagagccaccttgtccaggttcccgggtcaggtagacttcctggaggaggaacacttatgataagtcttaaatggcttatagtggcctttagtaagcatctttcttactggcatcctacttggcatatcaaagttcacacatctaatgtgaacattggcatatccaagagcactggaaatgggaaaagaattacgggtgaatggttgtcaaagtacagttaattgtctgtgaaatgggacttcctcttgcactggttagagaatgaagagagccaatgtatcttaagagctgagagcaggacctggccctagttgggccacagtaatttacctacccctatcttttgaagtcagcctcagcatcaccctggaattgctacaagtggggaatctcaggctcctctctccagatctaggaatctgcattgtaacaagttgcaatgatgcaaatgcacattagagtctgagaagccctgctgaagaagacagaggctctgtattgcaggagagttcctgggacatcgcagatagagctcatggtggggaaatttggatgacagccttgaaaaccagaagtaactaattaaagaacagaaaaccatttctcctggtttttacaaatgactttcttacttctaggttctatttttaacctcaagtgctctttgaataaaaataagactgaaaaaaaaaaaaaaaaaa

SEQ ID NO: 3614 - DNA, 798 bp, Homo sapiens
cggggtaaaaccacagaatttatttgcgcaaaagaggcctttcgtccaaaaattgtattagtgaacaacaatcgagtttcccaccccttgttcgagccagatgttaaattgtaaaccaagtcaagcaataacgttacagggaccaaacaagaacccatggcttcgagtaaatcgacctccataataggggaccagggcagttgcccaaactgggaggcggggcatcatgggggtcttttagaattgaatttgaaggaacccgctttaagtgaaaatgaaatacctgcacaaaagaagctggggctgaactatcatattctcctggaagtagtggtgcttttataatctttggcctgcaatgttatttgaagtgtgaatgtcttctaatttttctgactcaatgtcattggctttcctgagtattttgattaaggtttatcaccagtttgaagaaatgcttagtgatttttaaaaatctacccaggtatatcatagatcttgtagcctatgtgactcataaaaatcccttttctttatttatctcccttgcattctgaataattttgtcaattctacttactagtccattattattttattccttggtgtcaaatataatgttctacccatgatatgcatctttaatttcaatactatatttctggaagttctatttaattctgttttgagacctctagctaagtttttatacctgtttatttttcacttatttttatttctttaaatatatttaaacatattaaatatgtaatattctgataaaaaaaaaaaaaaaaa

SEQ ID NO: 3615 - DNA, 1111 bp, Homo sapiens
gtgagcactcgctacgtgcttatatattatatatgtgtatatatattatatatatatataaaattttctttatccactcattgattgatgggcatttgggttggttccacatttttgcaattgtgacttatgctgctataaacatgcatatgcaattgtctttttcatataatagcttcttttcctctgggtagacacccagtagtgggattgctggatcaaatgatagttctactttttgttctttcaggaatctccacactgttttccatagtggttgtactactttacattcccaccagcagtgtaaaagggttcctggaacctggaagccccacaagtatctccaagaaacaagtgcaaagaatccatcacctttctgaaacttgctcctcctttatccttgtctatttcttctcttaaagaaacataataaatactctatgtcattcccaaaaccaacccccacttcgtttcatccccacccaacaactgcccaccacgtccctcaagcacccatacatcccggacccgaatttatctcctcccgcctctccccctcctcgtacctcctatttcactcctcacttacttcatcaccctccccttccactttcctttccccatccaaccacctctcttccatccaccacgtaccccctcaatgatatcctgaccaattgcacccacccgagcaccactctcatcaaccgtcacgccttcctcacacttatcctccacacacggcaacaccccctaccctccccacgtctttcctcaacccttcaactcacacctttctcccacccccggagcacgctgagctaatcagcctaccctatacgttgctgctaactcgtatattccttactattaatatccctatccaataaacccatcatctatgatagctctaatctttatcctgcgccactttatagtactcgttctctccctcggcctcctcggtcccccctgtcgttccatatacgctcctatttatcttctctcgatacacctaagtccaacatccataaccacaaacccaatccatttacatcaccactcacctccacgtttcccccatatctcacccttcaccatcttctct

SEQ ID NO: 3616 - DNA, 167 bp, Homo sapiens
tttagtatgaacacttggcagagttcttcattcacaacattctttgcccaaaaagttgattgacaaaaacaatttggagaccctacatcattttcagcagtcatgctaaggttttgagacaaataaattgtcgtgtgaaaaacaaaaaaaaaacaaaaaaaaaaaaa

SEQ ID NO: 3617 - DNA, 499 bp, Homo sapiens
cttagcatatcacaaaaactgctcacgaatagctgcaaattctcaagcgggtttgtttggatatgtacaagctattattgatgtatctaaacttttgaaaagtcaacaaattgagctgaaagttggttacttcctgaagaagacttgaggagaaaaggagagatgttggaatgaacaagcagtccatggagcagttacacacactcatcaattaagtttgctgtcttatatgagggaaattcatggtaccccaaaacaattaccatagtaacattaaatatcactgatcagagaccaccataatgatataataatgatgaaagagtttgaaatacttcaagaatcaccaaaatgtggcacaaagacccaaaagaagcacatgctgttgaaaaaatgacaatagacttgctcgatgcagggttgcaacaaaccttcaatttgtaaaaaatgcattatctatgaagcacaataaagtgaagtaaaattaaaaaaaaaaaaa

SEQ ID NO: 3618 - DNA, 619 bp, Homo sapiens
gcctatagatttgtatggaactctttcctaacactcctgcctaccaacctctcctatctgattttggactcaccaagcctcctaattagagtcttgctcttgttgccccggctggagtgcgatggcacgatctctgctcactgcaacctctgcctcccgagttcaagccattctcctgcctcagcttcccgaggagctgggactacaggcgcccgccactacgcccggctaatttttgtattttcggtagagacagggttttgctatgttggccaggcaggtctcgaattcctgaccttctgtgacctgccctcttcagcctttcaaagagctgggattacaggtgtgagctgccgtgcccagccctaattcaatatttgtatgtgtacattcaaattgtaataaaagttctacaagcttacacattcaagtgataaccatgttgacctctgggaaagagattgaaacgggggataataaaatgaattttctcattatttatagcatttcagtccatacaagaacatgcttattttcacaggtgaaatttaaataaaattctaaaaattttaaaaaccacaccctaaaacccacgcggggggtggtggaaaggagaaaa

SEQ ID NO: 3619 - DNA, 606 bp, Homo sapiens
cctagatgcaaagcaaagggaaaaactgacagataagagcctcatgatagcagagaagtcttgattcatgatcttggggaaaagctgtccaagtcaaggatgctgtcttcttctggggagaaacttccctggacgtataacattggaaagaagcaatttacacatctagacttggagagtctggctcaacatcaaattaaaatcatgctggtgttcacgtgagggtgcttttgtgcaaagctggagaagcacgggatgtgaagggccttgctggaggcagagctctgcagatgaaccagaaggccgcacccgaacccccgttcagctgcgaggcataaacgccttcccctggttaggagctgatgcctcactgtgagcttggatggcaagttcatagaggccatccacacgaatgggtttaatgggatttctttatcaattgtttaaagagagtctttagcgtccctcaataccctttccaggaggatacacagaataaattcctgcttgacttttagatcccagataaaactactcccgcagaagaattagaatttctttgtcatattggacaataaaaattatgtaacttaaaaaaaaaaaaaa

SEQ ID NO: 3620 - DNA, 326 bp, Homo sapiens
aataagtattgcagaagttttggaagaatggagagggacaaacacagaagcagagaaagacaaagacaaaaagagagaaataattactaaattggttcaatgtggtctcattttgcagtatctatcagctaatcctacaagtataagaatgtttctccaaggctgccttctatcaaaatatgcccatggatttattttgcttgcattgactttatcagccatattgcatattaataattataaatatgttggataaatctaatgtaatattaaccataataaattgatgaatatattttctccctttctctccaaaaaaaaaaaaa

SEQ ID NO: 3621 - DNA, 443 bp, Homo sapiens
cttagcggttctcgatttgatgactaccttcctcagggctatttggcaaaaaagaagggtaataaactcatgaaatggtgcctgaaatccctcatggaactggtctccttacttcacagcctgacttccacagacacctgaagtgtggggccacactgtcaagtcgccccttgtcaccatgactgggatgtatatcacagatctgctacatcgcagcacagtctggaaggaagcccgggattccagggctgggagagacctcgagagacagtcaagctcatcacttcaactgcaggcagagaaatgcaaatataagagctgattcctaaggtttcttcaatgaataaaattatacaaatgtataaaaaaaaaaaacacacataaacccccctcccacctctttacctcaaccccaccccttttcttgccctccttgggcttca

SEQ ID NO: 3622 - DNA, 612 bp, Homo sapiens
ccggtccatcactgaaacaagaagttgctaccacttcaagactgctactgtaccagggaggtggtgtgataaaggcacagatctatcgccagagaattgttcttcaagatgaccagcttgacctctgagtaatccttcattttcagaaagaaatgacccatgtttccagatgaatagtagctttcttaacctgttttttaactacgaaagtactgaagaaaaatttaggtgacagtgggaggaaatgggcgtaaatattcattccatcaatttcatgaatacatcaatatgtgttcattccatcaatttcgagagttgaattttcaaataaaatattatgaagaaaaatataaacagcaggataaaataaatgtggaaattgctaaaagaagatataaagataagttatatttagcaaaaataaattcattttataaatcaaattataaacctaaaataatgttcttgtaagcagagactcttattattgcacttcatcaagtgctgaagatgtcccagtgatttgagttgaatagaattaagaggaaattagtcacggtaaaataacttctaacagaaaacacaaacccaccatcggcctcgctggcctca

SEQ ID NO: 3623 - DNA, 237 bp, Homo sapiens
ctcaggttgaaggaaatagaaactatccctgtctctgggagcagagcaggaatgaatgccagacccagaactacagctgcaagagaagcagggacagcgaaaggccgcactctcaagacccagggaaagaatggctgcctaagaatgaagcttaataacagtaatagagaatgtgctctttcctcttctgcaacaaccaaccaagctaataaaagtcaaaaattaaaaaaaaaaaaa

SEQ ID NO: 3624 - DNA, 782 bp, Homo sapiens
gcagatttttccctcaagaatctatgctgaaaaaaattaaacagcttggctttaagattcttttgaaaagcaaacaagttgaagatttttcttctaacatgattgattggtaaaatcaaaaaaagattacagatgatggactcactctggtcactttctaatataagctacttcattattttggaccacagcaagaattcctttgccaacagtgatgcagtgaagcaatttgaacagaagcacgaaacacatatttcattgcctacatttattaaaacagagaaattaaaacctaatttgattcattaaatattagaaacatttttgtcactcatctcaaaggccttttaatttgacaaggcaggtacagaggcaaacataaacagacaatgcaaatatacagggaataatcatactatacataaaagcgtcagtagaaagatctcagaagtcgagtgcaaaaactaaacaaagccatgaagatgcctgtaatttaatttaatgtcttctaatagttataaaaattataaattctagaagaccactgcctggaccttcactgaccatgctgtcccagggggtactttttgctgccaccacaccagtgccctctctgaagaatgcagccctcctaggtccagggatattgcaggcaacaaggacctttcttacagggcagccaagtcctaccctctacaacctcttcctgaatatggaggaaaaagttgtcttgggctgatccttgaggaattcttccagtttctttatcccaaaacttgcgt

SEQ ID NO: 3625 - DNA, 639 bp, Homo sapiens
cctagggtaatctaggtggcaacggtaatagtcttatgaccagcttcagtggcctgtaacccaatactttagaagacccattgggaggattccttgaagccaggagttcgagaacagcctgagcaatatagaaagatgccaactctgcaaaaataattcgaaattagctggacatgtatatagctctgatgtttggaagaagaaaacaagtttttggcaaatcaagattcatgacataacaaacagctatattgtatcaattgatacatggggctgtaaaaagaaaactattggcacattcccttgttaattcttaaggcttttccttaaacatgtgtaatggttgatgttacttcatagattgggtttgtaaggccggcattccaaattattatgcctgctatcgggtaagttgtcaacaggtcgacagaggtgcctgattataaaccaaataccctggattcccactatttgatcaactcacagagttaataacaaacatttgtggttagttgacatttccttcaatcaaaacaaacaaacaaaaaatctagctttagctgcaaagcataaacatttgttagacaagatgttaacacaaataatacacaactaaaccataaaaaaaaaaaaaaaaaa

SEQ ID NO: 3626 - DNA, 706 bp, Homo sapiens
gtctcactctgtcgcccatactggagtgcagtggcacgatcttagctcaccgcaacctctgccttccaggctcaagcgattctcctgcctcagcctcctaagtatctgggattacagtcatgtgtcactaccgtccagctaatgttttttatttttagtagagacggggttttgccatgttggccaggctggtctcgaactcctgacctcaaatgatccaccgccttggcctcctaaatgtgatggttaaattgatgaagagatactgaagtttatgttttgatatacttcatgaacagcttggcatctttaatgttaaatgtttttaattttaatgttaaaaggttaataagtactgtgtcagagttagggttttaatccatttggttttcatatgcatatacatcatggttttcaaagtcttaaaaatgtgcttatgttattccaagggtatctcaatctacatcctttttctttttaaccttaagtttccttccaacaaatttcactttcaaaataaaacctccataacttgaagataaaagcaaacaaacaaaagtaattgccaagtttgattgaaggtatatagttgcatttcatattataccaatatagtgcctggatagatgtatttttttaatatgtactgctactgatagttatgtgtcaactagataaatgatttgtatggaaaaaaaaaaaaaaa

SEQ ID NO: 3627 - DNA, 492 bp, Homo sapiens
ttctatatctggataaagtgtcgaagagcttaaatctgttgaaacccaaaatttgcctccgtttaatggcttagaaaggtggaacatcttgaagcggtggcttccaggtcatagatggattcagatttctgattggcagttggttgaaggagttaagctctgtctgaagagttgaagtcagcttgagttaagtttcttctgtctaatggtaactggaatttccctttctaattgtgtattgaagaacgagaacgactcatgtttaagtgttagatgtaagtcatttcataattactcgtgcacttcaaaaacaacgaaaataaaatcaaaatcatagattatatggaaagctcaattcaaaatttgtaaaatgtagcattttgttgcattttataggaaaacataggattgtaataacattaaattatgtatatatttttactcttcattaaatgaaatttagagacatcgtcaaaaaaaaaaaaaaaaaaa

SEQ ID NO: 3628 - DNA, 304 bp, Homo sapiens
cctagagtgacgttctgctccacttcctctcatctgcgacttcgtatggctttcagatgaactgaaggacatgctctgccacagctcactggaataccaacatcctccaggactgcagctggcacagtcctactgacatgagctcaggactctatgaggtagcagctgaacctactgatgaagtaatgtcataaaagtagcttttataaaatattaatataagaaattatcttgatttatctgaatttctcataaaactattaaatgacattgttctactgtgtggtacataaaaaaaaaaaaa

SEQ ID NO: 3629 - DNA, 817 bp, Homo sapiens
cctagattggctctagcaaaacatcacaaaaattcacgtttgtcatgaagttggaagaaaatggctgcatctgcacaaatccaataccagtgatcaaaataaggcccaagggcaatccttccggataacgcaccagttatattagattttatggttggtatgtaagcacctggaagataaggaccccactttactcatctctgtgtccacagcagcaggtgcaggctttggcatgaaaattacactcaataaatgttaaacagaagatgagtttttaaacatctgtgttgtaacattatgagaaaacacaaaatgctatataaagccttacagaggcattcaggaatttatatgtcacctcttctgtacccagttgtatgctaaataatgtgaaactaaaagaaaaacaaacaccaccaacaccccaaccaaccaccacccaaatcccaccaatccctaaaatccttcccctctccttctgtggcctttagcggtccgagctaggggcgccccctcacttctaggcgtggttacacgcgaatcaccagcgtcctggctcccccggcttcgcggcgttctgccggcagcacccgcggtacactccgttacttccccgcaactcgctcccgcccctcaccacgcccacaccccggcgaacgccccgcgcccccgctgcccaaccggggccccggcacccatccactcccggaaacgccggccgtcctccaacactctcgccgcccctcgcctgcacgcccacatccgtattcctcctccgcccgtcccccccgcccgtaccacccacacgcaccaacca

SEQ ID NO: 3630 - DNA, 417 bp, Homo sapiens
ccttgaacggtggaagttctctattattcatcaaatacctcaagctgttcctgtcaagtctctcaattcatttcctacagatcttctgcaaaaatacagccaagaaacttctctggcaggcatgagtccatctgattaaagaatatcggagccagacattttgcaaaaaaggaaatgaactggaaacctgaactctttcaatacctgcagtttgtttacgttatgccagctgttagaccctacttccaacaatcagattattcatctccatcttttacagctttcctcggtaataagggataactccctccctgcagaaggacatatctataagaaaagcattgtttcttatcctctttttacttagattaaaggcttttagttctaataaagaattattttttaaaaaaaaaaaaa

SEQ ID NO: 3631 - DNA, 346 bp, Homo sapiens
gttagatcttctgcaaaatacagctagaacttctctggcaggcatgagtccatctgattaaagaatatcgtagccagacattttgcaaaaaaggaaatgaactggaaacctgtactctttcaatacctgcagtttgtttacgttatgccagctgttagaccctacttccaacaatcagattattcatctccatcttttacagctctcctcggtaataagggataactccttccctgcagaaggacatatctataagaaaagcattgtttcttatcctctttttacttagattaaaggcttttagttttaataaagaattattttttaataaagaaaaaaaaaaaaa

SEQ ID NO: 3632 - DNA, 601 bp, Homo sapiens
atttttctcttctgtaaaatagggataatagtatgtaactcattaaattactttatcaaatttgttttccaaagcactttataaactaaatgcactctacaagtattagttattaaataacaactgctacatgaatgagtgactgcagtgacttaatctccaaagcatccttacaaggcttgataagttcactttcttatccagcactgaaagtatttattaagcaacttatagcacacagctagatgctatgctaagccaacaagacatttagaagctgtcaactaaaagatacattgtatagctaatcataaattgtagctatttcagctgctctttcatcttactgtaagtccagcagttttatctttaaagccttttgggaaaaaggtagctttgaattgagttacatccactttattctcatcaaaattggtattgaactgctgaagatatcttccatagcattgtaaaagggccagtttgtattctttcatttgacaaaggctatctccaaccttcagaagcttttcgttgtaatagtctgctggcagcctgggggcgtatttagtccagatattaaacaaagaagtggcactgt

SEQ ID NO: 3633 - DNA, 277 bp, Homo sapiens
cggctgctgcgctgacggcaacagctaattttcccaccacaccacatcctgagaggatccataaagaagaaatggatgtcattaggaaaaaagacttcatcaggcacttcccctaggaggtagcaggaattaagccagatcaatagtcaaattctactctgcttttgaagaaacagctgaaggaagcagataaaatttggaagactgttctttcatggttgggaagatagaaaaaagcaaagcaaaatataatcctcgatattcaaaaaaaaaaaaa

SEQ ID NO: 3634 - DNA, 946 bp, Homo sapiens
atggtcttcaaagatatcattaacttcagggctctgagatgaggtaattctggattctggattatatggtggaccctaaatccaatataaatatccttggaagaaacataaaaagtaaagacacacaaacacacagaagagaagcaacgtgaagatgaagcagatattggagccatgtgaccacaagccaagaaactccaaagtgcacctggagccaccaaaagctacaaacagggaaggaatggattcttccccagagcctccagaggcagtacagccctgattatgtcttttcccttctgcttttttgccatcgatatctaaagttgtctcctgctcttctctgctgatttctcagtcagccacacccaagttaaacccatgacccactttatctacatttggggacttttatgaaattgtcaattagcatattataaaggactcagactatttaccctgctggtaactttaaaaacttgttacatgctacaaaatattatattttatagtagtgagctatcattgtctggaattaaagaattttcctaaaatcttcataatcccgaacttcattctatgctacaacaagttacgaggatattaactttaatgaattttgaatctctaattattttagtttctttgtcttgtgagaccataatttttgcagttttcccttatgcccacacttaggtttttagtaatggctacttatttctttactgtttctgctttattacttgtgtctttaatgatactgtttttggctctcagtttattttcctaggtacttatcatttaattcatttaatcctgttgttttttaatcttatgtcattaatttgttttgtttaattcgttttaagattttatagcctgaagtaatcattaaatgtactatttcgttttaaaaaaaaaaaaaaaaaaaaaaaaaaaaaaaaaa

SEQ ID NO: 3635 - DNA, 383 bp, Homo sapiens
ttaccatgtgcttcattcactctacagactccagatgaactcggttttccaatatcaactctaccagatccctaccctccagtaccaggacgttcagcatagctggaggatgtcacaaaattatgatgtagtattctctatgtttttcttaagttgtaacttcacttaagtttcataggtacttagcaatttttgtatacttcttgctgcaagaatcatggtgactgtttcaaggatcttacaatttgcttttgccatttagtatagtctgccttatgttttatgtgtgtgtgtttgtatgtgtataatttctgactacatcctagagcttggtcctaagttttaataaatttttacagcctctaagtccaaaaaaaaaaaaa

SEQ ID NO: 3636 - DNA, 519 bp, Homo sapiens
ctaggaaaaatctatgggtccctatgtacctataatcccagttactcaggaggctgaagtgggaggatcacttgaggccaggagtttgagtccagcctgaacaacatagcaacaccccatctcttaaacagcctgaacaacatagcaagacgccatctctttaaaaaaaagtaacaaaaaaattatgcatcccattttccttcttcttgacatgtctagtaatattaggttttatagtgaaacattgtggactactgattttgagtttacgttgtcttttcttgaagagtattgagttttgtcctattaagcagttaggccaagtatggtggcttatgcctgcaatcctagcagtttgggaggccgaggaagaagaatcatttaagcccaggaggttgaggttgcagtgagctatatcatgccactgcactctggcctgggtgacagagtgggaccctgtctctaaaaataaatgaataaataaataatctgttaaattagtaaaaaaaaaaaaaaaaa

SEQ ID NO: 3637 - DNA, 732 bp, Homo sapiens
ctcagggttcttctccgtgtggatacattaagggagcgtataacctttcataccgcctgactaggatgatggatatggaaatacacactttgggagccctgtctgcttgcctgttaagccattgactgttatatactcttgggcttgaaacaccttccaggctggaggggccagtattgcatttacttttatcccatttctgttttcacggctacccaagaggaaataatttgatttggggctgcagggggtagggtggaaaagtgcagtcggaagacagaggaaatcagcaagaagattactgaaagggaaagagggggaaaccaaccagctatatatttcctgcaacatgagttaatgaaattccgttccttcttacaccgctgtattcggtttgttttacattgttcggtatgtaaaaggatttggctttgcgttacagaactaattgcttactagatattacatggatatcaaaatactttataaatattaattaatcttcacctgattccctggcaagcacaaataaccagtggcatatttattgaatgtgtaagcaataatctgattcttaaagatttgttttctctgctgaagctttctcatcatttccatttgtcaaaatgcctcatctcctttgaggaccatatcagatggtacttccataacaattgttaggaaaatagtaataaagacgatgtttagagtaaccaaaaaaaaaaaaaaaaa

SEQ ID NO: 3638 - DNA, 809 bp, Homo sapiens
tttttttttttttttctgaccagaaataggggattttattagggggggggggcgtccagaacaatatactaccaactaggtgggcttaaaacgataggaaattcattctttcagttttagaagatggaagtccaatgcaaaagtgtcaagagggctctgctccctctaaaatctgcacagaacaacccttccttgcctgtggggggggtataaagggcgggctggccgcccctgacagggacctgggcgtggagcttgcatgatgcccaagctctggggtggaaggcgcaggaggcgaggccggggggggctcgggcgcgctcctgcttaagagggcgccacgtcatatggaattaagggcgtacctctcctcgagaggtgacctatcgcgctgactaaatagcatggtggaaccccctctagtgtccaaggagacttgttgctttgggaggatttgcgggagtgaggcgctcgtatcgcgtcccttgggagggcggtccgcttccggccggttggggagtgggaacgcgcaatgtgtgatgccggtcccctccgtctggttgtaagggacaggggagaaggggtttggtcggctcattcgggttcattctttgcgttgcgtttgcggtggtagaactacaccagggtggcagaccacgggcgtcagataataattgggaatataggtgaggtagtagctacgtggggggcggtgtctgtttttccttagccttatgccgggcggtctgtctcggctcggtataacaattctttatatctcattcgtaatgttttacgatatggtatgt

SEQ ID NO: 3639 - DNA, 945 bp, Homo sapiens
ctgtccactgcgccatgtgaagaaggtgcttgctttcccttcacgcttccaccagattgtgagtttcctgaggcctcctcacccatgcctcctgaacagtcctcagagctgttgtacccaaagtgacgatcaactttctccagtctcctggactgagaagatcccaagaatgagaaacttagtgctaaaatctgggcagtcccaggcaaatcaggacagttgataatcctaacagctctcttagactgagttccctcccgatgggtttcctatagatgtgggtgcttactaagagcaaattgagcagtttgagcagtttctgagcaccagcagtacacgcagcatagactcagattaggactgctgctttccatgtacattgattctagagtaaaagaaataaaatctgaatttcttgatttttccatatcaaaggagaaccactctacctggtagtactaccaaaaagaagcagcctgttctgggtacatcagtcagaggtcatggcaaagtagtaagaactaccttatatacaaaaattaattcaagatggattaaagacttacatgttagacctaaaaccataaaaaccctagaagaaaacctaggcaataccatttaggacataggcatgggcaaggacttcatgcctaaaacaccaaaagcaatggcaacaaaagccaaaattgacaaatgggatctaattaaactaaacagcttctgcacagcaaaagaaactaccatcagagtgaacaacaaacccacagaatgggagaaaatttttgcaatctactcatctgacaaagggctaatatccagactctacaatgaactcaaacaaatttacaagaaaaaaccaaacaaccccatcaacaagtgggcaaaggttataaacagacacttctcaaaagaagacatttatgcagccaaaaaaaaaaaaaaaaa

SEQ ID NO: 3640 - DNA, 925 bp, Homo sapiens
  misc_feature (1)...(925): n = A,T,C or G
cccgctcaagggagaccaaacctgaatgccaaaagatataaagaaaatgcagattgctgtacccatcctgagtcacatgaaaaataaaccatctgctaacacacaagaaaagacttacatgcacaatgtagggtggttgtgaactcttcacgggcaaagatgggatctgattgtcattcaaaacgcagtgcctaattcaatgcctggcacattgtccggtgaatgaacttattaacccacaacaaaatgtaactgcaggagagaccagaatattcttggccattgatggtgtctcactctgttacccaggctggagtgctgtggcgctatcttggctcactgcagcctctacctccttggctcaagtgatcctcagcctcctgaacagctaggactacaaggaagcttaccatgggatttataaagagataaactaataaggaaattcatcataatattataataaaaaaacccaaatctagaaggaaagaaaatgtgtgccaccaggaaattctttactttggtcacactccaccagagtgacacccccacctacttttactcctcagtgtttccctagtacctcgcccaaggcctagatgctcagtaatagttgttgaatgaatttaaatgatggtatcaaactacaattaattaactgaaaagatgtctatggtatgttaagtaaaaaaaaaagtgacaaaataaaatataaaatgtgattatttaaaaatcatcaccctatgtatatgtggatgaactctataataatatacaccgtaatgactaaatcaaaaagtgattgagaagaagtggactgtgaatgtgagtttcagaaataccttaactgctgtatttccctcagattgtctatgttaatacaaagagtgacatataataaacacagatgcggcggctaanaacc

SEQ ID NO: 3641 - DNA, 254 bp, Homo sapiens
tccacaagcagatgagaaaacagaagagcagcagagtggtgcaacagagaaggagagaggagaaggagcatctgaacatcaagaggagttcagctggggacagttggttgggagatcagctacaggacagccaaactccaggggaagatgatcttcccactccatcccctttctggctcctcatccattctgctgagagccacctccagctctcaataaaacccccacattcaccagcaaaaaaaaaaaaaaaa

SEQ ID NO: 3642 - DNA, 251 bp, Homo sapiens
cgccgcctcccgacttatcgcataacccccccccgccccccgcgcccccctactattactctatgaagagtaatgtttggagctgcagcgatcattttggaatcatgaggcatcaacctaaatgaagccacagttgaagaagcagaagataaagaccctggattttggcgaccttttggtttccaaaactactctgagatggccagctttgaacttaccaagtcaatactgaaagcttgtatggcttaaaa

SEQ ID NO: 3643 - DNA, 757 bp, Homo sapiens
tttttttttttttttttgaagagtctcgttaatctttaattatctttggccctagattatattcttatcattaaaatagatgaagtactttcagaaaaccacattttcataaggcatcagtgtatctttaaataagcttataagtttatacaaccaagtgatattaagaaccctgaaagagtaaactatgaaggtcagattaggcaggggatcgtgacgacagtagataacgacttttggcgaaaatttcagagcaagtggggtttggttaccatgatttcaacttgattttgcttctaaatataattgagcacatgaagccaggtcacagttgagcagcattttttaaaaagttaagacattgccaaccaatgaaattatatatggacaagctatctttcaaggagttgtaagtgccgtctaagtgttgatgatttaaatccttcattactcagggcatctacaggaataacgcagtgtggctttatcagtttgccatcagttatgctacaaaacccagctcaatatatgaaggatcatacctctatgtaaaaccagtactcactcttttgtttctcatttcttttttaaaaaattctaatactttaacccaatgtatccgaaatgttatgtaaatatggaatcgaaggtatattattaataaagggttttttgggactaaatctttcaacgtcactctgtattttgaagcttctaccactttacaaatgcagaccagccacattggaggtgctca

SEQ ID NO: 3644 - DNA, 780 bp, Homo sapiens
cttcagaactctgccatctcccaggtacaaaccaatgttaacctgctggagcattagataccatggggaggaaaaccaaagcacctcagttgacagccagctcaccactagaagcagagctacctattcaactggcagccaaccacatatgcctgaaggagcctagctgggaccagaagaatggcccagctgagcccagccgaaatagctggccagctcagtcatgaactaataaattttggggtgtttgtttatgcagtaacagctaactaatatgtatacccagtgcagataggatgtcaagattgaatgacagactgattactgtttacctggtaaacagaaggcaccctgtaggtactgatattcttcccccttttttaaggttgtatctcttgtcagatgttgttgagttatacagaaatgcatgtagacatgtctgcatgggatgtgcttaacctcacatggtccccatgccacagaaagacccacagtgtgaccattaggaccagggtcaaattacaaaataacaagtttgcctttaacctatttactcaccctctaaattccagaggtcaaggctgtggatcaatttgaagacctgggctatcttgtctggggccttatgcacttgctcactgtctgaactttggaaggggggatagggcgaccctgaagcattaggcgggggaaaatgttctacctgtagaccctcactggttggaatcttcctttatctttttctcctctgccaactgcatattccaacccttggacctg

SEQ ID NO: 3645 - DNA, 609 bp, Homo sapiens
  misc_feature (1)...(609): n = A,T,C or G
ttgttttggaacgagcctgctgcctgntgtgagctaccatccagagaaggccacatgacaaagagccgagggcagcctccagctgacagctaacaaaaacaaaacaaaacaactgaaggctttaattcagcagcctgcaaggaactgaatgccgccaagaaacacatgagcctagaagaagatccttccccagtttagcctcagaggagactgcagccccagatgacacctctattgtagccttgtgagaccctgagcagagaacccagataaactgtgctcaaactcttgacccacagaaactttaagataaagaatgcctgttgttttaagcagccatatttgtgataatattgtcacgcaccgatagataattaatatgggggccaaagggaccttcctagaagatggaatcttaatgtctttctttcccaaactttagccatttggctctacctttcacagaaagactagtctatcctctagggtgattcctcttctcgggtttttcgaaacagcccaagttttatgtgctattcctattttctaaataaaagtgattccttctatgtacaataaaatttaatagaaaataaaaaaaaaaaaaaa

SEQ ID NO: 3646 - DNA, 737 bp, Homo sapiens
  misc_feature (1)...(737): n = A,T,C or G
ggtcttttggnngganngcttccagtctagtggaataccaggttatacaccggcagttgaggacctgtggnanaaccactactgggccaagcattaccaacctgacagcagaacaggagtacagcagtgctgaggtgaacttgacatagaactttgagacgacgaaggcagacaacacttccaacatatcacaacctgtctctcacatagatttattgtagaagaactcaaccatctccgtgtcaacaagaaatggtcctcactcaaaaccatcacccttggatttagatcatgaggctgtcctgtctttagtatggaactgaaaagctttaatttccacaaaaatgtaaggttttgggctacagccttattaaaacaaacaaatatgagcatagttgtctacagatggaatatctggggctctaaacaaactgctccttgaaagtgtaatcactgtctttttgtttgtttatttagcctggtaggacaatgtcagaaatttccttggtcatagggaatataaaacatagtgtgaacaaaagcagcaataaagctacaaactattttttggtgtatttgcttaagtataagatagctgattggggctttatcatgtaacgttagtttgcttagttttcattatgtttgttaaacttgagttgtgaataaatatatggctgattcacattgtaattaaactgcacattgacataaactgtacatcaaaaaaaaaaaaa

SEQ ID NO: 3647 - DNA, 804 bp, Homo sapiens
aacaaaccgcatacgtaacaaaattcaacccaaaaaaaactatgggtacacagacaacttggcagttgaacacgatgtggagaaccactactggccaagcattcccaacctgacagcagaacagaagtacagcagtgctgaggtgaacttgacggagaactttgagaccatgaaggcaaccatcacttccaactcatcacaacctgcatctcccacagatttattatagaagaactcaaccatctctgtgtcaacaagaaatgtgtcctcactctacaccatcacccttggatttcgatcatggggctgttctgtctttagtatggaactgaaaactttaatttccacaaaaatgtaaggttttgggctacagccttactaaaacaaacaaatatgagcataatggtctacagatggaatatctggggctctagacaaactgctacttgaaagtataatcactctctttttgtttgtttctttaccctggtaggacaatgtcagaaatttccttggtcatacagaatataaaacatagtttcaacaaaagcagaattaaagctacaaactatttttggtgtatttgcttaagtatcagatagctgattggggctttatctcataacggtagtttgcttagttttcattaagtttgttaaacttaaattgtgaataaatatatggctgattatattggaattaacctgcacattgactaaagctgtacatttaaaggtggtgcaggctgcaatccaaaataaacttatgtgaaaccacaaaaagaaaaaaaaatgggctcgttgg

SEQ ID NO: 3648 - DNA, 245 bp, Homo sapiens
cttccggtagctgccacaatccttggctagtgaccccttccaccatcttcaaagtcagcatcaatctttaaaaagcatctataacccactgaataagatgggttagaagatgaagctgctgagaagtgctgcaaagctgatggtattgatatcaacacagacatcatatgcttttggggaacagtgcactcagttgacacttattcctaataaattcaaacagtggagaaaaaaaaaaaaaaaaa

SEQ ID NO: 3649 - DNA, 807 bp, Homo sapiens
cctgagatagggtttcactgtgttgaccaggctgcacttgaacctctgacctcaagcaatccttctgccttggcctcccaaagtgctggaattatagtcatgagccaccacacccagcccctaagtggacatttaatccatgtacattcaaggttattattgtctatatttgatataatcaaatacttagtcatttttaaattattttaatagtttcaaatatatttgttaaatttgctctatttgaatcaggatctaaagaagtttcaaagttgcatcagctaatatatctttttagtttttaaaaatatatatgaattcctttctcctgctttttagctctgtgtatttgctgaataatccaggatattcatcctgttgaatattccataccttgtgattatcttattaaaccctacggtgttcttgcatgtttctctcttcgacatatttcctgtatattgtcataaaatagagaatatttaccaattaggctcatttctagttgggttctatgcgctccatattatactttatgtgtattcacttcatgtgacatataaaaattgatcagtaagttcaagtattttcagctgattcattccttatatgttttcttctgaaacagttattcggcattttagcttctattggttgtatttttaggccattaattatttgggttccaaatgaatttgcctgtatgttaatgtcccatgaaacaattcttttctccgatgtttataactaattaaaaagccagatcttgattttaaccagtgtaatttttctggtaattaattacat

SEQ ID NO: 3650 - DNA, 853 bp, Homo sapiens
  misc_feature (1)...(853): n = A,T,C or G
tgtttacttctctgcacaaaaactagaaaatctagagggaatggaaaactcctggaaacacatgacctacaaagattaaaaaaggaagaaattgcaacccaaaagagacaaatatccagttccaaacttgaatcagaaaaaaacaaccaaccaaaaaaaggccctgggccaaatggattcacagccaaattctactgggcatacaaagaaaagctagtaccaattataatgaagctattccaaaaattctaggaagaaggacttctccctaattcatcctatgagtccagtatcaccctgatactaaaacctggtaatgacacaagggaaaaagaaaacaacatgccaatatctttgattaaaataaacacaaaaatccccaacaaaatactagcanaccaaattcagcagcacattaaagagttgattcatcatgaacaaataggctttattcttaggacataaggttccttcacatatgcaaatcaataaatgtgattcaccacataaacagagttaaaacaaaacctattgatctctcaatacaatggaacagtttttaaaaaaatcatgcatccttcatgaagaaaccctgaaaaactaggctcaaagaactaccccacaaaaaagactatctggaaaagcccaactcaacttatcttgaaaggcaaacctgaattatcatttaaaataggaccagggctggccggggttcagcctgaatccagcatttgggggccaaacagtgatcaaaggcagaaatcaaacatctgttactgggaaacccccttctctcaaaacaaaaaaagcccccaggccacagggggcccggggcattcttccggggaaacaa

SEQ ID NO: 3651 - DNA, 342 bp, Homo sapiens
taggtggtcgtagaaatgattgcttgagaaagctactgctcagcagtggttgagggagaagatgctgaatagagaggacagtgtgaggccaggcaccttctgctcccatatcatgctttcttattatagtttgccgttctgtttttttctgagtttttctcttctcttagacctggatgttttagggctatctaaactcatgttcaaataaaaggagaaaatacatagaaaatataatcaccatggcacatatatacctatgtaacaaaactgcacgttctgcacatgtatcccagaacttaaggtataatgaaaaaatttaaaaaaagaaaaaaaaaaaaa

SEQ ID NO: 3652 - DNA, 412 bp, Homo sapiens
  misc_feature (1)...(412): n = A,T,C or G
ctagatctgggcttcatctgattcacttttcttcatcatgaagaagtattttcagcaatttgtatagcacgaatctgtggaatataagatacctacaattttgcctggggcaaatgcaattattttaccttcttttttttaattatcaggtttgtaaaggacagtttttcatacattaaaatgaatacattttaataaacattttaatgaattcgagtaaatttattcatcatgtaaccaagaccaaaatcacgatatagaatatttctctcaacccaaaacatttcttcgcactccattccagtcaaactcctatgccccagacaaccacttatctgttttctaacgatagatttgaattatctttctacagttccaaataaacaaaattagacagtnaaaaaaaaaaaaa

SEQ ID NO: 3653 - DNA, 440 bp, Homo sapiens
ccccctcatccatgtaccaccgcctgggaaatctcggtttttcggccagctttgttggctttttttgcagctttctgttcccgcaagttactcccccaaatcttacctattttaaaagcaactctcacaggaagaaaggcttggtagccaacagatgaccaccacattctctcccccaagacgtctgatttcagaagaaattcaagaatgaatatttactgcctatatctgatagaagaatcccatttctcatgagaaaatcaatggataatactcagcgtttcttcaaaaccaaaacttcctttatcaaaacctgtagaacacaggtttcagcaaacttcgtaaaatattcagatcaaatttgggtttgttattgattttcagggggattaatctcctttatattaaaagctcatttggtcacaaaaaaaaaaaaaaaa

SEQ ID NO: 3654 - DNA, 615 bp, Homo sapiens
gacaaggcaaaaggtttacactgagtagaactgctggcaagtagaatccaaattaagtaagagaagaaacagagaccagatccaggtgaaagtgggcctccacattttgttctgcatggctggggaagcctcaagaaaattacaatcatggtggaagaggaagcaaacacctccttcttcaaatggcagcaggagagagaagtgcagagcaaaaggggcgaaaaccccttataaaaccatgagatctcatgagaactcactatcacaacaacagcgtgggggaactgcctccataaatcgaatcacctcccacaaggtcccttcccaacgctttgggattacaattcagattaaaattcaagatgagatttgggtggggacacagacccagaccatatcagcctgtgaaaattattttaattgactttgaaacaccacaactctactatatatgctaggtgagatgtaaactaagtacaaacataactgcaaacttttttaaactttagtcattcggtatttttgatggcaagtgtttatgttttactctgtgtcccattgtgtgtatatcatgaaataaagcaaatgaatgattatactaaaaaaaaaaaaaaa

SEQ ID NO: 3655 - DNA, 581 bp, Homo sapiens
cagggcaaaggttaacactgaggagaaactgctggaagtagaatccaaattaagtaagagaagaaacagagaccagatccagttctgcatggctggggaagcttcaagaaaattacaatcatggtggaagaggaagcaaacacctccttcttcaaatggcagcaggagagagaagtgcagagcaaaaggggcgaaaaccccttataaaaccatgagatctcatgagaactcactatcacaacaacagcgtgggggaactgcctccataaatcgaatcacctcccacaaggtccctccccaacgctttgggattacaattcagattaaaattcaagatgagatttgggtggggacacagacccagaccatatcagcctgtgaaaattattttaattggctttgaaacaccacaactctactatatatgctaggtgagatgtaaactaagtacaaacataactgcaaacttttttaaactttagtcatcgtatttttgatggcagtgtttatgttttactctgtgtccattgtgtgtatatcatgaaataaagcaaatgaatgattaaaaaaaaaaaaaaaaa

SEQ ID NO: 3656 - DNA, 953 bp, Homo sapiens
cctgacggagcctcgctctgttgtcaggctggagtgcagtggtgcgatttcggctcaccgcaacctccacctcccagataaaagcttcaagagccagtgggccattcacaaggttctcttctccctgacatcaccttgagaccagtgatatcagttccgaatagtggaggctctatcaacttggatccctgagtgaggataacatggagaaaagctagctacaaattgctcaacccacaatcaagatgcagtgatgatacaatgcaaagatgcagtgatgatgcaatgcaaagatgcagtgtgaacaagagacaaacatctgttatttcagcccctgagatttcagtgctgtttgtgactacagcataatcatcatgactgctactataagctcctctgtcaagctaatcctgaccgaaatgcccccatgcattaggggtccatttgaactcctgaatattctgtacaccagggaagaggtctctataataagcaaatatatataaccatcttgtacacatctataatcagaaaaaccatggaaatccatctaccacgttagtggccttggaaatgcaccttgcagacttccaactacagggagcattactgagctggggcccctgctgctaaactctggaatcttctccacatttgctctgaggctacacttcctacaggttgttcccagccagtgactggaagcactgagtatagtaagcatactaaggcaggcctgttcctgagagatgcaggcctctaatagcctttctcagacttttcaacagtctaggacacttccagccagccttctctgcctctgtcatcacttggggtcagattggtgttgcagtctgaaagctctcccagccttcccccatcttctcctattttctctcacacaggcatttccccaaataaaatccttgcacattcaaaaaaaaaaaaaaaaa

SEQ ID NO: 3657 - DNA, 689 bp, Homo sapiens
acaagcgccaacagaacagcagattaacaccaaaaaaaaaagctaggagctactaaaatccagacatccaacaagagaccaataggatacactgatgttttatgaatggggccaggaccagcctgagtgtggagcctcgtgggctgagtttccccgggattcagagccctgaggttgagttttctactggtcagctggatcagttcagctgctataaagagacggtgcccggccacccatacagcattccattgtggcagacaatggactggtgaaatgcaacgtagacagtctgaggaccctgtgcaatggaaactccagttgaaattgtacatagtcactaacgttctacctattcaagggggctgaagacagagtctaagaaaaagctctgaagccagagcactgttgcagcctcggcctcattttccaacagaagtctttcatataatcagagggctagaaaagaaacagaaatacacatgccggctgccacattttacagaagaggaaatggaggcacccagagataaagccacttatacaaaatcatggttgatgatcgtgccatgtatcccctgaatgaagatgacagcatagatgagcacagcttattgtcgaagtcaacacatgtctatttttaatgatagaaactaatgaatttgcagaattgtaaaaaaaaaaaaaaa

SEQ ID NO: 3658 - DNA, 688 bp, Homo sapiens
cctaggaaaatgtaagcttgaaacatccaatagaaaatccctaaaaacttccctgaagaccacttgggtaaacatcacacatgggaatcaatcaggtcaacagcaaaagatgaatctgtgagccagcatttcagtcaaacccctggaggagaatttggattcctttggctcttcgcattagtcactccaggagagcaattcacatcccataaatcacattcagactgtgacttgtagggttgtctaaaactgtatttacccatcttattccatgtgccagaattaaagaaaatctgagaccatcagtgtgataggtatgtctacctgggcctgcttatgtaaatagtgaatgcaagatgcatacatttgtaacatgaggattgcataattgatctggtaatatgctcaatttgagcaaaccagattatttagttccctgtatcatcacaggaataaagaaatgtgtctatcaataatataaaggaacatgtcaatgttacttttaaacacaagtatggcataaatacaaaccaatgttgttaagattcaaaataaatgtttgaattaccacagttctcttagatacactgtcctttttacaactgcgtttatgtccaacttttttccccgtattatatatttgtataagattaaaataaaaagttcttctagggaaaaaaaaaaaaaa

SEQ ID NO: 3659 - DNA, 626 bp, Homo sapiens
agtgagatcatttgtacaaatcttgaaaccaaagcacagcctgtatgaacccatgttgaaccctggactttcaggactactgtatggctaaccacagccctgcaaggccaggctcagcatgtcacagttttgccactgaacaagaatctttcgaaggatcgcaaacactacatggaaaatgactgtattctttctgcaaggccactctcttagacatcaccctaacaaaaacaattacgggttggaagaggagaaaggatgcaaagtttgtgccttgacctaaaaaaggtcatgagcacctctaccggttcttggaaacattagttgcagtggatctcaaattctattgcgcaaaagatcgacctggtgaccctctaaaagtgtagattctctggtttcacccctagaccttgtgactcagatgtccagtgaggccaggaactcctcactgttaacctgtgccctattttaacaagcgctgctgggagtcgggatgttgggggtccgcacaccacactgaaatagaggaattccctgctcaaagatcccgttatgtcctgattacaatctgcaatgagattatgaaatcattaaatcatgattaagccaaaaaaaaaaaaaaaaaa

SEQ ID NO: 3660 - DNA, 792 bp, Homo sapiens
tcgtggggacggtgttcacccctgcagtgtagatactttatgtaaaatgatgggctttggactggggttgcctctcaagagtgatgtgacaaatgaacacttctcttaggaaaaaaagaaaaagaaagaaagcatatacttccccaagataacagtgcttagtcattcagcaagtatttactgggtccttactgtctgccaggaaacgttctaagagctaaggattatctttgaataaaacagatgaaaaattccactcttacaccaaaggcatcatccatgaaagaaaaaattgaatgaagttggacattattaaaattaaaaacttctactctgtgaaagacattgttcagagaataaaaagacaagccgcagactggcagaaaatctttgcaaaacacgtatccattaaaagactgttctccaaaatacacaaagaactcttaaaactgcacaataaaaaacaaataactcaatttaaaaaatgggtcaaagacatcaacagacacctcaccaaagaagatccacagatggcaaataagcatgaaaagatgcccaacgttacatcccattagggaactgtaaattacaacaacaatgagataccactacatattggaatggacagaatccagaatgctgacagcaccaaatgctggtgaggatgtggagcaacaggaactttcattcattgttggcgggaatgcaacatgacacagccactttggaagacagtttgtcagtttcttacaaaaataaacataattttaccccacaaaaaaaaaaaaaaaa

SEQ ID NO: 3661 - DNA, 253 bp, Homo sapiens
agcctgaatccaaatgacgtcagtgcaaagggcagggtttctttgtacagaaacagctgacaagaaagccatggaattttctgcacttcactgtaccaaccaccacctgtctgtgacctccatctacctgagctcccctcgccaataccaagccagggtcttctgctgtactcccagagcccagggtagcacctggcacacagttggtgcccaataaatgtgcaaaagaagagaggatggaaaaaaaaaaaaa

SEQ ID NO: 3662 - DNA, 676 bp, Homo sapiens
acccctcaaattttgtccctgatcctgatagacgagatgggaatgtggggactttgtgagataccctggatctttggaaccattttactccttagaagctcacactcagaagaggtggctaaaaagggtctgtgccttgctgaaatccagccaattgcttactactgtttctattaaatccgttgagcagggaagagtgttagcataatcatccagttatgtgaattacacaggatggatagatgaaaaattgagcacactccaggtcatgaagacatgctattaaacactatcgagttatgataattcatatgcttacctactgctgtggtttcaatattgcccccaccaaaactcatgacaaaagtgaatcccctatgtggcagaagtgagaggtggctcctttaagaggtgactggattttatttatggattaatgggattacggatcacgggagtgggacccgtagctttataagatgccaaagaaagacctaagttcacatgatcaacccttcaccatgtgatgccctgtgccaccttgggactctgtagactccccacgaacaagaaggctctcaccaaatgcggaccctcacccttgaacctcccagtctccagaactgtaagaaataaattttgtttctttataagttaaaaaaaaaaaaaaaaaaaa

SEQ ID NO: 3663 - DNA, 1078 bp, Homo sapiens
ggcgcaactccccaagggaatcaaatcacagaacaagtcatcaatgatgttttcacggcagaagttataggaaaacgttttcttggtgatgattgaagagttaataaagccaccacaatatgagactggtaccagcaatgcacacagctttatggacatggcctgagcataaagcaggggcttggagatggccacgtagcggtcataagccacggcagccagcatgtagcactcactataggccagccctgcagagaagaagaactgacacaggcagccagcaaaggagatgcttttgtcttcagagatgcaggtcactaggatctttggggtgtagacagaagaataccagagatccagaaacgacagatttccaacgacaaaatacatgggtgtgtggaggcaggagacattacagatcaacacgatgagggtgctatttcctaccacagtgagagagtacacgcccaggaacaccacaaagaggcccagctgcattcctgggtctgtggggaaacccagcagtataaactcagtcactgtatggattgctcctttgcatggctgccagggaattcacctatggggaaagaaaataagttcagtatgcataactgtcatgaatatgtagaattatgttacataagatcacatttgcagtgtttcgtgaagtctagaaccaacaatctaattgtttgttttagaaagtcttcattttgcatcaatcaggctttgcaattatgtattcaattctaaatttcttaagttgttcaattatgtttttcctttaggaatgactgttcaagtgaagaaaagatgtacttataattgctatttttcttatactttgatcctcttccttttgtcaattttctcttttgctaaatgtgtacatttctatttttaagtatcacttgtttgtctttaaaatactgggcatccctcttttaaatatagtttaaaaagaataaagtatttttcctctaaaaaaaagaaaaaaatggcctcgttggctacagcggggagtgtgcggccaagattttttatctttataatatgataaatacgactcaaagca

SEQ ID NO: 3664 - DNA, 775 bp, Homo sapiens
ctgtttggagtcattgacaaacatggcattgaggacagagactgccacttcataattttctacatgcaactgctgaagccactcgaagatatttccctcagagaaccataacccgctttggagaagatgcttccacatagcttgtttcacagcatctcatctctcattaaaaccttgttgagggagcattactgtctgagcaatggacatatctctcatacgaaccttttcagctaacaccggataagccagctttctgacagcctctttcacatccttggtgcaccctacaatttttggcaaagtctttgctgatggtgcaatacatgataacactgcctgtctaagttctggattcaaatcaatcattttcgatcaaagtagcatatgcattaaccactgggcattcatcatcctttggatcctgaagtcgtgaaagcgccagaactgcctgtattctcacatttggaatcttatctttcagtctaataagcatggcttcattaattttggccaacacaccatcatcaatctgagcttctcctggcatacttctcaaaagcttgattatgccagttcctggttcttgaactaacgtacgcatcagcaccggctgattctcactctggagaagacagtgctgagcccaggggcccctgaggcattgcccccctttccagctttccaggaagtctggactggagaaggattcaaccttctctgagctaacattttctgtgcccacgcgattatcaagtgtgatccagacattctt

SEQ ID NO: 3665 - DNA, 658 bp, Homo sapiens
cagaataatggataataaaccagcttacagtacccaaaggagagcttcttggaccctggaaaagtcttcaaatgcaccgcatacacattaaatttttttgccctctaaagatgcctttgaatcaaataaaaattgctttactttcaaaatcaagaatcaattttccagagttccctggttgaaaaggatatttttatctgtggcctcatctgattcttgaggaatttaattctccatttttcaaagtttggatgggagtactctaggattcacttggggggcattttataacccagattgcttcccaatacccttctttatttctcatctcagactccatggatttagccttctactctttctgtctctggtcaacatgccccgatctgccttttggactttcattagtctcaaattggccttcaaagcaggatgagatatttctaactgtcttctaccagtcctacaccacaaagcaataatttatttgatcagtcactcactttggttctacacagttaattcatacatgtattaataagttaaataaataagcttttaacaatgtatattcaatttaaaacaatttttcttgttccctagggttgccatgtaaataaaacagagtaggcttgtgagtaaaataaaaaaaaaaaaa

SEQ ID NO: 3666 - DNA, 611 bp, Homo sapiens
cctaggcggccacatcaagacgcatctcatccaaggaaccatgtgcagaattgatatggagtttgatgccatgattgaatgagagttgagggtcttgggagggtgcgagcatattttgcatgtagaagggatgtgaataattaagaccagaggacagactgagacaaattaattacacctgttgaacctgtgcccacatcctttgcaatgtgactttgttgctctccccttggatttggttgaatttgctaattgcttttaccaatatcatatggagggagtaatgctatgccagttctgtgcttaggacttgagacctttcacacttctactttctcttggaatcctgcctcctctatgagaacaaagttgacaagtatgctagagtatgagagacaaatgacttagttgtcactgtcaccccatagctatgaccgtagaaatccactaaccctgaaagcagagccacctagccaacctgtagctaactgcagacatgtactggagcacaaccaagaccagacgaaccacacagctaagcccaggctaaattgccagcctgaagaattgtgaactaaataaatgtttgttgttttaaaaaaaaaaaaaaa

SEQ ID NO: 3667 - DNA, 849 bp, Homo sapiens
attagtgggaggcgaccacaggaggggacgagaatagagagaccagagccctgaatgagtcagggttaccagggagatgatctacgaaatcacgatcggatgacaatgacagctacagctcacaaccgtgcaagcaacttggccggagccacctcgcttcccagagaccccacttttgttcctattatccacgacgcttcaggctcagcacagacaggttcggcaacctgccccagctcacccagtgggggcatggaagagtcagcttggaagccaggtagcgtacagccatgctcttaccagataccctgctgcccgactctccctggccatccgaatagaatccattctccaaggtccagatccctgacaaagggaccacgtggagctccagagggaatctgggagaacagagaagccgctggctgctatgctgctagccaaaccctctttggttttcactggctgttgttaatccctccagagtctgttttctcgtctgtgaggagggcacactgatattgtcagagggttaagggcacagcctctggaatcacacttgggctctaccctactctgctacctgggtcaaacggcgttgcctcacccagcctctgtatactcctttgcaaacaggaacctcacagggttgccgtacagtttagaggagataaagtctgcaacatgctcagcacggtgtctggtgaactgggagtgcaccacagatgacaccttgcaggatggggaccctgtgatgtccacagcaccccgtcctcagtgccttgcactgctgggcttggcaaggtggtcaataaatggtttgctgagcgaataaaaaaaaaaaaaaaa

SEQ ID NO: 3668 - DNA, 659 bp, Homo sapiens
acccaggaactggagggccaactgtatacgtgtaaggaagaaaatatttctaactcctatcaatgttcatggctaaagcccctacaacaaaagatagattaataagagaaatgcatacaattaatttaacgaatacccaagtgacagagaagaactggacctaaaggattctgaagtttatgtgaccacaaatgactttcctaaccacatccatgtattaattcaattgttttacaaagagaaacctgagatactaggtcgtctaacatcaagacctccgagacaatctggctttgacaagactaagtatgaaaagagaataaatttaaagctgatatgaagaaaaaataataaaataatagtactgaaaacccaagtgattgaaagtgacaataatggcatgctaaagaggacaaatttggaaacctcttaataaaaatctcttctcatttaaacagctacagaattccacaattttgggagctatttactaagtacaggtcactctggaaagattctttaaccctcaggacagttctgtggggacaaccttattatttccatttaaagctaaggaaactaaaagttttaaataattttcatgggggtgcatggctaataaatggtggagatgagatttgaacccaaaaaaaaaaaaa

SEQ ID NO: 3669 - DNA, 605 bp, Homo sapiens
  misc_feature (1)...(605): n = A,T,C or G
tccttgctactccccctcatatctggccatccaccattttgaactggtcagcatagtgtaatgtagtcaacacgtgcaaggacttcagaatcaaaggcctgggtgtgaaccagttctctccacttacttaaccacattatcttgaaaaaatttaattcatctttcagagcccctgtttcatcatctgtaaactgggataacaatacttctaagatcattgataggattactttggttacttaaaaagcattcctgtgccattactagtaatatttatcattttaaatgatgacaattattactttcctcagaaagcttctctgccctccccacattatgaaaggtgcccttatagctcctgtgcttatctcctaatagtgtaaattcctgttgaatgttcatctctaccactgagcgtgagctcttggaaaacaggaccattgtttctcgttcaacttggttaactgcaaaacattgatgataaccaggaaatgcttgttggttgaaaggaaaaaaagaaaaaaaaatggcctcgtggctaaaagcggggagtgtgcggccacgnctncctctttcttagagatctataacctgtctgaaaagcc

SEQ ID NO: 3670 - DNA, 1127 bp, Homo sapiens
cctggtgaactcatggtagtgctgcctcaggacaacggatcattcatctccctgactcccaggtccaacaggggacacagaagagacagatgccttgcctgcgttcacctggagaaagtttgtttagatgacagaataaccctgggtatattccagctcagcaagcttgaaatgactctggggacttggcctggccaaagcacagttctgaaatcttttctttgttgttgtattgttagagttttaacaatgaaactaaaggggttgcttttggtgagaggtaggagaataaaacttcacaggggcacagcaattagcgtgtggactagatccctatgacggagaaaaacctgcagcattttgtagatgatttattagacatgggtagaatttgctagaaacctaccaggagcaaatcatctgggaaggaattaatgacccaaacaaaacacttgataatgcaattagaacttgaagaaacgtaggggtttttcagagagagagaggggagttcatgtacatgactttgattatgtcaaatgtaaggctggaagaagggtgttaacaagtttttagaagttaaagttatcagagggtacaagaagatggcgggggagacatttatagtttttttgcatcagtgtagttagcaaatgtgcccagttgggtgtaaatgcactgccagctttgtctcagcaaaatggtgtgtgggtctgagaaacacaaattagcatgctgcaggcaaaaatacggatcccctgcacacgcaacggcagagaacagccaccaggagaacgcggtgtttttctttagttgctttaggcaacactaagtttccccctgtttttgtttgggtcagggattttttttcctttaaatcttttctcagttgagtttaaaactgtgagtatgaagctctctaagcttttctttgacctcgtttcatcgtgcattacagatgagctcattgaaaaacgtgttttgcagcggcaccattcgctgagtatgtccagaggacatttctggccatatacgtgtcttaattgctatcgcaggcttggcatatcaactatatctgggtctaacataggctatcttttgttgatataaacatatatgtttctaaa

SEQ ID NO: 3671 - DNA, 291 bp, Homo sapiens
ctagtcatgtgctcagcccctctgctcatcaggcaaaaccgagtgtccccagttggagaagtttaaggtcttcctgtttgtctgaactcctggcagcgaaaacatagacatctgtgcattgtccggctcgtttccttccctcagccccctgcccagcccctccacagcatctacaccattgtattgttcacattcttccttatcttgaccttgtactaactgcctgtttattgtaatgactcctcagataaagtactgcttgggacttttttctttttaaaaaaaaaaaaa

SEQ ID NO: 3672 - DNA, 277 bp, Homo sapiens
ctagtcatgtgctcagcccctctgttcatcaggcaaaaccgagtgttcccagttggagaagtttaaggtcttcctgtttgtctgaactcctggcagcgaaagcatagacatctgtgcattgtccggctcgtttccttccctcagccccctgcccagcccctccacagcatctacaccattgtattgttcacattcttccttatcttgaccttgtactaactgcctgtttattgtaatgactcctcagataaagtactgcttgggaaaaaaaaaaaaa

SEQ ID NO: 3673 - DNA, 315 bp, Homo sapiens
agtcatgtgctcagcccctctgctcatcaggcaaaaccgagtgttcccagttggagaagtttaaggtcttcctgtttgtctgaactcctggcagcgaaaacatagacatctgtgcattgtccggctcgtttccttccctcagccccctgcccagcccctccacagcatctacaccattgtattgttcacattcttccttatcttgaccttgtactaactgcctgtttattgtaatgactcctcagataaagtactgcttgggacttttttcttttaattaaatgtttggggttgagaaattgaaaaaaaaaaaaa

SEQ ID NO: 3674 - DNA, 767 bp, Homo sapiens
  misc_feature (1)...(767): n = A,T,C or G
taatcgcgaggccattatacttgtaagactttcaaactgcatcttcacgtagcacacgttgcagaaatatccatgatggatcttacaagacgttttattataacaaaaaaaaatatgctagcataccttatgttttgtaaacacttacacgattctgccgattaacaataagcgtatagttatggtgacaaagaaaaggcaatgaaggccgggtaactaaaaaaaacaatggattgaagtaatatgagtacaataaataatgtttaaattctatcaaatttaaatagatcatgtttcataaagtttcaacaagttccaagtaagaaccccacccttgtacatccaaagactaattttgtcatccgttagacaaagcagattgacagtttaagtgatccccgataggtagggactttgcttcaagccagcatgaggcagtttcagaagaaagaccattagcactccacctcccataaagaanatttggacgcccctggcaaggagggggggaggcccgaaaaaaggacccggaggcacagaacaccaggccgaggggcacggcagccccccttttatatattatctccattcacatagggcacacacaaaggaaccaatggaaacctctagagggcattgaaatccgccgaaatagtgccacagcgaccctcgaatccctatgcttgggccccactcccactctgtggagtgtacttccattttcaataaatatctgcttttgttgcttcaaaaaaaaaaaaaaaaaa

SEQ ID NO: 3675 - DNA, 509 bp, Homo sapiens
ttttgggaggctggagacttcagcttcagagttcatgtgacaaatgatccagccagttccagttgaagacaccacccctggccatcaagaagctactctgcctccactagacagagcagggtgacagttccgtgatccccaataggtagggactttgcttcaagccagcatgaggcagttacagaagaaagaccattagtcactccgcctcccataaagatttatggggatgacatctctcagagaggaaatgaggcaggaaaacaggatccggaggcatagaacataaggcctattcacacttcagctatgccgggaaatattatctccatttacatagggcatacacaaagtaaccaatggaaacctctagagggtatttaaatcccccaaaattctgtaacaggacccttgagcccctatgcttgggcccactcccacactgtggagtgtacttccattttcaataaatatctgcttttgttgcttcaaaaaaaaaaaaaaaaaaa

SEQ ID NO: 3676 - DNA, 315 bp, Homo sapiens
tcatactgtacatctgatggacctagtggcgccacccagaccagtaaactggctcctctggtcttgtggccaccatccaggagctgactcagagcaagaggacagcctggactccctgtgatttcatcctcaacccaaccaatcagcactccccattccctagccccctgcctgcaagactgtgtttcagggaggctaatgtgagtaataataaagcttcagtcttccatttagcctgctctatgtgtattaaactcttccattcagccaactctgcacgaattaaactctttctccattgcaaaaaaaaaaaaa

SEQ ID NO: 3677 - DNA, 318 bp, Homo sapiens
ttttaatgggaacatcaaataacccactgaaaaagccaatgaatcttcctttattacaaaagaagaagaagcctcagaaaaggttgaaatcctaacacccaaagcaatggtgtcagaaggtggggactttggaaagcgaataagtcatgaatgagattagcgaccttataaaagagaccccagagggctcatttgctcctgctgccatgggaggacacagcaaaatgacagccttctacaaaccagaaagtgggccttcaacacacagtcaatctgtctgtgagaaataaattcctgttgtttataaaaaaaaaaaaa

SEQ ID NO: 3678 - DNA, 365 bp, Homo sapiens
gggggtggggaatgtacttgatgatgttcgaggggacagggggttcagtattatgctttattgctattaccaaagctattgcctatgaatctaatctcttgcaatggagtcaaaactatgctgagggatgacaaaaaaacacttgttggatatgtgacctcatacctttttctggtggttcttacctatcacggatcacagcaaactcgtagatcttagtgggagaatgcagaagaggatcatttcccctagacttggaattttaaagctgtatgattaaggaatcaattgcctttcactccgtgtaactagagactgacttaaaatagtaataaaatatactgaaaccctgaaaaaaaaaaaaa

SEQ ID NO: 3679 - DNA, 776 bp, Homo sapiens
aatgattacatttgttccttgctgttaggaggaacaagcagaagttccatatgccaccttcttctgctactgcagcaacaagtgatattcgagacagtgaagcccccatcaattctagactgatatggagcagagacgacctcctatacacactcccactactgacccatggtggacaagaaaccagaaatttcattatgttaagcttctgagatatttctgttttttccactgaacattattctaatttatgtgatatatttgattttagagctaacttgttctaaagcttacagtcttttgctgggcagggtagcagttccagccacttagtaggctgaaacaggaggatggcttaagctcaggagtttgagaccagcctgggctaaataatgagaccccatctcttaaaaatatatacaaaatatataaacaaaaataaagcttacaatttttttcaacaacaaccatgtgtatagttcaaacggattttgtaccccataccttagcaacctactcaatgtcatataagcctttctacctttcagagtatcttcttgtcattccttcttaaaatgctcctcccaaatcctattctgtctttctttactacttttgatctgaactggccaataggtgactgtgggcatatgtggccacatgcaactatttgggccctttgaaatatggctagttcaaaactgagactcacttggaggataatactgcgtactgggattttgaacaattgggacaaagttaagttttattttcct

SEQ ID NO: 3680 - DNA, 819 bp, Homo sapiens
  misc_feature (1)...(819): n = A,T,C or G
caggcaccttgtaccctcaaagtttcatcggggactggcattttgtcttactatatcaccctttaaagaaagtctgggccgtgatttccaacagaaaatattgctttgtttactttccatctcccagaaattcattcaattctcacttcttctatttatttttcatcaataaaagcttataatttaaaaaaaatttctttttccttgtatcaatggagtctcatgagagagagcagataaatgcatatggttcataaactacttggaaccagggcatagacccaaggaataaatcatctcaatctttagtgcatcttatttcatttatttaactaatatttgttgaagatgcatgtgtgaaaaacattatggaaggtttaaagataagcaagatatgttctctatattgaatgaaattacaacctcataagtaaagaaaaaaatgaataatacctgctctggcagaacatagtaaaatctatgcaagttcatagaaggaagaaatcacactgaattaaggagattaaaaatattcatgaagagatagaatttttgatttaacaaaaccttctaggaaggcagaggaaacagcattaaaaaaagatgtagaaggcggaaaccacanagtatatttaggatcatgtaatttggagtacatgctatatataagagattcaagagataaggatacaaaaataaattagtactagagcatagacagccttaaagaattaaggcagatatatntaaatctaatttaataatgaatgctgaactattaaacacttaccaagcatgggactggcagacaggggtcac

SEQ ID NO: 3681 - DNA, 427 bp, Homo sapiens
ctagaattatatcatgaattgacgttgaattttgatcaacgctttttctgcacctgttgaactgtcatacaatttttctccttaaattattatgtaaatcacattgtttgactttaatgttcaaccaaaaatgtattattctttttctatattgctgtattttatatgcctatactttgttgagaattattgtgtatatttttataagaaatgttaatttgtaattttttaaaaaatttttaattgctattgagatggacataattaatcatgttaattgtgttgattgtgagctccattctgtgtgaatagaaaccatatcaaacaacatcagtagaaatgtgtttttatcagacagtttttgaggtacttctaccttttgaataaaggctttctgcagtttgcggcaaaaataaaaaaaaaaaaa

SEQ ID NO: 3682 - DNA, 336 bp, Homo sapiens
cagtcacagctctgtttgagtaaatgatccatccttgaatcgtgtatgcagagacaagatcagcgttggattgttgttttaataaactggaagtctgccaacattatctgggaagaggacgaggacattaatgctagcatgcaatctagccgtgtttggatttaagacagaatttaatcttcttgcctcctttccttcccctcctccccctttccagtcctttcttcccttagtacacagtctcttttcatggagttaactcaagctatcttaaacagcatgaactaataaaggatgacatttttaaaaggggaggcattcacaaaaaaaaaaaaa

SEQ ID NO: 3683 - DNA, 328 bp, Homo sapiens
gcgtgtgggactttacgttttccttacaacctacggcccaccctatccccatattgtgcctataaagactccaggctcagtcagtagagggaagaggcctcttgactttggaaagaagatggctggactttggagaagagacgggtcgactttggagagaagatagctggactttggggaagaagagacagcttgacttcagtgaagatggctggaattcagggagaactatctgcccttcccctcccctctccagctcccgtctcttctgagaaccattcccaccgctcaataaaattctctgccttcaccatcaaaaaaaaaaaaa

SEQ ID NO: 3684 - DNA, 395 bp, Homo sapiens
ctgctacttgaaaagattgaaaaatatgagtctggaagccaagccaaccaaagttctaataaaccaggtggacttttggaatgcatcaacattctggtgtttttcaacttaaggatggatttggaactggctgcagaaatgtaatcagcatcttctcaaagaaaaaggcagacttaactgaaagttgaaatttgtgtgcccaaatacatccctctgaattagggggcttggaatagtcaataacaagataccacaaaacaactatctctatacaatctgtataaaagaatactcagaatcatgtgtaagtaaagaagtggttacctatttcatgtttctcaacttgaaaaatggggcactggagattaaactgggattcatgaaaaaaaaaaaaa

SEQ ID NO: 3685 - DNA, 238 bp, Homo sapiens
aactgcaagcttagcggaactgtaatttaaacccaggagtgggtaaccagtgctctacctctgaagacaaagataactcactatacgggaagaaaaaggatgccccacagaagaggaaaggaaagcttggaactatcaactacatttgacagttcccggtaatttaatcaaggacttcaagggaagcttgaaccaaaatctaaaataaagcacaataaacatgccaaaaaaaaaaaaa

SEQ ID NO: 3686 - DNA, 488 bp, Homo sapiens
tttcaggtagccaaacgtcaccaagtaaagtgaagagaaaaaggcaatatactgtttgtggaaactgttgatctgaagagctccaaattcctgaaaaagagctgaatttgaagatgcccagcctggagtatgtgtatatttttagtgattactgcattaaaagaataataatgaaataaaattatatcaatatgatgtcacttcataatgacttaattgctaaccccagcctgtaattattttcatagttaacattgccatgtcatatctacagtgttatctatcttttttaatatatgcattaaatagaattttggtttttaactttgttttatgcccctttgtagagaaaaagctttattactgcaactaagaataagaacgtaaaatgtccataaatttctaaaagaatagtgtgtgcattactattttaacataattttggattaaacctattgttattagcatttcagacaaaaaaaaaaaaa

SEQ ID NO: 3687 - DNA, 387 bp, Homo sapiens
cttggtacactacttcttaagcgtgtgaagtttgcttttggcacagaagcgatccagaagtcatgcagagagggcgggactacatggttgagagcttcttggaggcagaatgaatcaagaaaaggttctttagctaaataattactgagccctttgtggacactaaataaatggtacctattagcatatgtctttaactcccagacctacaactttttcctgttttaatctttctggaatttcagtatgtcttgtcattaaaatgttcattgatttagcgtagtagtgtttcttttctttctgaaaagctattattaaattgagagtgaatcttgtaatagattatacctgattattaaagaaatatcattattaaaaaaaaaaaaa

SEQ ID NO: 3688 - DNA, 860 bp, Homo sapiens
ctagaacccaattggagacgttgtatattttatcaagtctttgactggaatgacattttttcagaaataaccagactgctttgaggaattaaaattgactttaagggctgagaaaaaccccttggaaaaactggcatggtaccctctgcatgcaattcctttacaaagctcctgacctgtgttctgaaggctaggaagtccaagattaaggcgtcagcaggtcttgtgtctgctgagggctgtctccgtgatttgcagatgtctgctttcttgctgtgtcctcacatgggaaaaagagagagaatttgctggtattcctttttataaggacactaaccccattcatgagggtcccaccctcatgacctcgcctaaacctataacctccaaggactccatttccaaataccagcaaccacatgtgtgagcttggaagaggatccttccccaggtgagccttgagatgaccctggcctgtgacttgatggcagcttttgagagactgagccagaggcctccagtctccctctccctctctttccaccgtctccctatgatgccgagccgaagctggactgtactgctgccatctccgctcactgcaacctccatgcctgattctcctgcctcagcctgccaagtgcctgcgaaaattgcaggcgtgcgccgccacgcctgactggttttcgtatttttttggtggagacggggtttggctgtgttggccgggctggtctccagctcctaaccgcaagtgatccgccagcctcggcctcccgaggtgccgggattgcagaccgagtctcctgcactccagcctgggcaacaggtaagactctgtctcaaaaaaaaaaaaaaaa

SEQ ID NO: 3689 - DNA, 534 bp, Homo sapiens
  misc_feature (1)...(534): n = A,T,C or G
tcctgatcctttccctcctcagagtcaggacacaagaattgttaagagtgtgctggagttggggaatgacccttctctgcataatcagacatgtaaaataaatttctaggaagaagtcttgtatttggacctgtaagatctgctaaagagtccaaattgtacatttttgactaattattaaattccatagcctgacacattgccacccaaatgatggttcaattaatatttgtcaaacagctttatactaatgatgcctgctaaatgcagatgcacatgtcaattcctttcttccttcttcttgtccagatagatggtgaaaggatgcctagaacaatgggcaccatgttccaaccatgaagcaacaagacaatattccaaggatgctacagcagaaagatgcaaaagatatgggtccctgaagaaatcaaggagctgtttcctccagatactttgttatatgagatcattcaatgtttttactctttacttctgaaaaataaaaataaaataaaaatgtnaaaaaaaaaaaaa

SEQ ID NO: 3690 - DNA, 869 bp, Homo sapiens
ttagatcagttaggattaaattttgctgcctctgatgcaaaacccaaaataaatattcaagatggaaatggattcttctctcacataaacagattgtaagcaggttgtccatggcagccatggtgtcagaatggaaagacagaggctgcttccagctcactgctctaacatccctaagggttgtgggttgccaagcctatcaagcagctcagggcaccaggaggtaactagtcttgaccaggatgccatcccattgcagggcaaactcacacaagcacacctatactcacgcaggctgggaccacgtaggcatgcctgttcacctaacctaacatgcacagatttgagacgtgagaagaaaccagagcgcccggagaaagcccacaaggacatggggagaatctgcaaactccttatacagacagtggctcagctggaaatcgatttttttccctcagcaaatgttataatggaaaagatgtttggacaaagcaatgttattggaggacctgctctatacccagaagtgagattgctgaattatatgctaactctcagtatcgttctaaggtttttactgtgcaggtcttgtacatgatcttttgtcacatctattcctaagtatttcagtttgctatgctcttgtaaattgcattttaaatttcaattttctatagatagatgttagtctgtaaaatgcaattgttttttgtatattgatcttatatcctgaaaccttgccaaacccacttgttagtcttatatcttttgtcttcctggtagatttatttagatttcctacatacgttaacatgtcatctgcaaataaagactattttacttcttccttttcaaaaaaaaaaaaaaaa

SEQ ID NO: 3691 - DNA, 169 bp, Homo sapiens
cttagaacaagaatttgagaatctgtgtcattctgatgagctgtgtggcctggagaatgttcctcaattaattcaagaattatctgtgggcttctattttggaatcagcactttgctagatcctggggagatggaaacaataaagtagtcccagctaaaaaaaaaaaaa

SEQ ID NO: 3692 - DNA, 555 bp, Homo sapiens
tattctggcccaactcacctcttctctgccatgtgcctaagctatatgatggggtcatcaaggagcttcatttgctgaacatggtgatgaccttgaagcaggattgatgagaaatagtgctctggggaaaggatgtatacacaagctgggctgtgacagcaacagtatggagtcccagaagctctactgtggtttgtgaaggctgagatttgaaaaatcctcttgcaaggcacagagggccaattaatagtaggtgaagtggcttctccaaggtcctatggcaaatcagcctatggagagacagctggatcctcatgtttgctgctgcatccagtccgttgtgatatcacacatcatgatgcctctgaagaacactattgtgcaattttgagacaattagagtgaaaaaggcaaatagcatcttagccttattatggacatactttcaccttgtggacccatggaaagggtcttgggaaccctgtgagggccctggactatactttcagaaatgctgctataaaatctgtttgaattctaaaaaaaaaaaaaaaa

SEQ ID NO: 3693 - DNA, 800 bp, Homo sapiens
cctaggagatcagaatcctgaagttgatgagcgaaactgcaggaaaggggaaggacacaaaggctacaccctgcaaaagcagtcatctgtcaagaaaaggaaacccttggcagagtagcccaggctaatatgaggattaaagcggcagcggatcataaaacgcaccaatcagcactctgtcaaaacggaccaatcagctctctgtaaaatggaccaatcagcaggacgtggctggggccagataagagaataaaagcaggccacccaaaccagcagcaacaacccgcttgcgtccacttccctgctgttgaagatttgttctttcactcttcacaataaatcttgctgctgctcactctttgggtccctgccgcctttatgagctgtaacactcaccgcgaaggtctgcagcttcactcctgaagccagcgagaccacgaatccaccgagagggaccaacaactccggatggaaggaacaactccagacgcactgcctttaagagctgtaacactcacagtgaaggtctgcagcttcactcctgaagccagcgagaccacaaacccatcagaagaaagagactccagacatgtctgaacatcataatgaacaaactccggacacaccatctttaagaactataacaccgcgagggtccacagcttcattcttgaagtcagcgagaccaagaacccaccaattctggacacactatgacaaccactattttggaatatggtgttaatcactactatgcatattttaatataaggatccataaaccaaaaaaaaaaaagaat

SEQ ID NO: 3694 - DNA, 547 bp, Homo sapiens
ttttttttttttttttgtttatttgtttattttattgatttttgaacccttgtgttttaactttgtggacaccaacttttggaactaaagtgatataacttcccagagtagtggtaaaacagccatgagacagagttgagcccataactaggcaaatttatagattatcatgtgagataatgtacacaaacatatttacatacatatttatttttcccgagtaatacatgtacataacgttaaaatgaaattctactgaataattaaagttgaatgcagctgtctcctgcatcactcttccattgtccaagttcagtttttacatcaatgatttgaaaacattaggcagttacttctgattcttctaaaatatatgctccatgaggacagaaattttctgtttattgactgtagtttcacactggcatgttggaaactttcttcaaatgtctcgctcttcttggacgcaagtaaaaacctttaactgggccttcgagaagaataggagtcagccatgggaggaggaatatgagaaatataagcagga

SEQ ID NO: 3695 - DNA, 735 bp, Homo sapiens
cctggagtctcatctgccgccttgctggagtgcggtggcactatctgggatcactgcaacctctaccttttaggctcaagtgatcctcacacctcagcaccctagtagctgggactacagatatgaactggaattcctgtcctctgcattgatggccccacctttcagggtgaaaaataccaaaaccaaaagagaaaaagaaaacagaatagagtaaagagataacaacaacagaagaaaaacaatgacaaatcattagagacatatgaagaaggataccaaagagtgcatctgccttcagcaatttgttcatgtctatttcctcagtatctctgcaatctcaacactcctatgccttgaatatcaattttgtgtgtgtcatcagcagcttcatgtagactcttttgtgtcccattacactctttttgttagggacaaccataccctagtcttccaaaataaaatcaacttctgttttttcatcttagttgcctctaatatctaaaatctcacataaattttccttctttccatcaaaatatctggcagattgcttattttccagttcacgaggctgtagccttgttatctgatgactagtgttttaagacattcgctgaatcagcctcttgcttctagtttctccttacaatattgctattgtatcactgccaatattttaatactctgtcacatgtagtaccagcttattgttcaaaatttataaaatacaaa

SEQ ID NO: 3696 - DNA, 577 bp, Homo sapiens
ccctagaatgacacaagaatggatcattaacaagatattatagaaaactacattctggtgccccgttttggagacagaccaatgaggcctacttggcttttggccttcaggcaagttggcattataagcaaataaacagccaattacaacatatggacaatacgattttatattaggagaatcatatggacaataaagatataaaagaaggaaacttagctcaaaaatggggaagaaatttggctaccaagaaatttatgagaaagaagtggcaactgacatgagacctgaaagatgaaccaaagtgctttaaatgtgaaatataatttgaaagtttatgtgatggtagttttgatacagatactagttctgatagtttagatagtagttcagaaactaaagtgattatgaaggctttaagcgtttttttttctctgacaaaatttgtatttcaattatttaagtagtgtcaataatccttgacaaataagattttcttctattgtggttaaaacaacgacccagaatacgtaccatacgccgaacttggcctctctgcgctcacgagcggaaccta

SEQ ID NO: 3697 - DNA, 810 bp, Homo sapiens
ctagatatgcatcacgctcaccagtgagcatcaaactaccatccgtctcgtagtaatacacactcactatataggtccttagagacaagctagcgtagcgcgtttatcctgttacaatgcaaactgcctcgaacactcacctggaacctttcctatatgcacaagcaccgagaagattcagctgttgccctgaatgcgacactatcactcggcattttactatctgaatcccagaataatgacagattctaaatcttacctacgtatgcagacatatactttggactgttaatgattgtaatgtgtgatctatgaattatttaatactctcctcttcaaaggacaaaaaccatggactcgttatcttaagtagtggggtaaacttaatgactcattactaatatacttatagaggtatgcatcagaggtgctacttctaatgctagggcataactgacgatctgtttgctgccctagtctgactttctgcttaaacatgcaagctgtgagatgccagcatccataacgtgaagaccctcgacctgcctgtggagaggtctccatggcccagacttggactctcaatccacaatcctgccaagaccctcagcctcacgccaggagacatcgcaatgggaaagagccgtcttgcaagcccatcctgcacacacaatcaaggcttcaaatccaccgagccccagaccaggatatgcactgggatctaacgaaagactattcgccagcatgacccttctaatacactctaacatttctaacccctaaaaaagaggctgacagaaaaaatggcgc

SEQ ID NO: 3698 - DNA, 353 bp, Homo sapiens
tagagtatcggaacccatggatcatgtgacctcagccttcactgaattactaatattatgacctctctgttcttgagtcaagactccacaccagaagtgttctacctgagcaccatgtccttgcttctccaagatctagtgagatacagtccactctgttccactgtgtccactaggcaaggactcggaggacatcccacttcaaatccatttcagggaagaggagagctacgcattgtgactttttatatgacttttcttatgtcaaaataaaaactatgtaatccacatttctatttttgcctcaaattataagccaattaaatattcaatctcatgtaaaaaaaaaaaaa

SEQ ID NO: 3699 - DNA, 205 bp, Homo sapiens
cctaggaatgggctggtgtggtaaagctgaaagagcaatgagttatgaagtctaagaaatgcatttcaaatccaatttctagtatcacttgatggcttggcaaccttgaacaagttcctattcccctcatctgcagaacaacaataaaaatatctatttcatagagtcattataagaataaaataatgtgtgaaaaaaaaaaaaa

SEQ ID NO: 3700 - DNA, 410 bp, Homo sapiens
acccccccttccagacgccaacaacgaccatcaagcattatcaacacttcaaatgttcgttccagaatgcaggtgtctctggcttggactctccagaggatggcactcacttcttctgctggttttggggaggaactgttgcctggctgggggatgggatccagtgaaatcattaattccaccagggaactttgtgactctccaagagtggtcgtcggactacgtctatcaaaaccacctgggaaagctgtaaaaatgaactttcttgagtctcaaaccaagctgactgcatctgaatatctggaagactatggcctggaattagatttttcacaagcatctcaggtgatttttataaatagtaaagtctgagacccactaaaaaaaaaaaaatggcctcgttggcctca

SEQ ID NO: 3701 - DNA, 326 bp, Homo sapiens
aggttggaatacaagttaagtataccaaagaagaaagctctccactgcagagagggagcccagaagagggttgcccaggtctttcagcttttaaaaattgaatgcactgtaaacaatactattggaaatattaattgcaattttatagagaaaaatatcttttctaatgacatcatggttatattgattttccccaaaattcattaaagtaaaaaagaaaatttacttgaatattacatgtaaaattttacatcttgttccgttttgcttaaaatttgtttaaatgttttaaataaagttgaattttctttataaaaaaaaaaaaa

SEQ ID NO: 3702 - DNA, 507 bp, Homo sapiens
caggtgttcctgtacaacacagtaccagacaagctgagcccaagacctgacacatgagtggaagaagccaagattgaaatgaaatttctagctccagctcttcccgctgtaggtgtttatatattcacagctgatctcccagacatctggggacccagacaagccatcctaactgtgttctttctgaattcctttcaaaatctatgaacatgttaaaatttctccttttgtatgccattaagttataggatagtttgctatgaagtaatatataaataaaacagatgtatgttttaagaaaaaataaattaaaagctctttgcagaagtaacactttaagggttgccactttaaattttgatataaattattttaatttaaatgattgaaaaaatataattgcgtaatttatttaattgttcagcacatccatgttttcacttttgatgccagggtactttagatcttttaataaaaaataaagcctggtgtgtaaaaaaaaaaaaa

SEQ ID NO: 3703 - DNA, 347 bp, Homo sapiens
cccaggcatgagtgaagtggcatgatctcggctcactgcaacctctgcctcccagcctgtaaaaagttctttgaagtgcctgtgtatgaaccaggaatttcactatcatttttagagtcttctgaaggctaatggatttgggaacacactcccttttctgtacggcttctgaaaatattgttcagctgtatgtggtgtctcacatctgtaatcccagcaatttggcaggccaaggcaagaggactgcttgaagccaagagctcaagaccagcctgggcaacatagtgagaccctgcctctacaaaaataaataaataaaattttttgaaaaatgaaaaaaaaaaaaa

SEQ ID NO: 3704 - DNA, 243 bp, Homo sapiens
ggggtggtgtgcgagagtacatattattgtgaaagagacgaaacagaacaccttactgctcacccttatggcagttgttactttaccaatgctaaccaccctccgtccttcctgagattccctttggtggtgagtgtctgaaccttctgacattagtatcttccacctgagagagattacttcaatgtaattcacttcatttaaacattaaaaaaaatgctactcttttgaaaaaaaaaaaaa

SEQ ID NO: 3705 - DNA, 782 bp, Homo sapiens
ccttggggcaactgaagatactgtggtcctatcccacaaggagcaagcggacgacactgatatcctgaccactaaccattcagcaccacttaaagaggtcccaaaacccccggctgtctaccaatacccatctgtgacctcttaggaaccgagcttcacagcaggaggtgaatggtggacaagcgagcattatcgcctcagctccacctcctgtcagttttaaaaagtatttacagaaaggaagaagtggctgaaacctaaatgccatatggagaagacagctaattgccacactctcctctttggtctttcctggtacgcagcatacaagcccacagattgaggactctgcacttgctgttctctctgcctggagctctatggctccagatagactcctgccaactccttcgccctgtccaagttaccttcattaaatgtcagcttaaatgtgtgcctactttttgccctacctagaattgcaagcacctctcaccactgtgctcccattctccttaacttaagccacttttattctcataataaagccacatattttttctttttatatcataatcgtactgtataatttatattttattacttttgtttgtatacttattgtatgtttctgttcacaaggatgtaaaccccatgaacacagagatctttgattgttttattcactgatttatgccaaatgtttggaacaatgcctggcacatagtagatgtttgataattttttttttttctgaatgaataaatacattttagccaaaa

SEQ ID NO: 3706 - DNA, 221 bp, Homo sapiens
atgaggatggaataaaaaccgcatctcacaacttttcaagaggccaccagtcattagacactggcatccgttagaactgctgcaagcttaaatcaaacagtcacctggaaggaacaggtctctggagactcccctctagctctgagatctgtatttcacaattatttgaggcactgttaaaagcagagaataaaatagttgaaaattcaaaaaaaaaaaaa

SEQ ID NO: 3707 - DNA, 763 bp, Homo sapiens
ttcgttagatacaagctgtaccgctgccggctcagcagtagctgtttcctcctcaagatgaacagttccgaaaaccaatggaagctaacagccaagatgtgcagttttcaacttacacagttacttgggactttttaaaaatatgttttcatcttggcatattaataaggacgacatagaaacgaattagtaaaaaggaatgtcacatttaaaacacttaaggataataaaaataagactattaccaagaaggcagtggttataagcgtacttattcttggtctggaatactagaaacagtaatgaaggcacagggaaacaagctgagaagggaaagactggtgtaagactggtgtaagtagtgtgcattcacatcagttcatcttgatgattcaacctgtacagtactaaaattgttgggaaaactattttgatgactaaaactttttttgttacattggtgtatattgacgcagagaataatgactgtgaaacaaatccatgttttactttaatatcatcaaaattggttttaaaccggtttcgattgctatggatatgagaaagatatctcatgttgtattccctactgaattgatcacacttgcctggcataaatgatgagaagtgactttaagagatgaggctaatggaaactatccggaaggcatctttgcagttttcagaggtcccatgccagtggtctatacgtccaggcgcgtatccaataaaactgtggcagcggggggactctgtggttatg

SEQ ID NO: 3708 - DNA, 232 bp, Homo sapiens
aagctgatgataaagatgagaggacgggaaagaagcagaaatctcagattacgcatgtaagatttcattaaaggcctgatgatttcaactggttgctgtcacacgatctcttcatcagtccaggttcagggtactgagagtagtgcttttcatcctttgtcaccaccatatcaccagcacctggcacaatgaaggtcgtaaataaatatttgttgaaataaaaaaaaaaaaa

SEQ ID NO: 3709 - DNA, 274 bp, Homo sapiens
cagtaggtcatggtgcctgtctatttcaaggagagaactttcaagggtttctctttgcatttagtttattagattgctactggtgtacaattcagaagagaagaaggcttggagacagaacagtgaaaaatggagagttggatcaacaccaagttggagacaggaactttgtaacacctgacacagagtggaaattcaataacagttgaatgaaggttaaatgaaccacatctgtatgcaaaaaaaaaaaaaaaaaatggcctcgttggcctca

SEQ ID NO: 3710 - DNA, 512 bp, Homo sapiens
acagatggtattgcctctgaatttgctgattcagaagatgtcggactcatgttatcctatagaagatgtaacaacccatatacatttatgaaaatcaggaactacattattataatgatgaaggaaaagcccaagaaatcaaccaacctgaaacctgcaatgaagctgtgcagctgtctttgccaacagggttctgcacctcaaaactgtataccccactgtcactcggtgctacattgatgatcttaaggccggatactttgttgaagaagcttattttgtatttgttgtcacttgttagctcttttccatccttaaaccacttagtactgagttcaggggtgccagctactgtacactccaaggtacaggtgtctcccgtggtaacttttatggattctggcttttctacaattgttgcaggctctggaatgaaatgtaaaagatatccatattttaaactcaaattgaaaaactaaagaaaatacagatcctggtgaaaaaaaaaaaaa

SEQ ID NO: 3711 - DNA, 245 bp, Homo sapiens
cgtagacatccaaggacagtgtctccttgtcccgttcaccaattgtctatgaaaagccaagggggcttggctctcactccactgaaaagaggcttccacaggctgcatctcaccacatgggcagcttcatcccaggcattgcaggtgtcacaacattgacagtaggattcacaggatctaaaataaatggcctaaaaagcaagaaaattaaaaaccaaaactgtcaatttctaaaaaaaaaaaaa

SEQ ID NO: 3712 - DNA, 202 bp, Homo sapiens
ataggttctgctccactttcttccacagcagggactgtcaccggggattcccatgacgtgtacgtcataatgcgacgctccagaagcctgtgtgactgctacttgtagaataaaaggacacagtcttcatggctaccataaaattgatggccaatattacaataaaaatataaaccgtaaatctcttttaaaaaaaaaaaaa

SEQ ID NO: 3713 - DNA, 227 bp, Homo sapiens
ctagaatgtacagaagacgggctggtagctgaatcagccatctttgactatggtgttgctctgagaatgggatttgcacaaggctaagtaacatcatagaagtagcccaggtgcctgaggacttcaaacacccaagcctccactacagcctcaatttccttccttacattgtttatgtgagaaagcaataaacttctattttggttaatgcactaaaaaaaaaaaaa

SEQ ID NO: 3714 - DNA, 413 bp, Homo sapiens
catgaagggcaaggcccgtcctactgcatgatgccgtctactttagcaacctcctgggaaaccttgtttttcatccatggacagcatttggccagagaccgcaagcagaaggcatagagatgggaagagtccattttttggcagtgtctccaaattcacctcaccaaaatttccaattatttttggtttctgcgttggcaatgaattttgctaggatgggtaccatatgttctagtgtttctgaaaccattccagtttttactattttacttgtctctgtaatacagcaaaatgccccagaaatttcaatattttagtatacaaactacatctatccaacaacttttcactctaggaagcaatacaaaaattcattttgagaaaaaaaaaaacaaatggcctcgttggcctca

SEQ ID NO: 3715 - DNA, 780 bp, Homo sapiens
catgggaccccacttcaagtctaatgcttgcctgtggcccacagtgacggaaatactgagctttggaatgggcgagaccgaggccaaataatagatctttccacttatcattgtgtgaagttaggcaagatacctagcttctctcagcaccaatttcctcatctgtaaaatgaagaaacagcacccacttctcaatgttaccatcaggaataaatcagctaaaaaaaatagaaactgcttggctcagtgcctgacactgatcagttactacataaatgttagtttcctgcctttttgccaaaatgacattgaacagacagttctaatgatatttacagacacatacatctgtgttttcttttcagttctttacctgtattctactcttagacctaataaacttctttcatgttcaacactcagcaagcttttcattagtctgaaggaaaatactgaaatcatattatataaataaataaccaagaacaagcaccacatttctaagcaacatgttcaaaattggagaaactctagtatattccttgtaaaaatttaaaatgcatgagcagtttaaggcaaagtagaggcagtatttatgctgcaaattccttataactacaacccaatttgattcttaggaaagcagaatcagaataatgaagtgctttcagtgaagataaaacagtcaccgggaaaaatcagcctccagaatatttattaatgtcatcatgctactttgcttaaagggtccaaggtaaagagggacaaagagactacact

SEQ ID NO: 3716 - DNA, 259 bp, Homo sapiens
gtaatggttcttatcctccgcgtacccgtgtcgcgaaacaaatgatacatcctagcttacaggtgccaagtactgtgaatctgaagacttgcaaagactccatagcaagcaaagaaggaaaatctgattgttctagaagcacatgcacagccgacctggccggagtcctcccaaccacagacctcttgagaaacttgcataagccacagagcaaaatgtgtgtgacatagaagtatggttttttctaaaaaaaaaaaaa

SEQ ID NO: 3717 - DNA, 339 bp, Homo sapiens
cctagagacagcggtttcaccattgttgcccaccctagtcttgaactcctgagctctagccatccacctgccttggcctcccaacatgctgagatcacaggaggaagccactgtgcccggcaatgtctggtcctcaggctgtgagtgatgtgccttaggggcaggaggaaagtcaagtcctcctgggccttggatgactcccttgcaagaatacattctgtgagttgagaccagaagcagcaaccagaataactagatgattactcttctcttcatgtggtcaaagtatttatagtattagcttaataaaactcatgaaatctctgaaaaaaaaaaaaa

SEQ ID NO: 3718 - DNA, 462 bp, Homo sapiens
acccctgtgtgacatggcagtgatgctcatgaaggccggcggagtctccaagcagcaccacctagaccgtccgggcaaagcgcctgtcacttcacatgcagccccaggaagggacacagagcagtcttcggcctcagtcctcccaccttctgtgatcagggccctatatttggattttgatctcggcctgacttgctgctaaatctgtaaccagttactcttacagggttgtgggggaggagtcatgttgctatggcaatccaacaactctgggagaaggagaggagaggatatggaatttcaaggcccgagaccaccaagactcagagatacccatttctgcgtgtgtgccacagaaatgaatcttgatatgctaaaataaacagacctctcttctctttttcccaaatttccatccattgacaaaaataaaagcctgcttatacaagaaaaaaaaaaaaa

SEQ ID NO: 3719 - DNA, 790 bp, Homo sapiens
ctaggttttctatattagaaagattggagagaattgtttctatggaagtggtgaacatgggacagaagtacttctctcttgataagaccagcatgtgcaaaccaggaagaaaaagtaaaatctccaataatagagagataaatcaaacaggaaaaaaaaagtctgggtccgaaaaacacgtgcattcctgtagcagagtttatgcgagtttttttttctttttttcttttttgtgatgaggtcactatactcacatggctgtgtgggatagacagagaacatgcataaataacaagaaagcaagcattctaatttgcgcaccttgtttttttaagagtataatcattggctggaattaataggagcagctctgaatgaataacttactcagcatgtaagtgaaataactgagattagaatcctgaattgttaccttgggcctggagcatttacctcctcctctacctgcttatctccatctcctccaaggtgtgttaacctcatgataatcaatcacttccatgatcaacaatctcgcttcttttgagaaactcttaggatttctgctctaaaaacttagactactgggacttgattttctttgcttttttctcagaaatgtatctctttcttgtccagttgcagcaaaatcgagtgtatgcggagttaaactcctacaattaaatgtgccatttcagttatggtttcttattcagagttttactttttttgtgtctagatttcatctattagttttataatcttcattggacccccttttggacataaa

SEQ ID NO: 3720 - DNA, 270 bp, Homo sapiens
ctagggtctggctgctgtgtgtctcaggctggacttctgaatgcagagaggccacatggacaatgaaaggcccagaccagagtcctactgttccaggcacccaggtgaagtatgagacgtgtgagctgaattcatcttggacatggcgagctccctgctgaatgactgaccccagcttacatctcatggagcagaaccacccaaggtagcccagccaatccacagaagcatgagagataataaatcattgttgtgttaaaaaaaaaaaaa

SEQ ID NO: 3721 - DNA, 516 bp, Homo sapiens
  misc_feature (1)...(516): n = A,T,C or G
cctctcggacccgatggatctaagaaagcatataggccgggtgcggtggttcgtgtctataatgccatcactttgggaggccgaagtgggtggatcacctgaggtcagcagttcaagatcagcctgaccgacatggagaaaccctgtctctactaaaaatacaaaattagcccggcatggtgctgtgcaccttgtaatcccagctactcgggaggctgacacatgagaatggcttgagctcgggaagatgaggttgcggtgagccgagatcatgccactgcactccagcctgggcaaaaagagcaaaaaaaaaaaagaaaggaagaatataaaaacacacaggacattaaaaccacagagtaaacatgatttaattttgatagccctgactcagagcagaactagacggtaggaaaaactatgtttgagcccatgtaataatctaaaagatgtctattaaaataaaccttattttattctttgaatacattaannnanaananaaaaaaaaaaaaa

SEQ ID NO: 3722 - DNA, 194 bp, Homo sapiens
gctagatgataaaactcacctatgacttggaattaaggagacaaaagggtcttgaattgtaaaaatgttccaaacacgttttacgaactccaagaaagtcgggaccacaataattcaacaggaatatttgaccacttccttatttgtttttacttcaaaataaaacccaacttaaaacatcaaaaaaaaaaaaa

SEQ ID NO: 3723 - DNA, 315 bp, Homo sapiens
agatgctgttacgaacttcccttagaatcaacccatttgtgaaacaccacattaataagagcagtatctttggagattggagagtccaccaaggatgcccactggctccctacaaagttttttatgtgaggactcggtctcagtgtaaggatacagtgttcatcaccctaggaagatgcagcgccaaggtatgatcttagaagcagagagcagtcctcaccagacaccaaatctgcctggaccttgatttggacttcccagcctccagaactgagataaataaattttgttgtttatatatcaaaaaaaaaaaaa

SEQ ID NO: 3724 - DNA, 413 bp, Homo sapiens
ttttcaaggaaagatatagcacatccaaaaggcgatttggtatccccatggatcggattggtagaaaccggctttcaaattccagaggctaattgattccaattatgcaacttccttgggtgaaatgtcacagcaatatggaagatgcttcactgaagttattcacacttcttaatgattaaacttttaaggaactgaccttctgcaaatcctttccaaagcttgaacttcagtccatcacattacggcattgttacagcttcaattaaattgtgtaaatcattttgatgcacgtacattttaaaattatatattttaattattcaagaatggttaacttccccttaaaccttacttttaaaaataataattaaatacacaatacagtgaaaaaaaaaacaaaaaaaaaaaaa

SEQ ID NO: 3725 - DNA, 349 bp, Homo sapiens
ctaggggtttttttctccattatatcactctctaagaattttgatgaaaataaaatcatcttgaccagatctatttaatactccagaagtcacaaggaagagattctccacactgtccagatatctactgtgtactcttcatgtgtcaagagatctatgggggactgagatgcagagcccctgggacagccgccatcttttgtcttcacggagtttacagttttgattttgtgtgtctttccttttatgacaggaagaaaataatataaaccttttaaaaaaattttaaagagattatacaatctcagtgttatgccaagataaacaactaattacacactttaaaaaa

SEQ ID NO: 3726 - DNA, 221 bp, Homo sapiens
ctagctggttggagttcaaccctttagagacccagagccacagcatgttgaagacgcacggcctctattggattgagtctccagacacgcagagtagaacttctccatctccctactcccttgcccacaaccccaatccccacctaccagaaacacctgcaataaactattagatggataagaaatagcttccatagtcaagccattgaaaaaaaaaaaaa

SEQ ID NO: 3727 - DNA, 693 bp, Homo sapiens
cactggtagtaattcagcgaaatctcctttaaagtggaacgatgaattaaaacacgttgcaattccaaatggcattcactttggaaggaaagaaccaaagagtggaggatgtttggggtcaagaacctgggttgtccttaatcacttgctcagacaaaaacaagtctcctgaaaaactaaagattcaaatggggggcagaaataatcaaaggagaactgctgctcagcagaaccacatcgaatgaaatcataattctcatggcttctattaacatgtaaataaataattcttatatctagagctccagctcacattatattgctggacttgtgactcataaatcttattaaatacaggtatgtgttatttcatttcactccaccttattgcaattcacagatattgtgtgttttacagatttaaggtttgtggcaaccctgtgttgagtaagtctattggaatcatttttcaaagagcatgtactcactgtatgtcctctttgtacatttggataattccctcaatatttcagattttattattattaatatctcctgtgatctgtaataaatgatctttgatattactattataattgtttttgggcaccaggaagcatgtccatataagatatcaaatataattaataaacattgtatgtgttctgactgctccattgaaaaaaaaaaaaa

SEQ ID NO: 3728 - DNA, 246 bp, Homo sapiens
ggggtttcaccgtgttagccgggaacggtcttgatctcctgacctcgtgatccacccgcctcggcctcccaaagtgctgggattacaggagtgagccactgtgcctggccgatgatctttattctattattatcctttctaatctttattctgcctatatttttatatatcttttatctttggctaccagttatactgaaacttattaaaaatgcttctatggtttcttcaccaaaaaaaaaaaaa

SEQ ID NO: 3729 - DNA, 776 bp, Homo sapiens
aatgacccagctgaatgcaccacaggataactggctgacattcctgacatcacagctgataagttgtctgcatacgtcatccttcctggatgtgggacaagaactcaggacccatcgaatggtacgactgaaagagctataaaaaaacaaacagggctggaacatgtccccactgctcaccagtcgtgtgtttgagaaggagaagagagctgcggccttttggggagcccagacatgggagccccccaagccagggctgctacaccctctttgagactccggtctctggcattttcaagctcccaggagccactgtgttccctctgtccaaatgcaggtgcctgcagtggaagctgtttgtggtgcatctgatccagccacaggcttgcacaggagtcagtgctcgagccggcgtctggagctgcctgccctgcttcagcagccgggcatgcctggctgtgcacagtggccagaccccacactcactcactcatgcaccctgtgccgctccatccccgactcacccttggcaggcatgggatccaggctggtagcctgaggcaagcgcagcctgccaggccgagtgggtgaaataagctctgggcctcgagcaaaactcgagcaaaggttcacaacagccacagaaatttctagctggaaaagtgacacccgatggctcccatgacaatatttcattactttgtatctctgtgatacagaggatttaaaaataatgtaatcaacaaataagtgaaaatgtaggttaataccaacac

SEQ ID NO: 3730 - DNA, 491 bp, Homo sapiens
acatttattctaccacttcatgtagctgactgagcacattcttcttatactccctgagaatatgtgcgtctccaaaacacggccctttctgcttgagccagcttgtcaaagttttcaagcagttgctagaaatggtaaaataaaaaattcatatggacaagtaaatatacactttttatgtcactatgaaaatacatgtgtactatattttgagaaagtatgtttgaggtaatttttgtgttaatacatttaaaacaaaaactgtatttggaaataaaattcagttctattcataaaattttaaggggctgtatttcacagtttaggaaaatgtgtctacttgatccttttaatttggtggtggtaaaataattattgctgtagtaacacaaagacataatatttgtactgatactaaatgtaaatattgaaaaatattaaagagttccccttttaaaaaaaaaaaaaaaaaaaaagaaaaaaaaaaaaaa

SEQ ID NO: 3731 - DNA, 442 bp, Homo sapiens
cgtctcctttcctaccctggaacaagagctttctaagggcacgaactgggttccatccagcaagaaaatcccaggatgtggcattgtaaacatggaaaaacaccatggtttctacagtgagataaaggaagacacatcaacatacattacaactgcagagcattcttggtaacatggaattgaagaagctttgtaactctctgataacatgtgaacttccatactaacatccgtagctaatagcttcaaggtcttataattttctcatatttgtttaatcccttttttctacctcccatgtccttttgtcacagttctgtcagtcagaacacaagggagaccacaactttcttacttgattcgttattccagatgctggaatgcagcttgagccaataaaacattatgacagacatccctgttcgaaaaaaaaaaaaaaaaa

SEQ ID NO: 3732 - DNA, 453 bp, Homo sapiens
atggaactttgcaattgcctcactgatggggtacaatgacccagctgaatgcaccacaggataactggctgacattcctgacatcacagctgaaaagatgagcagatggaatctggggattagatatcttgaccaagattacagttattaagagacaaagtctggattctgtgcttcaaatccctggatacttttgtctcctaggagtgagaactgtgagctccttagcgttccaccaggaagacaaagagactgggtatacagagctcctgcctctccagatttctcctaccatgaagataaatgatctggttaataaattaatgcatgtctctacagatttctgttttaagattagtctacagcatgactgcagagctaaaactaggcaatagatatatggaatctcaaacacaaataaaggaaatttagaggaaaaaaaaaaaaaaaaaa

SEQ ID NO: 3733 - DNA, 1016 bp, Homo sapiens
  misc_feature (1)...(1016): n = A,T,C or G
caggttgggggagataaggagtagccaggaaaaagaaatagtgataaaggaagagccaaaaaggaggaaagggaagatgaaagaccgacttcaggaactaaagcagagaacaaaggaaattgaactctctagagacagtcatgtatcaactacagaaacagaggaacaaggggtgtttctacagcaagctgttatttatgaaagtgagcctgtagctgagagacgcctacatgaaatccaaaaactacaggaaagtattaacaatttggcagataatgttcaaaatttgggcagcaacagaaaagtctggtggcttcaatgagaaggtttagtctacttaagagagagtctaccattacaaaggagataaaaattcaggcagaatacatcaacagaagtttgaatgatttagttaaagaagttaaaaagtcagaggttgaaaatggtccatcttcagtggtcacaaggatacttaaatctcagcatgctgcaatgttccgccattttcagcaaatcatgtttatatacaatgacacaatagcagcaaagcaagagaagtgcaagacatttattttacgtcagcttgaagttgctggaaaagagatgtctgaagaagatgtaaatgatatgcttcatcaaggaaaatgggaagtttttaatgaaagcttacttacagaaatcaatatcactaaagcacaactttcagagattgaacagagacacaaggaacttgttaatttggagaaccaaataaaggatttagggatcttttcattcagatatctcttttagtagaggaacaaggagagagcatcgccaataagngagggacagtgaatagtacaaaatagtatgttaacaatactaaagagaaatttggactaactgtaaaatacaaaaaaagaaatccttgcagagtactgtgttgttggtgctgtccatgctgtagctcaaaataaagaagcgtattttaaaactttttccagctttacggtaaaagaaaaaaaaaaaaaaaa

SEQ ID NO: 3734 - DNA, 976 bp, Homo sapiens
agcttaagcgggtgaccccgaggagctgtccgggaggcctatttttggaagacacattgggatggcggcatcatgagtctgagacttgccttggaaagctggtcttccaatctgagatggcctcagcccaggagatatgctgggagcataaggggagttgtgtcccccacttcatgccagatccgcttctactgctccctcgaatgttttctcatcctggacgttgggccacctgtgaggaaaagaggcatttgattttctgcagaggtcaactcttgtgaaagcctctgttcctcatccttcaacagagcagccacacgtatcattccaggccccacttaaaatcagaaaacctaagtgggcacaggaacaagctcaggctttaaactgcttgatgctggtgtaatgtgcgaatagagcatctttggtgtagattgtacaacaaaacttggagagtaaccctggagacagtggctacacgcagacaccgctgcttttgcccctcatactcacgcctctctatacactgagcaataccagcagagggtgcatgtgactttatgatcgcgtcgtccgccttgtcaccacataattcgctattaccgtccatgattccacgttttttattttctggtcttgataacacaattttttgcacccttcttcacgcccccgccttggtgtttttttccccgttcgcccggccctaaattggcaggtagtaatatcccccaccccccccgcttccacctcctctacccctatgtttcacccattcccgccctcttctgcccccgtcccgctcccaccgttgacgtatcacattaacacttgcattggatagtagctagtcctcgcccgcactcgcgtttgattttatcaccacccagctccgagcattatgttgccccccgctacatgcactggcaccatctaatactcccactccccgcctcgtgtttttatccctcagcct

SEQ ID NO: 3735 - DNA, 439 bp, Homo sapiens
gtcttaaggagacagagacaaggtttcaccatgttggccaggctgttttggaactcctgggctcaaatgattgccagcctcggcctcccaaaatgttgggattacaggcgtgagctaccacacccaacatgggttaattcagcagcaggagcagtgaacaactatggaagaatgcaggcaactacacacaccgcaggttccagcacatcagcgcagttttggcttctgggttcctggtgaactgcagcaatacagctccaacagcagcagcagcagcagcagcagcagcagcagcagctcatctgtgcatggaggctcctgggttctagcccacaggcagctttctcatctctggataacaaccctcttctgcattttgctcctcccaagcctttccagcacctttgtaataaatcccttgcatttaaaaaaaaaaaaa

SEQ ID NO: 3736 - DNA, 747 bp, Homo sapiens
ttttttttttttttcttttttttttttttttttttttttttttttttttttttttttttttttttttttttttttttttttttttattttttaggggaaaacccgaatttaaacaagtttaaacctaaatccccaaaataaggggggtaaacaaacggggggaacaacccctggggaaaaagccgggattggggacattttttttgggaaaacgggctcacccttttcaaaaagccaacgccaaaaaaaaattttgggggaaaaaaatttttttttttcccttcctttttgggtttttaaaaaaaagggttttattttgttctccaggggggagggcaagggcggaaaaaaaatttactggacccccaaactccggggctaaaaaaattttcccacctgggccttcaaaagacttgggattacaggcataaccccccccccccaccccggcggggattgttttttggggggcacaggtttgggcccccccctccctaggaagcggggggcaggaaaaaccctttaccctgggggggggaatttgcaaagacctgaaaaccggccccctgccccccccgcgtgggggcgggtaaagaaaaccctcccccctcaagaggaggcgatatacccgacccgtgggttttttctcctcccggaccatatccataacctgttgaaataaaaacgcgctcataaaaggggggaaaaaaagattgccaccaaaacaacattgggcgaggccctttg

SEQ ID NO: 3737 - DNA, 374 bp, Homo sapiens
cttaggtgtgcacttgtatcccatgctggccagttaggatcttccattccatcccctccaccatgactggttcaggaacagggaatgagaatcgatcctgaaacccacattgacactactgggaaagataaattcccctccccaccacccattgaagagactaatctggagctgccagtggtcaccttgtggaaaaagcccacacaagaatgacaccaacacagagggagagccagcctgagagggagggagaagaagaagaagagacccgatggcatcttttcagctccgggacccaggtgtactccacccactcgactttctggatagaaaagccaataaacaccctctagtgctcaagaaaaaaaaaaaaa

SEQ ID NO: 3738 - DNA, 466 bp, Homo sapiens
cttactctcagtctgtgtggtttgagtgggctaactatacccactttctccccctccaggtgtgaacttgtatcccaggctggccagttaggatcttccattccatccccaccaccatgactggttcaggaacagggaatgagattcgatcctgaaacccacattgacactactgggaaagataaattcccctccccaccacccattgaagagactaatctggagctgccagtggccaccatgtggaaaaagcccacacaagaatgacaccaacacagagggagagccagcctgagagggagggagaagaagaagaagagacccgatggcatcttttcagctccgggacccaggtgtactccacccactcgactttctggatagaaaagccaataaacaccctctaatgctcatgccagttggactgtttttcaattaaaataatcctaacacaaaaaaaaaaaaa

SEQ ID NO: 3739 - DNA, 256 bp, Homo sapiens
ttgcgaaccattgccatttctgcataggggttttgcctgtttccgaggatggtctcaaattcctgggctcaagcaatcgtcagcctctcaaagtgctgggattacagatcactaaacgaaggcagacatcaacatttctggattcagggtccagagtgctcaccattacaccatggaacctcaaaccagacatcaacgtctctaatgagtctttctttattccaataaaagaaaatggtcagtaaaaaaaaaaaaa

SEQ ID NO: 3740 - DNA, 453 bp, Homo sapiens
cttcaggtcgactgatgtctattatagtatcatcaaattccctgatgttttcctctctggcctgcattctgctgttaagcccatctccattgaggtttctattttggttctatggtatgtttcagttctgaaatttccactggagtctttccatcttcttcattgagtcttctctatttttgcatttgttgtaagagtttattgaagcattgcttactgaagcatttttatgatgactagggagaaatcattgtcaataagtaaaatagtgtaattggatgtttgtaacaccaaagatacatgcttgaggggatggactccccattctccatgtgattaatacacattgcatgcctgtgtcaaatcatctcatgtaccccataaatatatacatctatgtacccagaaaaataacaaataaaaagttaaaaacccttgtcaaaaaaaaaaaaa

SEQ ID NO: 3741 - DNA, 554 bp, Homo sapiens
ggaggcactggcaagaagataatttaagactggaaaaagagatttctgcttctgactccgacagaagggtagttgctggagattgctaaagcggtttcatctggctcattccggatttctggaattggcagcctgagccaattccagacatagctgcagcggtacctcattggtgggttcaggactgacttctccagtgtccttctcctctgagtatcaccttcgcctgcttttaccctccagccctccgatttctttgtcaccagcttcctgactcttcatggagccagtggctatctgacctttctgagttgcagtttcctcagttctgaaactgggttaattaatacacagggataagaggaaatgaaattaagacttacagaaatcctctgcactagaaaggtggtagtaatcccctatgtaattcaagttttaaaaaataataataaatgtaaaaaatccataaaattctgatttttaacagagctactattttaatgctactttttaaatatcaaaaaaaatatacatattggtgaaaaaaaaaaaaa

SEQ ID NO: 3742 - DNA, 591 bp, Homo sapiens
aatcctaaggtaggagcaaacttggaagagcttctctcaccaaggctgagatccagacttctttgaggagtgtggctgtgcccaatggatggtgaagtttactgagtgctgcaggcagtaactataaagctggaagccactcactggggacttgctgaggagctgcccactggggtgctggcaagactcactggaaaactttcacagttgctctggcaaaagtctttggaagcgggtgcaccactgggtctcctcaagccagtggtaggagagctgcagtgagttgttggagcaagatatacggcaactgaacaaggaggagaaactctcttctcttgcagtgtcctctattctcccacatattctactgacaatggctgactcacaaagaggaacacttacaggatcctacaccagggcaaaaacagtggatttggagctaagaggcaatatatcaatataattcacacagtggcaatgtatgtgtatgtatctcaagattatgaagagttgcccattttcctcttatcttcaggctataaagtatcagaataaaagttatctgcggtgagttgaaaaaaaaaaaaaaaa

SEQ ID NO: 3743 - DNA, 801 bp, Homo sapiens
atggtgagtcttatacaacctatagaagactctggtacaagttttgatctttgtgaagactattttaaacctccatttggaccatatcctgaaaagaggtgagttgaggtgttttgttggatggaattggctattttctgctggttagttaaaattatggtactcatctctaagcttcagagaaatcctaaaactgggaagcagggccctaactcccgctgtagaatttgaagggagtagaccctgcccctctatggagggcccaggcttataacctaggttcaccattggaagcttttatctgggaccttgaatcttgagggagtgatagaaagacacaggggcagttagaggctattcaagtcaccagcagcagaagaaccgagatttcagaggaagagcacagacatccattgtggtaaggcaggcaatgatgctctgctaatctcttcctgtactgtgactcagctgtgttctcgcgccctagcttacctttgttcccgcctcattttaaggccaggttctctagtttccattaatcccataaagcaccccatagccttccactaattccctttttaatattcaccctggccaaagagtgcccgtatttgcaaccaatcattccgatcactatgaccctccatttcacaatgtttaccaatgcgaagcgcactacataccacgcgattccacggtccttatgctcaacatcgtcatagcgtggctcacaagctgaaatgcccaccctgatggtccccaccgacacaacagaacctcattgttgaggcagactgagct

SEQ ID NO: 3744 - DNA, 473 bp, Homo sapiens
ttagctcagactgaagtctgcactgtttgcttctctgcttttgagattttgagattcagattggcttccttgctcctcaccttgcagacagcctatcgtgggacttcaccttgtgatcgttgcctgatccagaatatacaaaatatactgaatgattaaaccacaggaagagcaacaagcaatgcagacatcttcaaatgcagctcatcgtttggtcatatccaattgtaactgctcagatttatcatacggatagtttagcctttctagaatttccctattaatgtattttcttcttattacatctaagtgaaaaattacagccactcactgttataattctgtctagcttctgaaatcattatagctttgagttaaatctcttctccctttctgactgcataatgaagcattgggtcatcagattacggtaatgcaaaatacaagatttgtatgacctaaaaaaaaaaaaa

SEQ ID NO: 3745 - DNA, 429 bp, Homo sapiens
agacaatggaatgcttcaatgaaaacgcccaactcattttccatctatgaatgaacagaaggcatcccgtggctaaggagggataaatattccgcgccactggaggcctgctggctcacccgggctacaccactattgtacccactctggcttccacacgcaatttactaaagtttgtgctgtttcatggcaaggtgatttatcactgacacctctttgccatttcaactgggggccactgcaatggggcaaggttcaaggaagttggccgaaactgaagcagacattttatcagctaactattgcattttctagttcttgacttttccccaggagcttttgttttcattttgttggctgcctttaactcctctgatgctgtacaaccccaggttgttttttctaaaaacaataaagcgagatcggccg

SEQ ID NO: 3746 - DNA, 885 bp, Homo sapiens
accatttggattctcatggcacgtctacccattagacaggccctctctgtaccgatgatgacatacattaattcacatatggaattcaataagtaaccaagccagagcatgacgcatcttttggaaattatgcctcgatgcatgacgtggccatcactttgttcagcctcatgactcagcttgcagttctgcacaacggaataaaccacctcagcactacaatctgtttgtagtagatggggcacatgcttttctttttctttttgctgctgcactcccaaaaaactcattgatatttcctaaagcagaatgtttggtttgcaaagacaaccattctggcagaaagctttctgttcttccaacacgtcatgctggagggaaaggcaccaatgatttcggcataccccagggatgcgacattggtttctatttaaagagcccacctcttatggaaaaataaacaattccaatcgctctatttttgataaagaccggaaactgagctggatgaagaaaaatgccgggttttatgaaaagctttgcggaaatcaggaagtgggtaacatggtgccacattcggccaagtctatcacaaatatcccgcattccccgggggggaaatgcgattctctcgtactctgtcgagattgcacataggaaaatctgggtatttttggaaccaacagggacaaaggctgtctcgtaatgggagcttctcttttcacagaaggaacacagtgtactatgtgataagtattcgcgagctgcgtgtaatcctgaccactgtggtgccctgtacgcttatcaatcatgggtagacatattcggcgcgcggcgcgtaccctgttgtggagtgagagcttatatgctcgtctgcactcatct

SEQ ID NO: 3747 - DNA, 625 bp, Homo sapiens
gggatcccttcaatggtgcatttacagatgtggtaatgtctgtgacttcagactcctctgtgacttagggctgcagaagacaagtctgcagctgttgcttctgtactacacaggccttagaaggtgaaagcacctcctcggactaagctgttccagctgccccttttccacttacattcacaacagcgactctatgaggggaaagataaggaaaaagaaatacgacccaatcaaacatcttttgcaaaaatattctgcagctccagcaaagactttggggattccctcagctgaaagtccacttccctggaaatcttaagagcatgtttttaccctcacttacaatatggaccagaatacacagtgtaatctcctctgaggtcaggctttatgcttcagtcattttcttattcctctgcagtgcttacatagagaagtgcaacgaacaattcgctcaatgaatgaatgtatagttcgggaagctgactccctgcaacatgacttcctaagccagttcttccacagggtagcaacagagtgatcaccttgcatagaatttcctggatgttagaaaacagtcaaattggtcaataatgagacagagaaaataaaaactgatcgccag

SEQ ID NO: 3748 - DNA, 801 bp, Homo sapiens
aattgtcctctcactgtgacatccagtcaacactggccttcattctacgcctgctgccctgatgattgcacgttaatgaagcacaaagaggagtttatcttccaaaaattcacctcatctcacctatgacatccacataccctccagtggctactacagcagaagatcgtcaacatagctcccatctttgggctatcttccagcaagagcctgaatagttgtctcactttcatattgagcaaggacatggaatctctgacaaacgaggaagacttggaacacttaagcaagcataacctcctgagagaatttaccatgagcatgtgatgcttaggctacggcagccatcttggtaccctgagaagagtcaccctaagagaagatgccagcattctaggaaaagcagggcggggatggagaaaaaatccagggcctggatgacattgctgagctgctgagttaacctagaactatcctaactcaagatttctctttataagaatctctcttgcaggagtaacacaggcatgtggagaatctctcagagtatttccggagcaaccaactggcatgaagaatactttgctggaaacatggggttcagaagcagcccacagctctctttcggacctctggaagtccaccccgaggtctaggcaacatttgcttttgcagagattggaaaggtttgaacctaacaccatcggactaattcggtctctatgagcaaagccttataagaagaatgtctggttgacccgacctgagaccaagtgccgggtctgcgcccaaggtgttgag

SEQ ID NO: 3749 - DNA, 559 bp, Homo sapiens
cgaggaagatcaagaaaacatcatactgtacttgagagggaatgactctggagtcgaaaggagacccggaaagtcacatgctgcctgtacatctgcagaagacattatcactgtaaatgcactgaaagagataaacctgcatagctgaatcattagcttcgaagacattagcccagcttttctccctcaacttggactatttatggacgttcaacaaacttagcaacaagcgcttaaagggatttctctaaaatatccatggtgaagagccaagtccataaaggtccaagttggcctctctattatggttcttttccatatcacctctgtttggtttttatcatctcatctataaaatggacacgtgccctattggtatacatctcactcctcaaagatcttcaaagtatggctgtaaaatcctagacgctctcctgacctaaggtgccatttaattaataattgctacattcatggctgtgcagatggaatgcatggcatgaggctggcattgctggaatatagcttgagcttctgcattgctagaaaaaaaaaaaaa

SEQ ID NO: 3750 - DNA, 886 bp, Homo sapiens
tgatgcccgacaatcaacagctgataataacgaaaaaaagaagggcttttggtgtgcactgtcgcccaggcttggatgcagtggatatcttccgcctccccagttcaagcaattcttgtgcctcagcctcctcagtagctgagatcacaggcgtgtgccatcacgcccagctaatctttgtattttcggtagagacgaggttttgccatgttgaccagtctggtctgaagctcctgggctcaagtgatctgcccgcctcggcctcccaaagtgctgggattactggcgtgagccactgtggctggcttaaaaatactttttgtaaaagaaatcatctttcattttctgtcctggagtcaaatgttaagcaaatcttcgaaaatatatattttttacattgtgtaaaactagagtgtatattgcatgacatttatgtcttacttattttaaaatgcacagttcggtagcattaacgtctattcacattattgcgcccaatactaccatcctcccccgtcttacccggataacgctccgcccaccggccctctctgcctcctccgcgggagctctgcggccctttcccttttggagggcataattcctccgcctccgcccctccccccccgcccccagcccttccatactcggagccgcctcgcgcgctccctcgcgtgcccgcccccatcctccgccctcgcgacttcccgcgaagataccatggtcgctgctgccctattttgtgctcggtacgtctgtgttctgctgccttcgttacacaccggctcctctccccctcaccgtgcggttctcagatatattgcttacgatggaagcgtatgaggtactacactttatagcttactaacgggttgttgttcttcaa

SEQ ID NO: 3751 - DNA, 183 bp, Homo sapiens
acttgggattcatccggtggcctgatgcagactgagcttaatagaatattttgtatagaatgtgtggcacttgccttggatgaatctatgtggttggatcacctaaagcgatactcattgagcttacaatacatgtcataaacatgcttctttataaacgtttgtttcataaaaaaaaaaaaa

SEQ ID NO: 3752 - DNA, 1189 bp, Homo sapiens
tttttttttttttttttttttttttgagaaagaatcatgctctgtctgtcacccaggctcaggtgcagtggcatgatctctgtttactgcaacttctgcctcctgagttcaagcgattctcctgccttagcttcccaagtagctgggatcacaggtatgtgccaccatgtctggctgatttttgtatttttagtagagacgaggttttgccatgttggccaggctggtctcgaactcctgacatcaagtgatctgcccacctttagcctcccagagggctgggattacaggcatgagccatcgtgcctggcctctcctgagatgttttgatcctggagcttgtggataggtttacacgtgtgcagatatttttgcatatgtttttattcactccttttttatgcctttttttttttttaaactcaaacctcctttcctccttccagtgctccttcccataccgtaatgggtggaaagataaaaatctacagtttctggaggattctatttttttgcactgaaccttgaccaagagtgcctatgtgaatttttctaaagaaaaactcaacaactttcattgattctcagaagtctccagaaccaccgtggagagagaagggaatagtaacaggaagacatgccttaagcaatcattagatttctcttttgcatttcactctcctttgcatttctccatttttctctctagggactgtaagtccagttagagttatatatgacttgataacgtagcagaagcggggggaggtttccaaaactctatcctttttatttgggaacaaacaatatctaggtactaagtttctctatggttaagctaaaggaaaatgcccctaataccctatactatttttgatatctctggaatgaaatctatattatacaaatgcagcttccaaaggacagaagtaattacactagtccttacgtttgttcatttctgtatacttcggaaaagtcatttgccttcattggaattaacacagacgggtggctgagaagacttggatgtggctttcagcctctttatgcctccaggtcttaattcttcctcttctttcatttgaaattttctctcctcatcttcagcttgccaaactcattctcattctcaagaacgagctaacatctgtctcttatacacatctgtttaaacggccagatagac

SEQ ID NO: 3753 - DNA, 787 bp, Homo sapiens
ctagacttagtttggcacgtttcttatgagcaccctggtgaagtggaccaccaaggaacacactttggggaatatggctccattggactcacatcaaacttgcatcatggagatttatctgacttgctaaatggagactatctgatcgtggaaaaagcaaaattcaggaagaatggaacatagttatccacattttacagatgaagaaactaaagcgcagagaaattacatgaattgctgaagttggaaaaaataaaatccagacagcctgcttcagatccctgctcttcagcctgtagcatgccttcctgaatgaacggctagcatcctgaatttttgtctgctatattaaacatcttactccaaggagatatttcggctactaaccatccagcattcatttttactgctttattataggccccagaaggaataacagttaaccatttagggatccctcacaactttgtcagtttatttgaaattgcacccccaacaatttcgttggcttggtgaaagaatgtatgtttaacccgacttgattatctgcagttgggccatgatttcaagctgtatgacagaaccacttgcagtcatgccaaaccattagccaaagggggttctttaaacatgcattgcatgcaacaaagggcacaaccttaatacggtttatttgccaagaaaatgtagctggaaattaatcacttacatacatggcgtataatccctaatatgttcatatgaaggatgccccttacatttccctatcaccagcatcacaccccag

SEQ ID NO: 3754 - DNA, 510 bp, Homo sapiens
cgcacaatggtgtctgctgttggtatcaatgctggggtccttcagagttctggaactgctggtttcctgaagagcatgctgtttactgacagaggctgtcctgatgcccaaagggagtttctcaaggttgcagagattggtcattgaaggaagaaataatgaagccccatctggtcatcaaaaagggacttttctcagtcttaaaaaaattttatcattatttaattagaaattaaaacacatttataattggaaaaattaaatgtgctaatcataggaaatcttaaaatacaggatcatataaagatgaaaaaaatcagtcctaatccatatgccccagagaaaatcactgtgaatattttcctgtatttttttctggtcttttacgtgtaaatatttacataattgagatcatactaaacatatagctttgtatcctactctttattaatacattctacgcatttctctgtgttattaaacatttttctgcaaacaaaaaaaaaaaaa

SEQ ID NO: 3755 - DNA, 308 bp, Homo sapiens
tttttttttttttttttaagggaaattggatttaatccaccatccggctggttttggttgggcctggttggtccggctgggcattagaaatttaaaaaattcccttggagggccttatttggggggcccaggggaaccttggttggtccaataaaaactatttctgaacctgccgccttataggaggtctattaactcaacccagggctttgcttgttcccggaccgcattccttaaccggccaacattaaccatgggttggattaaggggggaaaatcgatagtggcacttaaaacagtcttggaga

SEQ ID NO: 3756 - DNA, 274 bp, Homo sapiens
aaaagaaccttattataaaccataaaaattcacccccagcatttaaaaaaaagattctggattgtaaagctgttttgttttaaaatatctttctgtatgaacttattttaactggacttttaaaacattctgacctctaattgtacacaatcaagccaaaagatacgctttggtgaatgataatgttcgagaatgaagaagaaagttttaatgagatcaatgttgccatcgtctcccaatgttaacctaaaagctgaagacaaaaaaaaaaaaa

SEQ ID NO: 3757 - DNA, 519 bp, Homo sapiens
ctggtaacttatcaagatggatatctggtgccagaagatgtgttcaactgataaagattcaacttggaaagggatctacttacttcctgataatatgcaacaaaacagatacaagggatcagttggttgaatccatggatgcagaactgactgatatgaaatgaagactccatgtcgccaattttacatatgaaaattaaaagacgtgtggtagtacattatttttaaaaatttagaggccattttaaaaaaaaagattggaggttgctttaaccacccaatctggataagatgtgccatcttgtagttcttgtgattccttctatcagagaatttgctacaacatttttgtaacagtctatttacttatctgcatccttcactaaataggaagctcttgttgccagaaacgatgttttgtgtaagcagtcttgagactgagattgttaatgaatgtttttctggctgaatgaatgcacaaataaactgagttggttttggaaaaaaaaaaaaaaaaaa

SEQ ID NO: 3758 - DNA, 476 bp, Homo sapiens
cccagcttgtctgcatacctgacactcaacagtaacttggcttcaaaatgtactctcaagtggacaggaacctattctcatgaacatcctgcaacatttgccaagtaccttttagaatcacagtcaaagactaaaagggaacctcaatgatttttggctcatgtacatagtgtcttcagtagcagcttgcggcattgatgtgccccaatggaatgttgtttccggaaagagggtactatttcctcgcttagaaaataaaggatgaaatgaactacactattggagctactataaagatgaaagaagatgaaagttttcagtaggattgttgccatgtagtaaaccccttataaatagtatgtataataatttgtcacatgctgttaggttaagccatcaacaacaaacatggcaataattcaagttcaaaaatacagacgggtttgaattaacattgcaaaaaaaaaaaaaaaaaa

SEQ ID NO: 3759 - DNA, 865 bp, Homo sapiens
cttgaggttcctttgtcacgaatttacaaagctgtaagcaaagccaatggaagaatatgtcagatactgagtttatgacagggccttgccattgttcatatcataaagctggtctatcatgcccagtgcttggacagaagaagaagagagcaatggagacagcccacctgctgggttaaaggcttgagcattacagcagcacattcagctctcattttattaaaaagaatttggtcaaatgaccacactgactgcaagagaggctagtaaagtagttttgctgtgcatccaggaagaggagcagaaatgattttgtgctacagtcatctacatgtaatacacatcaacaaacaaaaacatgtatgtttccaacatatatgtttggagacagagtctcgctctgtcccccaggctggagtgcactggcacaatctcagctcactgcaaccttcccctcccgagttcaagtgattctcatgcctcagcctcccaagtggctgggactgcaggcacgcgccaccacacctggctaatttttgtatttttagtaaagatagggtttcgccatgttggccaggctgatcttgaactcctgacctcaaaaaacaaaacaaagcaaaacaaaacaaaacaaaacctcagaactaattggattaggcatcccaccataataggctcattttaaattaatcacattaatcacttctttaaacacaattaccgtatttccaaatagggttacaatctggagtactggctgttgggactcgaacatatgaattttggggtgacacaagtcaactgagtacattctgcactctccctaaaataaaagaagtttaaaaacaaaaaaaaaaaaaaaaaa

SEQ ID NO: 3760 - DNA, 401 bp, Homo sapiens
atcctggaacgaactgcaagacaattagcatccaagactggatccctcctcataccctggagatgaaggagaagagtgcctgtgggcagagaagagggccactctgaaaccactcacctcccaccacagggtctgccgctgcacttccacacatcacccacaagccaccatgccagcctaccaccaagccggactctgcaggggcccagccagggccacaaatccacggcttttcctaaggcacagagaagctgagaaacctacatccagggctcagcagggctgtcccgcctaaagaaaaccaagagtacagaagcagcacttggtaagcgtgtgcaccggaggtttctcttgacaatctgcttcataaaataaaataagtgtgtgtaaaaaaaaaaaaa

SEQ ID NO: 3761 - DNA, 768 bp, Homo sapiens
gaacgaactgcaagacaattagcatccaagactggatccctcctcataccctggagatgaaggagaagagtgcctgtgggcagagaagagggccactctgaaaccactcacctcccaccacagggtctgccgctgcacttccacacatcacccacaagccaccatgccagcctaccaccaagccggactctgcaggggcccagccagggccacaaatccacggcttttcctaaggcacagagaagctgagaaacctagtaagagcctctggggtccccacttttagtaaattacaaggaggtgttcagcctgccctgaacctcataaaagatggatggtgtagttatataacatccatggctttttacgaacttcacctttcctttaaaaagctgctaacttcaaagaaaaaaaatcgctccaggcattctggtggttgtaataaaatgcattccccaggaacatgggttgtcacagccttagagaagaagacagggtggccatgtgggtgcccacgtgcctacttccttgtgggtgacaggttttatctccctgcaactgatttatgctgaggactgacagcctgtggccatgacctactttcccttttacaatacagcatccagggctcagtagggctgtcccgcctaaagaaaccaagagtacagaagcagcacttggtaagcgtgggcaccggaagtttctcttgacaatctgctcaataaataaaataaagggtgtgtaaaaaaaaaaaccaacaaaaacaaa

SEQ ID NO: 3762 - DNA, 789 bp, Homo sapiens
aggaaaagaacatctgaaccaaaaccaaagagactggagttttactcccagttttgcctccattatatttattgtgtgaccttggagaagcctgtcaattcttcacactcaaacgctcccatctgcaaaatgttggcaatagactagagaatcttcacaatccctattcaccccatattctttgtattctctttctttgtgtgtgtgtatgtttatgctgctcaatatgcaatatctgaaactgcttttgaaaatgtaaattactcaattgacccactaggtggtagcaaatttctggttactgtataatggcaggcttccaaccacttccataaccttctaaattctgccatcaagaagttagtgaaaaggacttctttgccttgtttgtcaaaaatcatgagttttattctcagctctgtcatttactacttgcatgatcttgggaagatgagtattgcagggtttttgatttcccaccataaaatcaaagggagtcttgcagatctaaaactttttgcatattgttaccataataaaaaacaagacatttaaaataaacaaaaaaatacatactcacctttataaactacccactaatatctctatccctccaccttactttaccctcatcccaaaacaatccgtatgacccaatagatagcagcgatagcccgtatctcatatattttcgctccttttgttccttcatagggcaactcccagacacctctcttctgaaggaggaaaacacatatcccccccattaatattggtccccgagggacc

SEQ ID NO: 3763 - DNA, 251 bp, Homo sapiens
atgtctctggaaaaattgtagagatttatcagtccttcacctgactttaaaggacccttcagtttgtagaaggggctcagaaaaagagctgatgcaggtcttggcactgtgccagtcatagatgaagggacaaaaacaacctaagaggccaggaagtttattcctatgaaatgttgcttctccaaaggccatctcaactcgattacacattttccaaataaaatctcttatataaaaaaaaaaaaaaaaaa

SEQ ID NO: 3764 - DNA, 336 bp, Homo sapiens
agttttcagagctccacacattctctccatgacttatggttgcattcagcaatgaaggagagacaggatggagtgaatgaattccattttccccagaaccagcaccctgtttcaagaggttttcaataaaacactttggattgactcttggtgctgcctgaaggatgatgtgagaagaccactcggtgatgacctggagatacaatgagttaatgtttcagttgcttggcctgtgattaaaagtactgaagtaaacaccagtcagaccttggttagaattgagggtctgccggtacctaggcaatgcttggggaaaatcactgaaaaaaaaaaaaa

SEQ ID NO: 3765 - DNA, 254 bp, Homo sapiens
agatactacgaactcacagaaagaaaggctgctctttggatatacttcagctaatctgcagaactcatcaaaatatgctttcagtggtggggagaagggtggatggagaaagaggcagagcaccgccgcagatggtccagggtaaacctgccacagcatcatccttccattattttgggactttgttagatggatacattaatcatgagccaagggtttaaataaaaactagtatttgtgcaaaaaaaaaaaaa

SEQ ID NO: 3766 - DNA, 430 bp, Homo sapiens
agatactacgaactcacagaaagaaaggctgctctttggatatacttcagctaatctgcagaactcatcaaaatatgctttcagtggtggggagaaggtaagattgttgattcaagcagaatatcaagaatctatcctgttaaactctggacgtctaccaagcaacaactagacatcaggcactggggctgcggcagcaacatgcgctgaccacggccatccttctgtctcttttctctctccactgctgtggacctggaccagggtggatggagaaagaggcagagcaccgccgcagatggtccagggtaaacctgccacagcatcatccttccattattttgggactttgttagatggatacattaatcatgggccaagggtttaaataaaaactagtatttgtgcaattctggtaaaaaaaaaaaaa

SEQ ID NO: 3767 - DNA, 334 bp, Homo sapiens
cttatgatggcggatttctggaaatgtcttcttcctgcatgtgaatcactcttcccacgtagtaaacagaggtgacgttaatggcaaaaggaccgattccagtgggctggttacattcacctttcttgcttcgtgggagggacaaacagccaatcaaaagcagcctggatgctctacccagaacaggcacttccaaacgctgccatttgcaagtggcctctagctctgctccgtcacagccaaatcctgcgccctccactgcagggtacttctgtgacgagtttcaataaaactatatttacgctaaacacaagaccgaacaaaaaaaaaaaaa

SEQ ID NO: 3768 - DNA, 674 bp, Homo sapiens
atggttcagccctgccatgattttgattggaattgcacttaatccacaggtctcttatcaatgaagaactttgtatccaacaataataaactgtcatattgcaagttgcattttgtagaagcaaaaaagactggctgtgacgaaataaagaaggagatttctccctctgcgctgaggatctcactgtgcacctccagccctgggtcctggtgggctctggtggccactggagtctttggaactgcctccctctggctctgctggggttggattcgggcatcgatgtcacacccagcaggaacaactggggccactggaggatccccaagggcacaggttgcccttttcatgcaggaagaatctgaatcgtttccatccagtttcccccgcatgcagcagaatacaacacaaggggctgcggtcttctctgactcttaaggcccttggaagatcctgttctgcccaaatcagggtgatttgggcaagcatccttagggctctggaccttagtttctttccctggttgattgattgaccatataggtgtcctaactcacatagttgaaaatcagatgtggtgaaagtgcattgagaccagaaacaatgttattgtcctgaaatgcatgcccagagagcactgaataaatttttaaaacacctgaaaaaaaaaaaaa

SEQ ID NO: 3769 - DNA, 507 bp, Homo sapiens
atggaaacatcccagacagctggatactaatcaagtgtactaaatgggtcaaattatctgcataatgaaaacaaacccaaaaggaatgacaggattttctcaaatcattgctgacctactacttgaaaaccacaagtcctcaactaattcccgacacagcagattattgggaaacttcatctgttgtaccaaagcaaaattgtatcacttggaaaattgaaacattcagaccgcttttgccacctctcttaactgaaagattttctgttcttatctgtttgttattttacacatggttattctaatggtattattttttaatccagaataaacatgtagggacaatgtattatccataaattcaaaataaccatgacaagctctttattaaggaaaaataaaaacttcaaaggatgactaaggataatacatctagagtatgttccatttaaatggattttaaaaactaacaataaaaatgagttttaaaacataaaaaaaaaaaaa

SEQ ID NO: 3770 - DNA, 308 bp, Homo sapiens
ctggttgttactcacactgcagtttgctgactttccattggctgccagagttacctgaaaataattatcatcaacatccagcttacagaccacgaaccagaaaaaagccctgtgggttatgtggagaagcaccaaatccaagattatactacatgactgaaatattagttttaaatggagttctttccaaattgaatttgaacctgtcttgggtttccacagtgatctgagaattttaaaaatccatatttgccttgggagtatcaaggtattaaagctgctttgtaatttggggaaaaaaaaaaaaa

SEQ ID NO: 3771 - DNA, 379 bp, Homo sapiens
ttcctctgaggattaagagttggatgtcagtgtattcagacacattctgactttattcctcaccaattcattaaaaatgatcagttgatacataaggatcctttctgcagaagaaaagaagtcagatcaagatactgggagaatgaagtcttctctttgccaaaactctgacctgggcatctcttccaactttcctactcgatgtggaccagaacattcttgtccagcattactaaacccttgctggatatgattgtctagtctgatgttaaattcacaagtctatttggctttctcaccaagccatatcttctgtggtgttccttaaaagcaataaacatacactggtgtaaaaaaaaaaaagaaaaaaaaaaaaaaa

SEQ ID NO: 3772 - DNA, 483 bp, Homo sapiens
tggttttcctcaattcccatcactggtgcaggagcacaagaaaccactccagatgcctctgaagccttcagtctcaatcccacaccaagaggtgcagcgcagaggggtggccctctctcctgtctctgatggattccgcagccagcccatttctggtccgtgctgacctccatcgttttcagcagagcaacaccgccatcgttctgtgtctctttgtgcaggcagcagcacagaattgggaatatatttaaggaccttaatgttctatggaatggttctgttcaatgagaagagtttcatgtatatgccaggtttaaggctttcttcttttctcattgtatctttttttttttggcacacccacttttgtatttatttatttttgcttatttcatcttatctaagaattcttctacatctttaagaaatagagaataaagagatatgcctcaaaaaaaaaaaaaaatggcctcgttggcctca

SEQ ID NO: 3773 - DNA, 266 bp, Homo sapiens
ctggaggctgagacaggaggatcccttgacgccacgagttcaagaccagcctgggcagcaagaccccaagcaagtccccatctctacaaagaaaaaaaattaaaattagctgggcagtcccagatactcagggggctgaggcaggaggatcacttgagcccacgaacttgaggctgcagtgagctatgactgtgccactgcactccagcctgtgctacagtgagaccccatctaaaaaaaaaaaaaaaatggcctcgttggcctca

SEQ ID NO: 3774 - DNA, 450 bp, Homo sapiens
  misc_feature (1)...(450): n = A,T,C or G
atgtgtcttctgccctggaattgactctccttgaaaactgagaccaagcccaggccactgaaacttcttgagtatcanaagcgtatagggcaattctccatggttgcctgtcttgaactgtgataccattatcctcttacagaccaattggtgtgaaatcagatcctgcctgggagtgggaaaaagaatagaaagggaagacgctggctccaagctcggcaagacacaaaaacttattggaggggtgtagggacctgttcaaagtttgggtatattctgtcatttggcaagaattaaatagagccttgggtcctctaagattattctgttaccttcaggattaggttacccatcattatatttaacctatgggaaaagccaacacaaagctctgctaaagatgtaataggaagcatataataaagaatcctcatgtcaaaaaaaaaaaaa

SEQ ID NO: 3775 - DNA, 180 bp, Homo sapiens
ctgaaatgggatctcagtatcttgctcaggctggtctcaaactcctgtcctcaaccgattctcagtaagcctcgcaagtgctgaacaggcatgaccaccatgcctgatttacttatcttttaatgtcaacacagtttctgcctcagaaaaaaaaaaaaaaaaatggcctcgttggcctca

SEQ ID NO: 3776 - DNA, 220 bp, Homo sapiens
atggctggatttaggatagtgaccctacttcaaccatataagcaaggttataatcctaggaatttgcaaacagaagaagccacacagaaggaacctacatccctggatgacactgaagacaagaggcatttacctgcctactccatggactgtaaagtggaaaaaatgacctatagtttttgagccaaaaaaaaaaaaaaaaatggcctcgttggcctca

SEQ ID NO: 3777 - DNA, 239 bp, Homo sapiens
ctaggtggctatgcctgctgcctaagagagaccctgagtcacaagtacacaaatgaaatgcgattgtcttcgtgggttgcatcgtatgatttggagcaagtcttcaggtctaatataaagatctttcaaataaatcatccagctaagcttctgtggccccaaactcctaatttaaaaatgttgataaatgaagtacctctttagttaataaatgaagtatctctttaaaaaaaaaaaaa

SEQ ID NO: 3778 - DNA, 337 bp, Homo sapiens
caggttccctctcagagccctgccccatgctgtgcaaatcccaagcctcaaggagaggccacatgatggtggctccagcaaataatccctgctgagcccttccttccgccaccccacccaggagccatcagggaaatggatgccccatccaccagccatgggagccgcttctggcagttgaagtcacttcagtggagggccaggcatcatggagcagagagaagctggacctgctgtgtcctgcctgaagtcctagcccacagagctcacaggcacaataaaatggttttggtaatgttaaaaaaaaaaaaaaaaaaaaatggcctcgttggcctca

SEQ ID NO: 3779 - DNA, 506 bp, Homo sapiens
tatatctattaccattctaatacttacgatgatgttttgttacaatgaacaccactgggaaacatcatctttacttgttcttcgactgggattacaccattggtttaccagattcttggattttcaaacttagactaaattacaccatcagctcttctgggtctccaacttgcagatcatgagacttctcatcttccataattatggtcatgctctgttgcccaggctggagtgcagtgacacaaacatggtccacaacagccttgacgacctgggctcaagtgattctcctacctcagccgcctgagtagctgggcccacaggtgcacgccatcatgtatagctaattttttattgttggtagagatggggtatcaccctgttgcccaggctgaagtaactctcgtataacatcctagactaaaataccctaggggtttgatgagatcgtccattctccttcactgcaataaataatatacccaccttgctcaaaaaaaaaaaaa

SEQ ID NO: 3780 - DNA, 805 bp, Homo sapiens
cctaggtaccctcggcattctggttctcttttcctgcctgatgcctgttaacctacaggcataaccgacttgcattaaggacctgtggggagacggaggaacaggagacttcctgggccatctacatgaccttacacaccagtctgggcttcactctcaaatccaatttatgatgatccgcccgccccaggtgctgacgatggcctgagacgcctgcacggaagagaggggcgtacgttgcgggcgcaaccctcatacgttactgctctgtgctccgaccatgaccatccatcctatgagtgctggctgggctcaaacccgggtactttcctccgagcccaagccaccctggaggaaccacatatcctgggccatacgaatgcaggagctgtctcctgtggacacagcgggggctctcaccccccttacatgttgacaggatgagcgcatttgctgcgagacagcacatcctacagctgggtcctaaggccccatgccagaccaccacgaccacgatggaccaagacaacaagcccactcctgattcacgcctcaacacacacaacatgatgtgcaaaccacagaaacgaccaaacacgccttctgactcatagctgctggctgtctctcatctaaccccggcggcactagctccctttgcttctcaggctctaggtcaaatagatgcgagtcatgggctagtccctgacacaggcccactccttaagttagcccatacgccttcttattgaggtgccctgcgagtccctgtggaggacagtcttcctgccgcaatgagcaatgg

SEQ ID NO: 3781 - DNA, 951 bp, Homo sapiens
tttttttttttttttgtctataatttcaaattttattctccaaggctggtttttcctatgagatatgagctataacatcccaagatgaaacaaagattttcaaaagtcaaggtgaaaccattcatgggatgattacattttgttcaactgaaaagtattaaacacatacacacatacacacacacacaaacttaattacgttgtttatctcagataatcatcaaagtgttggtgaaagggcaaaatatgacttttccctctaaactaaaacacaacatttccccctcccccaggaatctcatagacttttaaaaggcatcgtatgaaggcaggtaatattatcttgctttacaaaggggtcagttcacaaaaaggttaaggtaattcccaaggactgtataaagagtcagagggcgactcctggaacaaatcttcaaaatcttggatctcaggcccagggtccctaaactgaggtcatccttctggtcacaaaggcttaggcagatgtatgagataagcaggagtcactgcagtaacgttagatttcgtggtttgaatgctaatagttcactctttctctgctctttgaaaactcgtctcctttaatttctgcctattttttaagcctggatgctttagagcctaaagcatctgtatgttttttgtaccttttctgtctgtatcttctggtcctgaatcctgctgacccagagatggggctaggagttgcaggggcttccttctttctctgtggtggggaaagggctcctgattttgtctcatgatgcaaagaagtggtatcaaaatccagaaacttgaaattctgagtaaggctctgtcctaaagatcccagtgaggttggaaatattgcccctgatttcttattctgcaaaatgaggaagttggacttcatcctttggggtgtttattgctccataggtccataacaag

SEQ ID NO: 3782 - DNA, 324 bp, Homo sapiens
ccctggtctaacggaagaggaaaacctagagggagtggtacacttccacttccacttcttttcaacagacctggtggtggcttgctttataattgtggccttgatgttgcaccaagaagccttgttggacacttcacctttgggcccacagtctggcaagatcccttcctccatattccaatgacatggctcttcctggagaatatgctcgtattcattttctatgtggtgctgctgtttcagaaattcttctgtgattctatacacatggacatgagcattccctattaaattttttcatcttctgaaaaaaaaaaaaaaaaa

SEQ ID NO: 3783 - DNA, 719 bp, Homo sapiens
cggaccgcaatcccactgatgatttgctcaagttttacctgctccacaggaaacaaaaatggtatagggcaggaagcaggagcctcaaaatcgggcagaggctggaatgcaatggcgccacttcgactcaccgcaacatctgcctcccaggttcgagtgattctcctgcctcagcctcccgagtagcatgggattagaggtgcatgccaacgccaccatgcctggctaatttttgtatttttaatagagatggggtctcaccaggctggtctcgaactcctgacctcaaacgatccacctgcctcggcctcccaaagtgctgggattacaggcatgagccaccgtacctggcctaatttaattaaaattatttaaaagacggagaagaagaaaaagaagaagaagaggaggaggaggaggcggcggcggcagcagcagcagcagaagcagatcagcattgtttggagagcagaatgcaggaggcaagtgctgaagcacagcctggctggactattatagacagagctattataataggagtcagcacactggctcatccaccaaatccggcttgctgcctgatacagtctttatacggtctgtgagcatagagttgtttttacatttttaaatgtttggaaaaaaaatcaaaagtagagtcgttttatggcatatataatttttataaaattgtaaagattcgaaaaaaaaaaaaaaaa

SEQ ID NO: 3784 - DNA, 633 bp, Homo sapiens
ctagacccctgacgttgcacgtgaaacagtctgatgccaaccagtcagaagaccctcatagaggaatgaaatcagcatgagaatacagcttcttcatcatcctgtcccattacttcaccttacactctgaccaatcaacaatctccacacttcagcccagtccaaaacccttaaaaactctagccccaaacttctcagggagatggattcgaggttttctctcatctcctagtttggtgacccccagattaaacctttttctctgctgcaaaaaaaaaaaaaaaaaaaaaaaaaaaaaaaaggggaacagagaaaataaagattcatgaaagttatatctttaggatagtctaaggcatatgatatatattttaacacttacgtaatccatccaaatgataaacaaatataaaaaagaagtttataaaacatcagtctagttggggcagtgaaaataggttttctgccccaaagtctctcctttggttattctagaatcaatatggcagacctttccttttttattcttacttcaggggatgggggcacacccaaaacgtggaaaagaattagaccgttttgtgggggagcatctattataaaggcctacctgggaggcgaaaaaaaaaaaaa

SEQ ID NO: 3785 - DNA, 353 bp, Homo sapiens
tgagagcacagctggtggagaattccctggctggattcatcagtctttgctatggacaagagaatacacataagaagatattgagacttccacgttaatcaaactgaaaagtaagacaaggaattccaaatcagagcctattttagaactatgagcattcaactgaaaacgggtctccagatttctgtgctgctccattctgttgccaccaacaattgataattggtatcatttttgtgcaagtgagatgtgccttgttagtgctttttaacttgagtgtttgaagttgttcaaataataaactgttttctctaaaccaaaaaaaaaaaaaaaaaatggcctcgttggcctca

SEQ ID NO: 3786 - DNA, 735 bp, Homo sapiens
caggtaagaaagctggcagagcatggctggattctctgctcgaggtctcacatgcccaaaatcaaggtattggccggctgggctcttgtgtggaggctctggggaagaaccattcaggctgtggacagaagacagctccttgtggctataggactgagagccctgcttcccgccaccggcccttcaagcacaagccctccaggcctcaaatctctctgccttcctcttctgcttgtaaaggcgcatgtgatttcactggacccactttcaaaacccaggataacttccctattttaaagtccatttaccttaattaatctgcacagccactttgccatgtaaagtaacatattcgtgggcatgaaaccagggggtgaaggtcatgtggctttgagagcagcactctctgtgacacatactcaattctgctcctccagtgcaaaagcagccactgacaatatgcaaaggaatacatgcagccacaacatggaagaaatacgtgcatcaacaacacatagcagcgtgtgtatgtatgtgcgtaaaggccttggaacacagctgaagaatacttttcaaatccttcactgttatttcctctagggaagagagtggaggccgaggctgggaatccaggagctgttcccattttattctgcatacttccctatcttctgatgacttcacaatgtaaccattaagaaaaataaaaattgctcatgcaaaaaaaaaaaaaaa

SEQ ID NO: 3787 - DNA, 372 bp, Homo sapiens
gacacctgagtgctaagattacgggagtatatgtaaatggccacagtaaagtgatcactatgaaggataaggggcaacacagaaaaaatgcttaagataatgttaaatgaaaaaagcaaaaaccaaaactagaatctatttatatttgcaaatattatagatgcatatgtacaaaaagtggaaggtaaaacagaaaaataaaaacaatttacactgtttgggtgatggaactactggcttctgttaatgtgcttatgtttatacaataaatttttttaaatgtatgcatatgtagtaattagtgatatttatattggatataggtactaatatttctggactataaacaaaaagaaagcaaaaaaaaaaaaa

SEQ ID NO: 3788 - DNA, 168 bp, Homo sapiens
cttgagttcacccacactcaaggtagaggaaattaagcttcacttcctggagggaggagaatcagataatttgtggatgtatgctaaaattaccataataattaataaatatttcggtggataagatgttatgaggctattcaagtattctgataaagttttttcatg

SEQ ID NO: 3789 - DNA, 800 bp, Homo sapiens
tgtgctaagtgatcctcctgcctcagcctcctgagtatctgcgaccacaggcacatgccaccatgcccagatcttcataaatttttaaagacctcgaaagatatctactgtagaagactcttagttttttttaaaaatttttttaattaaaattattgaagtgaatagtatacactctgagttaacttgatgtagtataaccattgtgatagtatttctaaaatatgctatggaatatgttggctaattaagtcttacttattatttaaaaaacaacaaaaaaaactcaaaatattcttataaccacttcctattcaaactatttcgttataatatagtattatatttatttctgttttgaatcgtttttacttatcattaaccactcaccgctcctcttctctctctcccaaccaaagtcgcttggaccgcattcatttctctagagaggatatgacattcttcacccctactttttcctgatgttagtgggtatacaggttctttacgttcttctttatgatttttctcggcccagttctttcccctcttcccccttcatgtggctcactacttatataatgtctttcctcccatatcttctatatacttgactccctaagtataagcttccgcctctcccaccccctcctcctccccgtcccccctcccgccccccttctcctctactcccctctcatatctctctctgcctcgccccacacctacttaatgcattccgccacttacccttatctcacttacccccctctctcttctttcttacgttctacctccct

SEQ ID NO: 3790 - DNA, 309 bp, Homo sapiens
cctggttggagccagtagcacgatcttggctcactgcaacctctgcctcctgggctcaacaaatcttcccacctcagcctcctgggtagctgagactacaggatagtggagaacatctgggaagatggagtggcccattgctggagcagtatctttgaaaacagaagagactatcatcttgctgcccctcctgttttgcaattctaacatccattcaggacctgtttgtgtctctccttcctgttcattttaggaggttgaataaaagcacatgaactgcaaatctctcctctgataaaaaaaaaaaaa

SEQ ID NO: 3791 - DNA, 811 bp, Homo sapiens
cctgaaaccacacggaggatggaattgaaagtcagagtgaaatgtacttgcaatacagaaatccaataaaggattcatgaagaatatatacaaagaatgttaaataagaagaagaaacacagctaatccaattaaaattggacaacagatttgaaaaggcaactcacaaaagaggatgtcaaaatggttaatcaatacattaaaatgttctcaacatcattaatcatcagtgaaatcttctaggcccagaaaaatgaaagttgccttgggacaaaacaggaaaacaggatccatcaccattctaaaccatcagctttgtaaagacatctgagatgattatggcacaagaggcacagagagtaagtggatcttagtccagcagaatgattcctcctgggaccagaaaattcttctcattcttaattttctttatttgttttgcttcctataattactttaaaaattataatgtaaaatatcttcaacagaccaaatatgagtaaggatatcatgaacactcatgttatgaatattcctgcttaggaaatgatcatcaaaacgatgaaggccccaggtacctcatgctgatcacattcttcttaatgtcctcccaaactagaaaaagttactgcccttacaaagagtttcttatccctaagaacttctttatatttaatcatataggtatatcaacccaaataataggcagaatggtttttaaagttgccaaatatgcacatttcccaatttccttaagcaaagaccatatattttcacccataatatcgtttggactcactcaatgcgatac

SEQ ID NO: 3792 - DNA, 489 bp, Homo sapiens
tcttatgtgacttgaagatcccctccagagaatgacaaagtaacttccacctgacacagtaaaacattgtttggagagtccgggatctggaatgagaatgccgcgtccaggctgtgttaccttacaaaaattattaatgcttcagtggcctcatctgcagaatggaaataccaataatagtagctatctgataaggttattgtggggatagtaggagacaattcccctccatgtttgagtagtagctggcacattgtagatactcaacatacgccagctattattgttatagaaaatatgcagatctggaatagcttggaaaatgtttatgatacaataacaaattcaaaagaagtctactaaatactgtgtattttatgattgcaattttgtaaaaactatatctgcttatggaaaaagatttgaagaaaatatgcttatgtgaaaagaaaaaaaaaaaaatggcctcgttggcctcagcggtggagc

SEQ ID NO: 3793 - DNA, 626 bp, Homo sapiens
ttttttttttttttttttcagttatgaattttatttccaattttagtgttgctaaaccataagcgcagatgtcaatcctagaagaggtgaagtaagccactcatgaaagtgattcgtcttggttaagtcagtgaagactggctatacagtttggattttattttctgcacgtcttgctaggcattagaagaatagaagggttcttcttacggtaaatgtctgacaattgtgtcgttttccttctcctctttaggggaacagggtgctaaaaagacttgaaatgagctgccagtcaccattaaccccttcccttctgaacttccaggtcacggagcagtccccaaatgctttttactttcatattgaagttctcctagccctgccaggtttcctaaaccacatttcacagatgtcacaagtttcaatggtgtgttttttcttttgtaggtttctccaaaagagttttattaacaacacataaacttttagaatatacgggattcgttatttaaaatttcttcattataaaaaagaagaattgcagaaccaaaatttggatttaggtaggataaattccaacacacagctgatattctgatttactcatatcattggttcctatcaag

SEQ ID NO: 3794 - DNA, 789 bp, Homo sapiens
gggactcatctaatcagttgacagtcttaagagcgaagattgaggcttctatagacgaaggaattcagcctcaaaactgcaatacagaaagcctgcctgagtttccagcttgcctggcctgccatgtggaattcagactccagactacaacaccaactcatacctgaatttccagcctgctggcttgtccaacagattttgttcagcacgcacatcatgaagctccccgtgaccacgcagactgggatatatttttctcccctatgacgctcgtttgtgcagatccctctcaatccacacattaagttggaacaagacaacttcctttatgtggcccaccagaagaggaaccgtgtcttattctgtcaaatgaatgaataaataaacggatgaatcccgtgaaagaaaagaacataggttaattattttaagtataactctctgttgaattgttgggggctcgactgatggtttatgctacttggtgtttagtcctacacacattagctctttgtgtgtagaaatctgtttttggttggagactgtaatattataggcagcacagcgagtatttgatagcggaggtaatttacaaatagggttgttacagtctttcccaagccattttgccttcacaggaaacaaacacatgtttaattccaactaatagccaacgatgcttgttgaacgagggtggacgcgtggtttggatgaaactcgtgggacgtcatttattaaagatattttctgattggtgtgatgtataggttcacgcatagctcgcatctt

SEQ ID NO: 3795 - DNA, 289 bp, Homo sapiens
atgggtaaaggactgaagctgtggtgagcccactgagagaaggacagtgaagacagcctacagccctggggggccgtggggactctgtctactatgggcagtgctgggagcagcctagtgggccttggggcctgggagggacggtggagggagcctctgagacctgggaggtggcccagacccataaagtgtcacttcaagcccatttacccctcagtctttgaaataaaagggcaacagtgttgatgttgaaaaaaaaaaaaaaaaaaaaaaaaaaaaaaaaaaggaa

SEQ ID NO: 3796 - DNA, 253 bp, Homo sapiens
tctttaagtaaactcctgaacgtcgtttccagtcagacgatggggaaaaaaacaaaccagtgctggaattgatgcaactgtttattttttttttttgaagcatctcattgcattgatataaaactagcctcatttacctttttgaagttcttcttctgctagtgcaggcaatatacacagctctcatttcactctttgcatttgtacaagataatctgtaataaaaatttgggcagaattaaaaaaaaaaaaa

SEQ ID NO: 3797 - DNA, 556 bp, Homo sapiens
tctaaatctccatggctacagaaaatacagaattatctacaatagccaagaagtggaagcaacccaagtgtccaccaaacgaatgaggtatatacacacaatgaaatattatttggcctgcaaaaagaaagaactcctgccatttgcaacaatatggatcaacctatgttaagtgaaataagcatgcacaagaagacaaatattgcacaattacactatatggggaaatctaaataactcatagaagtagaccagaggcttggggagaaaaaaagggagaaaaatgagttgttggtcaaagcttacaaagttttagtcagacaggagaaataaatttttggtgactgtagtcaataacaatgtattatttatctccaaataagtaagatggcatatttcaaaataaacaagatgctgaatttcaaacatctcaacatgaatatgttaacttcattttatcattccaccctgtacacatattacatgaatgtatacagcttggaatttggcaactttttaaaaatttaaaagagaaggaatccaaataaagaaggtt

SEQ ID NO: 3798 - DNA, 634 bp, Homo sapiens
atttggtttttcttactctaattccatgattctttctcttttaaatttttaaaaaattgacaaatcacagctgtatacattcatgtaatatgtgtacagggtggaatgataaaatgaagttaacatattcatcatctcacttaactctttgtgttgagatgtttgaaattcagcatcttgtttattttgaaatatgccatcttacttatttggagataaataatacattgttattgactacagtcacccagctgtgcaatagatttaaaaatttatttctcctgtctgactaaaactttgtaagctttgaccaacaactcatttttctccctttttttctccccaagcctctggtagtcattattctactctctacttctatgagttatttagatttccccatatagtgtaattgtgcaatatttgtcttcttgtgcctgcttatttcacttaacataagtgaatatgtcttccaggttgatccatattgttgcaaatggcaggagttctttctttttgcaggccaaataatatttcattgtgtgtatatacctcattttctttatccatctgtcgtttggtggacacttgggttgcttccacttcttggctattgtagataattctgtatttt

SEQ ID NO: 3799 - DNA, 256 bp, Homo sapiens
aaggaaagcttgagaagaaatcgtcaaatgttgcaggattcttgtaagcacagagaactatgaagacctgacaaggagggtatctttttctttcatgcttgtccaacaagagagcacattgttagtgtgcttgaattccaacaaaagaaggcatagaatgaatcttggttgttcccttttacttgctaaatatgtactgaatgaataaatggtgcattatacatctataaaacagctgaaaataaaaaaaaaaaaa

SEQ ID NO: 3800 - DNA, 393 bp, Homo sapiens
tagtaacaaattggaagcacttatgttagaactgaagagaaaatatggaaaaacttaaacatggcaagaaagatgaagctcccttgacccagccatctggtcacccaggctgcaaataaagcagatgggccataataaagccaccattataaacaacccagtgaatactttttgtgagagatggagtggaggaagaacaagaagaaaatatatctggaaggttgatggttttcataaggtgaataattcatttctaagtaatgcaactgttactgtcaattagaaactcacattctgatgaattttgttgcataggctttagtttagggacaaatgttaatgcatgtggtttgttactattaaacctttattttagatttgttaatttccaat

SEQ ID NO: 3801 - DNA, 451 bp, Homo sapiens
agcccaaatggactacgacagtgcccaagaaagacataaggggaagagtaccagctgagaatacataccaaagatgctgtctccagcactgcatgggacaaggatgaagcctcatcagccagctgaactggaacaagtatattctaaaactccatcctattttaatttttctatttttaatgcagagttaatccatatcagctttcttaaccataaagccattccaagcgctaacttttgtttaattagcactttgcaaattaaaacttcagtgtgaaaagtattttaagcatattggatggaacaaagtatagtttgagaatgttatccatcatataggaatggatcagacagaacactgtgaaatcaacaatgtgcttttattaatattcctcaatcccagtcattatccaataaacctaatttcttccttcttttaaaaaaaaaaaaa

SEQ ID NO: 3802 - DNA, 613 bp, Homo sapiens
  misc_feature (1)...(613): n = A,T,C or G
ttaanagagccgaaacgactacagatgcgcaccaccaccacaaccagctaatttttgtatttttagtagagatggggctcacatctcaaactcctgggctcaagtgatccacctgcctcagtcacctaaagtgctaggattacaggcatgagccactgcacctggcccgtctttctctggctctgtatttttctttctaccaaatggcttgtaatgcaaaaaagataattctctaattcttaccctctatcatgtatatcttctaaggtctgacgatgtaaagtcaaacctttccntagaatgaagcttttagaattcaaaacgaaccctttgtatatgagtttactttaatcgcgcggggggcgctccagctttttggtccctttataggaagggtcatcttcagagctgtggcataatcaatgcgccatatcctgtttcccngtggtgaagattggtataccgctccgggaggttaagagtgtaaaatgctgtagtgtattatagagncccttattcatatttactggagttgccctatgttgcctgttcaagctaggaaaagctgttctcacagtggagcaaccttacagaagcgaatacacaccgatag

SEQ ID NO: 3803 - DNA, 384 bp, Homo sapiens
gactacagatgcgcaccaccaccacaaccagctaatttttgtatttttagtagagatggggctcaccatgttgcccagactggtctcaaactcctgggctcaagtgatccacctgcctcagtcacctaaagtgctaggattacaggcatgagccactgcacctggcctaatgttcctaataaaatgtctttctctggctctgtatttttctttctacaaaatggcttgtaatgcaaaagagataattctctaattcttaccctctattctgtaaaactgagtacacttctgtatcttttaaggtctcaagatgtaagtcaaactttaacatagaattaagcttttagaattagaaagaaaccattgtaaatgattttatttaat

SEQ ID NO: 3804 - DNA, 372 bp, Homo sapiens
ccgttcttttctatgtaggcctggtgggccagttccagatatttatgggatgttgcaaaattatctcagaagagaccttaaagaacatctagatcggctgtattcaaactggttttggccacagaactctttcatgaagtgaagtttcacacagaagcctaacatataaaacaaatacaggtgggactttggagatacatttactgaaaggggagcacaactggagcaggtacaaatgaaaaaacttggtattattttgtttttgaacaacagagaattccctttcatgaatcagatttgggttatgaatcaaaatctgtatcagatttgggttacaaagtatcatttctgtacattctatataaagagaat

SEQ ID NO: 3805 - DNA, 140 bp, Homo sapiens
ttgcttcacggaaggtcatcatcttcagttgaaatgccatactcaaagaagactttccacaagatcatgaagaaacatctaaaaaagaatggcagcactcagaccgtgtgtttcaaggtccacgctagcacagattaatg

SEQ ID NO: 3806 - DNA, 465 bp, Homo sapiens
  misc_feature (1)...(465): n = A,T,C or G
ttctaattatcaccgctacaggttatcccaatccagaaaatttttcctggacagaatacctggaagctactcaaaccaattttttaaaatgaggttgcctcatggttttctgccaaatatgaaacttgaagttgtggataaacgggaaccccaggttaattcggtgttgntacgattgtagacgttgatgaccaaagagtaaagtcagcataccaataacggaaacacgggccgagcagcactacggaaacatgtggccttggtgatgaattggcgcctactctagaactccctggataactcccccaccctgtacccatcttaccagcctgacctgcgagatctagtgagatcctgacatgattatttggctagagacatcagctcagtcatgagccagatagaatagaaatagaatgtttcacagttttctatgcacaacactgtgtagaaaccttcttaaat

SEQ ID NO: 3807 - DNA, 882 bp, Homo sapiens
tttatccattcatcttttgaaggttaccttggttgcttccccgttttggcaattatgaataaaactccatgtgcaggtgtttgtgtggacataagttttcaattcctttgggtaaataccaagaagcacaattgctggatcatatgcggccaaccttgggataatgggattactttatgccttccacatcaggctctggatgagtgcgcagaggccagtggcaagagaaataagatggttgtaaaaatgcaaacgttggaagttaaaaaaggcccaagaaatcttccagtcatgccgttgactctttattgtggatattacaaatgttttgacacatcttcagggtcagtttacaaagaaaacggattctgcatcctcctcaaaggtaatgaaatcactggggaaaatcctgcagatttagagaactgaagaaaatgtacctcaactatctgcaatctaagggacaaaacagaataaggaaggaataaaatggcagaatgaactattaaataagtacaacactgaagatacagtcagagttcatgagattccaggtggaatatgaaagaaaagaagaagtaaatttgtgatgggatgaatatacatgcacacacaggtaactttggaagtcatgaggcaaatggatgaaagagaggagggaatgagaccatggtaacagtaagagcctactgaaacaattcaggcaagagatgaccaaaactgtgccttgtggtattagttagtagataaaataaacagaacaggaaatatcccctagataattgaaatgaacactttcaaatagttattgtagaatgacatgaaaagtttactataagcagtgtttgagatctataaaaattaaagttattaaacaccaat

SEQ ID NO: 3808 - DNA, 581 bp, Homo sapiens
attggtagaagcacattatttaatatttaaaagtacacatcttgaagccaggatcgtcgtattcttaggtttccggctttgagtgaactactcatatgagcctgtgttttctcatttgtgaaaggaaaataatgctgtcctcagccttataagacctaaatgggatgttacacccacacacccatacatagagccacacagtagacctggtcacatcatgctcatctgttgtcaacacgctcatctgaatttgttgagcacatattatcttcagctgctgtgaattgccttgaagataatttctatgctgccaacagttgcattgaatggaggtgaaatggagaatttggacatgttcttcaaacttaacttgagacgccgacaaagcattatgaattctgaaccagacagccaatgggacatcaaaatctgggcttagaatttaaattagttccaggaagtcattaggttccctgcctccagaccctgtttcctgcttcaggggtttctgtggccagtcagctcagccctctccctcatgatgggaagggaatggtcaggctggctgctgccattttgtc

SEQ ID NO: 3809 - DNA, 209 bp, Homo sapiens
atgctgatcacaaggcactcatccaaggaccctgctaatgacctctcactcccacctctcaaagcctgaccagcctcgaacttcacgcttcccaagatcctaaacaagatcggctcccagctttgctgaggaaagctgccactgaagagagctctgcttcttacttgcatgagtaataaatttaccttgttgttgcaaaaaaaaaaaaa

SEQ ID NO: 3810 - DNA, 734 bp, Homo sapiens
caggaaagcttcctgctgactcaaaggatttttcttcttctgaactcctattatgggaatggatgaaatcacttacagagccacagaaggaaacaaagcaaagccaggatcatgagttggattatctggaggcctaggccaatggggagttattgcttgcagtcactgatcaagcaaataaacttttccttctttcttatgaaatttatttaagaagctgaaattacttaaatgataatgagttgtgagaaaagaattgtagtagatatttgttctctatccaaattgcactgagtggggaggtgttcccataccccagcttcgagaattgactgataacagttcacacctgcacttctccagagaattgtccttgtctgacctgagcaccgtgtttagtaatgtctggtaggctatgctccaccttccctgggcagatccactggtctaagacaaacaacccaaccctctaatttctgggaagaatcacctccgtgattaatctaagctccagatctcccagagaaatcatgctgaggctacatttgtgaaactacattttatctagcttcttcctttgccctttcctgctgtcctcacttccctatgaatttttttctgaaagatcttgattaataaattatttaatcaaagatcccccagtcataaagttttgtgttttggaatataacctatacaaaaataaattaattggtactagaaaaaaaaaaaaa

SEQ ID NO: 3811 - DNA, 612 bp, Homo sapiens
atggtgaagatggagctgccctcagtgctgggcatggatcccatccagatggctgtggccacgtctgtaccactttgctgttgattttcatctctgtctgcttctgcctgctagattgtaagctcttcaaggacaaagcctatatccaggaaagctcaggatggcactgggcacttgacaaaccttcaacaaatatttcttggccgtcaagaagtcctaagaaatcagtagagctcactttggaaggaacattgaatgaaatgatattgggatctgattcatctgtgaacactttttgactgcctgctatacatgatgtcaccaatctggattgtcattggttaattaatcatatgttgtagccaaaagaacgtggggctggaagccaggagaccttagtctcatcccaattctgccaccaggtgaggatagcacctcggatgagtctgttcccctcgctgggccttgatctcctcaaaaaaggaggtggactagatgtctgtaagatgtcttccagccccaaatgccgggtctgctctatgactctattttaaaaatgcatgcacttcttattggttacataaaacctcacagaaaaacaaagtcaataat

SEQ ID NO: 3812 - DNA, 361 bp, Homo sapiens
atggagtctcactgtgttgcccaggctggcctccaactcctgacctcaagcaatactcctgccttggcctcccaaagtgctgggattacaggacaatgctcttggtaagaacgtaaagcattagttttgggaaaaagaagatttactattttccactcactgatccatcaaggaagactctactccaaggctctgctccttgttcatctatgaaacaaattacaagagagaatatggagtggacaacagatgcacccagatcagtagctaataatgtctaagtcagtgccctggagccaatctgttcctcctctccccacccccataaataaaggcaatgcaatttccaaaaaaaaaaaaa

SEQ ID NO: 3813 - DNA, 319 bp, Homo sapiens
ttagtatgtactgcagaccaccaggttaaatggaatcaggaagaataaagtgccatctaagaagaatgtagagtcagggcagagacactgtgatggagtttattacacataacagcaaattccaaagcaggagtggcagcagaaaacaatgaaggcaaaggaagtaagcccgggaagagaaagcagtttttggacaacagttccttcacctcagcatttttcatggatttcaaataagtggtaacaatatttttatttgcacattttctttgaaaataaaaatgatcttattgattttcaaaaaggaaaaaaaaaaaaa

SEQ ID NO: 3814 - DNA, 993 bp, Homo sapiens
tgggacagtcaagaagtccaatatttcaaaggagcacacgaagcgggatggctgagttacagttattttttacaacaggagtaccagtgcatcacacaggatttggaagacaataaagatataaagaagaaaaatgaaagcattgataagatcattactgaatagccactatcatgatttgggagtatttgcttcaaacatacatgagcactgggagctctcctggggtggtttgggggggcctgctttgcaaccctaactgtctgtgagtaatggcatgagtgtacaggagcgttaattacctccacagttggtgggtaacatcctgagtgcttgcaggaatacctgctgttggtatgaccagaggtcaattgtctcttgtcctaaatcaggtagatagacattctagaaagcattttactttactgagacacaaaattcaaattccttgggtgcggaactctgccaggctgagaattattggtggctggtcattattctctgagtccgattccagacacaagaaattgttgaagtgactaactgtttataattagaagctatgattaaaactgctttaacattaccctggggccctctctccaacatgaaatgatttctataaaagtgtcagtgggtggtttggaagggaaatgttggcctcctccctggtaactacttttccacctacagagctgctccgatgtcatgggaagtctcctcaaagccccagctctggtaattaaatgaaacacaaccatcctacaccacaatggctgggcactcacccacggaatatccaaagaagacaggaatgagaagaatcagccatcagttgcgttttaaaatttaaaattgaaagaagtatttatatttcatatttcccttaatgcaaatttttgacattttctaaatttctacttattttgtataaaaatgagcttatgatataataaatgatgactcccatatgttacaaaaaaaaaaaaaaaa

SEQ ID NO: 3815 - DNA, 744 bp, Homo sapiens
agaacccccacatttcagatgggcacttggtctctcggaataatgactccattcccaggtctccttggaggtgacagtggccatgtgactgtcagggatgcaaacagaagcatcatctggaagtttctaaaaacctccccagcagttggaatgtgagtgtgatggctggagctctgaaggccatcttgatccatgagatacttttgaaaatggaagcctagttcagcagaacaaaaacacagaagggttgactccacggagtgcatcaactcctgcaaagggcgaggaaacttgcaaaggcctgtgatgggtgtagcatgtaatagatcgtggagccagcccttagcaagcaggagggggacctcctgtgcctgggtttctgcatccataaactagaaagacaataagagtgtccatctcagagggatgcagcaagccctgaatgagacacctgtggccagggcttagcacctgcttggtggcaccgagagagctttgcataaatagtagctgtcattactagcaataatagtatagaatgagtaggactcaaagtaggagggaaggagtcgtttccttttctctgcagtcctgtatgttgtttgacctattaacaataagtgtgcattccttttgatatttttatgaaaagccagtaaagtgaaaattttatttaagaaaaaaacgtatcgtatatccctatgatcagttgtatgaaaaattaaatttatatcacttggaaaa

SEQ ID NO: 3816 - DNA, 924 bp, Homo sapiens
ctaggatgtcttcaagtcacccaagcagtttctactgtgaatctttgagagggagattgcaaggggccatcaaaagtcattccaagtcaaaccaaggtaaaacctgatgacagtgatgggatttttctcagcaaatggtcttgggtctgctagaatatacaaatgaataaacattcaaggtccaaaagtttcttttacatttggctataggttgaaagcatgagatgtttatgaagtaaacacccaacatggccaaagtgaaatgtcagtaagacaactacagaaacgtgatctttgagatgaccttctaattcaccctctaagctattcataaaatgtatagctaaaacatgtatactaggatttgagtttttctcattcataagaccacttgcatctgttgcatgatatcttctattaattttaataagtatcagcaaagcaaaacatttcttcaaatcttgcattcatctggtttttctcaactctaactacaaaacttagggtttcttatcttttcattcatatgtgataccttttatatatttttttcttcatgaacttttcttcatttgcatttcttcttctcataaaaactatccttgagctcggtgcaatggctcatgcctctaatcctaacactttgagaggccaaggtgggaggatcacttgagcccgggagtttgaaatcagcctgggtgggcaacacggaaagagcccatcctacaaagaatttaaaaaattagccaggcatcgtggtatgcacctgtagtcccagttaccaggaaggctgaggtgggaggattgcttgagcccagaaggtggaggctgcagtgagctatgatcacaccactgcactacagcctgggtgacagagcgaggccccatctcaaaaaaaaaaaaaaaagaaaaaaaaaaaaaaaa

SEQ ID NO: 3817 - DNA, 327 bp, Homo sapiens
ctggtgttccttatcaagttgaggaaattatctctatttctagtattctcattgtgaatgagtgttggatttcatcaaataacttttctgcatctactgatctaatcctatgacttttttctttagcctgttcatgtgaatgattacgttaattgatattttaatatagaaccatctttccatagctgaaattagtcccattgatgagaaattgtttttttaaatatggcaataaatgctattgtatttatttccctattttattgttagcttattttatgattttaaaatgaattaaattttagcagccaaacaaaaaaaaaaaaa

SEQ ID NO: 3818 - DNA, 386 bp, Homo sapiens
agataaaattgaatataaagtatatcaatcatataatcacaacataaagaagaaacctgcgtaggtaaactgcatacatcccatgaatgaagaatatggagaatgaatgtgatcacttacagaatattatccagcgacatatatgttaaaaaactatgacatttgaacccctattaatcataaaactgttcatcttttgaaaaggagaatgattctttgtaaattcaaactccatctgtattatcaataagagtatctcagattgagtttcacacattgaaactaacctgctgactataaaatagttaagtaattttggagtaaagttctgaatgactttttgcacatggataatgaagacaaaaagatatacaaaaaaaaaaaaa

SEQ ID NO: 3819 - DNA, 287 bp, Homo sapiens
ggaaagcacactaggggaagacagccctggaaaaagtggatggactgccagacagatgcagtgagacttgcaggacttaacttttgaagagagaaaataactccaagagcagggtttcttatcattcttttggtctggaagtacattgatacatcccatgaatgaagaatatggagaatgaatgtgatcacttacagaatattatccagtgacatatatgttaaaaaactatgacatttgaacccctattaatcataaaactgttcatcttttgaaaaaaaaaaaaa

SEQ ID NO: 3820 - DNA, 1003 bp, Homo sapiens
cagggccatggtggatgtgaacagaatccttccttatgtccatcttggaggtgagaggcatcaactctcatgtgccactgagagagagggcaaaaatattaaaaaccattgctggaaggacaccttgtgagtttgtaagtttttcagcacacttatcatctaagaacctaaactaatgaactcagtcccagaatgcatagagttgtcccacatgcgaatagatttcaacctctatcaagagttccctgtgctttccagagggaatgagcaccagcacttgccattcgaatctgtcatcaagatgctctcaggctcttatctcagacaatgttgactccactaccaagttataaagtataaaaggaagtgggtcttagagatggtacagaggaaaacattcatacgacattccttgttgtagtgaacgtaactgggttttgcagttttcccacttcaaaaaatcacctgacagcccgtatgctgcgttcagttccactcatcataaagggaagcacaggattacctgggtgacagcttccaaagcccatgaaccatgaataaggctggggacatacggagacagcagcctctgtggtgtgttacattggatctgggctgagagttgctgtctgctctagtatctttatctcctttcaccttggaaattgctgtttggctctggctaatagttggttgacttcaggatcacagtagggactaacttggaaagtgcccttaaacttatttttatcaggatgcctcttatggttaaatatatttgcttcctgcttgtgagttggagaattgccaagcagaatgtacacctccctcagccttgaaaggatggatgcttctaccttttttgcattatcgaagagataataaagtgtatttgtgttattcactatatttttagcaagactgagccctagtccatgtgcagacttcttggttttgtttattaataaaaatcatatatatggctgcaaaaaaaaaaaaaaaa

SEQ ID NO: 3821 - DNA, 767 bp, Homo sapiens
ctgaaatcctggactacagatcatttactctttgtaacagctatagtatccacaccacagcataactcaggacaataaaggtactacagacaactcaatgtatgcaaaccacaatgactaaccctggaaccctggaaagaatgtacacagtagcaggagcctacagaagactgcaagaagatggggaaatgcaaaaatgaagtataaaatgaaacaaagtaaaatctaaatggatacctgagatgagtaatgaaattttcattgccatttttggatttactctcctaactaatctccaaggtaatgcaaactaagttagaagaaagcttttctgagtcaatcggggtcccaagaagcaaactgaaggcccactgtgtgtaggcactggttttctgcaccacaccctggctcactgccttctccaagccctccaaagactgttagtttaggcatctaggagaaaacatttcagaacttgtatgtcccaacatcatgctatttgaaatatcacttttctcagaaaaagtcttggaaggagatctgatttaaccagataggtactgggttagtgacacaatatgtagtgttacttcttccaatgaagaagaaatgtgtctggtgttcagaatacacacttaggctaatattcaggctctgccacatgctatctttgtggagatggtggttagtaatatgtatgttgtaacccatacacagtacaatgacaagttccttaatctctctctacgaaatgtttatatgctgtc

SEQ ID NO: 3822 - DNA, 253 bp, Homo sapiens
cttgaatcctggactacagatcatttactctttgtaacagctatagtttccacaccacagcataactcaggacattaaaggtactacagacaactcaatgtatgcaaaccacaatgactaaccctggaaccctggaaagaatgtacacagtagcaggagcctacagaagactgcaagaagatggggaaatgcaaaaatgaaatataaaatgaaacaaagtaaaatctaaatggatacctgaaaaaaaaaaaaa

SEQ ID NO: 3823 - DNA, 314 bp, Homo sapiens
gacctcaagcatgagatcatcctggattatagtgggcctgaaatccaataaaaagtgtctttataagggatagaaaaggaaaagacacagaagaccatgtgaagatggaggcagaaactggagtgatgtgtctacaaatcaagcaacgccaagaattgcaacaaccacctgaagctaggagtgaggcatgggatggattctctctcagaacctccagaaggaactaaccctcctgacatcttgatttcagacgtatggtctccagaaaaatgagaataaattcatgttgttctaagccaaaaaaaaaaaaaaaa

SEQ ID NO: 3824 - DNA, 740 bp, Homo sapiens
ctaggctcacaagcagaaagaactatccttgtctctgatgagactttggactttggacttttgagctaatgctggaatgagttaagactttggaggactattggaaaggcatgactatattttgcaatgtgagaagaacgtggagtttggaagagccaagggtggaatgatatgatttggatctatgtccccaccaaatctcatgtcaaattgtaatccccagtgttgtaggtgggtcctggtgggaggtgatttgatcatgaaggcagagctctcacgaatggattagcaccaaccctttggtgctgttctcatgatagtgtgtgagttatgatatccggttgtttaaaagtatgttatatttccctcctctctcttggtcctgttcctttaaagtaagatgccttctcctttaccttcccgaatgagtaaaaactctctgaagcctgccccaaaacagataccatcatgtttcctgtacagcctgtgaaactgtgagccaatgttacctcttttctttataaattacccaggatcatgcatttttgatagcagcctgagaacaagctaatacaccatgccaactacatttcataaatatccttaattctcacggaatgagaaacaggtggtatatgcccattttacatatgactgattgtagtctgaaaggaactaagcgactagcctaattgtctgttactaactaacatttaaactgtaaatcaaaacataaacat

SEQ ID NO: 3825 - DNA, 854 bp, Homo sapiens
ctgattgcaacgtctctgggattttgaatatgactctattactattgaccatctcagaaaggaggacaaactgcccagttttctgcttcacatagacactatgtttttgtaagccaaaggcagaagagtagagataaaaacctgaatcatagttctacctttctttcaagaaaaaacaaaatatctggcttacagtaaacatttaataataaatgaatgaatgaatgataacttttgattatgatggctaattgggatccacacattataattaatgaatttctcctccagctccagatgttggtgatcactaattgccactcttagattaatgttcatctcttttccgtttcttaattgtttctttggtggggaattgggagaggctgcattagcaatcattatcccgatagaatttttaaataaaattctcactactttattctatttttaaccaagagtatgtaactcattctgattttttaacttaattcaagtgttttttgttgaactttgtgatatcctacaacctatggccacatagttcacttctataatttacaaaattcttagaagggaaatcaggtaacttttccttttaaaattaatgcaataacaatacctctcctatttaacttattttttttcaggatcaaatgagattataagcacaaaagtttttgctgaaccatgtatctattcattatgcgtctgactctctctctaaattgtgggctcctgtcttagcttgcaatatgtgctttttaattgttgacaaactacattaaatatttgtaaaataaggacaatcataataaataaaacaatgtacagaataaaaaaaaaaaaaaaaa

SEQ ID NO: 3826 - DNA, 564 bp, Homo sapiens
ctggtgagaacagttaagtgccttcaaatgccctgcagtgttcaatgaactagggatataagaacagatgagacaaaatttctacctcaaggaccttatattatatagaagataatttattttcccaaaaaggataattctttaaacatttaatctcaaaggcaacaagaacaaaaactcacaagtagcactatccaaaacgtgatccatgaaacagcaacttgggcattgtctggggttttgttagaaatgtagaatttcaggccccatcccagaatctctattttaataagatctccagaaaatagaaaatttgagatgtgctggcctagactttagtcattcatactactatccttaccacttccttcttcccatttggcctgaacaatgatctaaaacaatgacaaagtcccaaggaatcaggagaccactaataaagtcaagtgtagaccaaactgatttttccaaggcttgtgaaagagagcatggctcttttgagaattctatttctagcagtaccgaagagtacaaatctaagctggggaaaaaaaaaaaaaaaaa

SEQ ID NO: 3827 - DNA, 213 bp, Homo sapiens
atggttatttttccccttcctgtgaatttggatagcgagccaaaggaaaagaaacttcaacaagaagactggctcaaatcactctagggccagactgcaccttctataacatttctaataaatcatggggaaaaagaaatctctgccatagtggcacatttgacaaattgaaattaaattttgccaactctggagaaaccaaaaaaaaaaaaa

SEQ ID NO: 3828 - DNA, 576 bp, Homo sapiens
  misc_feature (1)...(576): n = A,T,C or G
cctttgatgaagcactaagtggaggactgnaagagtaacaaaatgccacatcacagcaactgtgaagagtacaaaatttggctccaaaatgccagcagctctccaccgtcctgaccatgctgaaaagcatcacagtcacacctaccaagaagtcagcacaggccagagaggcaatgagaaaattggttggagagtgcagctgcttaaaatgaagaacagaagtcattactaagagatttccaaatacagccagcaaagaccctaagctaaacgccgtgtacagaattacccgggacccaggagaatagggagtttcaatacaagatccattcacatcctcatagcaaagctgcacaacaggttgggaaaaattgctggtcatggttctgctgtttgttgtttgctatttctgtccttccttgtgatagggaattataattttgaattctgaaaattaaatcaaaaacaaactgcatatgtgagtacttacaaattttgtttcatattatattctttttcaattttaattataaagagaaattaaattcaaaaacataaaagataaaaaaaaaaaaa

SEQ ID NO: 3829 - DNA, 189 bp, Homo sapiens
cctggggtagtctctggagtgaggccaccgggggaagtaatgcaagacgatgtcaagggagctgcagcaggccaagggcgttctccagcttgctgatgtttgtgccccagatagtgaagtttagaggcagttcgtcttcagaagcacttcaaataaatacattgtattagtccgttaaaaaaaaaaaaa

SEQ ID NO: 3830 - DNA, 379 bp, Homo sapiens
cctggtagtacaatatgggaagatcctcaagctggttctccagagggctctgcaggacactgctgaagtatatgaaggtggaggcagacttgttcaggaaaccctgaagctgtcgggaagcagactgaggcagtgaggaaaagcctctgccttggtcagtcagatgtgactttgacagtaaacactgccctgccagacttgacaattacctgctcttctctcagcctcatgccgccaaagtgcctcagttattcttcaatatcttcaaatagatatatttaatgtggcttttctagtttttctcagagaaatcattagtcccaaagtagaatatccctatgatacgaataaatttcttatattatcaaaaaaaaaaaaa

SEQ ID NO: 3831 - DNA, 804 bp, Homo sapiens
ctggtaccacccctagaatttccagtacaccagcaccagcctgaaaaccacgtcctcatcaaaagacagaaagaaaaaacttgagccagcctgggaagaaccctattctatgctgttaaccactgagactgccatccgcagagccaagaaaaaaacgaccacactccagtcaagaaaacatctttctctcagaatcatggaggactgtactaggaccaatcctactaagttaaagttaaagaaagcttaattttcctgtaccttcatattgcttcctttccttattgttactagcgcctttgttattactgtaactaactcacctcagaccaccgccttgaatgcttgttctgtcataccttgcggaaatgtaaaagatcaacaacagctagccttttcacacaaatgcttacgtcccagccctctgatggacatggttacccctagctctcattatcgtaatgacctgcagccaagatgccaatgttctgctcctatagcctgccaactttgtagtaaacgggactatacacattcaactgctcaggagcaaagttaaacttccaagaaaaaggtctgtgcagatctaaaacccctcatctatttcactgaaagggactaccctttcgaactgtcagccttatcagtggaacccctgttttttctatcaccaacccccaccttaactaactcctagacctgccctcaatcgcttctggggtatggggattgacataaatggaaaagaaccccctaggtattttttaaatacgcattatttccccatctcccccttcttagtag

SEQ ID NO: 3832 - DNA, 1245 bp, Homo sapiens
caggcatgaaagcaatggctgctaaagagtataaaatgctctcctcctgtcagccatcatgtctggggacaacagctccagcctgaccccaggattctttatcttgaatggcgttcctgggctggaagccacacacatctggatctccctgccattctgctttatgtacatcattgctgtcgtggggaactgtgggctcatctgcctcatcagccatgaggaggccctgcaccggcccatgtactacttcctggccctgctctccttcactgatgtcaccttgtgcaccaccatggtacctaatatgctgtgcatattctggttcaacctcaaggagattgactttaatgcctgcctggcccagatgttttttgtccatatgctgacagggatggagtctggggtgctcatgctcatggccctggaccgctatgtggccatctgctaccccttacgctatgccaccatccttaccaaccctgtcatcgccaaggctggtcttgccaccttcttgaggaatgtgatgctcatcatcccattcactctcctcaccaagcggccggccctattggcggggggacacttcatcccccacaccctactggggaccatactgtctgtggccaaggtatcctgtggcaatttcaaggtcaatgctatttatggtctgatggttgctctcctgattggtgtgtttgataatctgcctgatctctggatcttacactatgattttgcaggctgttatgagcctgcgcatcagcagatgctcgtcacaaagccttcagcacctgcacatctcacatgtgtgccattgtgatcacctatgttgctgcttttttcacttttttcactcgtcgttttgtaggacacaatatcccaaaccacatacacataatcgtggccaacctttatctgctactgcctcctaccatgaacccaattgtttatggagtcaagaccaagcagattcaggaaggtgtaattaaatttttacttggagacaaggttagttttacctatgacaaatgaaacatagaatagacatattgtttcaggtggtgagaaaataatggagacaaaatttcataaaagatgtgaataaaatggtattaaaatcatgacatgcaatttacccatgtaacaaacttgcacgtgtacctaaaataaaaatagaaataaaaaatcaaaataaagacataaatttgtaagtcaccataatatgtcaaaaaaaaaaaaaaaaaa

SEQ ID NO: 3833 - DNA, 369 bp, Homo sapiens
agctgtagtttgggaggtcggagttcaccaagacaatctgcagctgcctctgcctttcctcttgttttaaaggaggattatgaggcttgcatacctactgcaccaacccatacgaagtcaatggacaggatgaggccaagtcaataatacagatgaagagcagtacaaccatgtcttcatgccttactgaaaagcaaagatgtattttatatctggattttctttgcactgataaaacgatatcagcggtatatagtgacttgggtgtcactgtatgcatgttttttgaaatcctaaaatgaaatgtatttatctcccaatcatctattgaataaaagacaattgcttctgatcccaaaaaaaaaaaaa

SEQ ID NO: 3834 - DNA, 563 bp, Homo sapiens
aaggagtctttgtcgcccagagaggagcgccacggtatgatatcggctcactgcaatatcagagtaacggcctcccaggttcaagcgaattctccctgcatgagtctcccaagtagctgagacttcagacgcccaccaccacgcccaggtaatttttgtatttttagtagagacaggatttcaccatattggccaggctggtcttgaactcctgaccttgtgatcagcccgcctcggcctcccaaagtgctgggattacaggcgtgagccactgcacccggcctatgtattcgtttcttttaaaaaaaaacctatggatactagttatgtctacatgacacaaaaatttttgtcaatacagaaaagtctatggtaatataatttaagttagcttgagactattgttaagattaaaaaataatactaaagctgagaatttaaaaattaaaatgaacattttaattatggctaaaaaaaagaaaaaaaatggcctcgttggctacagcggggaggttgcgcccaacctctcatccactttcttcattcattaatcctctcaatat

SEQ ID NO: 3835 - DNA, 408 bp, Homo sapiens
ccacacaccccccccacccatcttcttattctcccctcgcctaggtggaaataaaaatagagtgctgaagtatctacaaagaagctaaaaactgtcaatgatattgataattcttaagtatatttaggaaatattaaggggattattacattcaaaggcttataacatgtaatttcatagctctttatataattccatctcaaactctgtaacaaaaaagcatgtgatgaggattagaaagttctacaaaaagttttagttgaaaaaatagaagtaaaaatttagttgcctttataaaaacagaaagtaatgtacagaggtatattttgaattaataggttatatatgagctaataaattttattacaactgaattatatcctaaaattattgctaaaaaaaaaaaaa

SEQ ID NO: 3836 - DNA, 301 bp, Homo sapiens
gaccggttacgatcgccgcgtacctgtgcaattagtaagacgtgagagacgctctgtagcattcgtgacctgaccagggcaaagaaattccaaacctccttggacccttgctggcatccagatgtctgcggtcatcagtaacctcttgatcccaacctcctcatcttccgccgtcctcaacataaaaagagcctgaaatctgtgctgacttaagatggttctttaggacattagtctaccatgttattggtttgctggctatccaaaataaagttgccttccttgctcaaaaaaaaaaaaa

SEQ ID NO: 3837 - DNA, 773 bp, Homo sapiens
  misc_feature (1)...(773): n = A,T,C or G
taaggatgatgctggcctcaatgagttggggagcttctacacagcaaaagaaactatcaacagagtgagcggaaaacctacagaatgggagaaaatacttgcaaactatgcatctgacaaaggtctaatatcagcatccataagaaatcttcatctgagtccaattaatgaaaatggtgacagcacaacaataacagacaagaaatgttgtaatctaagttcatcttgagagaaatgaagcaggatatttgtcaaaagacttgaaggactctcaatggtccacacctatcacgtgatctcatcaatgttcaatgtgaaaagtaaggccctgcatctttgccaaatggttgacagtgggagcatttgccacatccagaggaaactcaatcactccatatctactggagggtacttcatccatggactcaactggacagccacaagagaaccatgtcaaaggcccaatggtcctacagagatgcccagaacggtggcagggggatcatgtcactgcagcttgggagataactangagtagtttgggtgtttacaaggaccaaagaagggaagaaaggagacatttggatacatccataaactcttacgagtgcttactgtgatgaatagcactatctctgctgccaggctgcctaggttgaagcctggctttgccactccgtgactgcatgcgcttgggcaagttactaacttcgttgggcctaagcccttggggaaatgaaggaaagctggccctgcctcataaggcacaggtg

SEQ ID NO: 3838 - DNA, 911 bp, Homo sapiens
aggtttttatacatttgataatgtctttaaagctgaagagtttttgatctggttaatctacactgtagacctgtgcagattcagacaccacctcatgatgtcaaaattgctgccagaggagaaaggtcttctctctacaacagttgaatagaagccctagtcctctcattgcctggatttgcatcctgtgcccaatactgaatcaattgctgcagtccctggaatcctaaaccttctctgttcacagcaatctggtgtctcaaaagtctttttcatgatatcctacgtcaaaataaatacacaacagttctgtttattaagtaattaggtccaaacaacttgataagtatccataccctaacaacatagtagctgcttgaatatataatacacatatatatttttaaaagcacttttatttttaaataaacataattacttagtaatgggatgtgtgggctacggcaaaatttctcaaatgttagaatcagattagacacttccactcttatttcttgtcccatattaattttttcatgcagcacttgtttttatcataataataactgaaaaaccagcttcataaacatatgatatcatttggaacatcacacaatccaatgttgtttgtagtgtactatagatgtataacaatgagtatcaccagatgtgagtatcgccatggctctcttaaaaatttacagtatctcatgatccacactctgaaagccaaagatgtcattagaatgatggaagacgctgcttgggcttagctgtcctaacctagtccttgacctgagggtgaggctgacttcatatgactggtgtggagacattttccaaggggaattcaagatgctgtttaataaaataaattgagtatgttgttgggcaaaaaaaaaaaaaaaaaa

SEQ ID NO: 3839 - DNA, 693 bp, Homo sapiens
  misc_feature (1)...(693): n = A,T,C or G
gttaataatcaccgctacagacatcccttgaagagcccccaatatctcatgacaacttctggaaccgttcctagagatggatcggaggaactgctgcttcttgtccctgataaaatataacacttcaaagaattttcagacatcctccctcgcctccgctgttacgttgctgggaagcactgcttatatggcgctaagtggtggcctttccaggtgcttggaggatgtcactcaattgcattcctctctgggctgaatgaagccatcatgaggaatcccactgttccaccgacttctaagtaaaacggagctgggtggcacagcctgaggcgtcattgattgcaggctgagtcgtggagccaattccacacattcatcaggacagagccttccgtgctagggggaccgcggcccatacaggacttttgaaggacaagtaagggactgccccatcacaactgggctccctgcctgcgggatgacctgagacttcaaggggggccttggaagccactattcaccatttgttggggggcaaagagagcattattggggtattgccctttagaacaaaaatacacctgngaaaattgggctggtaattaagatccccctcctgttggaacctagcattgggaaatgtaaggagcctggttatgaaacaaacctggttaagagttgtgcaaaagaaaa

SEQ ID NO: 3840 - DNA, 732 bp, Homo sapiens
acatcccttgaagagcccccaatatctcatgacaacttctggaaccgttcctagagatggattttctgagacaaagccacggaggaactgctgcttcttgtccctgataaaatataacacttcaaagaattttcagacatcctccctcgcctccgctgttaaggacacacaggtggacgttgctgggaagcactgcaaatatggcactaagtggtggcctttccaggtgcttggaggatgtcactcaattgcattcctctctggtacaggcctgctggagtgctgaatgaagccatcatgaggaatcccactgttccaccgacttctaagtaaaacggagctgggtggcacagcctgaggcgtgattgattatggtgacaagcagatctgcatgctgagtcgtggagccaattcctcacattcatcaggacagagcccttccgggctagggggaccgccgtccataacaggacttttgaaggacaaaaacccctcctccctgccctctcaggggactgcacccgtcacaactgggctccctgtcttggggaatgacctgagactccaagggggccttttggaagccactatctaccattggctgggggcgaagaacagaagccccggaaatcttggcacacttattggggcgtggcccttggacatatcttcccctgggagaatgggctgagataagatgccttttctgtggaattagtatgggaaggaggg

SEQ ID NO: 3841 - DNA, 263 bp, Homo sapiens
tgaggtaaccaaatataagaccatctctggattgtctatcttggaacttcttttgaataaagaaacataagcctctttaatcaaatcacaattatttgagtattctgtaatatgctgctaaaccctttcttatctgatctgattagcaatgtaataatttcttaagcttaaatctctttattattagtagtcctttttccaatgaagaaaaactattaaaaaccaaaagccagaagaagaatttaaaagccttttgatttaat

SEQ ID NO: 3842 - DNA, 585 bp, Homo sapiens
tctaataaccaccgctacaggttttggtatcaggatgatgttgccctcatacaatgaattagggagaagttcattctgctctcagtagaaatagcacattgtccttacacatctggtagaattctgctttgaatccacctactccatctttttctgcttgcctgaggagctaatgcagtcatctgaaggcaagaagacaacttttcgagttgtgagagttagcacactgtttctttcccatctgtgtgggtggaccatcagtccaaatggcaacagatcaacatgctattttaatcagttggtgactattcatattcactctcatagcacctacatgcaaaattttgttcccaccgcaacttctcaatatcacatcatatcacccttgcagaatagttctttgggcctaatggtggaaccatctactttcacaacacaataagtctccttattctaacctgctacaagaaagcaccctgtggtgccaagagccctggatagctgatacatcaactgcctcttattccaggtcagctcattcaaccctaattacaactgatcttccaccagaggaataaactacat

SEQ ID NO: 3843 - DNA, 668 bp, Homo sapiens
tttggtatcaggatgatgttgccctcatacaatgaattagggagaagttcattctgctcattttaaaatgatattttcagtagaaatagcacatttgtccttacacatctggtagaattctgctttgaatccacctactccatctttttctgcttgcctgtttaagaaccgttgctgaggagctaatgcagtcatctgaaggcaagaagcaacttttcgaagttgtgaaagttagcacactgtttctttcccatttgtgtggggtgacatttattcagttttgaccatcagtccaaatggcaacagatcaacatgctatttttaatcagtggggactattcatattcactctcaatagcacctacaatgcaaccaaatggctaccttatgaattttgttcccaccgcaacttctcaatatcacatcatatcacccttgcagaatagttctttgggcctaatggtggaaccatctactttcacaacaaaatattttgaggtgttagtcaataagtctccttattctaacctgctacaagaaagcaacctgtggtgccaagagcctgtgatagctgatacatcagctgcctcttattccaggtcagctcatcaacaatcttcactagggaaacatcaccctaattacaactgatcttccaccagaggaat

SEQ ID NO: 3844 - DNA, 657 bp, Homo sapiens
  misc_feature (1)...(657): n = A,T,C or G
tctaattatctcaccgctcagaaaaagggaaaatttaaacacagagacgcacatagaggaaagatgtggagagacacgggaggccaagaagagaagcctgaaacaggtttaccactcccagccctcggagcaaatcttgccaaccccttgatttaatacttctagtgcaagctccacctcccgggttcatgccattctcctgcctcagcctccagagtagctgggactacaggcgcccgccaccacgcccgttagtagagatagggcttcaccatgttagccaggatggtctcgatcctgacctcatgatccgcctgcattggcctcccaaagtgctgggaatgtccgccacaagtctatntttttctctacgtatttgagatgccatttttatcttatactgaatttcaccatacacttggatctatttctataatctgtgttgccatttatgcatactaccatactcaataattatggagcctttatagtatgcttaacatccacagactactctacccacctttacctgcaacaaacaaactacatttggctttttataatctaaggggtncttacttttctggatttctcttctttttcctaaactttaataagaacatgcgccccacggggtaaggtatttcacctgcgtat

SEQ ID NO: 3845 - DNA, 708 bp, Homo sapiens
  misc_feature (1)...(708): n = A,T,C or G
cagaaaaaggaaatttaaacacagagacccatagaggaaagagtggagagacacggagaaaatcatgtggataaaccaaaagagaacctgaaacagtttaccactcccaccctcggacaaacttgccaccccttgatttaatcctttagacttcaaaaagctcactggaagctccacctccgggtttattccattcttcctgcctcaccttcagagtactggggactacaggcgcccggcaccacgcccgggttttttttggatttttagtaaagaaagggttcaccctttagccaggaaggtctcgatcctgacctaatgatccggcctgcttgggcttccaaagtgctgggattacaggtgtaagccaccatgtccggccacaagtctatttttttctctacgtatttgagatgccatttttatcttatactgaatttcaccatacacttggatctatttctataatttccattcagttttattggtctgtgttgtccatttatgcataactaccatactcatttaattatgtagcctttatagtatgctttaacatcctacagactagctctacccacctttacctcccaaactctgtctctcacacactcatgcaaacaaacatacattttgctttttttaaatctaagtgttnacttagctattctggtatttttctttcttttttcctagaaacttttaaat

SEQ ID NO: 3846 - DNA, 328 bp, Homo sapiens
atggagttttgcccttgttgcccaggcaggagtacaatgacgtgatctcggctcaccgcaacctcagcctcccaggggactctgttccatactatacaacatttaacagctttcctggcctccacccattagacaccagtataacttcctcagttgcaataactaaaaatatctccaaccattgtcaaatgtctcctgggggaaaaatcaccccttttgagaattgctcaggtagagtatttgcatacgttaaaatttaataaataattgtttagtcttttacattatgtaaacatcatgctatctcttggaagacattatgatgaat

SEQ ID NO: 3847 - DNA, 696 bp, Homo sapiens
  misc_feature (1)...(696): n = A,T,C or G
atttaaatctcggtaggacaaagacaatgaacgtggctcagaatccctcatgtacatgtcttacagccttgagccccttttcaggatggagcatcaatactctcaaaaggtaaagacaagcagtagatcccttgctgctcaaagggcgattcctggaggagcagcagcagcagcatctgggaacttgttggaaatacagactctgagtccattccagacgagctacatcagattctgcactttaacaagagtcccaggtgacatgtatgcacattaaagtatgagaaacgctggcaaaaccattactagattcccaggtgttcggtaatgaaaatgaatgtttttaatattttgtctgtttgaaagtgtcttaaacaaatggcatgagagtttgggcctagagttacacaccagtcctgaanagatactctgttcaattacaggcccctgcagttatcaagagccacaatggcagagcacattctcgattctaaatatggtcatcctgtgggtanacaaaattggctctcccagacagcngcacaattaaaaggcagcttccgaattcatnacttactttcatgtcatcagcccagccacacacttcncngctnttcantcngcccctgcancaggnntgctatgcactgctcagagnataatcacgctatcaatgacccgtgaaagcaanctaat

SEQ ID NO: 3848 - DNA, 273 bp, Homo sapiens
attcacacatgcctgcattccctcatttggaaggcatcatgatggggtgggaagaaccctctgagtcgtccaagctccatggcttcaatcctggctcctgcacatccttggttcctcctgcctcagtatccgcatctgtgatctgggctgggagacccgcagggagaaatcaaagcacatggtttcatcaacgccgctcaccgccaggattcagacacacggacagaggtggatgaagcacatacctgacgctccgcgagctttctccttcag

SEQ ID NO: 3849 - DNA, 115 bp, Homo sapiens
aatactctaagggttttgaagggtttccaaggatcctgctcttggaataccaaaaccctccatccaaaaacaacagatctgaaagaggtatcctaatacaaatgtgtagtaaaat

SEQ ID NO: 3850 - DNA, 502 bp, Homo sapiens
cagaacttgtcaaggtcatcaggaaagtccatgttgctaaacggaatgaccaattcttaatctccaccttacttgactgtggtagatggttacatggctggcccccaaagattcatacgtctcaggatccatgcattgtgtgctttcttctctcattaattctgtacttggccatgggacttgctttgaccaatgggacatcagcaagtctgaagcaagcagaggcttgacaagcacttgagcattggttcttgctctgttggagcccagttgccaaaaaagaagtctgggctaacctgctggagaggtcatgtggaggagagtcaaggtgcagctgcccacattaaccaccaggcctgtgaacaaggctatcaggaaataaccagcttccagccaacctggtgtctgactgcagctgtgtaagtgatcccaagcaagactagcaggtgtaccacacagctgagcccaatctgaattgctgacccccagaatcatgagtaat

SEQ ID NO: 3851 - DNA, 449 bp, Homo sapiens
aagagctgagatcttgaggagcaagtcattctcaggtgaaatgtctaaggtgtaagacttttcaccattctcttgattgtgaatcaaaaaaagccaactctgcaggacatctgtgagaagatagatatatcaccttgagacagaacatcacctcctggcaccagacacactgcttgataggctgagcacatgctgatactcaggaccacttcccccttacaccaggtgcctttggaaaccaaccctccggcaaaaactgcaactcctcaaatccagacaatgagaagccaggcccctcatccatcttgattgctttcttacttgtttctgattcctgttttctctgaacatagctatattccttccctaccatataaaccccaaatttagtcaagtgggagagacaaatttgaggtttggctctcacttcttcagctgaagtcccccaa

SEQ ID NO: 3852 - DNA, 460 bp, Homo sapiens
tcttctcaactgagaaagagtaatcgtcacttgccacgggcagacttggagagtcgctgttacgtgccaactggaagaatctcgctggcccgccctggtcatcctgggctacacgactttatttgctgctcttcctcatcctgactctttttacccaccctggccactctgtacttccaggcttctctactcctgcccacgtgtaaactgcattctggtcctaactccctggcctcctgcctgtctgcctccatttcctcatctattaaactctaggtgtctacatccctgcccgcctctttcactgtaggaccaggcgtgggaaatgctgagcttttcagagatcagtcaggaggagaatgtttgttaaatgacagaatcctggttgtgccactgtccactgcatggccttggtcattcacttcactactgtaggtctctaatttctcatctgtaaaat

SEQ ID NO: 3853 - DNA, 742 bp, Homo sapiens
  misc_feature (1)...(742): n = A,T,C or G
gggaagatggagctgaggtgggggggcctcttaattttcaccgctacagaccaagaaaacccaagaaataccccttctgcaaattcttatgaagcctgcatgtgcctttcaagctcctttctgggttgagcttgtgaaggcagcttcactcgggcagtcgcaggaaaaactttcagtgggaggaagaatgccgacatactcttctgtttgctttacaaactgttcttgtggcgtctgtgcaaaacactctactccctacacgaggaaatagaaagaaatttgtacaggcggaaagaacatttaccttctcccaggatcaacaggaaatgtaagcaaaggctaaacctatgccatctggacattctacaaggcccagcccatacactgtttctattattactctccangattaaataatttcaatatgccgcccccatccgagtggggatcccccagcttttaagtttcactcgctaggtgatcattctcggtccttaccttagtgtccttgatggaanagggttctctctcttaacatttctcccaaatatccgatcccggaggcntgtaagtgtgaaacccgtggggtaatataattgccgtagtcctccattgtacgtattataagttcgnnnnatcttgctggtcgttattcgataatgnncataaaggtcctcatccaacccgctcttacaaaaanncaccaaatcgatagtncattatacctatactactcagagct

SEQ ID NO: 3854 - DNA, 436 bp, Homo sapiens
  misc_feature (1)...(436): n = A,T,C or G
accaagaaaacccaagaaataccccttctgcaaattcttatgaagcctgcatgtgcctttcgaataccacaaggaggcaagctcctttctgggttgagcttgtgaaggcagcttcactcgggcagtcgcaggaaaaactttcagtgggagggaagaatgcagcctctcaccaacttctggacatactcttctgtttgctagacaaactgatattgtggcgtctgtgcaaaacactctnctccntacacgatgaaatagaaagaaaagatggtgtcagttttatttgnacaggcgggaggcacatttcccttctcccaggatcagcaggaaatgtaggcaaaggctaaagctatgccatctggacattctacaaagcaagcaacgggattaaagcccagcccatacatggtttctattattacttccaaagataaat

SEQ ID NO: 3855 - DNA, 376 bp, Homo sapiens
gaaaaagcctgagcaatattgcaagacacacaccacaaaatgtgaaacttcttgggttaaggccctgagagttgccagatcctgagctagaaagataagtttcctctgtctttcctctgcaagagattcaaaccaatgactgctcggtgctttaatcttttcctctcttatttacactatgttaatgatgttttatttttaagtctttagagcatctagaattatattatttatatataatatggaactcaaattttatttagtccatgtgtgtagacaatcatcctaatatagtttgttaaacagaatgttctatatcttcaaaatgacaaacttgtaatatattaaatatcatatatgctcaaaaaaaaaaaaa

SEQ ID NO: 3856 - DNA, 781 bp, Homo sapiens
ctagacgtgaagagcctaatgatccctccacgccctatgtgattcctgctctccagcaaaaccaacctaagccttcaatcatcactgcataattctcccatttctgctaaagagataactctttcatgccagatgagccgcatttctaattagcagactcctcatggagcaccatcctacggtaaatcaaacagaatggacctggtgacaacagatgctgatctcaagcacaccgcttgtgaaatcatccattatgcggaggtggcctaggagggctggcacagagggccctgctcacaccaccacagcaccgccattccatagcgtctcggaaacacacccaccacataagcacctggtaaactttatgcatcttagttgggattatacaaactaccactctctgtaaacttgtctttgccttttcaagctcaaatactattactactcagggttacataatgctaaggcttacaactggatggttaacaaaaattaatgcttaccttcaattctctttaaagctgaaaggcacatatcctgacttggaaactcaaagggattgctgcaggttcgaatggtgttacattcacattccccattgattatattgcagccagcaataaggttttcattgcatggtttaaaaccaagcagttggtcatcagtccagttctcatctgtaaaacaattagcaaccagataatgtgtgtttgcagcttcattcaaaggcctgttcgcgggcaaaaacgcactgggatgtcaagattaacattcaatt

SEQ ID NO: 3857 - DNA, 260 bp, Homo sapiens
cctagagaaagcaagaaggaagaatgataaagaaagaaagaagaaaattttaagtttataccttttaaaaaaggaaacttaaaaatcagtggtgggtgacctctggaggcaactggaaaaaatatactgctgctttcaagagtgaagtggggaatgaagaatcagaaagtagatctttccatttagagaaggctttttcttttttttttttttacatttaatcagggtgaattaaaatatttaattcaaaaaaaaaaaaa

SEQ ID NO: 3858 - DNA, 406 bp, Homo sapiens
atcactccagcctgggcaacaagagcaaaactccataaataataataataataataataatcatcatcatcatcagagatagtgaaaaatatatatgtacaaaaatattctttacattttatggagggaatatctttgaggaatgtatcaatatgctttcctcctacatatttccttgcatgaatttccctagtgattagtagagtgcattttctaccagaaggcaaaaatggaaaatgaaagaacacatagcagctactcgggaggctgaggcaggagaatggcgtgaacccaggaggcagaggttgcagtgagccgagaccatgctactgcactccagcctgggcgacagagtgagactctgtgtataaataaataaataaataaataacgaaaaaaaaaaaaa

SEQ ID NO: 3859 - DNA, 793 bp, Homo sapiens
atgatgaaatgaccttcttgaattattgtggcatagaggaaagaggaagaaggaaaaagtcatctgaagaagtcttctttctaagcggttcttctattccacgtccttacaaataattcaactgtgtttattctcaaccaaaactctgctattattctaatgatggacagcctgttctttacagttctatcatatttcctgatccgtgccaattgcctagatggagctatgaatgtggtcacagtgataggtggctgtgagggtattgtgagaggcattttcttctgcagggcagatgaagtgcttggaatggaggattaaaaaaatagtaaagctcatttccattgcattatgtattttgatgtatttctaatgtattccttttcaaaacttatcttcactggagtagaggtaaagacagaatgagcaacagttgctgtttcatgcacatcgagtagccatttttaaaactcttaaaaatgcagcaaagcaatttaaaaaagagccagggggcatgggttgctttttttaaaaaaaggtgttgtctctgtagctacatttaccagactcaagattttgcaatgggacattatatgattttggtttacccattttctttcaaaccgtctaatacaaggatttaattccttcttttatgctttaaatccgatttcttaatcagaacccgtacttcttttaagtaattaaccggattgcttttggttaaaaaatatttcgaagtgaaagatccattttaacatactttggtcaacattgcttataatactagtca

SEQ ID NO: 3860 - DNA, 303 bp, Homo sapiens
tggtttccatcctgagtgaaacagagcagggcatgaagggcaagagtggaactgagagagaagaggaaaatgactggcaatataccccagccttgagtccccaccttatggcagaagaaccgaggggaagggggaaggatgagcatacagatgagaccccaggcctggctgacaccttgatagcagcctcatgaaggactgaagcaaaggatcgagctaagccacacccagattcctgcccccctacccctagacacggtgtgataataaatgtgtgttgcctgaaaaataaaaaaaaaaaaa

SEQ ID NO: 3861 - DNA, 345 bp, Homo sapiens
ctgagagacgggtctactatgttgcccaggatgcatatcaaactcttggactcaagcagtcctcctgcctcggcctcccaggtgttgggattacaggcatgtgagccacctcatccagctgctgcttttacttccaataatataaagctttttcctttttttagctattacaaacaaaaacagcagtgagcatttttataaacatttgtttatgttaactatttccttagaaattttagagagtagaattaccaaatcaagaagttagtgtacctttttttaaggatctcagtacattttgccatatgctgctattaaacttgcgtcaatttaaaaaaaaaaaaa

SEQ ID NO: 3862 - DNA, 576 bp, Homo sapiens
cctagaaactatacgtgaaattttggataccaacaaacaggatgctgtcaaagaattagtactcatggagcatgagggtcgtgatgttgtcattgctttgaagactaaacaggcaatccggaatgtgattgctaaagctctaaaaaatctcaccttcctttgttcaagaggcattattgataagcatgaagtcattgagatagataaggtacttcttaaaaaattaaaagcactaaataactttccaaaggcaatcccacccccaactcctgacatataccttcacaacatcatttggctggaaggtaaagatgttctcattgacttcttcaaggaaagagccaaacttgcctgttttgactctggagataccatttgtaaaggaggtgaaatgccacaaggaatctacttaattatttcaggaatggcaattgtaagggactattgatttttttttttttttttacttaaaatgtattttgaaacatgtaattgtagaataagaataaatttagatactgaaaaaaaagaaaaaaaatggcctcgttggcatcagcggtggagtgttgcgccaac

SEQ ID NO: 3863 - DNA, 415 bp, Homo sapiens
tctcggctcactcaagcgtctgcctcccagattggcgaccattctcctgcctcagcctccaggcacctcaggactacaggcacccgccaccacgcccgaccacttttatgtatttttagtagagaaggggttgcaccatgttagccaggatgatctcgatctcctgacctcctgatccacgtgcctcagccgggcagagtgctgggattacaagcgtgggctacaatgttggatttttatcaaaagtttcttcatgtatgttgagatgaccatataattttttgaaaactttctgtttatgtggtgaatcacatttattgatttgtgcatgttgaaacaaatttgcatcccaggaatgagtcctacttgatcatggtgaattaactttttgatgtgctgttgaaaaaaaaaaaaa

SEQ ID NO: 3864 - DNA, 314 bp, Homo sapiens
ctggtataaatgaccgagtctagagaaggtgaagcaaaatgactgaatagaactttccagcgattgttgcccctgcagaataccaaattgaataacatccacataagaaaacaccttcataagaaccaaaaaccagggatctttcgatggctggctcctttgtatcattcgtatttcagctcaaaagtaacatcctcagagatatctttccttgattacccaatttaaatttatatccctcatctctttatatcaaagcattgttttgttgacttaacagcattaattatcatcagaaattaaaaaaaaaaaaa

SEQ ID NO: 3865 - DNA, 294 bp, Homo sapiens
cctgacccaagataaggagcaagtagtgcttcattaaaagaggcagtgtcgacaccctagaaagttgtgcaagggcatcccaaggactgagaagagtgctagttgttcattatacactgaatccaggggaaatatgcttgccacagaagttctaaagagaacaaagcaatcaaacaaaatgagggctaaaaggagactgtgaacctggtggcttctgtaatttttgtgaagggatggaagttaaagccaggttgctatgagatgaggaacacagacgtggtaaaaaaaaaaaaa

SEQ ID NO: 3866 - DNA, 864 bp, Homo sapiens
gtagtatattcgcttaggaaacttggataactactgacaactaagaagaattatgaacattcatcatacaggaagtaaacattcatccaagaaaaacaagtgatagaaatgaaagatgagattctgtttctgagctgcccattggcttttcttatgaggactgaatctgtggactctgtgaaattttcatatgcattgttacactgtctcggaaaaggccatttaagtttacaacatgagagagctagcaggccctcatcaagttctgcaattctaactgtatgtctccattggtctcacatctatgcccttgagttggtttctactcatgccatttttccaaaacaactgtaattagtgtaaaagttgaacaagcaaatattaacttggctgggatatgattttcaaactacattacagtagagaacaaagtttgtaatgagattctgtgtactactattcaaagcaattaggagaaatgagtattgagctcttaacattctgacaagttatttcaatattgtgaccaaataaaggaactttttgtaatcaaaaaaactgattcgaattcttgatattttcttaacatgaaacaaaaaaaagaaacagtcatcacttgatcttccagcaagtcacaattgtaatgtattgaaaaatttaatggccttgactttagaagtgtaatgagttttgtaattgctcatgtgagaggtttttggttatgctgaatatacgggtgcaaataagcaaatataacaggtgacatttgttgttctaataaaataaatccagctttgaacaagtttagtgtaaaagttataaataataaagaaactttaagaaagagaaaaaaaaaaaaaaaaa

SEQ ID NO: 3867 - DNA, 844 bp, Homo sapiens
agatggagaaaatgagctcagtgtctctacttttcaaacgcacacctcccaaggcctttgaagtggaacaggatttcaagtttttcaagtctctttcttctcctaagattcgaagatatcccttggaaggtttcgtgactgaaaacagagaggcagggattgttttcggctctccgcctatatacagtatatcaagccccactagtctaagatttcttccactgattggcgtagaagcccaaaaggactcttcagatggcattacaggaaagaagaagggaggtcatgttcaacgtgaaaaagcaccacgaagaagaagtttgaaaaaaaatttagtcccacaaataaatctggcttcttccttcttcccagctatacccaagtaaggagaaaaaatcagaaatggctgctgcacataaaatggcaatgtttggatgatacctgctctttatttcaggatgagagggagaaaccaccagacactatcagtcatctctggtgtcaggccatcctattgatgggaaagattgcttagggagttctggtgaccttgactctgaataccaagcaagcagcaagcagccagaagtttaggcggtgtttcttatttactgtcagcaaactgacacataagagaacaaatgaaatcaacagcattagtaggtctaaaataatatgggtatcaatgtttagctttccacttcctcccatcggtcaccttactccacagcaagaatgactgccagaacatgtgcagtaaaaggcactttcaagtcatgctatgtgttgtacaaaaagaattattaaaaagaaaaatgtaccagtcaaaaaaaaaaaaaaaaaa

SEQ ID NO: 3868 - DNA, 399 bp, Homo sapiens
ctagggactgtatgtcagataacgttgcacattactgcagaaatcacatatacaggtccaaagggagacgaagaagaagaagaaagcaaggtttaaagtctatacattcctaacactgtatcagaaactcagtaatgacagtgaaatcaaagaatgatcacagtcaattccatgtcatacctagactgaaatatgaaacgtcaaaagaaaagaaagttaagaactttgggcttgtaaaaattttcccatacagatgaaattattggtaactttgtctcactagaaaacataaacaaaaatccactttttgcatatgtgtaaacagaaatatttttatttccatcagttatgacatgcaagcaagtaataaagtgaaagtacaatacaaaaaaaaaaaaa

SEQ ID NO: 3869 - DNA, 495 bp, Homo sapiens
agcgaggcacgttgaagtctgtctgcgaatgagggctctcagagaaatttggaggagaaacgaacgaaagaacagtgactttaagggaagaggaactcattggatacgctggggagaactcactagagtgataggagatatctctctaagatgctagaagcctgaagcgccgccactggcgaatctggctgtcaatgatcccccgcctctgctgggccctgcgaatcactccctgccattgattactgaggagtgtcaatttcaggttgaattcatccctagtgaagaaataattacatggtaaaaaagcactgttatcttggatgcagttacgcaatcagccaatgtatacactgtcaacaaccctaagccctgagaagtgatctagggcggtggtttttgaatatcatgccatgatctcttactgggttttgggtctattgcaattaatttttaaaattaaaccacccagtgtttgcaaaaaaaaaaaaaaaa

SEQ ID NO: 3870 - DNA, 264 bp, Homo sapiens
ccctagaaagaaaccatcacatcacaaaagcaaggacaagcttttatacaagcttgaggtctgactcagtagaatgctacacccagtaacaaaagaaaaaaaagctgccttcggctcttgggtgcagtgtgctagaagatatttctttgaaacccggggacaatgaatacagacattttgtatggtagaagaatcaaagcgtaaatgttccattaagaaacctacaataaacattctgattctacccttctaaaaaaaaaaaaa

SEQ ID NO: 3871 - DNA, 257 bp, Homo sapiens
ctagatggaaatatcccaggagaagagtggatcaaccaaaggagcaaaatgctttccaggcacggaagagtcatatctataaattattaggccgatagatttcaaacactccacagaggtttgggagaatcatccattatcataaattacatccattttatttaaagtcattacttcaaaaagatgttatgtacttttataagcttctttttttttctttttaattaaacacatttcccctaataaaaaaaaaaaaa

SEQ ID NO: 3872 - DNA, 797 bp, Homo sapiens
ccctagggagcaacgtttgtcatctttgtcactagatctttgatgatatcaataaggaaacatccacaccctttggttaaaagactctgagacttcaaggactgctggctgttcagaagaggctgtggtggttcaagtgaggctcaaggctgtagttatacctatctgttactccatgaagagtccaaggctgctgaacagagtgaacctcagaacaggtagcagtggctcctagaagatataatctcaacagcagatgagttattgagggatgattgctgattatggattcctcttcatctctcttaacttatattccaagctgttaacctagaataaatcttactatatctaattaatgcattaatcaaactttgttttgaatggaaggggggagaatatgttgattaccccggctagtgggatacaaaatatacctaaagcagaatatctttctccatcatgaataacattaatctctgcagttcttacaagtgaataattattatatagtttgtttcctatttgtctggcttggtatttatcctttatgagtttccaggtgacaatttgtttcaggaagaattctctccagaaacaattttttaagattatcgtcaaattccttaataaagagttgaaagccaaactcactaggtgaaatgcaacaacaaccaatgggcaacagactgatctccaacttcctgaattcttttttttttttttttttgagacagggtctctctctgtcgatcaggctggagtgcagtggctcaatcttggctcactgcagcctc

SEQ ID NO: 3873 - DNA, 243 bp, Homo sapiens
tcactcctgtctgagcgctatcactaactagtcactttatcatccaaatcttttggtagaacagtaatctgtcacaagcagaagaggaggaggcaatgtgaccatgagatcagagactggagtgatatacccatgggtgaaggactgccgcaagcaccagccctgtgcaactgatttcagccttttggcctccgggactgtgagataataaatttctgttgttttaagccaaaaaaaaaaaaa

SEQ ID NO: 3874 - DNA, 458 bp, Homo sapiens
cctggtccttccaggaagaaaaagttggatcaatttggacagagctgctaaactgaagggctgccagtttgatgtcatattccaaggagcgaccaggagtcaattggaaaatcttgtcactcaagctatccacaaaatctttctgtttatcaaagagggcaattttagaactttcagagctgtccacgatgaagacaatatctatgaaacaaatggagcctgaaacagaataaacaggttaggcaaaataattattcctatcatgaaacaaatttgcatacggaaacccctgaagtggtgtgttgtatactgtttggtgttgagagcagcgtgaggagagaaagagagacacgttggacagaaggcttcaattgtaaaaaactaaatgtctaagtttatgaattattttctccttgtaaaatcatgcaaattaaaaataaataagaaaaaaaaaaaaa

SEQ ID NO: 3875 - DNA, 522 bp, Homo sapiens
tgctcccgggaatgctgtctacttgttgcgattttactcccgtggcctgtgctagctgcctgcttggccgttgggactgaagggatgctcatccacttggcacactgactgcaagcctggcaccggccttgcctttgttctcccatgagtcctcttgaaggcaacccacttgtggtaggaggcgtagagtccagcagggctcttgccccttttgccctcctgaatcatggaggaagagctcggttcctcgtccatacagtgggaaaaacgaatgagcagttaccttgggcagagtccacagtccagcctgcttggctgcccggggggaggtgccgactgcagaaggcgtgggcccttccaggtgtggactcggcccctgggcagtgcgacctgtggcctccttaccaatgaagaggagtggaaaagatgctctctctgctgctcacggcagcctcagcccacacaggctgctggcatttctgtgctattaaataattaacttggtaaaaaaaaaaaaaaaaa

SEQ ID NO: 3876 - DNA, 426 bp, Homo sapiens
cctcacgtgggctcccatggagaaatataatgtattaatgcctatctttggactacaaatccagtggccatatctactgaaaaaggacaaatcagaatcggccaccagaagttcttcttcatagactatcacctgacctgtttcctcccctgtgcctcctttgcttaagctcccagtttgatttctgggttgcaacacaaacctgagaaggagggtattcctggacctgacttacttcaccagtgtatgaaattccatagaagtgtgacctgaaagaaaatccgaaggttatatgccagggaggatgattccaggaaaacacaatcagaagacataaagagcaaattccagaagaataaaatcaggaagccatgacgcataatatgtcaaggctttccacattacatacacggaaaaaaaaaaaaa

SEQ ID NO: 3877 - DNA, 604 bp, Homo sapiens
  misc_feature (1)...(604): n = A,T,C or G
tgcgtgtcaactttcaccttggcacttgcttctccgagggtctgtcatggggcttcgtttgagtctggaagcagtggagaggggccagaagctccaggccttggcttggagatctctacaggtgtgcatggagatgtttgaagtgctagtggctgagacagagcaagtggcagaggcctaggagacggaggctgaaagagnctgaggaggaaaggaggcactgagggactcacatgaagctactctgtcagcattctaaaacttctgacattcttttctatgaagataattgaatcaccaaatttgatgaaatgttccccaaatatcaggtaacagattttctgtgggggtctatggatacactttaaagtcaaggagaaaatttttggattgttttccagcgtggactatttcttcactgacaaggatttaaaaacaataaagcattgtacatcgacagaaaacatgacacatgtggacctttctgttgaagaacacattgcaatctgataatctagagaatataaacttgtcttgaacattgtccaagaaattttacttaacaaattactgaagagtctgagtcattccaaaaaaaaaaaaa

SEQ ID NO: 3878 - DNA, 630 bp, Homo sapiens
ctaggacccaccctccccatgtactgttacctactgcagagaattggggagttctcttctccagattcagaacatacttcacccttagtatcagaacgatggacttcaagactacattctgcgtcggcgtgcccctgagatatttttgcattgcataacttatttctttgaaagaaactattgtattttataaagctgggttgaatagcattttattgatgaaaagagttaaaaggctagaaaaaaatgcttaattcacacttatgaggcaacttgtattaactgaagaccaatatttttagatgtcatatatttaaaacatagtctctagtcttcatatttctacccagtattttactgcacacagtagattttttaagttcaaagaggctggagagtattaatatttctagttgttttgacttgtttacatttgttaagatctgaaattttctttgagcctatttcttgtaacataagcacagaggtttatataaaacagtgatttcaattttaggactatttggtcattgatatatatctcaaatttatatttctgtataattcctgaaaagaaaaagaaaaataaaacaaaacaaaacttattgacctgaaaaaaaaaaaaaaaaa

SEQ ID NO: 3879 - DNA, 433 bp, Homo sapiens
cctacattgtgagacacatggatgtcatagttgaaggaagacagatagtgtgcatgcaacagatgaatagataaagaaaatgtgagtggaatgaaatattattaagccatgcaagaacgatcgcttgcacatttgcaacaatatggataaacctggataacattatgctacatgaaacaaactatatccaaagagacaaataccgtataatgttacttgtatgtggaatctaaagaagacgaacacttaggaaaaaactgctgaatggagatttatgcgggctgaggtgactgatacacaacttggatccttaaatgagaaacaaatgcaacatttccaaaatggatatactacagaatgctctttcacagtatgttacttgatcaattctatacccaaaataaacgtgatcattggataaaaaaaaaaaaaa

SEQ ID NO: 3880 - DNA, 439 bp, Homo sapiens
actagcacccagtggctgagatgggacaccctgaaggcaaaagtatccttctaacctccttcagcctcatgattctgatgtggatctttgtttcgaagaagaaccgcattctctgaaccatcctcctcctccttcaggaatgttacagctgaccggattcctgcaaagtggcgtctacttcacaggcagtttatatgaagcctccaaatcagacatgcttttactgtcatgaagtagaaagaaaagacttttattccctaagactctcagaatatgaactccagataagaccaaagatagctcgttgggtgagaattggaaatacaagactggcatcttcagtattatgttgttaatactctaggagcaatgaaaacccacatgtaaaaacaaacactctcattaaataaaagaccctaaattgtgaaaaaaaaaaaaa

SEQ ID NO: 3881 - DNA, 938 bp, Homo sapiens
ctagagtctcattccatcacccaggtctggagtgcagcggcgtgatcttggcaacctccacctcccaggctcaagaaatcctcccacctcagcctcccaatagctggttctacaggcgtacaccaccacaatcagctgtattttttgtagagactgggtttcgccatgttgcccagggtggtcatgaacttgtgagctcaagtgatctgcccgcctcagcctcccaaagtgctgggattacaggcatgagccaccgcccctggcctaataaaatttatttttaaaaaaggacctatggcgaatcatttttacaaataaaatctatagtcaaggtgcagtatgggaacagcattttactgagtaatcttgcaaagaatatgtcattaaccactacactaatcttgttcttgatgtacaccagcaacaaatacaaagaaaaatttagtctcttactttaacaggttccaagtatgccacatcgtattttttgccaaataatttattagtaagaggagatgactctagtaagttatagaggttatattgaatttttaaaaaaaatttttcaaaactattctgtggggattgaggacagatgaactacaaaggaacatgatggaactttctggggtgagcataatgttctatatgatgataggggcttgggttacataagtgagcatttatgaaaactgtacactttttgtgcatttcattgtgtataaagtttacttcaaaaaaaacattgaactccaattaattacatgcatgctgaactatttagagtgaagtatactgatgcctgttgtttactttgaagtatttcaaaacagtaaaatggatagaggaatgtgtaataaattggtacacgataaggaaaatatagtcaattatgttaatagtaaaatctagatggtgagtaaaaaaaaaaaaaaaaa

SEQ ID NO: 3882 - DNA, 791 bp, Homo sapiens
actggttccgctgatcttcttctttgcgttccatgctcttcttgtcctacgctggtctactctggtttgtgaaacagagagaagaagttgcaagtggtccttaaagaaatgcagttattcaaatccttatgtatagttctaattttatttactatgtgtaatcatttagagaatggttatttttataatctcaataataaacaagtactatcgtagccagggggtgcccaagtatgtaatcagagaacactaatcctggcaaaggattgtggggtggtcaggaggccggctgccttttgacatggttagagtcctgggtttagattactttataaatagttattaagattaatatttgatatattaaatattgcctgattcaaataactttgcttaaaatttttctgtatcttaacttgcctagggttttctacttcttctatttttataatattttctcattttttagattactaaacattctacttatccgcgtgtgccaagatgtgccatttaggtctctgcagaaattagctgtttggtatcatcacctgccatacatgttgtgtgcagcagtgagaagtatattctctaccactgctctttctcatgattattttctctattcctattaaaatgaataattgatatgttaattaagtaaagcaaatcaataaggaatgaaatgcatggcccaaaacatagaaaatgaaaatcgtttgaccatttatccaattattgaacccaattaagatgatccattttaaatttaatatatgctcgcttttgga

SEQ ID NO: 3883 - DNA, 258 bp, Homo sapiens
atgatttctcagaagaatgacagaatgttgatcattgatgtcgactgaagggagaccatcacaaaggagatctgcctcgaggaaactatcagactggcccaggatggagaatgaagacagcaatttgctctgttctctaaagctctgattcaagttctctagtctgccgaaaataaataaataaataatttgacatgaaagaaatgaacaaataaataaaattaaaggagaggtagggaaatcagaaaaaaaaaaaaa

SEQ ID NO: 3884 - DNA, 487 bp, Homo sapiens
cagaaggtatttttacctggcattatggagaagatgatgacaataatgtagaacttgattagacatcaacagagactcaatgcctcctggaaaacacctgagaaatgattgaagctcgctctggtcttgcctggaatcatgcataacatttgttgctgcctgcatgtggattcattttagcagtttatcaatttggacagggaattttgaataaaaaattttggcagtcattatagtgactcttctgagactgaaaattcaggtaacaaggaaaatcagtgactctttctctctgctttcttcaaaacacaaataatccaatgatgtataggctgcattgccctttgatttgttaccttagagatcattacatgttagtacataaagaaacttcccaatcttcttttatagcatccaggtactccaatgtgtaattcagccataacttaataaaatggactctgtttgataaaaaaaaaaaaaaaaa

SEQ ID NO: 3885 - DNA, 794 bp, Homo sapiens
  misc_feature (1)...(794): n = A,T,C or G
tagaacaatcctcgactggctgttcgtggtggcttatgcctgtaatcccagtgctttggaaggccgaggtgggagagtcaactgagcccaggagttcgaggctgcagtgagctgtgatcacgccactgcactccagcctggagagcagaatgagaccctgtctctagaaaaacaaaaaaggaaggaaagaaagaaaaattctctacccaaatattttttcatgacgttgactatttgaagaggctgagccagttttcctatataatatgtcccatatcctgactgtttcccatggtgttgttcaacctgtttgtctatcccctttattttgtgtatttaggtctagacttgattaaattcaggtttaacctanaaaataaaaaaaaaaaagaaaaaaaaaaatcatggaaataaaaaaagttgaagaagagtgacaggaggaaaaagagataggtcttggccctttgtggccccgaggagggggagttttcgggggggtttctcttttgggaggggttatctaagaccccccctaaaatgaatgtgtgccttcggagttagggtgggggggggcgggttcacttacttaaggggggttatacgggtttacccacacagcggggttaaaccgggaagaaaatcgtgcagacacgggcgcttaagggccacaaaccgaaagggggcgctggggtgtggttttttcaagagtccgccccgtcagcaaggtttgtaaaaaagtggatttcatgtaagtggcgggtatacgccccgagcacttaaatgtaacgggcttt

SEQ ID NO: 3886 - DNA, 298 bp, Homo sapiens
ctagatgtggaaactgagattattacccaattttatgcagcaagtcactggcagagctgagaggaaaatcatgatctggctctagactctgaagttgtaattatcatattatctctctaaattgagtcagcataaatgtttaagaattaaatacagaaaagcataattaagaaagatcaacagtagtcttagaaaacttcaatggattggtgccatacagaccacattctctaagaacagtacaattaagttagaaatcaacaataaaaagggaactggaaaaaaaaaaaaaaaaaaa

SEQ ID NO: 3887 - DNA, 620 bp, Homo sapiens
ctagactccgagttctcaagaattcaaggcatatggctgggcatctcttttagcatccttgaacagtctgtaatggcccaaatgtacttcaagaatgcagcaattgaaaacaagtcacccggagcacacagactagaggctgaaattggttgtcagaatacagcatcactgaaatattatgtgcattgaacaaatggagctgggttgcattccacagtatgccaccaaagtgaaaagaaacaaagtttttgtacagaaaactggcatgttaataacgtcacactcagtggcacatgcctgtagtccaatctactcaggaggctgaggcttggaaatcacttgagcccagaagtttaaaactagtctgggtaacatggcaagaatccatctcaaaagaaattgcactgactggggctgaaccctcaagtcattgaatcatggaattttaaaggagaagtctggctttttcagttgtctggagtggatacttaatttaattaaagagacggaatgcatttgatgaaaacaattaagccacattggcatactctacattggcatctaatatgatacggctatttaataaaaagctagtattctgttaaataaaaaaaaaaaaa

SEQ ID NO: 3888 - DNA, 668 bp, Homo sapiens
accttggagttgacagctatgtgctcagaggagaatgaagcaaaccaaccaaaagccaaccccaatcacccaatggcctgagctcctcagagcaagaaaagtcaagttgaatatctcagatggggccgtcagagaatggagatgacctcatccacagtgggacaagttggagcaaatcacttggatggaaagcaaggaaatagaggggcaatttcagcatgtccctcaggcttccacagaggaaggtttggccttccaaattcccaaagggcttctctcctgggacgcactgtctctgcagaggtgaaaacactctttcttgtctctctctgcctgggatcttaattgtttccagtgtcaaatgaaggactgaggaaagaaccaaagcttccccagttcactaactgctctgggatttacccagaattttgacagcattgagatttggagttggcttagaagaagagaagaagggaagtggaggtgctgagagctggtctggagttagccctgcttcagccacattcacttccctttgtctctcatgaccgggcaatgcagtaggcttcccatgttgtgtatcttcttgtctattaaacagggttatccagctaaaaaaaagaaaaaaaatggcctcgttggctacagcggtggagctctcggccagg

SEQ ID NO: 3889 - DNA, 801 bp, Homo sapiens
ctagaagcaactcactagctccagttcctcactggtgggaagaggattatgtaagaccatgaaagccagagatgggaatccctgggactcactgtggaatgccacccaccacaaacattggcccctcctggcctggggatgagactacacacaaaacaaggaggccctgcttgcagtgttgaaacaggcttctgctccagagcagctgccctgggacaccaagaagacgctgggtctccttcagggatccagggttgcttggatgctgggagccgacctgcattcgctgaaggaagtggagcccagacctcatgacagataattccagcaaaaccagtacctcgcctactgaaaaattaccttcactcatcatctaccttgcttaaactcatcagacatttctcagttttctactccccggtgtgctttaagctttgctataaagcatcaacatctatcatcaccctaacttcttaaatcaattttagtgcctattaaaagttgccatcaaaaaagactatagttaataacaatgtgttgcatatttgaaaattgctaccaaggcagattttgagtgttttcaccacaaaacctatgtgagatgatacatatgttaattagcttgatttagccatttcctcatgggcacatatttccagacatcatgttgtataccataaatacaggatatacaatttgatttgtcaattaaaacaaataaataaaaaggcctctgtgtgtgtttgcaaaaaaaaaaaaaaaatggcctcgttggcaacagcggtggagctctcgtccagg

SEQ ID NO: 3890 - DNA, 1181 bp, Homo sapiens
cctagacgttattcacagtaatcaagtatgtggcaacaataagtgtccatcaacagatgaatagataaagaaaatttgaatggaatgaaatattattaagccaagcaagaaggaacgtttgccatttgcaacaatatggataaacctggataacattatgctacatgaaacaaactaaatccaaagagacaaataccgtataatgttacttgtatgtggaatctaaagaagttgaagtcatagcagtagaaaatagaatggtgatttctgggggctggtggtttgaagagatgaggagatgctgataaaaggttacaaatttaattataagatgaacaagttctggagatctaatgtatagcacgggtagtgataaatgtgttaattaaattgattgtgataatcattatacaatgtatacacatataaaattgtcgcattgtacaccttgaatatgcacaatctttacttgtcaattaagtattttaaagtataaaaagaaaactgtgaaacattcatagagattataacacagaagtctcatgtgtacaaataactaatacccattgtaagcacctggctgcaggaagggagataaataatataaaatactattcattagccaaagccttttttaaatcttttcttctacctccttctcctccttcttcttttctcatctatcccacctctctcccacccttacttctcctcctcctcctccttgttctttctatttaaatattactgttagaaagatcctagtaggaatcagctgatagcaattgctcccttgaaaattctaagttgtttctagacctgtagtcttacccaggttattgttagttcttaaaaatcttttatgaattttaactcttttttaacttaaattaaaataaaccatctgaaattcttggatttgttggcaaaggcattattggcttatttgttaaaattaaataataactgaagcattcaggttttatttttctttgtaaaatgtattccctgtgagcatttcttaaaattgatatatgtattttctttagaattacagattctattttcctcccaaaattaattagatgttgtgaaatactcctagatggacattctctgtcataaatgaaagtaaagtattaaattgtatctaatttttaagagtaaaaaaaaaaaaaaaa

SEQ ID NO: 3891 - DNA, 643 bp, Homo sapiens
ctagtttccttgattcagagaaagtagaaaaaacacatacaaagagacggcaccagctcctttcccagttgtgaccagattgcatgatacccaagccatggctccaaagagtgcgtgtactgaagcctggccattcatgacagactcatttccacacctgagtccggttttgctctgtgagtgttgggctttctccaagggaatggttggagctgttgcgagcgaacttcctggctgccacagagttgattggattccttggaaatgcacactcacaggctgctgctctttgaagctgtctccttcactggccatgattctcctgtctcattagctgttgcctatgaccctgatgtcgttttctccttttactcatcaacacccaaatccacagggttgtgatggattagtagcctttcttattagcaagaagccctgtggcctcaagaggcaaaatgaatcgtggttagaaatctccatctcctccctcccttggtataatgccatcatttaactatctgaaaatagagaagactccgttccaattgtaaagccctaaggagaaaaactgagtttgaaactttccttaattatgctgatatttaacaataaactttgtagtatgaaaaaaaaaaaaaaaaaa

SEQ ID NO: 3892 - DNA, 251 bp, Homo sapiens
ctgatggctcgcagagattgaggtaacttgcccaaggctacgcagcttgtgagtgacagagccagggtgggaaccacgtctgtctgagcattatgatctgagcgtcatgcctgcctactcctagctccaatctcacacttctattatctgctttgcatcgtagatgctaaatctatgctggccagtatggaaactactagccacatgtggctttttaaattaaactaatttaaaatttaaaaaaaaaaaaa

SEQ ID NO: 3893 - DNA, 291 bp, Homo sapiens
ctagttttggatgtcctctgagttgaaggcctgacagcccaattcttttgcaccaccagaagttcagaattggatcttcaatacagatgatctcatctaatttgtacatttagcatcggctcagagtctctgagaaaatgtcttcattcatgaaacaaggggtgtccaatcttttggcttccctgagccacattggaaggagaagaactgtctcgggccgcatgtgaagtacactaacgatagctgatgagctaaaaataaaaaataaaaaataaatcaaaaaaaaaaaaa

SEQ ID NO: 3894 - DNA, 418 bp, Homo sapiens
catgctctgccactgggccagaagaaagatgactccctgacctttccactcctggagcatgccttaatatgcagaccaacgaatccaaggccatatcttctctatctggccaatacacctcaggaggcaatatttctctgccttaatcctgccaggccaggtaccaggcaactagggatcctcccaatagcttagagtcagttgaaattcaaactagcccatcctaaactatcctgttgtgacacctttccctgagaaagcccaataaatgttcggcctaggctttctcctagctcctattttctgcctcttaactacactgaggcctccccatgtggccttgcatagtgtgctgtgcctcctgtttctagaatctgtaagtataataaacttttgtttacctgcaaaaaaaaaaaaa

SEQ ID NO: 3895 - DNA, 1152 bp, Homo sapiens
tgtggaacaataagtgtccatcaacagatgaatagataaagaaaatttgaatggaatgaaatattattaagccaagcaagaaggaacgtttgccatttgcaacaatatggataaacctggataacattatgctacatgaaacaaactaaatccaaagagacaaataccgtataatgttacttgtatgtggaatctaaagaagttgaagtcatagcagtagaaaatagaatggtgatttctgggggctggtggtttgaagagatgaggagatgctgataaaaggttacaaatttaattataagatgaacaagttctggagatctaatgtatagcacgggtagtgataaatgtgttaattaaattgattgtgataatcattatacaatgtatacacatataaaattgtcgcattgtacaccttgaatatgcacaatctttacttgtcaattaagtattttaaagtataaaaagaaaactgtgaaacattcatagagattataacacagaagtctcatgtgtacaaataactaatacccattgtaagcacctggctgcaggaagggagataaataatataaaatactattcattagccgaagcctttttaaaatcttttattgtacctccttttcctccttcttcttttgtcatctctcccacctctctcccacccttacttctcctcctcctcctccttgttctttctatttaaatattactgttagaaagatcctagtaggaatcagctgatagcaattgctcccttgaaaattctaagttgtttctagacctgtagtcttacccaggttattgttagttcttaaaaatcttttatgaattttaactcttttttaacttaaattaaaataaaccatctgaaattcttggatttgttggcaaaggcattattggcttatttgttaaaattaaataataactgaagcattcaggttttatttttctttgtaaaatgtattccctgtgagcatttcttaaaattgatatatgtattttctttagaattacagattctattttcctcccaaaattaattagatgttgtgaaatactcctagatggacattctctgtcataaatgaaagtaaagtattaaattgtatctaatttttaagagtaaaaaaaaaaaaaaaa

SEQ ID NO: 3896 - DNA, 328 bp, Homo sapiens
taaaccattctcattaattttaatgagtgtttaatatagaatttttttaacaaagactcttaataattgctaactgtcagcattagtattttctctgtttcacccagtttctcagagctgcttcagaaactgagagaagtgaaatatgttcttttttataccttcattttctaaaaataaaatgaccaactgattaaaaaaaaaaccaaaagaaaaaaaaacttgtgggtagtcaagctgaaaagaaagtcatcaaaaataaataacagaaaacctgaaaaaatcttttaaccaaactttgcattaaaaaagaagaaaaaaaaaaaaa

SEQ ID NO: 3897 - DNA, 345 bp, Homo sapiens
gtgagtcggtgaacggaacccacgatgcgtcagaggagtgttccagttgcacacactctccccagccacctggcagctcagtctataatctggaggcttccacatctacagctccatacaaatgaacctctggttctaaagaagtttcttccttgtctggttctcactttctaaacctcagtctctggagagaaaaggagtcctggaggatgaacaaggcgagcttggagtaatttggaaaagctaatgttgtaggacagaagcaaagcctgcaagtcacagcctaggttccctgagtgatgttttcagcagtaaactgcaacttcaaagctaaaaaaaaaaaaa

SEQ ID NO: 3898 - DNA, 344 bp, Homo sapiens
gctagaaggatttcacctaaatgagtcatagtctacaggtcaagcagagcagaagtaatatttaatacagtattaggatgtttactgttgagatgaaaacaactgggaacaagatgaaaactatgtttctgttgagatgaaaacaactgggaacaagatgaaaactggggactgagtcatcagatacctctggcatgaagtgtttctccccaaactttcctaacttttcatttatttcattttttaaaaaaaggaaattatacattatttaaaattttaaattatctttgtaaaatatcagtattcaattaaaacactattgtgaactattaaaaaaaaaaaaa

SEQ ID NO: 3899 - DNA, 356 bp, Homo sapiens
ccctaggtggtgagactagagatcataccatttaagtggcatgggagaaagtgacaaaactagaagtggtggagctaagattcagacttgagagctcccgagcccaagtcctgaactgctacacagattgcctctactaaaaaaagacaagtctctattatgaactacccctgggcaacatagatggcctccacctatatataattgaaacattttttaaaactgaaaataaaactctctctgctcttatggaaagtaccacatgctgttcacaaccagtatatttactttgttggctaaattcaggacttggagatatacaaatgaaggatgctgactgactaaaaaaaaaaaaa

SEQ ID NO: 3900 - DNA, 609 bp, Homo sapiens
gcctagaggaagcgaaatttgagactacaccctgaccctgttgctggagagtagtatcaagccacagcgttgaccccggaagatctccaagttcacagcaggacctgcatcatgggcatgtgacctgtgcaataacacagagccccactcttggataggccccatgcttggtgtaatgctctgccactgccatcttgaaatacctaatatgttttgaacaagaggtcccatatttacatttttcactggtgctgcaaattatgtagctggtccttgttcacagagttggcaacctttactcttcagacccagagaaatgactaaaattacaaggggccatgaaaaaaggagaaaagcattattttggatgaagaatgctcatcttacagatgatgaaccaaactgcagagaggttgatagttatttgtcttttttatttgaattccctacagtatgttcattttacacgtgtgtgtgcatgaacatacccacaacacacatgcacttccttggcttaaaaatatgttgagaaatttacaaatagtcaaataacacaatgagtttaaacaacaagtaagtgtatattattcttcagcaaaaaaaaaaaaa

SEQ ID NO: 3901 - DNA, 304 bp, Homo sapiens
ctcaggcttactggaatctaccatgtttggggcaagagaaatggatatggcaacttacaaagatgatcaaagccctgctacacagtttactgtccagcaaaggaggtacatattgtaccagtaactataacaaaatgtgagctttacaatgaaggacattcatgctattaggaaaatatgaagcacaggtgctgaacctaatataggaatctggggaagatttcttcaacaaattattttgcaatgaattaattaattaatgtaaattgacaaataaaaattgtatatgttaaaaaaaaaaaaa

SEQ ID NO: 3902 - DNA, 367 bp, Homo sapiens
gagggaaaagagggaggaagaaataagcgagaggaaaaagtgagatgataataatgttagaagaaactaatttcctgggttcatggagagtactggttacaaacatgttcctcacacacagcatgaggttactcttcatggaaaatgggtttcaatggactgtaataaatgaagtgtgtcccttaggaagaagataagatattgagaagaaggtgataccataggcaaaactttccaggttcactgaaaattgtgctcatttaattttacaaccattcacgcaacaattattttttgactaccaacctcatgtccgatgtgctttgtactgggaataaaatattcagcgaaaagaaaaaaaaaaaaa

SEQ ID NO: 3903 - DNA, 190 bp, Homo sapiens
ctagtaatttgatacagaagatggtaaactgctcaccaaaaaagacagagaagttgatgatggtggtgaggaaacaagaagatcctggatctctgacgtccatggaactttcataacatcgttgccacttctacttcaatggtccctttatgtgaaataaagtaaatcactatcttgaaaaaaaaaaaaa

SEQ ID NO: 3904 - DNA, 781 bp, Homo sapiens
cctaggtcaaacatgacattttgaatattagtcttgcatcaataaccaggatgttttgaaatggaagaaattggacacagggagaccaaagaagctactgttacggtaatgcacgtgagaaatgaattaggtgaaaacattgtatacgaagagaaaaagatgagctctcataatttggagaagaaaaaaccccataaacttacagtgacagaagagacatccataacaaaggattgggaatagataacatttatttaaccctagggactgaaggattcataatgctatctgcggcatgctgaaaactgtattgattcttctgaatgtgcagagaaagatgacctcagtttgggcatcacataacttttttaaaagtgaaaaaggaagcaaataatactgtatatttcatacactatatcttaatttgagatatatatgtatgtatatttaaatttagaaccatatattaaaatttttgcagtggttatttctgaaaggtggtttatggatggattaaatttctttctttgtacttttctgtatttttcaaattttctacaaacgaccatagtagaaaataatagagaagctgcaaaaaagggagaaaatttttataatagagaaaaagttgcaaaaaaggggagacacccaagtttatagtactatattttggggcaattgccatgaaaaattggtaaacttaaaaaaaaacttaaagaggtaagggttgggtgtattgagcactttcaatgtggctagctcaaactgagaatagctgtag

SEQ ID NO: 3905 - DNA, 469 bp, Homo sapiens
taggcttgactgctgctctgtacaaatggatggcaaagtctgcaagagaatgcattgcgttttgcactctccatcatcagagcacagtaccttacatatggtgatggctcaattgatatctgctgagaaggcaagagaattggataaaaaacattataatactgttacaagaaatatttttctgcttgctttgttttataaattataaatcttcagcatgacaagctttgaaatgtaggcttccaccttataaagaacaggaaaatgaatttaatatctgtttccttttcatctttactgttagataataatttatgtggtttagtgcttagaacttgaaactgagttctatcttttatgcattctgtcgacctgactaatttgtggctctctcccgatttatgtctcaatttcccactctgttttcataaacgacaataaatgtgtccttagaggaaaaaaaaaaaaa

SEQ ID NO: 3906 - DNA, 197 bp, Homo sapiens
ctaggttggcagattacatgtctatatcttgttcacacctatgggattggacaaaattttctcgtgaaactaagagaacaggccacagagtgtcttgcaatctatgctgtcagcaagtgtctttctcatgcctgatgttatacaaaaactagcaataaaggcttattctttcctagccaccccgaaaaaaaaaaaaa

SEQ ID NO: 3907 - DNA, 420 bp, Homo sapiens
ccattaattgagtgcctaccatatagacactgggaccacaatgaagaagataaccactgatcctgtggaacttttagctaatggaaatcaattcctgagtatccatgtaatattggatgctcagcattatttatcgggactcattaattgatatttcataggaatttaagaatgttttctcaaggaaaagctcattattctgattgaattcaagaaaatatttcttactgagtttagtgatataaaaccacatgaaactaacagtatctgattaagaccaatagccaagttcatttttaatgtctttatcctacaaatcaacaaaacttgtcagtgaaaagaggaatattgatcaatcacttgaatgtttcattaaatccaaatcttttgtataacagtgaaaaagcaaaaaaaaaaaaa

SEQ ID NO: 3908 - DNA, 667 bp, Homo sapiens
acgcacgaataaagaatgcgtaaggaaattacaaacctgacagatccaccaaaaacatacctttgtcgtcaactatcttcaggaaatgaccatctcttctttctcctttggtactatcaagcaacatcttcgacatctacttcatctactggaagaaacctcccacgttctccagagttgtcaaccatgtaccaggatatgatgcaaatataaagggatcattgcttttatcttgtcctcttacagtcaaatgtccagaattaacatctacgtttgtggctcctcaaaacaacttagattcacaattcatggattgctttatgaatttattcacaaaattgagactgaaaggaaagtaaaaattcaccatgcaaggccaggcgtggtggctcacacctgtaatcccagcacatcgggaggctgaggcgggcagatcacgaggtcaggagtttgagaccagcctggctaacatggcaaaactctgtctctactaaaaatacaaaaactagccaggcgtggtagcacatgcctgcaatcccagctattagggaagctgaggcaggagaattgcttgaactcagagggcagaggttgcagtgagccgagatcaagtcactggattccagcctaggcaacagagcgaggctccatctcaaaaaaaaaaaaa

SEQ ID NO: 3909 - DNA, 738 bp, Homo sapiens
cctagttttaaaatgcttatttacagtacaagacttagaatgacagcatgaggaactgcatgaacgctcttccaatcaaatcaactatcaccaatgaaaacatgttttttaactatttcgaatctctggaaattgttctcagatcaacaccaagtgaaaatacacatttattcaataaaatctaccaaatcttaagtagaaacagcagattcctgtggttcctgagacttgcccacctcttgcctcatttcaggaagaagaagcaggaaacagaaacttcccatgagagggccaaatgacagacttactataagatttcaagcagtcattataaatataatttaaaaattaaaggaaattattctcaaaggagtaaacaaaagtataatgataatgtctcatcaaatagaagataatacaatgatagaaaatataaaaaataacaaaattatctgaaaatgattttaaagccaccattataaaaatgatttcataagcaattatgacttctgaaacaatttgaaaagtaggaaattacagcaaagaaataaaaactaaagagaagatccagttggaaagtatagaactgaaaaattcaatcaccaaaacaaaataaccaaacaaaagctcactgaataattttaatataaggtggagagatgacagaagatagaatcagtgaacatgagaacagatgaatagaatttgcccaatttaaacaatagaaaaaaaaaaaaa

SEQ ID NO: 3910 - DNA, 483 bp, Homo sapiens
ccctaggggggatgtccacaacatcaagacttttggtttctcttggaaaaatctgaagaccaggcaacttgtgtcactgtggagccgctcagcggtgccctgtatagatgggatgtgcattcatctgcttgcatggatcgcccacctcttcattgcccccaactcctaaggccaagagtcagatgccatatactactctctttctgctaggattgtccttagacccaaccactccacttatttattctatatagctgagccttgcaggaatatgcatctgtgatccctgatctaaaataattatattaattagcatcaacaatgctgaacacaatcagttgccatctcttcaacatttgacatgatgctctggggttcttaaacattttctgtgctatgcgcccctgacactctgtggatccctttgcagaatagtgtgttaaaaggcatacaataaataatagaatcacaaaaaaaaaaaaa

SEQ ID NO: 3911 - DNA, 326 bp, Homo sapiens
ctaccaggattgctggtactgctaattaaaaaaaaagaagaagaagaaggaagaaaggatccacagcagtagaaacaaaatgttgcattgacaaaaatcagtcttctaaagaaggataaggtaactccaagtctcgatcctcttcggttctttgtggcaaggcatcttgctcctctttggcaacctgctctgtaggaacacaacattgcagcctcttctgctcagttcattcagttaccatccacctgtttcttagcctgtaaacttttcttgaaatcagtcatccattaaagcatcctttcttattccttgtaaaaaaaaaaaaa

SEQ ID NO: 3912 - DNA, 222 bp, Homo sapiens
taggggtctaaacatttggaaggtgggttcctgatcccattcctcctccaggacggactaccgtgcatcagatataggaagcattggacataacagttgaaagaaagaaagaaaggaatctctccatgtcaataaccaacctaactgatgaactttaggagtctgttttttccaccaaaacagaataaaacttctaagtaaggggtcaaaaaaaaaagaaaa

SEQ ID NO: 3913 - DNA, 227 bp, Homo sapiens
ctaggtgttcagctattaccaagactgctgtaagactgctacatacgatataagaggatgaaggaaataagcaaacaaggaataaggaaataaggaagctaagtttcacactgttaaaaaatggagttacagacatggaaatggaatggctagaatttgaagtagcagtgtgaaatcatgattttcaagaataaattatatataagttgatattaaaaaaaaaaaaa

SEQ ID NO: 3914 - DNA, 748 bp, Homo sapiens
ctaagcacaagggacagaaaagcaatacatactcccaccgaggaccgttttaggtattcggcagcggaccagacaagcccctacaaaaacaagacctgtcaactcccaagtctctgtttaagtaatttcctgaaggacaaggaactagcagaagttatcaaacattcaagaggaacttatgaaaccctcacttcagacgttacacagaacttacgggccaccgttgggcagagctctctgaagccaacagctaagacagaagggctctccacgttcttagagaaaccaaaggaccaagttgctacggcccgacagcactcgacctttacaggcaggtttggacagccacccagagggccaatctctttacacatgtacagcaggaagaatgtgtttctccaccacaatttacacagcactgagctgcaaactctaggccagcaggatgggtaattaaatcaccgtattcctgtctttgggtaggataaagatggttagtgtttctcgtgcatagttcatattaaaattgtcatgtactttttcctacattttagttataaacagagttgtgttgttgggttttttttcttagtcataaacaaagaatttgtgggtttttttttctccaagagtgaaagcttcgaacatgtaaattgacctaggtctgattgccttgaaaactttctatttgggggtttaataacggcgcccatcctgttcggctaaaaacaaaaaaaaaatcgccctc

SEQ ID NO: 3915 - DNA, 767 bp, Homo sapiens
aagatgtcggtgataatgtggaaaaattgaaacttccacacacttactgctgttggtgaggactcttattttgatactctcatattggagatttggaaatctttaataatttctagcaacccaacacgtaatcatatacaagtacaagtaggttcactataacattatttatcttagtgaaataaactgaccatctagggaagaatcaataaattttctaatgtgttgcatcaagttaaacatatccacatggataaatctcaaaaatatattaatcagtagaaaattcattcgtaaataaatatagccaatgaaatataatttatgtatatttttagtacataccaaacaatattatgcattgttttaatgatattccccataacgatattatgcaaagtttaaaaatgtagatgtaaagggcacatacaatagtggttagaatagtggttacctgtgaaaaaggagaaaagcaaataaggcaaaagagagatttgaagcaggactgaactataacattttatttctaaattgtacatatagtcttgaaacacatatggcataaagttaacaacagttaagtttgagggggaggaataattaggggttctatattatttttggagcattcagcaactttcaaactttataatttcattaaaaggattgctccttgtggccgttttcttgaacctatacttgtcccttactaaatctaccaaggaacctttttgcaatcttagataatggatcccaataaacacaga

SEQ ID NO: 3916 - DNA, 650 bp, Homo sapiens
cctgagtttactctcagaggaggtatttgttcttcattgtggagtgatctctatcaccagtgactaaagatgttggagcacagagagccatacctcaaaatatgatgcttcggcatgctgactgctttgaaaattgaaaggcctcagaaataatcctcagtgccagggtctccctctgacctccccctacctccctttctctctgatcctgtctctcccaaagcacagaatgaagctgttctctgaattcccttatctacctagaaactggaccccccaaagaggaacacaatttgcctttgatcccttccctgaaatttcattaaccagagaaaattaaaacttctatcacaaaggaagagactgaacattaaacaccatagctacagcccagacaaacttcttcccaaaccattgtttgttctcctgcctgttaaattgccagagaatcattcacaagataaagtctgccttctgggtccattcattccccactaaaaatcttttactcctacaccctcatgtctccttcctccatgaagaagggtctataaacctctaggcctcattgggttattgggtaatcattctcatgcagttcccctgtgctctgcatgttaaataaatttgtatgcctttttctcctaaaa

SEQ ID NO: 3917 - DNA, 399 bp, Homo sapiens
ctaggactaggaggtgaggcatttgggaagtgatgaggtcatgagcatggagcctcacgaatgggatcagtgccctcataaaatgcaccccagagagctccctcgccccttccaccatttgaagacacagtgagaaggtgccgtctgtgaaccaggaagccctcaccagacactgaaactgccacaccttggtcttggacctccagcctccagaactgtgagcaataaacgcctgttgtttataagccctgactgtggtattctgttacagcagcctgaaatgaactaagacagcttccctctgtgcttgagaagaggaaaaacttaagtctaattattgtaaagattaatatttcagatgcagtataaactgaataaagcttgtatttatttttaaaa

SEQ ID NO: 3918 - DNA, 811 bp, Homo sapiens
ccctaggaagccatggaaatatataatgagctgttgaagttgccagctccctggagtaactgtgtaaacctccggtcttctattctcatggccaatagtgcttccactggtcaaaactcaagcctcaagataaagcatgtaaatagcttaagaagagcagtgctggtgcctgggggagaggagccagtcaggaccttcagcttcccagggaaacttggattgagtagaatgtagcaatctcactttgcagcgtgtccttcagcaagtcacttactctctctgtactccaacttcgtcctctgaaaaattaaagaatccaactggatcatctccaagatcctttccaattgagaaattccatcacctgtgatgatttttctgtacaatgcaatttgggaaggacactagcatttatggaaccactgatatgtgccagatctttcacatgtgttgttatttccactttaagtgtaaaaacaatatcaagttcagagatgtgaaagaagtggtccaaggtcaatcatccagtacctggaggactctagattcaaacccacatttatgagactgtaaaaccattgctctttttcatgacacccatgtttttagggactgcccatctaatggttccttacaagacagagctgtatatagagggggaaatgttacctactctatatgcagctataaaaaccaagattctgggattctaaccacttagaatctccaaagtcataatgtcgttagaatgaatgtatgagaaattatttttgttgcccctttggtcctccatggtgactgagattgcccg

SEQ ID NO: 3919 - DNA, 784 bp, Homo sapiens
cgcggagctcgaacctaggagcatgagcccagcataaagatctctgaaagcctggatgcgtggattcctctcttacttcccaaaacggtggggtggaaatgtgaatatcagcatgatgcacagatctctgcagatgtccagcggactgaatttctagacgctataatctatgttctttcccaacccccacttcagtttacatatcgcaggccatagatcctgtttgttgaaaagcgatcagctagaaaacaagagtggttataacctgtgctgcccagtgatcaggaaaagagagcggatgaaacttccatgactttctgttagtctgattaatatccatgccaaatgtaagactagttaaaaggccttattgcttcccacccaaatgttccttcactaactatatactacactgaaatgtaaagttatgggtatgattaacagtttaatttgtcagtgggcatccaactcttctatttgtgtttttactttgagcttaattggagcagacaaatagaggtgaccactaactgttttcttcctgaagccattttcagggcagaagtgctttacccacttcattgagaaaccacctttgcatgcagtaccctgagctgtcttcagcacaccaagcatccacaacatgggaaataccgtgcttttaatgttgccttaatcacagtgctcatgagtaagggcatgtcctgtctcttatccatgaaaacactcccacaaaatgaagtcacacccagtatctgttaactgagatactgagtgggtgaag

SEQ ID NO: 3920 - DNA, 731 bp, Homo sapiens
ctagaagaagccatgtgaagatagagacacacagagagaacgtcatgtcataatgaagatgaagcttgtagttatgcagctgaaagctaagcaatgccaaggaagctaggaaggagcaagaaaggatttctctacagatttcagaggacgcaggaccctgccaacaccttgatcacagacttctagcttccagagctgtggaacaatatatttctgttgttttaagccacccaatttgcgatactttattatggcagctccagtaactaacatacataccatatttcgatctcatcttaattttgtaaatatgagcacttgacttttccaacaattattataatagcaataacaatcaacaacgagcagaataatagttgatttgttcctagtttttccaaggttgtcagttttcttcaccccaaaagtggaatcttcatttcagttttagatactctagagatgcactattcaacttgatagccacttgtcacatatggctatggagcactagaaatgtggctagttcaaagtgagatgtggtttcaatataaaatacatactacattgtgaagacttaggaagaaaaaaagaatgtaacattatctcattaatttttttatgggtgcctatattttaaaataacatgggtgaaggcattgggattgaatataaatttgtatgattcaaaaaataaaaatcgcccttcctaggctcaagggtggagctct

SEQ ID NO: 3921 - DNA, 788 bp, Homo sapiens
  misc_feature (1)...(788): n = A,T,C or G
cctagggcgtacagctgttacctcttctgtttctgctgctgtagctgctgtccctgcaaaggccatgctcttggggtctgcagagttccagactgcccatgtatgcctgtgtgtatctgatggccaggccaactgcttagcactcaagctaccactgtctgctgtacctgcagacctgagaccacatgtttactatcatctggttatgtcctctgctcaatgcatgctctattgccccattaaactttacttataaggcctaggtacaaaattataaaatgattaaggatttcaagacagcattgaattccacagagcattgaaccaagcccgaggccctttctgagagtggggtcctgtgttatcgcactggagtgcccatgagcctggccctgttggctgaacttgatggaagggtgagcatcactggacattccacatgctgctggctgccatgatgtgataggagcaagtagggaagagcataccagaaccaggaagagaagcccttctctttcagcatccctccagtgtccttctagtactctctactgaaaaagcttaatatcatgtcagctgaaaaaaaaaaggtatagggtccaactctactatcacaaacaggataaagaagaatggaatctaagtcactttggaaatgagtggtatctataagactagaggcanaatgtactatccataggaattttactgtagntggtggtataataaactttggatactcagaaagggggaggatgggagcaagctaagtgataaaaaaattacaa

SEQ ID NO: 3922 - DNA, 457 bp, Homo sapiens
gcgactgaggcttgttagagtttgaagcagcacctccaccatcgccatccacgtcttctacctcccaggcttgcgaggggagcactggctaccctgcggacccctgggagacccaagcagggtggcccgggctctgccttctctgaggtggggtcagccctgctcaggtcgttgcaggagggctgctgaagaggcagccttgttggaatccggcgcccatggcaagactctcttgtgaggtttccgacaatccctgtccacattttcctccgctccttcctggtgccaccagactcctggccctcaatgtctgctgccctggccccttgagagtccgctggagcctagcgcatagcagatgggcgatgttcacccagagcagccattctgactccgtccctcgggtctggtacatactgtgtgccaaggttaattaaaccggtaattagaaggaaaa

SEQ ID NO: 3923 - DNA, 455 bp, Homo sapiens
gctagttctaggatatataagcagacaaggagggtctctaggaaccataggagtttaatccacgtgagccatcagcctgatttacagcttcctgccctgcagcctgttcttccctaaaccctgggtggactatagtaacctagttggttgaaaccagctcctgacagaccctggcaacttagagatgaaccctggtgaatcttcctcatgactgtaacgtctccatcctggaggaactgtagttccgttatcataacatgtaacccatgtgttgccatgatgacactgtgtctgcaccgctgggacccctcatctacatgcgataatgcaccctctcccctctccatcaccccataaaaccctcctgccactttccctcagggagacactgctttggagaatacacccagtgctccccttacttgagccaagtaataaaactcctattgatcaaa

SEQ ID NO: 3924 - DNA, 867 bp, Homo sapiens
cctagcttcatctatgcagtgtaaactgtgttttaagtgtgtcaagaaccacaacaagtttaagaaggtagagagaaggatgagaaagaatttaagttgcaaatgcatacttcacctgtgtcattttggatctgtttggaaaacggaagagaagaaacctcgattaaacacatcctcatttcctgttcactgatttactatatcatccatcagattttgtcatcaagcatctaaaacaacatgcaaaaaaaccaaagcatacgctttttaagttaaaaaaatagcaatctattactattttttaaaatcagtagcagaaagttgagttaggtaaggacacatttgatgaagaaagttctcttaaagcaagcagcactgtttccattccccattacgaagatttgaaatgtatgtcagacccactcttttttgctctgatttatgtgacttacttgatagacagctcccagtcaaattgagatatatcagtcagaatgatttttgacaaattagtaccaatataaaattgatttcttatatataacatagaattgtataaaagatgaatttttaaaacaatcatataatttttatgataatacatcaatgttactagaaatgacaacgttcatttcacatggtcagttttgttaaaagaagaaaatagagtataaattgattttgtctgtttgcaaaatcacattctttaaaatggttaaatctaaattcttttgaggtaaaggactgacagtactcttaatatggactattgtctttagaaaattacccattacctatcctactctgaaaaatgtggtggaatttacattcaaaaatgcaaaataaaatttatatgatactttaaga

SEQ ID NO: 3925 - DNA, 431 bp, Homo sapiens
  misc_feature (1)...(431): n = A,T,C or G
cctgcaagcctcccnagctggagcttggactgagaagccacctgcagaatgttgtgactcactctccttccatttccataagaagaaaaaaaatcttctgtggttaaatttcatgagccatttaactctccagcagccatttggtctttgcttttctgttttgtggatgaatttattttatgtgctatttcccccttaaattttaaggatatgtatcttcatgaaaagaacaatggaagaaaaacaacttgtaaattatcacaagaaaaacccctgctaaaagcaataagtttgctgacagatggcagaatcagttgaaaagcgagtaccatatttactaagtctaacccacctagtaagccaaaagagtgttatctaattctatcccctgggtatgcatgtgttttggaataaacagatgcctaatgaaa

SEQ ID NO: 3926 - DNA, 495 bp, Homo sapiens
attaaggagtttaacaaatttcaaagaggctttttggagcctaactgaaactttctccttaatgtgatccctgggatagatgcctcccagctggagctgggactgagaagtcacctgcagaatgttgagactcactctccttccatccccataagaagaaaaaaaaatcttctgtggttaaatttcatgagccatttaactctccagcagccatttggtctttgcttttctgttttgtggatgaatttattttatgtgctatttcccccttaaattttaaggatatgtatcttcatgaaaagaacaaaggaagaaaaacaacttgtaaattaccacaagaaaaacccctgctaaaagcaataagtttgctgacagatggcagaatcagttgaaaagcgagtaccatatttactaagtctaacccatttagtaagccaaaaaagtgttatctaattctatcccctgtgtatgcatgtgttttggaataaactccga

SEQ ID NO: 3927 - DNA, 808 bp, Homo sapiens
agctggcactgacagcctcatgaggagtttcctgtgatcagctgacagaggaagagaagactagggcctggtttatgagtggtgtctgcatacgtggctctgcacaatatgaagacaccacctgaaagtggacagctgccgcagcactacagcccccttttagccagtgtccactcaggaccccagctgaaggattataactgacgtgtgggctgactctgccacagaagcacaaccacaattgatcactatattctgaataagacttggagttcaagcaatcatatgaaaaggcactcaataaccttctgtcttccttgattccaaatacggtatacataaaggttatcatatactcctcttcagctagctaggttatcttgacatgcttcaattattttgtaattgccactgtttttcaacagctgtgcccttgaaatgcattttctctttagactaatcagataatttgaagatgcagtgccacttctgcaacaaagccaatattgttaagagccattggtgttttaaaggatccctatttcaggagaaaattataccatcaactgtaatttatgtgaaattgtgtaaagcaagtgtgtctctaaatttctactcgagaaaaatttactaaaaatgttgtcttttatttctgtgaccactcaaagtctgattttaaaagtgattctacagcgagtcgctcatattggattttcacttaatcctaaaatagcagtctgttgccaacaatagaattaccgaataccggagcttgtcaagacctctaagaggtggttaaccctagaga

SEQ ID NO: 3928 - DNA, 581 bp, Homo sapiens
caccagctcgacaggactttcttgctctgccccaaggacaaagaagatggctgctgcgttcccctctgtgaagaatttgctggcctttgtaagaaacggtcagtagaagattcactggatagtgaaattctttgtgcctgggatgtgttcagtctgcttttctgctgcaccaggaaagaaggtccagtgtcttatttcattctggagctttttgaaactttttactctgtactttaattttggcaaccttggactgatggggtttgtagatattaattatcaaattgttatttattagctgatattctttcaattcaataaatattttaaatcccttgtggtgtctgttgaaccccccaccaggaaactgaaataatatcttcagtcttccttttctttcctccacaaaatagaaagaagataactatacatagctgatagttattttctctcagaaattcaaatatattatttttaagtgcttctgtaaatatttgccccgaacccaatttaaaaaataaaaatctaaggaccaataaaactatggcctcgttggcctcagcggtggagctctgccgccg

SEQ ID NO: 3929 - DNA, 291 bp, Homo sapiens
ctagtacactcaagaatctaaaactttgcagtgccttcagatcagtgtcatcacaccagtacccatggaaagccagtacctccagcccttcccttctgtctctcagagagccacaaggaaatacatttgatctcaaaatgttgtaaaacatcagcatccattcattgttttcttctgaagagcaaggacacttaacggatttttctgtattattttatgtgagacaacgcgttgaatgctttattctttgtaataaataaaatgcttacctggttcttaaaaaaaaaaaaa

SEQ ID NO: 3930 - DNA, 342 bp, Homo sapiens
agagaagggccttgatatgttgcccaggatggtctcaaactctgcagctcaagtaatcctccaacctcaagcaatcctcctgcctcagcctcccaaagtgttgggattataggtgtgagccatggtgcgccccgcctatgaatgtctctttggcaaagatggagaaaacactgaactgtatgcctgataaaatgactccacatgaagaggctcccagtttatagagatatgctatctttaaacaggttttaactttgtatttatatcaaataaaatttattatctgtttacacaatgttccttacatagaagtggaaataaaggaaattgtgttattattcc

SEQ ID NO: 3931 - DNA, 938 bp, Homo sapiens
agtgctacaattttagaggaaatgattttgagaggtgaagccaactggacttcctgggtcgagtggggactttgggaaccttcctgtcttacaagaggcttgcaaaattcaccaatcaggatctttcctgtcttacaagaggaacgaggccatcaagctacacatggttttacaaatggaaccccaaatgagctcaactcacaactgctaccgaggacccctggatggacccactggcccttcaagtagcctagagaattcccctctggaggacactataactgcagggccccttctttgcacctatccagcaggaagtagctagagtggtcattgcccaattcccagcagctgttggagtgtcctgtttagaggggggattgagaggtgaagccagctggacttcctgggtcgagtggggacttggggagctttcctgtcttacaagagtttgtaaaacgcaccaatcagcactctgtaaaatgcaccaatcagtgctctgtaaaatgcaccaaacagcactctcaaaagtgcaccaatcagtaagattctaaaagtagccaatctcggggaggattgagaaaagggtattctgataggatagaaatggaacatgggaggggacaaataaggaaataaaagctggccaccccagccagcagcggcaacccacttgggtccccttccatgctgtggaagctttgttcttcactcttcacaataaaaccttgcctgttggctccacctttgggtcctgtcccacctttaagaagttgtaacattcattggaaaaggtacccagcttcatttcttgaggtcagtgagaccccaaaccccactggcaggaaccaactcctggacccaggttggaatgtaaacaataaagcctttcctaaccaatccaaataaaaaaaatcgggcctcgtgggctcagcgtg

SEQ ID NO: 3932 - DNA, 630 bp, Homo sapiens
  misc_feature (1)...(630): n = A,T,C or G
cagagtaagagagaagattcaataagctcaattcaaaaggaaaatggagacattataaacgacaccacagatatacaaaagatcatttgagactactataaacacctccgtgcacacactagaaaatctagaggaaacggataaatcctggaaacatacaaccctccaagcttgaatcaggaagaaataagaaatcctaaacagacacatatcaagcagtgagaataaatcagtaataaaaaaaaaattgtcaacaacaacaaaaaagctcagggccagatggatccatagccaaattctaccagacattcaaagaaataataccaatcctactgaaactattaaaagactgagaaagagagaatcttctctaactcattccataaagccagtatcatcaccctgataacaaaaccaggaaaggacataacaaaaaaagaaagctacagaccaacacccctgataaacacagatgcaaaaatccctaacaaaatactagcaaaccaagtccaacagcatatccaaaagacattttatcatgatcaaggaggtttcctcccaaggatgcaggaatggttcagcatatgcaagtcaatanatgtgattcaccactgaaacaattaaaagcaa

SEQ ID NO: 3933 - DNA, 799 bp, Homo sapiens
ctggaatttggggttccctaaccttgggatccacacctcactccatacagactcttcagactgggcacggcggctcacacctgtaatcctggcactttgggagaccaagcggcttgagcccaggagtttgagaccagccccggcaacatagcaaaatcccatctatacaaaaaagttacaaaagttagccaaacatgctggtacatgcctatagtcccaggtactggggggctgaagcaaaaggatgacttgagcccgggagtttgaggctgcagtgagccaagatcatgccgctgcagtgagccaagatcatgccactgcactctagcctgggtgacggagcaagaccctgtctcaaaaacaatgacaacaacaaaaaatcagattgttcaaaatctcagcagttctataagtaagtttaagaagctcatctttaattctgcttgctaacatgacctggtaattgtttttttatagcttttccaaagaagtactgagaaagagacttagcagcccttgttcccctgaggtctgacactaaacagctggagctagagctttgactaatctgaagagggaagagaaagaggaggaactgtgaaacatcattttaaactttcctgagaagttctcctgagactatcaaaatcatcccccagaaactgggggatgggtatacaggaaccctctgtcccacctttgcaacttttctggtaatcaaaattatttcaacatagaagtttatttaaattatttgaaaataattcccccaaattttctaaagtgatgaacggaacca

SEQ ID NO: 3934 - DNA, 787 bp, Homo sapiens
cagaagataagatctatccaagcaacactgcaagcaagcaaggcagtctgtttgctctttcaaagaaagccttggagaaacagcaaccctattgtctaagaaagagaacaagaatgatttccgaacacgactggtcaaacttgctacccttcagagtgtgtgtctatatatgtatgtaaaatccaagtgtctcgtttactgcaaaacaacctttatcctgaagaacacttcagctcaagaaaatgctctttaaaatgtctaattccctactgtgatttcctttaaagttctaattagttgtgcaccataatgaattctgtaaattgcagtgtttcatttaaagcttttaaagtacagaaggctctaataatgagttttgccacaatcagtctttgaagaaagtaattttgacatgtaggtttcatatttttggagatgtcttacattttagatacaatcacaatgttgagtcgcaaattaatatttgttgcttaatgtcatcaaaatgtcagattaatgagtaattaacaacgtttgtacatcatgtgatttccttctttctgcaaaggccaaaagcataatggagaattcaagtcaagaaacgtctttcaacaaatacattttctgagttctccttttaaataacttactaccaggtctataactgtcttcttttaatggtcagcaaacagctgggtttccagataacatggagaacataaaatatttatgttatttaagcggaaaaaaatattggtctccgtgggcccagcggaggagctctgcg

SEQ ID NO: 3935 - DNA, 651 bp, Homo sapiens
  misc_feature (1)...(651): n = A,T,C or G
gcctgactatgacacatggtgaggcctgtgagcccttccagcaaatcagcaaatctgggagtggttccaagactcccaacatttcgggaggctgataagttgaagatcagaccgatggcagctttggtgtctggtaagggcccaggctctgctaccaagatggcaccttcgatgctatatcctgtagaagtgataaactctgtgtcttcacatggcagaaaggatggaaaaggccaaaaatggcctgggttgtttccaccggcatttttttttttttttttgagacagagtctcgctctgttgcccaggctgaagtgcaacggcacgatctccgctcactgaaagctccacctcgcggattccagcgaatctcttcagtctcccaagtagctggaattactggcgccccccccaccatctctactaaaaatacaaaaaattagccaggtgtagtggcacgcacctgtaatcccagctactcaggaggctgaggcaggagaaatgcttgaatcagggaggcagaggttacagtgagaggagatcgcgccactgcactccagcctggacaacagagcaagactccatctcaataaataaataaataaataaaataaaaatgtcctctcacannagaaaaggatgggatgagaa

SEQ ID NO: 3936 - DNA, 365 bp, Homo sapiens
acccatcaactggatcctggatgtgcagctgagcctcttttaaaactgctgtcacacatggactcctgcgcagaccaaacatcccttttgtgtgtgtgggtcttcacctcacacaacccctacggaatcacaagaggaaaataccactatttctcagtcaggcggaggactaagaattcaaggcctggatcagctcaattacttgcctactctggacctgagcagctgtggataaaaacaactggagaaaatcactcaacagacagactcaatttactttaaaatatgtgatttcaaacctcaaatgtccaactcctggcaactgcactatattccctaataaacttgctttcccaaactccaaa

SEQ ID NO: 3937 - DNA, 705 bp, Homo sapiens
agcctattgaaggtgatgacctgcatatccagaggaatgtgcaaaagctgaaggacacagtgaaaaagcttggagagagtggagagatcaaagcaattggagaactggatttgctgtttatgtctctgagaaatgcctgcatttgaccagagcaaagctgaaaaatgaataactaaccccctttccctgctagaaataacaattagatgccccaaagcgattttttttaaccaaaaggaagatgggaagccaaactccatcatgatgggtggattccaaatgaacccctgcgttagttacaaaggaaaccaatgccacttttgtttataagaccagaaggtagactttctaagcatagatatttattgataacatttcattgtaactggtgttctatacacagaaaacaatttattttttaaataattgtctttttccataaaaaagattactttccattcctttaggggaaaaaacccctaaatagcttcatgtttccataatcagtactttatatttataaatgtatttattattattataagactgcattttatttatatcattttattaatatggatttatttatagaaacatcattcgatattgctacttgagtgtaaggctaatattgatatttatgacaataattatagagctataacatgtttatttgacctcaataaacacttggatatcctaaaa

SEQ ID NO: 3938 - DNA, 899 bp, Homo sapiens
acaactacataattgtggggtgttttcccatgaagaagtgaacctagcaattgagaagacattgagtgaaaatctgtttttctcttccaacagtgggaagagctttcataattgtcctctcactgtgacatccagtcaacactggccttcattctacgcctgctgccctgatgattgcacgttaatgaagcacaaagaggagttattactgtccatttattttccatccccacagatagtagtaggaccagcctgtcctcttcttagtaggtggagaaaaaggcttattaaatgtcaaaaatattttgagtacttcttggacagcttcaggagtcaaaccacctgcaaagaatcatcaggcctgcctccattgaaagctgtctattgggaagggactctgtcacccacttgtggaactcattgagttctgtcatgtggcttcttcaccaaaaacatgccttatgattcctcattagcacagcttctctttctaaagctatttcctttgatgtagtgcccccccccaactatctacatctcatttcaattttacagcctctattctctgtccttgtttgcatagcagcaaaggaaatcttaattgctttgtatttatagtcagagtctaaactgttggattaattcatgtatcaattctgaaattcattaaataaatattgattaaaagaacacttttaatatacactgttataaggatatacactgttataaggatatacactgttataaggatacaacagttgagtaagacactttggaaatagataatggggatgaacacaaaaaaaaaaaatcggcctcggtgcgcctaacggggagctctggcggcccgttcctttagggaggggtaattcatgatcctcgcttactcgcttcgt

SEQ ID NO: 3939 - DNA, 584 bp, Homo sapiens
ctagatgggattcaaaacaataacaacaacaaaagtgccctcctgaatttaattgtcaagaccagtcccaagtctcctctgtccacagcatcactgcttttggcaccatgtgagagcctgacgccatgcggagggaggagggacatttggcctgggcgtgatggaatggcctccactcccttcgagtcatactctggctcggcactgttcaatgactgaatgaccaggactgatctaacgtgatcttagaaggacatcaccgaatcctgaggattaaacaaaccacaggaaaataccaactgttttcctcaaaatagtgaagggttacaactactgggcagagggggtggtcacagaatgcaacatcctaagctctgcaggtcaactgaaatagaaagcccagtggccgctgatggcaagtgatgcttctgtcagacctacatggtaatacattctcccagactcaaagatcaccctgttccaaggctcatatgcagaacttatcctgacctttcagagaaagcagtgacaatctgttcagtggaggcaggttaatttaaaaataaaaattaatgttacgacaa

SEQ ID NO: 3940 - DNA, 950 bp, Homo sapiens
agacttgaaatactcagaacaagatgtgctctgttcctgaaaccctgccaggcagttatagacaacttgatgtgacttctgaggacaacccttatgcctgatatgtggaccactcaggaagatcattgaaaccctcagtaccataaccagagacattcaaactgcaaaccagaaaaatatgtttcaagctcaaatctagcaatcttgttaactaaatttcctctggactcagactgaatttatagtttgctctagtcattgacctttggttttcttttgtttctctagaaatgttagttgagttggtttgtgaggaccttggctaaggaacatactgcagtctttcagtattatcctcctggtagtcatcataatctccctggtgaactacattcacttgagggtcttaaatgtgtgttcacagtcatcaacggtatgccagatgatctcactgtaattagagcaacaaaaatgagatgaacaacaaaaggaatctttcctcaatgagcttgatgttgtgacttatgagtttcacactgagacaaggacaacttagccatgatggtcacagagagtggagcttatgcccaagttttagtcaatatctcttaaatgagaggctgatcaaaaaggatgaattatgttttacaatttctatttggaaggccattagactggaggtggctctgggcactttaaatttcctgtgtgaacaaaccaaagcctaatgtaaataggtaaatttaacctagaaattggtcccaatcaaaaaaataacccattaatttcttactagggactttcactctaccaaaaaaatggtttctttgcctgctctgcaacactataagttttcttctgcccccacacacacggtggcgccgaactgcctgatcatgaaccgtgatatcaataactctttaaattacaaaaaacacaggctccgcgcg

SEQ ID NO: 3941 - DNA, 135 bp, Homo sapiens
cagatcattgaaatttgacacaagatgcaatcatccgcctgaaggattttgacaacactcacgtttttaaactccacattccctatccctaggaaagaaacctcaataaatacatcttgcatttattaaggaaaa

SEQ ID NO: 3942 - DNA, 792 bp, Homo sapiens
acaaggcccttgtgtctgagaatgactgcttctgtgatctgatgagcacacgtggtgtgcatccagtggctctgctcttaaactaggcccatgactaccaacagtcattcttcctgggctgctgagaccagaaaataaaagtgccttccaaatggttcacagatgcagaggaattttgcctcaggatgaattgcatcttcagtctcacccaaacctgatttagataatatttcaatgagacttcggacttcagactttacagttgatgctgcaaccagttaaggcttttgggattgtcggaatggaatgaatgtattttgcatgtgagaagaacatgaagtgtgggggggccatgggcagaatattatggattgcatgattttgtctccccagaatacatatgttgaaattctaatcctcaatgtgatggtattatgtgatgggaaatttgggaggtaattaggttatgagggtggagacctcatgtaaaggattagtgcccttataagaagaaacacaagagcttgcttcctctctctgctctccactatgcgaagatagaacaagaagatggccatctgcaaaccaggaagagagccctcatcagacactggatctgccagcaccttgatcctggacttcacagcctccagaactgtgagaaatacatatatgttttttaaagcacccagtctgtggcattttgttgtagcaacctgagctaaaacagttgctattgaactctgttcagagctccagatgtcctgtgctggcactgggcagggtgctctc

SEQ ID NO: 3943 - DNA, 739 bp, Homo sapiens
agattctctttaggttctgcctgagctactatgaagcagttgtggggagtgggtcttccaatgctcggaatgctctggaaacttgaattgatgataaaagcagttcagcatgggactagtaccaagactcacactaaggaagaaggagttggaaaaaattgaaagacactctggggatgtgcattccccattgcagaattggggacactgctgtaaatggggagtactcactggagaatgaaaaactttgaatgttgcaaagttctgaaccatagggttcctttttatgtagaaatatcttcataatgtatatatccacaggggaattgcttgagtaaaatgtagagcaactatgaacacacagaaccactcagtaaaactgtatatatccatatggtaatgtatgaaatatattgtagagagagaatttcaattgcaaacagtattgttttatatgatttaacttttatttaaaaatacaaagatatgaatggaaaaatattgtaagtgtatatgtggaaatactgacattgattatcacttgataatggatactggggtataccatacccattataataggataatgggtatcttctctttgcttatttatggtttctgaactttctacagtactatgtaacttgtaaaaatataaattttcagaaccggaattatttttcttatcatcaggatagcaataaataaaacttggccgaagcttaccatgccacataaa

SEQ ID NO: 3944 - DNA, 797 bp, Homo sapiens
aggtttttgctattcagggcactaactactccagtccttgtcacttcaactttggccagttgctgattaactcctcagagaaatacctagaagtggaattgatacatagactcaaatgtccaccaaaaagatggtactaattttcagcatcccatcaacagtatataaatatgacaggttctcaacacatgaaaacaaaatttgaaacattttaacatgtactaatgtagtaggtcaaaaaaaccttattgccattttaagttggatttttctatttcttcagttttaattgactgtaaatacatttttgtatgcttattgttcatttttgtatttttcttttgtgaattacccatgaattccccttgtttatcttttcttatttcagtgttactgtttttccttagaaacaacaatagaattaaggataagctttggtgtttcatattttcatatgttttgctttttgtcacttgcttttcacagttcttaattacaagtatatatagtgtttgtatatacatgaattttacctatgtaatgtatgtctacataattttaaagtgttcaagtttatgattttctaaaaatatcctgattttggtgtcatttaaatactatcccttctatttatatatcttttgattacagagtacatgaaactgttcccttatcatttcaaatacatttatgctttaaaaatatattcttaaatgaataacattaaacttgttttgatatataatattatttggttaatctttggacctaaatacattattgtacccttgttttat

SEQ ID NO: 3945 - DNA, 851 bp, Homo sapiens
ggctgaagagatatgatatgttaatgaggtgttgtgttgttggtcggtttaggcatcttaacagggataaatgaatttgtgaaggtgatgagcttagcagaatgctttgcacagagtattgagagccaatgctgtagacaacagagcctaacttaccaagaagacgtatggtctgaaaaatgcaaaacatcttattttacgggaaagacctgcagaagggatgggatgttcacagtggatttctaacaaagaggaaacaccacagccatcagaagtgttagagaagaagttgtgccttatccacatcaaagaaggaaaaaccacaccctttctatttaggataaggaaaagactcaactcctggtgtgtgctttttggctaaaaactacagcctatgtaaatttcctaatgactggaaaaaaatttgcatgtatgaaaaggatcaaaccattttcaaaggatttttaactggcaatcttttaactggggagaaataagggggtagaaatcccatctgtcatcaaaggatccacccttctggaaatgtgtaattgtggggtattccgcccatcacaggcttaaaggcagcttctaataaaagttctttctaaaattaaaaaaaaaatcggccttgttgggcttagcgggggagttgtgcggtcgcttccttttatggagggtaattcatgatcctcggtccttactcgctgatctgtgccttacggttcggtcaaccgttttcactcactaaaagggggataacgtttatcccccattcggggattacgcaggatgaaatttatccatatgcccctaagagtcctgaaccgtaaatggcccaggtgggcttt

SEQ ID NO: 3946 - DNA, 817 bp, Homo sapiens
aggagatacctccacggtccctatactctcctgtgcaactgacacggaattgactgcgtgagccatcgctagggcgatgaggctacaggaaagagcaacgcacgtgctcgagacctgaggcgcctggccactacagcagctactgccttgctcctcatggcatatactgccaatgctggaggaaacactcatacctgcacatttacttctacaggcctccaaacgtctgatacttctaaggagcacaagtacacaaatagaaagcgctgctactcccgttcatttctgctttcacaaacgtgtacaatgcatgaagaaagaataacatgactgaccaagctcattacctgggataattggagagatgggcactaaataactggcagtacagctggaaaacacactatcatggacaaacgcgtgagagaacacagtgagcgagagatgtccagagactgtccataaccatttatttggtctaatatgtgagaagtaaacccacagatactcacccagtctagcgaggcttttatttatcattatttagaatgccacaaagactgaccagagtaataaaatacgagtcaatattccgtaaaagccaactctggcactcatctgggacaaacatgtcagggaccaggatactgtatccgcttgtacgtaatggaagggtacctctacccaatgatataacgctgaaacggtttaacaaagaagaaagaagcgccctccatggcctactgggtggaccatccgccgccgctaacccttaacggggggcctaattcatggaactatcctcattgactccatg

SEQ ID NO: 3947 - DNA, 569 bp, Homo sapiens
taggtggccattctcctaatgttcattcttcaaaaatgaaagcctcttctgtggcctagattttggatcctgaagtcctggacagatgtttctactcctcatacaactgtcacactgaagactactgtgaaggaggacctcagcttctaaggcttgctcgcaagaccactcctccattttaaagtattgttctggagctgaattagatcaaatattttccggctcttctctcttagtacctctattgtgaatgtattcaatttgtcctcagtattcatcactattttctatatttagccaatcatggctttggtgatttctcctttaggctttcatttatttttttcttatattctaccctatgtgtcctctctttctctctatctctctcattcttatctcattattatgtttttttcttttaaaaacacagggttattttttactatacaaaatagtttgaaatatgcactccagggcatttaaaataactttcactcagaatattgaattgtatggatatatcataacaaatacaattttgctaaaagtaaaaaaaaaaatcggcc

SEQ ID NO: 3948 - DNA, 1153 bp, Homo sapiens
aagaaacaaacatactgctgataaaaagaatgtctccttgtggctactgaaacccacatgtcaactgctatagctgtcagcctaccaggaataacccctgcttcaaaccccaagaagcccatttactattttaatgacaagaacttgctaatgtgggcatatgaactgtatccttggaaaggaatgccgtccataccaggaagtccttgagaaggcttgagttcttgccataactaaaaatccgatgatgcattaccaatgacttcatccccaaatgaaagctagcagcctgcttccgtaatcctcatggagagttataccaagaaaagacaactttggaaaaacatgcaagagagaggcttcattttctcttttgaataaaagaaagaaaccagtctatgtgactacggaggaggcaccttgcaggccctggtgtgggggcctgtgtttctcctacaatgctgacagctagggatttaccagagacttaaaaaatgaaaaaactgctaatggtatatatatatatttttgggtggggcttgtgaatgagaaatatggaaacgattggtctcccccacattaggtttttgcatcccagcagttctgacacttcagacttcattgcacagcctagtttcccctttagaagaagggaacggtcccattccagttgatggtggcctcgctccacttggttctgattgccatctccactggtgaaaaccgtcgtcttggtccatgcttctcttcctgttggtctctttcccagtgatgggagtgagtatctgaagaaggaatagccagcatttagacccaagcctatgaacaccattccagaggaaaccactaaagaaggacagaagggtgggtgggcaggagtcaggcttggaaaattgtgctcctacaactggttaagcagatggggattcaagcaggtagtgtgttgaaatgccccacacagaatgagtcagtggtagcctgggttgttgtgcatattaggacgtagtatgtgtgttgaaacgccccatacagaatgagtcagtggtaacctgggttgttgtgcataactgttgataagctatgtaatacaccttcccgtaccatgatgtgacacctagaaccaggtataggttactaaatattgtcaggaaaa

SEQ ID NO: 3949 - DNA, 906 bp, Homo sapiens
cagtgaccaagaagtgattatccttttcatggtcatttcacttgagaaagacaacaaagaaaatggctgagaaaaaagatggttgataataaatagaatggaatgttggcacccacagaaaacaaatctagaattggaagactatgaatgtgcacatttttagattgagtcaacacaacagaacgttctgtgactaaagtgtggtggatttctccaagccaacaactcattgtccagcagacaccaactgggtgtcctgcaagttatctggatcctgacactcgccggagtcagtgcagaacccacaggggaagagcccagtcttgtaagatgccctcacttcagcagcccatcgcaagtcccacgtggcgaccttgtgacctgtgcttctgactgcccagctatccacagggttttctggaccctctcctcaggtttaatagtttgtgagaacagctcatagaactcaggaaaatatttaacttatatttacctacttattatgaaggatacagatgaacagccagacggaagagatgcacaggacaagacgtgggaaggggcagagcttccatgtgtctccgggtgcagcaacctccaggcacctccgcgtgttcagcaatccagaagctgaatcccaaccccacagtgcaggggtttttattaaggcttcatcacataggagtgatgggtcatcaacgccatctccagtccctctgcccaattcctggaggatgggtgatggggcttaaagttctaaacttctaattctggcttggtctttctaggggccagtgcacccttccccccagaacccctcaagatttgttgttttaaataaaattgcccctggtacttaagaaattgctagggatgagaaactttacctaacaaccctggtcaaag

SEQ ID NO: 3950 - DNA, 390 bp, Homo sapiens
cctactgcagctgctggtcgccagtaataagtatcctgagagcccagaaatggtacactttgccttgctgtttaaaagtaatgcaatatgtgaacgcccagagaacaagcactgtggaactgctattttcctgttctacccttgatggattttcaaggtcatgctggccaattaaggcatcatcagtcctacctgagcaacaagaatctaaactttattccaagtcagaaactgtttctgcagagccactctctcccctgctccatttcgtgacttttttttttttttttacaaattgagtttagaagtgagtgtaatccagcaatacagtttactggtttagttggtgggttaattaaaaaaaatttgctcataaaaaaaaaaaaaaaa

SEQ ID NO: 3951 - DNA, 782 bp, Homo sapiens
atgactcactacaacctctaccgtacatcagatgtctgagtcctgagctctgttctgttccactggtcaatttgtcttcctgcaccaagacaatactatcttaattattagagttttaaaatattttaatatttagtagacaagtacatctaccttattcctcttcatcagaagtgttgtaattcttggcacattgctattctgaacaccttttaaaattagtttgcgaatttccaccaaaaacactgttgggatttgaattgtgctgtattaaaactgtggatcagtttggggagtactgacatatttagagcattgagtcttccttttcatgaacatggaatctttctctatcaagttcttcttttacatctttcggtaatgttttatagtttatccataaaggtcttgcatattttttgtgagattgctctgaagtacatttttttgttgttgcaattgcaaatggatatttagaggccgtttgctctttgtggctggtgtatataaatgaattgatttttatgaattcatcttttgcccaaccactttgccaaactcataattccaatattttttctacagattctttgggggtttctatgtatacataacatctatgaaaaatgatagtttttgttccttcctttccaatctttgtattctattagttcttctcttgactctttgaactaggctagatcattaataaaacattggcaaaagtgaaaacaaaaaaaaaatggcctccttggcctcaccggtggagctctccggcccat

SEQ ID NO: 3952 - DNA, 484 bp, Homo sapiens
ctggtatgtgccagcaccaggaagtcagagctataaacaactcattttagattcagccagagtgttttctctgtcaggataaaacgcagcatgactaccctgcacagtcctatggatcctgaatgtatcaattaggaatacagcagatacactgtataaagacaaggaaggcatcactgataaccttgctggataaccctgtaatctatactctactgatcccaatgcctgatttattgaaatgaaggatgcaagtggttcttggtcaggcctattccttggacatgattggcgatcacagaagaaaagactatctcttatgtttaatttcatttgggtacctccagagtagaacaagagttcttccacctccacacttttttcctttcgttcctccaaaagcataaggaatccttaataacaaatatctgaaatgggaatagagtttgaaaattaaagttcaagtgttacaaaaaaaaaaaaa

SEQ ID NO: 3953 - DNA, 372 bp, Homo sapiens
  misc_feature (1)...(372): n = A,T,C or G
ctggcggcccgtatcgcccttttcaacagttgttcatgactgaatggacaactgggacgctcccctgaaccaccagcttaaagcgcaggtgggtcttggctgtttaccataccaagcccccnacgcagccncatcttgctaggtttctttcagttctcttttaaccctacttccaatcggtttttcccatttaacatgtaatatatggagctctcctcatgagtcttacactactaaaacctcgatatggatatagattaaatttcggcccacatgacaacgtaaaactaattctacccttgaccgagtcgaatctcagatctatattattattcattgtccaaattcaactctttcttccattttacgatt

SEQ ID NO: 3954 - DNA, 120 bp, Homo sapiens
aagcattgattcctcaagggacccacatcacaccaaagaagagtcatcatgcgaactacaactcgggcaattctgcaagctgcaccaaatctccctcttgcacgatccactagtttcaat

SEQ ID NO: 3955 - DNA, 710 bp, Homo sapiens
cccgatgctatcatccattatgttgaagaggacaggtcaaaggaaagagccctgtgggaccttccctgagaccatttttgatttagagtcatttgggcctggaactgagatttcccagctacgaatccacctacctgtcccaccggtctgtgtatccaacctacacttatacacatggaaatgaagagaggctgcgtcttaaatccttttcggagaatccatacatgtatgacctgtgcctatcccctaggtaaccatgcctgacccacaataaactggataagaaacacctattgactatgccccctttccttaataatctgtagttaaaaacaatgagtagcaaaatgcggttcggcattcaagagtgaagctacgattaaattagtaatatcagggagggatgaatagcgtacttggattgaaataagagatgataactatttcattagagtaataagggttttaacataacaatgttacagtcgaatatgtagtctgaataggtagaataatacaagaccgtgatgctgattagatatgacgtatccggacttttataacgtctcagacttagttcagacagaggagtgatacgaagaacctttagtaaccgacaggtgaactatgagaatagtgcgtgacatatgttatctttgactgacgaaatatcgatatcatagttgaagaggtaacctcctgaagggaat

SEQ ID NO: 3956 - DNA, 391 bp, Homo sapiens
agtgagaaagtgtgggaatcataaaagaaggcagaaccaaaagacagagggatcttgggccatgagtcacagcaaggaaagcctcccaccaaacatctgcactggactcctacaggaacaagaaatgaactatcgtgttcagcccctgagacttgggcttaacatgattttcacattgtctaccctacctaatagagcagagatgtaaatattattcttattttagaggtgtgatgcctcagctgcaatgggtgagaactactcctcatttattctcttccaaggcaataaaagagaatggaccaaagacagtctgtcatcacatctagtcaaaagagctaatgtcgcagtacaactcttcaaaagaaaaagaaaaaacaagaaaaaagta

SEQ ID NO: 3957 - DNA, 283 bp, Homo sapiens
atttacatttgatcacaagctcctgtgtaacatactcagtagcatcttcttccaagctattctgtgattatgtagactatgattatttttcttgcttaaatatcttagaatggaagccagttttccagttgcattttctctcatttacggctctgcaggctgtaagggaagcatagcggtttctgcttctggggaggcctcaggaaactttccatcgttgattcaaaagtccaaaatccagtgtcttactggggactcaaggcaagttccttccatctatgag

SEQ ID NO: 3958 - DNA, 265 bp, Homo sapiens
gaagggcaacaaatggagctgcattttgactgcactctttctaggttggagaagcagggaaagtgatactccgggagctggtgtgtctaaggcctctgtgagtctgcatggtcaacacagctggctctgcctttgcgctcagcttctcctgaggcatcaacctgcatctaagctcttctgcctcctttccgggaatggccacggtctatggtttctcaattgactcgagattcaggagaattactcaagataatcccctccaaat

SEQ ID NO: 3959 - DNA, 330 bp, Homo sapiens
attctgcatcagtcttcctccatcatgaatatccatctggtagcagtggaaggtattcaatatgttaccagcaggtctgcagcaacctcattcttgcctcctcagaagaaagaatttgaaggacataagggagaaggagagaccaaggcctgcggaggtcccacttttgaaactgaagccaatatgctttacccatgagaagaaaagggagaggaggggagaaagctgtggctgtgccttgttgaataattaaaatgttttatttggaagaaaaagctgacaggtagcaaacctcatacagcatttatgaatatgtacataataaatacc

SEQ ID NO: 3960 - DNA, 400 bp, Homo sapiens
tttaataatcaccgctacagaacaattaaaattggcgtacaagggacatacctcaatgtaataaaagccatctatgacaaacctgactgaggaaaagttgaaagcattccctctgagcactggaacaagacaaggatgcccactctcaccactcctcttcaacatccagagcaatcagacaaagaaaagaaataaagggcatcatcagtaaagaggaagtcaaactgtcactgtttgctgatgatatgaccaaagattcctccagaaagctcctagaattgataaaagcattcagcaaagtttacagatagaagattaatatacacaaatctgtagctgtcaaatggagaataaaataagaactccaccccctttacaatagctgcgaaaaaaaaaaaaa

SEQ ID NO: 3961 - DNA, 765 bp, Homo sapiens
  misc_feature (1)...(765): n = A,T,C or G
aacaattaaaattggcgtacaagggacatacctcaatgtaataaaagccatctatgacaaacccacagccaacataatactgactgaggaaaagttgaaagcattccctctgagcactggaacaagacaaggatgcccactctcaccactcctctttaacatagtactggaagtcatagcccgagccatcacgacaagaaaaggaattaagggcctcattcagtaagaaggaagtaaactgtcactggttgctgatgatatgacccattaccttggaaacccctaaagatccctcagaaaggctctagaatttataaaagccttcagccaaggttacagatagaagattaatatacaccaaatctgtagctggtctatataccaacaggtgatcaaatggagaaataaatcaagaactccaccccctttacattagctgcntaataaaaaaaaaatagaaggaaattcttatgaatatacctaccaaggagggcaagaactttaccaggaaaaccgcaaaatctggggaaagaatttttcaacaacccaaacaatggtaaaccattccatgcccatggatgggatgaaatcaatttgggtatataacccactcggcaaaagcatcaacaaaacttagggaatttcctataaagaacccccattccatctttccctatgtggaaaaatatccacaattttatgggcacccaagaaaaactcactttggccaaggccagactatggctaaagaactacactccggcg

SEQ ID NO: 3962 - DNA, 158 bp, Homo sapiens
taataacaccgctcagggcctgggaaatggagaaaggaaagcctaaaattatgaagcctctgctggttcctctgggtggactacaccatcccgtgtttcaacatattaatgagtttttgatgtacaaaggttggcctttgttagttagtggtggagac

SEQ ID NO: 3963 - DNA, 173 bp, Homo sapiens
gcctgggaaatggagaaaggaaagcctaaaattatgaagcctctgctggttcctctgggctgctaaaggaaagacttggactacaccatcccgtgtttcaacatattaatgagtttttgatgtacaaaggttggcctttgttagttagtggtggagacaagtcattctgcata

SEQ ID NO: 3964 - DNA, 201 bp, Homo sapiens
tctctaataaccaccgctacagtttggatactttctacttatctgactttatatggacattttataagatgactggacagtggacattgaagccaagaaacacaagaaggaggaagccccaagaggtagaaaggagaaccagaaccgtatcccaggaaaccgtcaagataatgccaaatacttctagagggcaaatacaat

SEQ ID NO: 3965 - DNA, 212 bp, Homo sapiens
tttggatactttctacttatctgactttatatggacattttataagatgactggacacagcagaggagagggggtggacattgaagccaagaaacacaagaaggaggaagccccaagaggtagaaaggagaaccagaaccgtatcccaggaaaccaaaggattaaaaaaaaagtcaagataatgccaaatacttctagagggcaaatacaat

SEQ ID NO: 3966 - DNA, 314 bp, Homo sapiens
attaataacaccgctcagggtgtcttgctttgccaaaattaatactgctactttcaagtgaatgtaggttgtgccagagggtttacagtgactttgagttgaagccaacttggtggcaaagagcagaagagctgcttcctcttcaaagtggacataatctggatattgataagatgacaagaagatctatgactagagcaagatgttttctgacactgttatttttccaacataccactcagtaaaagtccacaggtaaaattatctgtgttggaatttttacaacctggaaaaaataaaggaaattaacaaaa

SEQ ID NO: 3967 - DNA, 346 bp, Homo sapiens
cctgagttttggcaaaattaatactggctactttcaagtgaatgtaggttgtgccagagggataggattattggacctttacagtgactttgagttgaagccaacttggtggcaaagagcagaagagctgcttcctcttcaaagtggacataatctggatccaccagaagaagctggattgataagatgacaagaagatctatgactagagcaagatgttttctgacactgttatttttccaacataccactcagtaaaagtccatggcttagaaaatcctacaggtaaaattatctgtgttggaatttttacaacctggaaaaaataaaggaaattaacaaaaat

SEQ ID NO: 3968 - DNA, 296 bp, Homo sapiens
attttacagttgtggagatatgagagctagtcaggaacaagtgacaacccattatgataaatgcaagaataagtgtgtacccaagagacagaaaagaggtccttggaagcaggtggtgagcacctacttagagagctcagaggaggctacccagaggagatgacagcagaacaggactttgaagaatcagtaattctcatgagaaagaatttggctgcaggcagtctgggcagagggagccacatccacactggcatacaaagccaggaacagaagcagctggagcttgctggaat

SEQ ID NO: 3969 - DNA, 173 bp, Homo sapiens
cggcgctgtgggatgtcagagctggaaaaaccctctagttaccatgacttgattctaaaaacttatatattgagtgtcttctttctatgggtgaaaaagtgaacaaaacaatgtccctgctcgtgtgtaacttctatttttgtggaggtagattgacactaaacaaataaaca

SEQ ID NO: 3970 - DNA, 415 bp, Homo sapiens
gtctggctctgtcaccctggctggagtgcagtggcgtgatcttggctcactgtaatctccacctcccgagttcaagtgattctcatgtctcagcctcctgggtagctgggactacagacagaatttcccccttgttgcccaggctggagtgcaatggcgcgatcttggctcactgcaatatctgcctcccaggttcatgcgattctcctgcctcagtctcccgagtagctgggattacagagctctttgctaataccacatgatgctgactgtaactgaaagaagttaaactgtgctaagaaacaaagagtttaaatagaacttttcctgtactcaaatttctctttttatgtttcttatttgacaatataaaagaaaaaataaacgaacattaacacatttaaaaaaaaaaaaa

SEQ ID NO: 3971 - DNA, 624 bp, Homo sapiens
  misc_feature (1)...(624): n = A,T,C or G
gcgtaatcacacacgcctgtgtgaaaaatctaaatgaaagcacagtgaagaactatgaagccaagatctaaataaggaaggaaatccagtgatagtgtagcatttggggtaatttttccctagcaggaagctcttgtaaacttcacagggctacaggggagaaggtaatctcgtaaacacaacacactttgatttggaaccttacaggagcacaaacttttccagtttgtgacttgtgggggaaggaatcctagctttgaagcatctaaatgtgtgaacagacgttattagtctgctgatggcgtacacagcttaggcctctccctaacagtcctcttctacggcacacgtaggggttattttttatacggngaaaaaaagattctagatgaaaatgaagagcaaataaaaaagtaaatatgtaggtaaatctaaaaaattttaactatccaaaacaacacatatgtcgtatgtggttggaaaagtatgtaggtcttataactagaagtataagtgtcttaagaagttataagttttgaagttaaggtgttcagaaccttgatttccaggaaaaggttaaatctaattaagattcgggacgggtaggtcaaaaagacacaggag

SEQ ID NO: 3972 - DNA, 677 bp, Homo sapiens
  misc_feature (1)...(677): n = A,T,C or G
gcgtaatcacacacgcctgtgtgaaaaatctaaatgaaagcatcagatatctaccagacagtgaagaactatgaagccaagatctaaataaggaaggaaatccagtgatagtgtagcatttggggtaatttttccctagaaggatggctgaggtacaagaagctcttgttaacttcacagggctacaggggaagaaggtaatctcgtaaacacaacacactttggatttgggaactttacagggttacatttctaagagtaagcacacactttttcagtttgtgacttgggggggaagaatccctactttgagcatctaaagtgtgacagacgtattagctgtccccctagtactggctggatgcggacaagttaggcctttcctacagtctctttcggcaacgtaggggtatttttatccgggaaaaaaaaattagataaggacaaggggctgataaatggaaccataaaaaagtaattgggggaatttaaagattttactttcaaaacacatatgcgtatgtgtgganaagttgtggataaaatttgagagatggttatacccaaagtttagggcgaagagtttagttttgaggtgggggttaggaccctgttttccgggaggtgaaacctttaaaatgggagtgaaatacggtgtattccagggggacaaaaag

SEQ ID NO: 3973 - DNA, 552 bp, Homo sapiens
  misc_feature (1)...(552): n = A,T,C or G
attttatattaagtattttttattacttcattttttccctctattaaattggaaggaatacccatattttctctcctactcactcttgctgtcttttttgtacctaccctggaaattacaacatgtaatcttgacttaccgaagtcttatattagtattttaaccttttcctggataatacaaggatcttgaaacaccttaacttcatatacttataacttcttcagacacttataacttctgagttataagccattctcatcatatattttaatcctacatacttttccaaccacatacgacattattggtggtttgnatagttaatattctttttagatttacctacatatttacttttttttattgnttcttcaattttatcatgcacctctgaacatttcatctagaatctttttttccccgtataaaaaaataacccctaccgtggtgccgnnaaaagaggactgntagggagaaggctaagctgtgnacgccatnaagccnntacctaggggnaggagaataataacgnttgtccanatttanaag

SEQ ID NO: 3974 - DNA, 300 bp, Homo sapiens
atgaagcgattaaacttgacatgtttgcacaaattacgatggaataaattgaggcccaccacgcccttatcctctacccaaataagcttgaaccccatgctccagaagcagacaaacagacaaggagacaagaagacgagctgtggcaaagaaggaaagaagagaaggagcatatgaatgccaagaggaatttggctggggacaattggaaaggagatcagccagtggaaggcctttcccactccatcccacctccagctccctatccatcccattaagagcctcctccaacactcaatt

SEQ ID NO: 3975 - DNA, 352 bp, Homo sapiens
atgaagcgattaaacttgacatgtttgcacaaattacgatggaataaattgctgcaaaagttgcctttaggcccaccacgcccttatcctctacccaaataagcttgaaccccatgctccagaagcagacaaacagacaaggagacaagaagacgagcagacgaacggcatacaggtgtggcaaagaaggaaagaagagaaggagcatatgaatgccaagaggaatttggctggggacaattggaaaggagatcagccagtggaaggccaaactccaggcgaagaccatcttcccactccatcccacctccagctccctatccatcccattaagagcctcctccaccactca

SEQ ID NO: 3976 - DNA, 279 bp, Homo sapiens
gaagagaacagtcacgcctcatgatcagctgagtgtgtgagttaagcagcagaatcatgaagggagttgactgcctgtgtgtagagttgcactttacccctctactccttttccatcacctccccttcctatccacaactctcaccgcgaatttccagactggacgcttccaagccagcttacctgtacccttaacagatgtgccagttgggaaactatttcgtgtttctatccttccttaagcaatgaaaacaactgatttctcttagtcaacacaat

SEQ ID NO: 3977 - DNA, 329 bp, Homo sapiens
aagagaacagtcacgcctcatgatcagctgagtgtgtgagttaagcagcagaatcatgaagacattcctgtcctgctggagttgactgcctgtgtgtagagttgcactttacccctctactccttttccatcacctccccttcctatccacaactctcaccatgaaaacagtgcagaggcgaatttccagactggacgcttccaagccagcttacctgtacccttaacagatgtgccagttgggaaactatttcgtgtttctccttaaacaaactccttaatccttccttaagcaatgaaaacaactgatttctcttagtcaacacaat

SEQ ID NO: 3978 - DNA, 808 bp, Homo sapiens
tagatgcaaagaaaggccagcaggagaagcagggacctgaagcatcagccacaagtccaggttggaaccagatggcccagaggtcccttggcttcagacgcacttgcaatattgcctccaaaacaatcccgaggtctccgggtaccacagtgctgagccccccacctccagggcattccctcaggccaagcagttctcgagggccccatccggttctcaaatgggacatctttcaccatccaagtcactcaccgtcatcttcccaagtcggaccccaaaaccgtgctcagttctcacccagggtctgaccttggttaagacactccacagggccagcctctggtttcctcctatggaatgctggtgcaggggatggtgcatgaaagcatcttgcaacaagtgttttcctttgctcggctcctgcctgatccattctgcccctcaagaactgagacaactctcaggaatgtgtaaggtaagataaaaatcagagagcaagctcagggcaaagggaaaaaaaatgagagacaaacaaatccaaaatcaggatgaagtagataaagcccaaacataaaccagtgattgcagaaagcaggctgcaaaatttggctctgagcttctagtagccaaagcaaagagggaaacaaggatggataccggtttgggaaaatgggaaaacgacccagtgccacagaataggggctaccgcaactatatacccctctaaagtcccccattaagaaggccaataattgggccaaaatcaaggccaagggcttgtggccttacccttccctttttcctatgg

SEQ ID NO: 3979 - DNA, 778 bp, Homo sapiens
atatttcaatgtttcactttcatcataagagaactctcccagtcaacatgttcttaacagtctctggggagctactctgccacatgaatcccattcagcatctgtatctggccctagcagttccccgagaagacagatacttgagaagaggggagtctggcacaaggatgagaaaagccaaagaagcatcacaatcatgctataatcctctctgtgaaaattcgttctctgtttggacctgcctacttctctgaagttaaaattttgaaaatcaacaaaacagcaataaaatccctttgtatcctatcacgtttatgttatattataaatgcttttctagaagtccctatctacaggttttctgtgctgaaaaaaatccacaccatataatagtattttactatcttctttaggtgactcatctttgtatcctttttataaactaatgaccagctgcattttatatttaagtaaagaaaaatctttaagaattggaaaaagtaatgggttaataagagattgatttaaacaaattataattaataggaaaataaaaattttaaacatttaaaagttctattgtatataatagaatactatacagcaaaaaaaaaataacaaatgaaaccttctggtcatgtaagtcagtctgatgaattcaaaaaatgtcattttgaatgagagatgccaggcattaaggtatacatattttaggattcccgttatatgaactccaagagtagacatgggaatagaatcagcattagtagtaagtcag

SEQ ID NO: 3980 - DNA, 338 bp, Homo sapiens
ctagttccatacagataactcctctgaggatctgaggaacatgtgttcttaccttgtcctgattctcctatacatcttcttgggagagaactgtgcaacttaaaggctaccttattttgtactgtgaatgtccctggagctccttgggaaaaaagttatctgatttagctactatgtgccttttgaaagaaaagggctatgtaagaagacagcagtctcacactgtgccagaaaaacactccaaactgaaaatgaaaacaaagtttcacttttggctctagtgatacttgttgtacttgctatagaaccaataaaaattgtttatcaaaagggtaaaa

SEQ ID NO: 3981 - DNA, 687 bp, Homo sapiens
ctttgtgacagctaaaatccacttatatttaatctccacttgtgactctttctgaatccattggaagagctccgcatcatttcctgtaccagcgaacaagatgaacaagctgcatctgatccatgaatctcaatttctgggacacatgcccccacccagtctaaaggcccatgagaaaagacggggtcttgaaattgatcaatgacactggaaagagaaacattctcttcctctaattggttatgctgtttcttttttccccttctatcaatgaattattcatttttcagaggtcatttctgctagttccatttctacacacttgcatgcacacacacagatttattatataattttctgcttaaagattacttaggttcttgctgtgttttgctatcagtgaataatactttgattcacacacggaagttcatgtttttacacgtttaagaatcattatagaataacatgctagaagtataaatttgggggcaaagaacaaatctgacattaattttaatgagtaatgctagattatcccttttccaggagaagctttaacaatctacaattccacgataacttcaaagagtgtgaatttttctatggcctagacaatactgggtattaggtcgttcagtgttgtcaatgtaatgaataaaaaaaagttataatgttgcattaaaa

SEQ ID NO: 3982 - DNA, 879 bp, Homo sapiens
  misc_feature (1)...(879): n = A,T,C or G
tttggaatcctgtgaaggacacaagtgaagaagcccgtgataacctgctgaataaagagagatctgtggtccagtcacccctactgcttccgccaatagcctaagaaatgctggataagtgagtgaggctatccttggtcatctctgctagctgactggcaagctgactacaacagcataaaagaacccaatggaattggagagctaatgacccataaaactcagagttgatattttaaagtgctttatagttttctttttatatatgcaccactatagtgtccattttcaaattattcatctgttgattcctagggaaaattaatagtctataacataaagttcctttaaaacttggatatgaagtctttgtagtgttacctttttttagcagtggagtgaataacatcaatatatctaattaataccaatagagattttcccccatttgaccaattataaaaatatcattaatatttttcaggataccattgtgtttgcataaagggcttaaattataaaaatcatgtacttctttgcagggaggatagtgtgaacattgaaagatcttgtcaagtaggttccatggtttcctccagacatggggcaagattaacattgcgggtttaaactgataccaattcttttcaacaaaatgatgaaaatagacgcttttagggaaaaatagaagaggacagagtaaatatacggacctggctcggccctcagacggaggaggactcatctggccccttcactttgagatgaggggttaaatgtaatcgatccattacttcaactgacctatgttggcgcgttgggncgtatcangntagcaggggagacgggtatgtactataaatacagaggcgagggaat

SEQ ID NO: 3983 - DNA, 257 bp, Homo sapiens
ctaggatcatctcaaagatactgctaactacctcccaactggtcttcctgtcttgagtttcgctcatctctcatccatttcctaccctgtcttgatagcaggttccagagcagaagaggcagaggatttaagaatgctcctagaagaggaccaggagaacttcgtggatgtggaaagggcctacaagggagccaagaagcacccatgagcatcttttttccataagccctttgggtattaaagaggattgaaacaaa

SEQ ID NO: 3984 - DNA, 699 bp, Homo sapiens
aaaagctgcaatcacccgtcttctgcgtcgctcacgctgggagctgtagaccagagctgttcctattcggccatcttggctcctccggatagtgtttattgaactggagagaaggagagatggctacagtgcagtggtgcgatctcggcttactgcaaactccgcctcccgggttcaagacaatctcctgcctcagcttcccgagtagctgggactacaggtgagaagaaacatcagaagcagttgagagactgagaagtgggttctctactgatgaaaaggcattcttctggatggctgttaaaaaatgtttcctagagtcatgtgcctcattaacaacagttgtcgccttagaagtctctctttgatttgttgattgtataagctgacacaatttcttgttatgaatgcatgctgttctagtccttcaataagcccattatatattttcaccatgtcatctataggcacttttttctacagtgttaacaatgccagcttcattgtcactattgatcaaaatcaccttggttcagaattattttggctatctcaccatcagtcaaggaatgaacaactgaagcctcattactgatgttaaaaacttcaatatctactttttctagctcactgattaaagtcatatttttgaaaataaaaacctggcctcgttggcctcagcggggagctctgcggcgg

SEQ ID NO: 3985 - DNA, 792 bp, Homo sapiens
ttcatctgatgcgacacagtcacaaagaaaaaacctaattggcttctggattccccacatttgaggggcaaaaaatcatagatgaagaaatcagaaaaacagaatttaaaatttataaacatattttaaacaagatcataagaaattcaaaatagtatacataatagaaacagcatgtggggaagcatatagaacaatgtgtccacccctggctggtttctgcttccacctgctgatctcacagaggtgaggtgataacagtgatgaaacaaaatcttcaaaccacagcacagtaagaagatgccgagtttatatgtggacactgcttttgtgactatgactattgttgtgggtttccttgctttccatctcgccagttcccttcttgacattgtacagctatttcctttgtaatacagaaactctcttacagaatatttccacagctggctttcatcacttcttgataggtacctaaatatttcagttttttccactttattttcctttaacaataactgctgcccaattaaataattcatcttttcccctgtataagtatttgtggtactgaatgaatgtttatcaagcaccatttggaatctcctattttctctggcttggctttttcacagactcttggtctcaattacacatggcagtttgaattaagtgtatttaaccattttaaaattaagaatgagtttagagtttgttttagaattttttctaccccatagagatgattgtgtgtaaattaaagactaactttaaaatctaaaaaaaaaaaaa

SEQ ID NO: 3986 - DNA, 808 bp, Homo sapiens
ctaggattatccttgtgcttatcaggaaggagtacgggaaaacatgtctacactctgttgacttgactggaagatcaaaaaaataggaaggccgatttgtagtaagagaatgaagctgacccacagagaaaaacaggaatgagaccccaagagaaaatggggaaagttcttccttggtatacccacctctgcaatgaagatggagtgaaggtgctatttgttctcctgctacttcttattgtgtccaagatgtgctgtctgcctacaaacatccacaaagaaagcccttctcttgccttctctgaagctccaggctctctacccactgacctcccttccaccacagacactcagagccttcaaatgaaaaaggccatttctctacaagagtcagtaattgacacacacacatgaattgggtacctactttgcctgaattcaactacaaatagaaatgtaaacaaacaggtgcagactttctgtggctgatgtgtacatttctgttgccttatggatctattttccaaaacagagcagtaattgatggtgttattgctgtcgttttatgattgctgttgttgttttaagattgctaaatttctgtaaagacatgaatcaggtgaccagttgcatcagggttttataaaccactgggtgaattagagacaaaactcatgctcattggtgagctggaaccatctttgatgagataagcacagaaattgagagtagaatttggttttttctataaatgcttaccagtatttgacatttctacaccatttaagctcatgaccaggggacttat

SEQ ID NO: 3987 - DNA, 195 bp, Homo sapiens
ctaggtcccggtttatgactgcataacaatggtttaaacagtattcattctggaacatcactcaatttcactaatactagatcccaaacactctgatatcagaatgttcttccctattcgggctagtttatatagttcatttgagagtattctgaaattaaataaaacaaacctaaaacagtaaaaaaaaaaaaa

SEQ ID NO: 3988 - DNA, 734 bp, Homo sapiens
  misc_feature (1)...(734): n = A,T,C or G
tagatgggataacttttctatgaagacaaagaggatgacatagcagtcaaggaaaatattagaagatatttcttgcctgtctgttcaccaacacacttctgcaaggcccaggcactgtctgtgtgtttattgaggatagaggaccaaaagaaaatggtcttttctttaccccaaaggaaattgtattccccttcacctcacctctactccaaggaaaagaactgttttctaaccaactgagggctactttgtattttaactttattaggcctttgtgaaataaaatgttcagtttttggcaatgttttatatcatcatgtggtgtgagtcctaaattcaaggccccttaatatgtgctatcttgatatgtgctgaaattgggagggtctccaacggcctaaacacaagttctcctcctgactctgctcccaagaatgaggtcccctaactaccctccttatcaagggcaccagggcagttcctgctttattccagagtagcagatttcagttctctgccagcccatggaattatttaaacaagccaattacatcctcctgggaaaccagggatcaccccactctntgaatacctcanagtctgcttcccagagcccttcgttgtgctgtctgtacccaaatgtaacccccatgtgggcctgtttagcttgccatgtccttctccccaggctgtgaacatctgtaactaataaactgctgttggcctcatcaaaa

SEQ ID NO: 3989 - DNA, 182 bp, Homo sapiens
ttaggaattggagggaaacattatttacatgaggaaaaaaagaagaaaacaaaaagaaagaagccaggtactggtgccgcagcctgcatttccaaccagtggttccatatacttgcagatggatggctgctgccagtttccttgggggtagatgctaaaaataaaataaaaacaaaagaaaa

SEQ ID NO: 3990 - DNA, 407 bp, Homo sapiens
tagtctccccccccccagtttgttctcgggacaaaccatcggtctaggatgaactccgttttccactggagggtctcaagaggctaaaggcaccccacgggcttctccccgaggaagggactgaggacagaggagggccacggttgcaatgaggacagctccggctcaaaagcgtccctggacccttgactctcagcttgtcttgtcttccttaataaatttcagtttgcgggggaggggagagggatagcattaggagatatacctaatgctaaatgacgagttaatgggtgcagcacaccaacatggcacatgtatacatatgtaacaaacctgcacattgtgcacatgtaccctaaaacttaaagtataataataataaaattaaaacaaaataaaaaaaaaag

SEQ ID NO: 3991 - DNA, 812 bp, Homo sapiens
ttttgaaataacagtgcaaattgcagaatgcaccgaatccccatttggaagtgccagaaccagaagttcaactcatactttgtcttcaataaatgcaatccactgaaacttgaaaagttggagcttttgggtctccattcattgaatattttgattaaaaatctccagttgattttgttcaaaatacaaacaaaattacaacctatcctttaaagaatatatttgtatacattgaaaagtgaagcaaagaaatataatgcacaccaccacattgaagtatgtttttttctagccaacatcagttttgttattaaaattttgaagtccctgtttatttgaagaatatttttaataatatctttggcaccccttaaatatctgtaagtttatactagtgcaaatatggccacttggttgactaaattaataaatcattttggcttcaccaccaaaaaaaaaaaatgagtctcggtggcctaagcggtggaactctgacaacgcttccttttattgagggttaatgtatgaacctcgcttaatgaatctctgcgctacgatcattctctgaggaaagaggtatcatgtctctcaaaggtggaaattcagttatacacataaagatcggatttaagcattaataatctttgtgattaaagttcattaaatgttaataaacatatataggacgcgtttctgatggtttaactaagatcattccctgtgaaaaaataatagagttaactataaatttgagtaagtaaaatcagaaggattctaattatcaaatatatatctcataaatgtacctatgg

SEQ ID NO: 3992 - DNA, 962 bp, Homo sapiens
  misc_feature (1)...(962): n = A,T,C or G
tgttaatttattttattttatatataaatttttatattttttatttttttttattttattgtgttcacctacagttaaataatacatccatgcctgtacgttgagtgctgactgaacaccatgaactgtgttataagttaaaagttaattgattatgccctgagtcacacagatggagaagtgtacggaccaggaacatgtgtatctatttgtgtatatgcccttattcttttgatactatgattttttaatgtgttttttgttttcttcaatatgacttttgttgtgataaaacattttatttgtttctataagattttatgttttagtttattttatatgtactatgttttgtgttattttattcgtttttttttatctattattagtttatattgtgatttatgtgtatttgtactattattgttttacgttatagttaattttcttaggtattgttcatatataattgcatataagcaaggatttatgtcgtaaaatatattaattttgtgtttaatttattttgtttttttttgttttatgttagttatnttattttatttttattaatatttattgtcatatttatttgttatgtttgagtgttagtacgtatagtctttcgtataatagtatgttttatattgttccttaaatgaatcacatatatattcattatattgcacgtaaataattnttatatttattaatatgttatactctattctcttctttttagtgtgttattttctatgtatttttgtgcatagtaatatattatgacactctacaatatgtattttttctcttattgtgatttttaacttgttttagttattggttttaagtgtagttagttatttgttatattggacgtcaatagatattaatatatagataattttntacatatttcatntatgtaattgtttataataattttcattaaattatgtttt

SEQ ID NO: 3993 - DNA, 809 bp, Homo sapiens
gagataaagccaaaatgtcagaacctataaccttagagaagattatggagaggcatgttgctctaccttgcaacctctaatacaaggttaaggcagatggagtcttgctctgttacccaggctggtaacagagtgcagtggcacgacctcggctcactccaagctccgcctctcgggatcacgccattctcctgcctcagcctctcgagtagctgggactacaggcgcctgccacaatacccggataattttttgtatttttggtagagacggggtttcactgtgttagccaggatggtctcgatctcctgacctcgtgatcctcccaccttggcctcccaaagtgctgggattacaggcgtgagccaccgcgcccggccaagatgatcaattttattctccatagctttcaattaaaaactgctacagatacaatttattttgtcttatctggttgactatatctagatcatttactctattggacccttcagttcagagtcatttattatgtgactttcattcatcatttttaggttcttgctattaatacttattaaacatcagaactattctcgacagtgtgcaacattcattgtaatcaaaaatttatttaatgcaccaaaaccacttaaaatttgttttcataaactattttgtaaaaaataatctgaaatactatatatgaaaagaatttacacttgaattataattatgaaatatttgaccacctacctttggtaccattcataaatagtaaatttgattcaggcaaatggaaaaaaaaaatccggcctctttggcctagc

SEQ ID NO: 3994 - DNA, 398 bp, Homo sapiens
atagagtctcgcttcttcgcccatgctgaagtgccatggcgtgatcttggctcactgcaacctgcacctcctggactaaagaagctgccaaaccatatgcaaaagtgaatatttcaatcagcagttcaaattcctctatatacacaattaaatttaagttcaatatgtttaattttagttattcaaatagatgtgtagtggtgtatcatgcaatttgagttgacatttttctaatgacaaatgatatcaaacatcttttcttgtgtatattcatatacctccttttgtcctttaagtgacttcaaatgtttagcattttttctgggttgttttcttatcatagaattttgaattttgagggttctttatatatttgaataaaagtaatttgtatgaaa

SEQ ID NO: 3995 - DNA, 745 bp, Homo sapiens
tagatgcacgatgtgaggccattcaggcaacttatggaaggatgcacatagtgaggatctgaagactacagttagccagcaagtactgaggtctgctgaccactatgtgagtgaacttggaaatggatcctccctaagtcctatgatcagatgacggcggcccctgaagaagagtttgactgcaacctcgtaagagaccataagccattaaaccatccagctaagcccctacgacttccagccctgtcaaagtgtgtgagataataaatgtctgatcttaaatggctaagttttaggataatttggtacacagcaataggtaactaatatattacaacaaaaattcttattacttttctgtggagcatgtttaaaaatagtgatcataaagtgtttttacgaatgcttgaaataaattctagagatggtctcccttaccaatggagtatctcccagtaaacttaagatgcaaatttgtgagtttctaaaaaattgccttttcacactaatttcaaaattagactggaaggtgagcaaagcatcatactgtgtgtacgtatcattcacagctggcttttttctgtgagtgctatctacaggagaccctgcttatccactgggggtatgtggcaagacccgtgatagattctgagatccatggatagcgccgaacgctttttgtaatgaggaggggcctgtgtttacctacagtaaagggtgattgataaaatgggggcgttgggag

SEQ ID NO: 3996 - DNA, 831 bp, Homo sapiens
  misc_feature (1)...(831): n = A,T,C or G
caaccaacactcgccacccataaaacaacaatgacaaaaattacgcacactttaggtgtaacagaaccacaagctcagcctaaagagcagtgagatccaaggctacacgcaagagctagatagacccatcgttgaagactccttcccctggggccttggcaagaggaggagataaggcttcaaaggatcattgacggcttcatccacccccctcctccaatgaggacaccttttatgtatctatacttataaacattaaatacagttagattccaaaagaactctccctaactgtagctgttaacggaatttcttgccaaagtcattaactgataataacattttttccttttctaggtataaaaccagacttggaccttggatgatgatttaggcaatagccactccatctaattaagaaagaataaaagtttattgcacttctttttgagaaatatgtctaagtcgaaggggcatatatagagcaggcttttgtgtatctaatgctaaaggtggctgtcatcatgaacctaggccaccatggacacctgagagggaaggggacagatgtttctcattgcatatgtcacagctgactagaatgagcaccatttggaataatgatgtaaatggcatgacacgcctgactgntttgcatctcttgatttaatcatgggaaactctctctagatgcatatgctgactaatatggacatatccaccttcaaaaaaaaatttctgcctctgtgaacttagggtcttactattcggacgcttcctttattgagggtaatgtatgatccttgcttactgattggctgggctcggaac

SEQ ID NO: 3997 - DNA, 763 bp, Homo sapiens
  misc_feature (1)...(763): n = A,T,C or G
gtgctgactgacaccaggaactgtgctagaagttagaagttaagtgatttgccctgtgtcacacagttggtgttgtgtaacggaccaggaacatgtgtacctatctgtgtatgtgcccttctccttgggatactaggaataaagaaagtgatcattgtctacgtggaaagcatctgcctctgtaaaaacgttatgcatgtccggaaagactctgtgggatctgtgagattactgcattgttcaaaggccggctctgaaagaaaagtgtgccaaaacgaggaacctggggcgaattggcagacaaatggcgacggactggtttataatgggcaggatacaagagggtgtgctgaggttgtggggaataaaaccctgcatgttggttggaactgcgttgagtctcggacggtagatatcagaggagagatggctgtataacgtccgtctgcagcgggtagaacgagatgcagccaggggacgtgaagcgggctttagggttgtctatgtactagtatgtttttatggttataatgcatgagagggacgagtgggtgtattgtatattcgttgatggatggaagttcaaaagttggctttatctgtgggttaatgttttgggtgtgagggggggggttttttttatgataaattaggactttatttaagtatgtcaagattatgtatncattctttattggtatgtcgactgttcgagtgctgtctttattataataatgttgtaaatataccaatctattcgtat

SEQ ID NO: 3998 - DNA, 215 bp, Homo sapiens
gaaaccctgatctctcgttgaaggctaataaaatcaaatatgagtgtgaatgacactgatgcctgtcaatgggattaaagccttctacaactttgagaattcaaatcacagaggaaattaatctagtctctttgaaaaggtgtgatggatcgatagagatattcagacttccaatttttaaaagtgtaaattaaaaatgaaagattcaaataaaa

SEQ ID NO: 3999 - DNA, 166 bp, Homo sapiens
aagcagtacttctctctgcccggtgaggtcacagcgtgaaggccctgtctacaagccaggaaacaccctcgccagaacctgaccatgccggaaccctgatctgcgactttcagcccccagatctgtgagaaataaatgtctgttgcctaagccaaaaaaaaaaaaa

SEQ ID NO: 4000 - DNA, 339 bp, Homo sapiens
ctagagctaacaaggtgaagtaattgaaagcgctcctttcttttcactctgatctgaaattgcaacaggctgagtggagcgggaatgagcctgtgtgttgctcaagctgtgaagagccaagttacagaagaggtagaggaaatatgacagggctcaaacaacggctgctgaattataatatttctgaaggccctaaagtatgctctttcttccctcacccccttgcccctgagccagtcagggatgagactggcagagcactactactacatcccttctgctttctgtcataaacctggaacactctagcatgattaaagagattcaaacaatgcaaaa

SEQ ID NO: 4001 - DNA, 194 bp, Homo sapiens
ctgggtcttgctgtgctgttcatggctggagtgcagtggtgcaatcatggctcactgcagcctcgacctcccgggctcaagccatcattccgcctcgcttcccaagtagatgggacttgcccggcccgaagcggaactactgagtttccttattttggaggcagtaatcaaataaaaaataccaaaaccttaaa

SEQ ID NO: 4002 - DNA, 305 bp, Homo sapiens
cttgggtctgcaatgatggaaggtctatctcacaggcatggaggcgaatggtaggagatcctgtcacagaaaagagaccagggtctaacacgggaagcttcaggagacctgcaacaagaagcacagactctttgccagagcatgataccaacttggacagtgatgaatgtcagctaggcgtagatcatgtccaccaggcaggcaaattccggattgctggattgataatggttcaaaaaaaaaaaagaattattagcagatactctgcttcttcagctatacatagcaatcaggaagttacaaaa

SEQ ID NO: 4003 - DNA, 219 bp, Homo sapiens
ctctgggggacaggaagcgtggttctggcatctgctcctggtgaaggccttaggaagcgtctggtcatggtggaaggcacagaaggagcaggcatatcatatgaagcagcatggtgaaacagaatcaatgtcctctagacaaaatatcattaccatcggaattaaaaatgtatccttaattttgctgtgttaataaatggctttatggttactgtaaaa

SEQ ID NO: 4004 - DNA, 568 bp, Homo sapiens
acacccacaacaaacgcaaacataacattgaacaaccggcaaacttcagcaaaacgcttggacctggtaggcgaagtttgcaatgagccgagattgcgccactgcactccagcctgggcaacaagagtgaaactccgtctcaaaaatgaaaataaaataaataaaaatgaaacggccttttaagaatgcaattattaggcaacgtcttcaaaagccatgaaaatgttcatatgctctgatgcacaaactgcttctagaagttcatcttaggaaatatcctgctttacttgtagtttggtaaagtttggtttattgcatccaggccacttggacaaatgaattttgtggtatatgtcacaaactatgctgtagaactgcattttatactgtcttagagacctctctttgttcacagaagtttagagaataagtatttgtggaatggagaagaaagaagttcaattagggtaaaatcacatcttatcaatgttctatagcaatgtcagttaccatttaatgagtatcgataatgatagtgaaataaacgatatgtacttaaagggcaaaa

SEQ ID NO: 4005 - DNA, 134 bp, Homo sapiens
ctagatgcgctgactgcaagagtctatcgtggatggaaatagagtttgtgtatagagtcactctgttgctgctgtcggtacagatcgcttccccaaggaaataaattacatttcattctctaaaaaaaaaaaaa

SEQ ID NO: 4006 - DNA, 542 bp, Homo sapiens
agccatgtgaagacacagcaagaaggcagctgtctacaagccagggagagaggcctcaccctaaaccagccctgccagcattttcatcttggacttcaagcctccagaactgtgtcttctagagaaacccaagctaagacagagactaaaggacaaggaatatgaccaaggtcacactgctgttcaatgccaaagctgggtctatgtgctgactcctgactccttctgccaacagctcattctactgcccagcacagagaactttcatggtaatcccaggcccaggtttgcatgagagcctttccctgtggattcaaagaaagaggccccctcacccttagtgaggggctgggccaagcctgctatgtgagtgccaggactagggcccctttcttttccttcaccactgtgcttcatccaattactgggtccttgcattagcactgcccatccctggggcattacttctaaaccatttctcaccacctccctttggagcgggcttacgttcacctcccaagacagacaattccagctgaaaa

SEQ ID NO: 4007 - DNA, 755 bp, Homo sapiens
cagatctgccctcaggagagaatgcaacagtccgagatgtgcttccaggcatgcagagaggcgagggctcaccccaggtgcaaagcctgctgctgtctggccaatctccacctgcatcaaaggccatccacatcaggggctggcgccagtgggcacagctggctctcagaccaaccaagtcctacaccctctttatcatgaataaatgcatgataaagaaagtgatattttcatctccgccatctgcctctcttgaccgactgtgcccatggacaagaaacaagaagcatgccctgttgtacctggtgaccctggtgcccaactgtttggttgacccgttctattgttttgtcttctaagcatttacacttatcaaatttttttccttctacttttactgggtttgttctgtctttctccccaaaacttcttaagttgaacaattaaaacaatatcttaaagagtacctttcctcttcaccaacataggcatttaaaactgtaaattcccctgtaattacaattttacttgcatctcctaagttctgatatgcaatattattttagcattcagtttaaaatggttacgcattttcattttgcgggcttaattgactcatggaataattagaagccccatttaaaattaaaaaataaaacccgttcaaaatggttgttagggaaggggggaatgaattccggacttggggattttgggccaaaaaagcttttaaattaaattagtacccgttccct

SEQ ID NO: 4008 - DNA, 257 bp, Homo sapiens
cgcccgcccccccacccctaaaaattaaatataaaaacaaacttgaccccataaccccgttcaggtttggcaagaatacatctaccagctgggtgcagttgaacaaaatcattacaggattagcagttttctgacccacttactaaaaagaagctgaatcactgaatcgagaccccagggaaatgcagatttatacctttgatgtatttcttgatttttcttaaattaaattctataatcagttaaaaaaaaaaaaa

SEQ ID NO: 4009 - DNA, 441 bp, Homo sapiens
cctaggtgatctcatccatatacaatggcttcgaccacccatggagtgcatcaccaacttgacctctccccaataccccagacttgggtattgtgctgcctgctggatgcctcctgataaatacccgggatgcaccaccttgccctttgcagccctgatgcagtctcacctctgtctgagaatgacacctcaaccacccagtaccagatgactaggaagcactctagactctgccctctccattttgttttgttttgctcctcatcataggaggtgccaccaggctaacctgtctttgtgaaagaagaaacaaatcaaccttgcacaaccaacagattattaactgcctttgaaagagcactattttgacacaaatggatcacctgtccttgagataagcataataaaggaaacagtgacatccattaaaaaaaaagaaaa

SEQ ID NO: 4010 - DNA, 351 bp, Homo sapiens
ctggagtgcagtggagcgatcttggctcagtgcaaccccttcttgaagtggggggtgggaagaaatgtgttttcaaagagcttaccatggactcaactttgccaaggaaagaatcaatgagtttgaagatatgtcaatggaaactttgcaagccgaaatataaagaggaaattaaaagtggaaaaaacttagaacatccaagagctataaaacaatttcaaaatatgtaaagattaatctgtttatctcttctgaatgcttgacatttagtaaatttaatgaagtatatctcattatcggtgattctctattcatttttttatgaaataaaacaagcccttgaaaacaaaa

SEQ ID NO: 4011 - DNA, 715 bp, Homo sapiens
cagaataagggaacagggaaggctcatgctactggtgctaggaccacactttgaggatcactaccctaggaagcttttgttttcacagagtggtgtaccttccaggtacctataggatcctgggagcacagagccaatttttccaagcccatcgacagatctaccctgcctcctataccaagacagggtattcccagaagtacaatccctaaggacaaatatcctgacctctccgcaaagtcattcctctcagaactaaaagaggttactcacattctcaggtgaatattttcaatgccttaggaaacaagcatgtgctgttgctattcttttgaatgtcctgtgtatgattatgttggtcttttttttttcatccactctcttatttttaaggccaaatacgagaaaaaaattggggctagaataaggacaatgaaaaacttgggccctgtctctagttccaacactacttgctctgtaaccttaggcatccaatctctctcacttttacactcgtcattcataaaataaaatgcccagtgaaaactgactgcagagttctatgccacagattctgatgctcagttcagaagtttacataattccaaaacaagtacatcagaagaccattgtcaaaccagtagtttcacttaaaagttattccatctgttcagtgtttgctgggggttaaaaaataaaaagctattactgaaaa

SEQ ID NO: 4012 - DNA, 905 bp, Homo sapiens
acgtatacctggaagaagactaagttatctatcgagaaacctcaaatggtgatggaattcccccaataaagtaaacaacacatttgaaaagtatattgagaatttccattgtgtggacaagcaagacaggctggaatgtagacatattggttggagctcatgaggctatattggaccatgatgtggaagccatgtgtaaaaatggcaggcaagaggaataacaaatttaataaacaagcaaaaggaccttggcttccagagaccatcgagaataattccagtcctgaattgcaaacctacagatttcttttataacatgtattcacaaggaagaactttgtctcccaggaaagcatggccgcgttgtctacagtggtgtcggaaagaatcactcctgcaggccacagttcattatttcttaggaaaactgaggttaaaaaggacaggagtagttctccaagaccaaagtcaattcaccagaattaaaattctcaaaaatatattgttgggagtcagatttttgatattttagaaagcaagttctctgactgagccaaagggacttaggagaaaggcaaaaagactttgtgaaaggaacagtttttgagtgccccttgatgtcccagaccttccaaagaaaacaaacaacgaccctaggattattgttacctcatcggcttgtgcatattggtatcctctctggccagggaagtcaccacccaacatcttaaagtagtaccgtgctcctggtatatttggttcctgtgtgtgaaatgcttgtttctactacacatgggaggtgacaagacaaaatgttaaaaaataattatttgtcctatattgttaatcatcaaaaatttacataatgaactgtgtaaaattaattaaaattaatgtaatgaaaa

SEQ ID NO: 4013 - DNA, 251 bp, Homo sapiens
ccccacacaccccaccctaccccaaaccatcccactcaacttaacctcattacattctgtttggaagatgaaaatgacagctaagtggtgtgatctaactgacacagggaaagaagctgaaattgaccactcaggaaatgaggcatgtgttaatgattttcttttgactcattgtttttaaaaacatccacatgcaatcaactgttgtctataaaataaaataaaattcctaaaaaggaaaaaaaaaaaaa

SEQ ID NO: 4014 - DNA, 279 bp, Homo sapiens
ggtgggtttctggagaaatcaactgtcaacattctgcaaaacaatcactgactcaaaaaactcaggaagggagtaaagataattaataaaaccactaatatcacattacagccaattttgctttcatgtggctaagaggtgaaaggacaaaacagatcttggagatgccaataaggtttcgtgtgcttctaaagttgcaagcaagtaataatcaattctctcctgaaggaatgatggaatgaagattaaagagttttaaaaaagtgaaaaaaaaaaaaa

SEQ ID NO: 4015 - DNA, 279 bp, Homo sapiens
aggtttttctggtgggtttctggagaaatcagctgtcaacattctgcaaaacaatcactgactcaaaaaactcaagaagggagtaaagataattaataaaaccactaatatcacattacagccaattttgctttcatgtggctaagaggtgaaaggacaaaacagatcttggagatgccagtaaggtttcgtgtgcttctaaagttgcaagcaagtagtaatcaattctctcctgaaggaatgatggaatgaagattaaagtgttttaaaaaagtgaaa

SEQ ID NO: 4016 - DNA, 577 bp, Homo sapiens
agaatttatataatactgccttgggagaagaaatcagctttctaactggccacatcacaatacagcttgagcgaaaaaattctgcattttttcttgcacggtggacaactactaagcttacttaagaccagcatgaactacaagactacatatcaatttcacttgtacttgattacaaaactcatctgtgatgaatgtaaaagaatatccacctgttgtactgaagagttttgcaaccaagtatcaaaaggagacaaggaagagaagcaggccataagatcgtcatgtgagaggtgcccttcccaaaacccagaggaaaaaagcaactgtatatctgaaaatggaaggacatcaaaaggaatctaaataagaaggccttgctacgtttccttcggtttactactcttagcacatactcttttttgtcttatcacatttttccaggactgtccattcttcatcgaacctataaaaacattcagctttaattgtttcctcaagtcttcatttccttatgaaggaaatgtgtcacataaaatttatattaaataaatttgtatgcttttctttgttaaaa

SEQ ID NO: 4017 - DNA, 531 bp, Homo sapiens
taggtgacggactgctgacttaatttaagacatgatggggagcaccattctagcatcctttagctcttaaagtccttaagaagcatgcaaaattcaacctcaccattacaataagatgtttttgtgactacattggtgatgtaatttgtgagtgatgtctgaggagctgcgctatttggatgtcctgaaacacacagtcaagtcatcactctgctcagtgagatagatacacatctgattgcctcctgtggaaaagcttatcagaaaagcaaaataatgaaaccatttgtctctcacctacctgtgacctggaagctccctccctgtttcgagttgtcgctgtctttctggaatcaatgtactacttaacatgtattgattgattgatgtctcatgtctccctaaaatgtataaaaccaagctgtgccccaaataccttgggcacatgtcatcaggacttcctgatgctgtgtcatgactgtgtgtcctcaaccttggcaaaataaactttcttaattaaaaaaaaaaaaa

SEQ ID NO: 4018 - DNA, 267 bp, Homo sapiens
ttggaactccgggtgaggacgacaagagctgagctcgggtgcttgccttctgcactctcgggaggaggcaccagcatgggcacccttcacagttcgggcccctcactcacaaacgtctggcacatggaaacaagctggcaaaaagattgtttttttcttctgtactttttgttataagcctgtggtgaagtgtccatatctggcataaatgaatgtgagtggtcttgggaatctaaatataacatgtttctaagttacacacagaaa

SEQ ID NO: 4019 - DNA, 1092 bp, Homo sapiens
ccaggatttatgattgaaatagctgggggatgatgtgactgaacaaactttgatatcagatggctaccagatcaagaaaaagttgggctctttcttgaagcaaaagaagacaaatacaagatgaacaaagaagcaataatgatgcaaaagataaatgaggtgatagtctacatttccaataacttcaagaaggaatggcagatcttgactcctgaaaggttgaaggaaaacagtgaccccagaagtatcaaatagtactaactttcgaaccatggtttggcttcaactaaactggttaacactggcctctgctactattaatcaaaatcagatgacctgagcaagtcatatcacctaattaaaccttatttacttcatataagtaagtgacagagtcagaataatttgtcatttttatttgctagatttgataccaaataccatgaaatgtgaagaaaaacagaaaaaaagtataaagcttatccagaggtccaacaaatctgtaaaggtagaaaaattttagacaagtaatattggtctctttttatatcatttttgagaatttgcttgaggtggaatgaaaataataatggaatcagaacttttccttcaaaacacctaagcccattgttttctctctatgtaggtagtccaaactagactacagctgtttccttttaatggcacaagtatcatctatgtctgtcttttgcaagttcagtgatgatgagctgtgtatatctggttctcagttatatattcccggaaattaatataatacctagctcttaatgaatatgcaataagtgtttgttgaattagtagaatagataaatcacaacgacaaacaaatgcatcttaaatcttttttcctaatttggtgaaaaatagtgtcaactggacggctctaggaaatgacaatgtcaaatattctactggagtactttgaaatagatgtatcttgatttccacgcagttcttctaatgctgttttgcttctcttttcttaaatgcctcggagtttgaagataatttggggaatttgagaaaaatctatccaataaaggccgagctcctcaaaaaaaaaaaaaa

SEQ ID NO: 4020 - DNA, 280 bp, Homo sapiens
agataatcacccactctgctcctgcaagaaaacaacaacaaaacaacaacactggaaaaccacaaaaaataacttgctttgcgtagaatttgaatttatttttccattctatattttaaatttattgcaacagcttgtaatgcctaacaaggacatcttttgtaaaatttcaatgagttaggaagtttttctttgttgcttttagtatgcaaattgccaaatttaatgtcagaaaattaaaaacctgcatcaaaaccagaaaataaaaccaactgcaaaa

SEQ ID NO: 4021 - DNA, 910 bp, Homo sapiens
ctctacgtgtatgaagttatttaatacttataacaactttatgaggtcctggccccattttaacatctgacatcaacagcttttcttgggcatctgcagtctgaattgatgaggaaactggtttgtatagaagataaatagcttgctcaagatcattccaagaattagtagcagaaatggagtattaacccgagagttgtcaggcttcaaatatattctttgagtgttttttctatacctaaaaatttgacactaatatgacacaaacattggggcttcttcttttttgtcgatgggaatctttctaccatgatgtcaaaaaacttgggctggcctactggaagataaggacatgaggcaagaaaggccccagctgttctaaccaagtcatcacaactactccagctgaggccccaagcatgtgattgaggccattctacaccaccgttgaggctggatcagaagaccagtctgaccagtctacacaattatggataatgcagagatatagttattcaccattgtcttatgcaactaagtttttgggtgacttatacatcagaagctgactgatacacacgaagtagtttttgaagtgatagtttgaattaaattgtaaggaatgtcttagaatcattacattggagataactggcgcaattgaagtgaaagagtgttaacttcaaattcaagtacgatgacctatacagtaatatattacatatcctgtactatgccaatatttttcacatgcttgatcacttttagtccttatcactgtctcatgaggtgaatattggttatctctattttaacaaacaaaccgaaaattaacgttagtaaagcaacctatctaggccaccaacacttaataagtgcgggtggcaggatttaaatccccagggggcta

SEQ ID NO: 4022 - DNA, 230 bp, Homo sapiens
  misc_feature (1)...(230): n = A,T,C or G
cgcgcgggcggacgcccacaccgggccgccccactcctcgggatacctgcaggaagtgcttttggaaggaagacctctgaaaatctttttcttaatatggaactggggaaactacccgaggagtgggcaatctgaancattttactcaagaaaatggctgactcttgggacatggatggaactggaggccattatcctgagtaaactaacacagaaacagaaaatcaaaa

SEQ ID NO: 4023 - DNA, 358 bp, Homo sapiens
ctggactatgaattgaagaaagtgtaatcagtatgctgccaccctgccacttcttcttgaaatctggaaagctggagaagttactgacaattgtaacccagtgataaggaaccaggaattgagaagctgctgttgcctctgttgttgatgcatctacctcttggcacacaagagtctggtagttggacactggaacacagaaaagaagactcacatatccttgtttttgctagccatcagaaatggcaataaaataataataataatgaagaaacatggcttctgcttcactaagaaagtactattgaattactattgaaattactattgaattttaaaaagtggtcagtatagtaaa

SEQ ID NO: 4024 - DNA, 529 bp, Homo sapiens
gcgaaactactttctctggagtgcccaatcctctccaatgtgacttggataattctcaataatttaagcaacttggagtccaaatgttttttgccagagactaatttagagtttgccaaaggactgtctctgaccaatgaagaagtgaggggtggtctcctgggagcttctttgaaaggttccctcactacacaaagaacatgaggaagaaatacttgctcttttgaatgttatgttcctgtatagggcacctaaactgatattgccatgggcatcaatgaaggacattaggcaaaggcaaagacagcatgtagagaaagatagaactaaaaggcagaagcaacccacgttcaaacatcatcatgaagccactgaattagcctagtaatggacctcagtgcttaactattattgagatacttcattttctttattgtgtaagctaatttaaggcatattttcagcattctgaatcttaaagcatcctaagtgatgcattattaaataaatattatatttttctccaaaa

SEQ ID NO: 4025 - DNA, 645 bp, Homo sapiens
agaaatgtggccaatcaccaaatatctgtttggcctactataggccaggtgcaattccaggcaccatggatccagcagtgaacgaggcaggtgagatcctgctctcaagaagtgtccattctaattggaaagctggaccataaaccgcagaaagaaaaaattccgagtcctcaccttggcaagatggaggaaagaaaagcttttgagggggaatgagatgggacctgccagtgctttctctcagacagtgctgggagggctcttctgagatcccatctcccattctctagtcaagatcactggctcctgcctgggtcctggcactggctgatgaagtctcagaatttgctcctgcccccaggcagaggccctcatgcaaatttgagctgtttccagtgccttcagccagaagtccattttgcttggtgttggaccctcctctcctcctgcatgcctgcgtctgcattctccctgttctctggttgttggatgagtgactgccagaccttccccttaggcatgctcttagagtacctctgttgttcacctggcatcaaacctccagttctcccctggcccctggactccaggtatccttgtctacctggtccatatctattaaatctcttatggccttggtaaaac

SEQ ID NO: 4026 - DNA, 672 bp, Homo sapiens
  misc_feature (1)...(672): n = A,T,C or G
cttctaagtatatccaccgntaccagctctgagatgcaagacattatttgtcaagattgcagagataccaagaatcacctggaacaaatgctggagaactgatgatgatgggatctgaaaatactcatcttaaacaagcattctaggcactaaggactgctcttggctagaaatagcatgaggctcatctggtgcaagactccggggagaaagagcagggggaatgctccagggaagcaggaacacacttacaattctaaagcctcctcaaagcacacctactctctcattcaaatttgtcccagagatgtatgagccccgagttagaaagccagtgaacattaacatctaggtttatcccaaaaaggaccagagcatcctgcctggctagcaagttagataatccaagaatgagggtgggaaagaaaaattaatccagtaaatactgatgtacttccaataatgtcaaataaagttatttctaaaggtatgatgcatttataaaaaacagttaaattaggagaaatagattcaatgatagtccaaaattaacacagcttgattggaggataatctagagagtgggggaaaaaaagaaatngttattttatattataaattgatttttagttgcataaactgttaaaatgactttttttaaaccctatgccc

SEQ ID NO: 4027 - DNA, 811 bp, Homo sapiens
  misc_feature (1)...(811): n = A,T,C or G
attttaggaataaaagtgcattagggtttgaaaaaaaagtcagatttgattatttttttcaggtagctttttaacagtttaatgcaacttaaaaatcaatttataattataaaataaacaatttctttcttttcccccactctctagattatcctccaatcaagctgtgttaattttggactattttcacacatgaaaaaaggttcattgaatctatttctcttaatttaactgttttttataaatgcatcatacctttagaaataactttatttgacattattggaagtacatcagtatttactggatcttaaatcttccagaaacttaatttttctttcccaccctcattcttggattatctaactcgctagccangccngaaggctctgggtcttttttggggataaacctaanatgttaatgcgtttatgagcctaccgccttcactggctttctaactcggggctcatacatctctgggacaaatttgaatgagagagtaggtgtgctttgaggaggctttagaattgttcttcagaccttgaggaaaagtgtggtcctgcttccctggagcattccccctgctctttctccccggagtcttgcaccagaatgagcctcagctatttctagcagtaatagggagcttccctagaccagcccagagtgcatacaatgcttgtgtatgagtagcattttcgagatcccatcatcatcagttctccagcattggcatttttttctctcagtttccaggtcattcttggtacctccccaatcttgacaaataatctcttccatcccagat

SEQ ID NO: 4028 - DNA, 201 bp, Homo sapiens
atttaaattacaataattttattttcttgggacttcttcaaggacatgtcaggtagactgagagttacacatttcatagtcaggcagactgcaggttggatcttagttatctcatcagcttttaaatcctgggaatttgcttaaccttcttcagcttcagtttcttcatctataaaatggcttgatgatgctcaaaagttg

SEQ ID NO: 4029 - DNA, 102 bp, Homo sapiens
agtctattaattgttgcctttaagctagaccatcactggtgcaagctatatttaacggagatcctgatgaagttcgagcactaagttaactttcaggacaat

SEQ ID NO: 4030 - DNA, 474 bp, Homo sapiens
tccaagtctatatttattagttttgaaagtactatggtgaatacttaaaatagtgatggtttactccttcaaaaataattttttaataaagtcacacagttaacaaatggggcattaaacaatagtaatgaatgttcctctttatgtacagaaacttttcagacatcaaagaatctacccatagggcagaggtgaggatgtcataggattgaaaagcaacgtactggagaatcactcatccattttcttttggtacgttttcacaacaaagctccttttgagagcagcccatcacctgtaaaccttgaaaatcttgtgattctatcatcctggctataaataggttagagaagctgatgttcgtttctcttggcctttctcttctggtcacaaaatgtcacccaggtgaggaccaggcatatagagcagtccatctggacatggaagatgctatcttttgtgattttgggcttg

SEQ ID NO: 4031 - DNA, 536 bp, Homo sapiens
  misc_feature (1)...(536): n = A,T,C or G
taccctcatattgcttattacagtattagcatgtttgattatttttttcccagtagacggtgagtttcatagaccttgtctccttgttcactgctctatctgcattatctgtagtaggctatcaagtatttgttaaaagcatagatggattgagaatatttattaggtgctattttgtgttaggcaccatgctaggataaaattatactcacaaagtgtaaaattaagtcaaggagatattaatagtaaatagtctgggatgatagtcataatgaacaaaaaaactttgggaaccaataaacaagaatatcttncaattttattatctgttgtaagggaagttgcttgagtttccccgtgtctagccccgtgtttggatcctgtagagattctagtttttatccatacataacaaacactgaaacttaagagacctttgactgttataattgctttctgacacctaagactaacnttattttcattagaaatcttataaggtatagactctgcatctagatagaactggtaattag

SEQ ID NO: 4032 - DNA, 513 bp, Homo sapiens
taccctcatattgcttattacagaatgtagagatgctgtatattagcatgtttgattatttttttcccagtagacggtgagtttcatagaccttgtctccttgttcactgctctatctgcattatctagcataacacctgaaatgtagtaggctatcaagtatttgttaaaagcatagatggattgagaatatttattaggtgctattttgtgttaggcaccatgctaggatgcggaacatcgatgttaataaaattatactcacaaagtgtaaaattaagccaaggagatattaatagtaaatagtctgggatgatagtcataattgaacaaaaaactttgggaaccaagtttaaagggtcaaaacatgaacaagaatatgtgcaattgtattatcggtggtagggagtttcttgattttaccccggtctaacacccgtgtttggatcctggagaatatttagtgtgacatgtctatcttgaattcctggtgcatcataacaacacctaaag

SEQ ID NO: 4033 - DNA, 667 bp, Homo sapiens
  misc_feature (1)...(667): n = A,T,C or G
attatatgttatgttttctactatttaaatttcaggcacttcagtggacttcaattcatcaactcttctacaggagcacgcttactttctgacactgacctgaatcttcttttcctttgttagagaataattaaagcctcatatgtagaagcagggctgtaaagtcacactgctaagagtaccaatcttgtgactgcagctgaaagtcctatgactctgtggaaataattaacttgcactctcttaattttgccttgtcaaacttttcattcactaaggttttaaaatattaactaatctgtttatttggaacatgcaaaatatcatggaacaaaacaaaatatcagaatcaaaaagacaatatggaatattaccttatggaagaaagtaattagtaatatgaaatttgtttttactcattcaataatattcaaatttcttcatttgaagtaaagaaaaaaaaaataagcccaaactgaagtaattcagggtatttaaaatttggttttaagcccttttttagtttgctagtcctgctggtaccaaagnacctacaatatggggggggttaaaaccaccagaaatttntttttctcaccagttttcaagggccgaaaaggncctttttnaagggccttgngtangggtnggttttcttttgaaaact

SEQ ID NO: 4034 - DNA, 727 bp, Homo sapiens
  misc_feature (1)...(727): n = A,T,C or G
cgcatcttggtttatttaagaaactattcatggtccagaatggtaatggtgtaggatggttgtattgaaaaaaagaaaagtagtctatacaacgatcaagttagcttttaccgtatttttaaaaacgatgttaagtaattttgagtgatgtgggtcacattctgcagggaatggctaatcataaaagtaagccaaaaactatttggggcaggcatttttaaaactttaaattaattaccctaacaacatctttctagaaagcaactgtgcctgaagtgcacttagggccaagaaacaagcaagtatctgcaattttattaaagtgttgtttgccagtctttcctcagaaaacaataagagatttgagaagaaaagaaaaataatcatttatgtagtttttggctcangtttcaataaagagaccagggccagatgattttttaaggccaagagctttcttggtcttgncngcggattgganccnnaaagttaagagnttntcccaaaatttntcaaaatgggtttgcntcttgaaaccnccttccatttngggttcaagtttcttcatntttggggtaatttncctttgaattaaaccataaaggnggatgtnggggaaantaattagggagaagccntnggattgggcagaaataggtaaangcatcttcatntaaaaaaaaacaccctnttttttttttacctttntattaggnattcttggatt

SEQ ID NO: 4035 - DNA, 677 bp, Homo sapiens
  misc_feature (1)...(677): n = A,T,C or G
attttaataatacaaagttgacttaataattgaaaatttcattcttaattagcaccacaataacagaattaatgaaaaaattgggacatctaaattgtggcacaaaaataattgaggttttggaccataattttaaatcaaactagtcccaagcacatctttattaatcaaaaggggaaccattacaatcaacacattttgccaatgagaaataagtttgtttgttcctgtagcataaaaatccatgattcagaatttgacaaactcttggaaagcattttctgcatcctgctgattgtgcaagcattttccctgcaaaaagttgcccagatgcttggacaaggggtagtcggttgacgagaggtgaggtgaatatggcagatgagacaaaacttggtagcccaatttgttcaactttttgaagcactgtttgtgcaccgtgnggtcgggcacttnttgtggagaaaaaattgngcccctnactggttggcccaatgccggnttgcaggcnttgcagnttttgatgcatctcaatcgatttgctgaacctaccttctcananntaatnggttcaccanaatttggaaagctntantggaatcaaactggcaagttgggcnttannncccccaaacagngnccnnancctngnntttttnttntnttntttatngaaa

SEQ ID NO: 4036 - DNA, 464 bp, Homo sapiens
  misc_feature (1)...(464): n = A,T,C or G
agaaacaaacattcagaaatattgctgcttggaagtggcagggcaaagaggtatgttcagatccacctgcttctttatctgccgtttaatctgcaacaagctccccctataactgagtacctgccatgtgtaagagttacttgcacatttgtcatggtactccccccaccaccacatacacacacaaacacacatcttgggagaagcctacactaagaagaggtcttgagagagtgagagctccctgactccagagagtggtgtgcatctacacatcagccccagtgtgtgacaacctgtcagaaaaggacatccatgagagtttacaagtttccatccttcaagaaaaatggcatggctttctgccnaattatatgcagaagtttagtgaatcctgaanccaaagtgacatacaaaagcatgtaaaaacacatgatgcaagtagaaaaataaagacagatgcg

SEQ ID NO: 4037 - DNA, 341 bp, Homo sapiens
ctgcactgatttcacttttccatcaagactgttttgtgaaaataaggaaatatcccctccatggactcctccaaagatgacaatgactatccaagggtcagatttgcaactgcacaggccagctaccttttccctaagggagatttgatctccacgatgacctctgagtttgatgtcactaaaggagccatcagtttcccttgtactgttttactgaaactgttaacaggaacactcacattctcagaatcctagtatctaaaataaaatacacacaaaagaaaaaaaaatgtactatggaatgtttttatgccaataaatgtagctctaacttgtgaaaa

SEQ ID NO: 4038 - DNA, 813 bp, Homo sapiens
ctgaagaccactgacctattgaagtggtgcctctggctcagtcggcctcagtcttccgctgggactcagacctgctccggaagtaaaaaatgttcctgatatgtcatcaactctgtcctctttgtgcttaatttgcattgacaactgaaaagccatcctagaatccctgggaagggctccctttattcctggaccgcctttgatgacacacaacctttgaccctgatcaatgcatcctcctcccaagcagtgcagacaggagcagctctctcagcacccagaggaagcgcgggcattcggctctgacctctcaccctgcccctaacctcattgataattgagttttccattcgtactcaccagcaggctctctacacaaagaaacaagccccccttactctgtctttaccgagatgaaaccacgagcggagtctgttcagccaacaccagcatccggtaccggaacacacaagaggatcggatctgggtcccggctccccgattccatcctgggcctcccagcacctcccatgccgctaggacagagcacctgactcagacagcatttgtttctcctagtgtggcacttgaagagagaactgtgtctctttgaaaaatgttcatgttgcagagcaatttaaaacacacacctccttccaagtgcccttccataaaagcctgctttccagaagctcctggaatcctaaaaactgaatcaaagacattttaaaatgaactttctctacctccctttgaatctttgtaaaatctcttattgtagaataaagtaagctatcaacaaaaaaaaaaaaa

SEQ ID NO: 4039 - DNA, 533 bp, Homo sapiens
atgagaccagtgacctattgaagtggtgcctctggctcagtcggcctcagtcttccgctgggactcagacctgctccggaagtaaaaaatgttcctgatatgtcatcaactctgtcctctttgtgcttaatttgcattgacaactgaaaagttaagcagatgcatcattgggcctccttgttcattttttgcacttcactgtaaaaaacaagaaatgattatagaaaaatgtatatatctgctggaaaactcctttctcccctctagttcagaatcttgcaattgggaatgtttgtcgtattttaaatcagcagatgatagttggctgcatctgcccgtgtggcattttttttttttcttctgggttcacacataaacttcctttccttccctctaaatttctgtctttctttttacctctctgtcttttggtagatcgtctttcttttttttcttcccatctttatggtttctctacacaatcctttagccatgttattgttcaaatttaacttccaattctcaagttaaaa

SEQ ID NO: 4040 - DNA, 503 bp, Homo sapiens
tttttttttttttgtttttttttttttttttttttttttttttttttctttttttttttttttttttttttttatcagtactatagtttattttgcctgaaaatacatgttttaacattgtacaatttttttctaacttgattatcctagttcaagaatatcttcaactcctatttttgtttagtttcaacccagaagacattttctttaaaattttaattggctaggtttggtggctcatgcctgtactccctacacttggggaccccaagccaggagatcacttgagccaggaatttgagatcagcccgggcaacataacaagaccccatctctacaaaaaaataaaaaaaataattagtcatgtgtggtggcgcatgcctttagtctcagctacttgagagggtgaagctggaagattgcttgagaccaggaggtcgaggctaaagtgagctgtgattgtgccgctgcactcaataatgggcaacagagtgagatccagg

SEQ ID NO: 4041 - DNA, 436 bp, Homo sapiens
acagattcttcccttttttcctgccccagccactcaagcaggtgcttgagttctatgctgatgaccttgttggagagatgtgattggtcagaaaagcagcaactgggctgggcacggtggctcacacctgtaatcccagcactttgggaggccaaggtggacagatcatttgagcccaggagttcaagaccagcttgggcaacatggcaaaacccctgtctctacaaaaaaaaacacaaaaactagccaggcattgtggtatgcccctgaagtcccagctacttggcaggctgaggcaggaggacggcttaagcccagaggtggagattgcagtgaactgagatcacgacactgtactccagcctgggtgacagagcgagaccccatctcaaaaaataaataaataaaagtaattaaaaaaaagaaggaaagaaaa

SEQ ID NO: 4042 - DNA, 816 bp, Homo sapiens
caggttgtgcatatggggtgggtaaatgagaaactccaaggagctgactcctctcaaaccttcagacccaagttcctagcactgaagggcccgtccttctacgttttcagcactcctccgtgcccaccggtaccattctccccaaactgactgaatgtaatgtgtaatgtctagaagtttatcaatttaaacagctttacttttgagagtctgaccatcagaactgcaagcaaactaaaaacctgagagcttcaggtacctacacgttttggatgcatgtcacgtgcagtgttcatgggacttttttccattaaaaggaaatgaaaagataaaaccaagttttacctccagacatcaagacagtaataccctgcctgtcttttcgttgataaggatggctttttaagtaagcgttttacttgagaatcatttcagatttatggaaaagctgcacattgagtgcagagagccccgtctgcctccactcagctcccctgatttacacaacttacgtggccatggagcatctggcaaaccaccatttgacaatgatgcagcattactaaccacacttcgccctccagtcaaaacttcagtttttctactaatgcacttttttttgccccagagataacatacgatattatattggctttagttgcaaggtttggaaataaaccagcattgtgtgcttattgcacctaaaatgttgcatggaatatgactgaacttccctcaaaacaaacataaccatgttccttaacatttactgctaatttgctccatattttcaaattcaagtcccagaggtgaacg

SEQ ID NO: 4043 - DNA, 1214 bp, Homo sapiens
cctactaaaggaaaagaccagctgtatgttatcatctggtggacgcttaaccaattatcttgactgatggggtgaaaagaagaggacggtcttatagaaatggttgtgcatatggggtgggtaaatgagaaactccaaggagctgactcctctcaaaccttcagacccaagttcctagcactgaagggcccgtccttctacgttttcagcactcctccgagctaagatattcatgccagctcatctcagaggtattgaaagactcggaggaggtggctggcaccgcatgtacccaacctggaccacgtaccactgacactggagatgcatgaaggggctgaggtgtcggaggacttccatggacccatatcactccatgtgttacctgtgtggcctgtttaccagttggccttttatggaactcagggattcttcaaaccctaatgggcagatcctaattcaataaccattgaaaagcaagggttcaaaacagacaggtttcttggccgtgggtcttcacggaagttatgtcctgccttgggatgctccgagtgctggtagcatccaacacatctcagcaaggcccggctggtaaactgattgcagcgtcacaaagtgtccctggaattgctaacgtgcgtaaactcctttgtagcttggaagggcaccttctgtccattatataatgtcgattgcttgaggaaacctgaaggcccctcattttagtgatgagtggcaagagcacacaatatcagagctccatcttgatacatcgtaactgttttatcatggagacctattgtaatataaatcgataactaaaaataggtattttcatcttagcaacacattgaacagacacattcacttgctttttttttctcatttgagtcttgcttttacagatgaaggtcatgtgtaaataaaatagtaaacaaatatacttgaccgaggattgttttggataatttatttaaaatcctctcttaatagactatgggttgtattaactgcatttaataccagaatattcttacaatgtactgaaaatccagaatgcagggagtatactctctctggtcttcttccccggtgggaaccacctaagtatgtggcctgtcattgttcttcttgatacttgctctcataatttgtttgaaactggctgactttgcctgaaaaaagtaatagatacaaataagcaactttcaaaa

SEQ ID NO: 4044 - DNA, 793 bp, Homo sapiens
  misc_feature (1)...(793): n = A,T,C or G
cgataacctgctctgcgtgagggctacatgttcccagctggttgaagatccttgctgacagactgcacagtgatggatagccacacacccctgtactgccaagatggcctatatgctccacgccatcctttgggaggaagcaaagtagcattgccatgtcagaaaacctcgaagtcaagaataatttgaaatgctgcatcgtttttaatcctgagagacagaataagtaattgattctttccagctcacaaatttgtagaactattccgactcagtttcaatggaaattaatgctagacttgattaatatgtgttgcttttgaattatgtactataaaactcctaaggacaaaacaactttttatgaagaatttataagtcatctgtctataatacaagtcaggtgtgtcattctttcaattaccaagacgttctccctttaccaaactttagttaggctcctccgagttctctttttaattagacttcaacctttggactttcatgttcatctgtacatcactcagttttagcaagaatcttgtcaagttggtttagttagaatcccacccctataantgatnatcctcaatgtctgatcaaatttttcagtccccatcaccccttaggtgatatctgattaacctggcctggcttcagccaggaattctggttagggcagtttaacaagaattccacccccactcctcaatccccgccttatttctgatgttttcatctttctggcccctcctctgcttcttagntataaatcctcacttgtccacgctgt

SEQ ID NO: 4045 - DNA, 732 bp, Homo sapiens
aggtaaagaagcttttaagttttactgactgaagacaatcaaccctcttcacaactgagaacctgaagattgaatcttctgagaacatcagagaaagactacccttgccatccatactgcagaaaaacttcaggaccttgaaccttgggttcataatctaacaactcagaagtgtctctccacactcttggaacagtacacccattggaaaccttaagaagcatggaaatgatatgaattgatgaaaaaggaagatactggagctcctttaaagaatgctgtcacgccataagtggaagtactgtggtagaagagagactataaaatattgatggactattgacctgaggtagcaaaggaagataaaagcaaattctctgagtgcacaaagaagctacctgtctccacagtgtggaaaagaacttcaatattaacatcaataatgagttatcgttgtctgaaatacatttttcttgttaccatatcagaattgtattcatttcagtttcagagaaaaaaaacatatttttttaagtttcataattatgttttctgtagcgtaagaacagttcacgtggagaggtgcttcgaaatatacatcttatcattaaatcctagccattgtggctatcttcataagacagtccaacagttgagctgtttgggagtttatttgcttggtgtcttgattttaagttattaaaaagttgtacctgcccaaaaaaaaaaaaa

SEQ ID NO: 4046 - DNA, 206 bp, Homo sapiens
cctagcctcagcaagtatcctgtgactgtctggaaacagtactacaattctcattcctagaatatttgtttgagactagctaaataatctgttaaatgaacttatgctaaattatattgaatgaaaaaggatcatgtaatgtgtctccctagggcttgtcacataatagaaactcaataaacgtacattgaatcaaaaaaacaaaa

SEQ ID NO: 4047 - DNA, 502 bp, Homo sapiens
gtgttttgttcacccttccaattcagaaagaaaaaaagagagttactgcttcactttcttcctgcctcaccactcaagcaggtgcttgggttctacgctgatgaccttgttggagagatgtgattggtcagaaaagcagcaactgggctgggcacggtggctcacacctgtgatcccagcactttgggaggccaaggtggacagatcatttgagcccaggagttcaagaccagcttgggcaacatggcaaaacccccgtctctacaaaaatttcacaaaaactagccaggcattgtggtatgcccctgaagtcccagctactgggcaggctgaggcaggaggacggcttaagcccacaggtggagattgctgttaactgacatcaagacactggactcccaccctgtgtgacagagcgagaccccatctcataaaataaattaataatagctattataagaaagatggaaagaaaagaataatcggcccttgttggcctcaa

SEQ ID NO: 4048 - DNA, 742 bp, Homo sapiens
cctaggatacccccgtgttgctccttttgactctgcaagaagtaccgcacatctagccccttgcctagaccttccacggcgattatgttgaggaaatgggcattatctccatctgtgtttgaatgaacaagggctagcaccaagcatcctgatggaacttcatcctctccgtactcatctcccacttactctccccccagtcaatatcccaaggtgtgactgtggcctagtagccatatgagtgctgggccagggatgccaggcaaggtaggcaggggagcagtgctgtggctgaagcccaggtgcattggtgtcatacagacacaagcctgtgttcaaatcccagctctgccaccttctggctttggggccgccataggcagctcttccagtgtgctgagcctcagtttccccctctggaggatgccgttgctagaaagcacaccatggcacgatggttcagaggccccagcccagcaccttctgctcggcatccctgtgctcaccaggcacagagcaccatggcactcttatgtggttaacaaacagcagactgtggggttatacaggcagctctgtagctacaaatcaccaaggagaggctgaggcccagcacagccctgaggctggacacccaccagcatggacctcatcgacttgctctgaggatcacatgatataagaaatgtaaaatgcttcattgagtgcccggtacataataaaatcttgatgaatatcaaaa

SEQ ID NO: 4049 - DNA, 1066 bp, Homo sapiens
gtagatatccaaacatcattcactgttaaatcaggcaacatccttggatttggaattatggtaggggaaattattattggaactgtactgaacctttagctcaattaagggttgcctcatttactcagcgtgacagtgtaaactccttgtgggagggagcatgtaagcaaacaagtgcaggaactggagtgaatgaccactggaacctgccagctgcttcggtgccagggggatcaaaccccactcactcttacctgatgccttccaccccttccaggagggaccacgcagaaaggcagaataatacgatgatgtggatctagactccatggattctaattcagccttgtgcctctttcagctgctggatgtctgctggctggagaccacccgttcacctgccaagggggcctctctgccccaataagctgcttcatcacccttccacaagagagacaggttactaccaagacagatgttacaattacagaaacgaagttttgccacattggccaggctggtctcaaactcctggcctcaagcaatccacccacctcagcctcccaaattgctgggattacaagcgtgagtcactgcacttggctctttctaaaagcttttaagtgtcgtctttgggggtaatcattttaaattgctttaaccaattttctttctgactcctttattggaacttcatagaccctaatcatccctccagatatattgacactagttataccatctaattctttgttctgtatttgatatcatttaggaacaagtacatcagcttttccttttatcataggtctaaggtggcttccataagctagaaaattatattagaaaaacgcatcttattttatccatgtagtgtttttaatttttttaatttcttctattctgaatatagggctaacacatttttaaaaccaagccaatatcgctccatttctgtcaataatattgattcctagtaaaaatatgtttaaacataacattttcatttcctttgtgacatttggctatttatattccattaataaatatatttttctcaactcaa

SEQ ID NO: 4050 - DNA, 646 bp, Homo sapiens
caatgatgttcagttccaattttccaactccccacaagatgctccactgctccactctcttgccaccatggtcattccaagaaacaaatctgaccacagcacttctccccccacacccttcccaacacagcatggactctgcaacctggtatgaggggcctctgcttcactccagtcagtcccatggctcccaaagtgcggtctatggactcctaggggtctacaagatccttccagaggttttacgaggtcaaaagtatttgataaaaatactaagacatttcttggctgggagccatggttcatgcctgtaatctcagtgcattgggaggctgaggtgggagggttgcctgaggccaagagctcaagacaagcctgggcaacatagaaagaccctgtctctacaaaaataaaaataaaaataataaataacctgggcatggtccccagctacttgtgaggctgaggtgaggggaggagcccttgagcccaggagctggaggatgcagtgagccataacagtgccactgcactgcagcctgggtaacagagcaagactctacattacaaaaataaaaataaattttaaaaatgaaaaaaaaaaaacgtgcctcgttggcagcagcggtggagcgtttcgacaaag

SEQ ID NO: 4051 - DNA, 593 bp, Homo sapiens
agcaaatgatgttcagttccaattttccaactccccagaagatgctccactgctccactctcttgccaccatggtcattccaagaagtaaatctgaccacagcacttctccccccacacccttcccaacacagcatggactctgcaacctggtatgaggggcctctgcttcactccagtcagtcccatggctcccaaagtgtggtctatggactcctaggggtctacaagatccttccagaggttttacgaggtcaaaagtatttgataaaaatactaagacatttctaggctgggagccatggttcatacctgtaatctcagtgctttgggaggctgaggtgggagggttgcctgaggccaagagctcaagacaagcctgggcaacatagagagaccctgtctctacaaaataaagataaaaataataaataacctgggcatggtccccagctacttgtgaggctgaggtgaggggaggagcccttgagcccaggagctggaggatgcagtgagccataacagtgccactgcactgcagcctgggtcacagaacaagactcttcattacaaaaataaaaataaattttaaaa

SEQ ID NO: 4052 - DNA, 465 bp, Homo sapiens
acaacttggccaagtagaaatcaaatgccccatcacagagtgttttgaattcttggaataaacaactgttgtctataacttaacgcatgaagactccatcaagtataagtacttcttggaacttggccgtattgattccagcaccaagccatgtcctcagtgcaagcactttacaaccttcaagaaaaaaggacatattcccaccccttccagatcagaaagcaaatacaaacaaaatggcaggatgaagtggtttcaaaggctgtttggagtcatctccatttaaggtaaggagagcactgacatggataccccagccaaccaatcgtgagattcatggccacagtatggcaccctgtactgagactaagatctttgttctttgtgatgaacaggatgaacattttttattttgcagtatttttaaaaattcagtttccctaataaaataaggtagttccaaaa

SEQ ID NO: 4053 - DNA, 923 bp, Homo sapiens
gtactttttggtgaaaacactatgaggagcattgagaaagtcctcatttggaatacttagctggacttacctaaactgaactttcccttccttgacccagggcaacctctgccaagcccaccaccctccagctcctacgccatgaaagatcgaagaaaataatcagaaaaaccacccaagaaaaggaaaagggagaatcagttacatatccagcaagccagaaaacaagaaaacccaaatctgttccagttctctagtttcaccttaaaggcaaagaactgtagatgcttgtgaggagctcttcaaagcctaaattcatagcctctctacgcgggaggttaccagcatctgaagaaaaacaaccactaccagaaaagctcttctttgttttcatttcttcgcagtccttcaggaaactcttgataatgtgaaatgttattactgcaaatgctggctcaagcacgtttactctagagtctgactatcagtgacttgttcgcaaaataaaatcatttttaaagcctacaaggaaagccaagagcaaaccacaaatcagaaaaccaccaaggcgggctggcctcattgccagaatttaatgtgatctaatgcgaggacaacaagatgtgagaatttgattttacgatgttccatgtaacatttgccaatacggaggggttgggcccaacttccccatccttaagcaaacatttgaaggttacccaatgcaagtgaaaccatggaattccatgacacctgcaaaccacttctcctcttcagactggatttggcacagctaagcatggaatcagaaccagaaagccagagacctacctgccaaatgaatgctatttcaagatgtcttcgatgttgttgttttccttttaaataaaaatgaaataaaatcacataataacaccacaaaa

SEQ ID NO: 4054 - DNA, 719 bp, Homo sapiens
tgctgccctccttccgaccaggtagggtttgtattttctgcttcatgatgtaacacatcaggtagggtttgtattttctgattcatgatgtaacgcatctcgaaaagcagtctctggttttttgaaatttgatttgaaaatgttgataggaaaacattagcacatttcagactgcatttggtggtctctgccctgcctgttaattctataaaactgctctttctgtgggaatagcataggtcattctgatctcctgtgtatagattatttctctattggcagttatgttttgtaaagaatcgtgatttaaatgatgatttagatatgattgtttaaactgagaagggctttgagatgacacacctgtgtaatttgaaattttaagcattatattattttcttaaataaaatccttactaggaaagcttcattctcaggagggctttggcccagtgggtgttattgccagtgggtaggatcctgtcatccccaattccaggcagtttgttcacctggagcccagagcccttaacgttgtcctggattcaggataactacctttgtagccaccctcaggcctgattttctgctcacttcccacgtctatgagtacttaggaaaactctatggtaatcaagctgtatcaatatcagccaaatcagtttttaagccactgtgttattcttctgtttcctttataataaacttatgatttaaaa

SEQ ID NO: 4055 - DNA, 1081 bp, Homo sapiens
agggacgaatgacagcttgataacagaaacccaaacaatgcaccagaaaccaatgactgataatgcaaggcagatgagcagagacaccccagttcccattaacttcactgatcagcaaaccactgataatccagatgatgtgaaagagaaaaagcacccagagaacaaccagaaatcagaaaacaaccagaaactactaacaggggcaaacagtagcagattcctggatggcaatattcccagtcaagcaaatgtccactgcagctctgtaccaaccggagaccagtccttatcctatgagcatggcattcccaggagaaagcttagagactggtccttggaacagacggtgagaggcagctctgaccaacctgaggatattggccagagcccaagtgggacaacaaatgaagacgcttttcttcttgccctggtcagaagagaactcaagtcacgtcctttgagttccaacttattagaaaagcttcagaaagagctgaagatcctggacccaatctcttcaggatttcttctccaatctcagctgagccgcctctttttgaagcatgaagtccctctacagttaccaacaggttaaaatcctttgtcagagattttctaagaggggttctcctgaaatggtgaattatgaaaagctactctggtttttaaacagtgcagcatcagattatccacagcaaaataaagcagctgcagacctgagaaaaactgagagtcatggcactcatagccaaagccttccccatttccccgacaatcagcactccacctcagcactccagctcacagccagaagcgaacaggagtctgttggagattttgaagatggccctaaggacaaccaatggcagactcaacatagacaatctcaatctgaggagcgaaaagaagatcgctcgttctctggctgcctccctctacctaaggtcagggctaaatgtgggaagcatggattatatctgaccctgagcctgctggaaacattgcttaaccatcaagaattgggttaccaaaatgaaataaagtaagtcacctcttaaaaaaaaaaaaaaaaaaaaaa

SEQ ID NO: 4056 - DNA, 397 bp, Homo sapiens
tatttatgatatatgaaggagttatgaagcacgtcataaaaactaggttaccagctggttggttgtatattttaggcaagtcagaaaattgctattctgtcacgcaatcgagtccaggactggatgagatgacaattggaagaatacagacaaagcacaacaaaggcacagagaatacaacagagaaatactagaggaaaagctggcctctcacactctgcctagtaccacacgatcaagtcttttcctgcctgggtttctgctttactgatttagcaactatcaatcaaaaagtgaactctaatgatagagtttagttatatttcattgtatttttatagactctataatctttgcctaattaaaagataagatatttcttataaaaaaaaaaaaa

SEQ ID NO: 4057 - DNA, 910 bp, Homo sapiens
aggggaaatgacaggggccgttaattacgaaagcaacacaaagctgtacactcgtgtgttctcttttctgagatcaggctgaaggaacaacctctatctggaacatgctttacatatcagaaggagaagaaagaaagcagggaaagaaaacaggcatcatgatggcaactaaagggtgatgagcttgtttcccacttcactggaaaacaaaatgggaatattcagaagataagttccacagctcccatagcatcttcctatccaccaggatttggaccgtctacaccctgctcccattaaggaattagccttgctcttgtccaaaactagcctttgcgtatgccttagatcctatcccccttgcttgctcacaggctttgctccagcaattctccctatttttcccctataccatcagcttcctctctctactaggtcatttccaccagcacacaacaatactgtctctctcatcttggaaattggaaactaacaaaattggagttaacttttcctttatgacactatccctttttctacctccccccactttaccagcaaaacttttttgaaaagcctgccttgaattttcactggcttccatttccctctcctccttctcactaaaacctacctgcttgccagaaccgggaactccacccacctccaccagacgccctggcttggtcaaaaattatcaaatggacttcacatccttggttaaaaccatttcttttggtccccattggaaccttgaccgctcaagtaaccaccctttgcaaacttacacccctccgctgtctcatgggaaagagatttctttggtttcctcaggacccctacaccattttggtttttcctttaacaaccccgtggatgcttgtatctccatttttggtccgttaaattt

SEQ ID NO: 4058 - DNA, 1030 bp, Homo sapiens
attgtgaactctgctgcacacccctaactcccaccgagggcggactcattaggctcgcaaaatattgttgctgtgaagagaacaagtggagaacctcctaaccctgcttcttgctgaagtcacttggggcctgggtgtgcctttcagggtccaaggattacactgggcccatctggataaccatgataatctatgttcttcagctttcgaaggactcaagcaaccagaacataaaggtatacatgctcagtacatctttcatgaagttcattcaaatgtttcaaggcggcaaacataaaagaagcctttaaaaattttcatagtagatcaaacaaagatcaaataaggtgccaagaaaagacacacaggttgtgatcatgaccacccaggtgtgacttaagaagggccaagcatgaaattgagcagcaaagcaagaacaaatttattataatgcaactgctctgaaaactcaataggcggcgcagcaaagcaagaagggttaaaggggctgaataattcattgaagttttaagcatcaataaataatacttacagtgaggattgtctgctttgcaatattaggtttgttgtatggataagaatatacatatatcgggaggcagttccaagatggccaaataggaacagctccagtctacagctcccagcatgagcaatgtagaagacgggtgatttctgcatttccaattgagggacatggatgaatctggaaaccgtcattctcagcaaactatcgcaaggacaaaaaacgaaacaccacatgttctcactcataggtgggaattgaacaatgaggacagttggacacaggaaggggaacatcacacactggggcctgtcctgggtggggggagggatagtattaggagatatacctaatgtaaatgatgagttaatgggtgcagcacaccaacatggcacatgtatgcatatgtaacaaacctgcacattgtgcacatgtaccctagaacttgaagtatagtaataaaaaactaccctaaacgtttaa

SEQ ID NO: 4059 - DNA, 635 bp, Homo sapiens
  misc_feature (1)...(635): n = A,T,C or G
gcgatgacgtaacttcgctcttgcctcccaggccggacgcaatggcacgatcttggctcactgcaacctcctcctcccgggttctagtgattctcctgcctcagcctcccaagtagctgggattacagtcaggtgccatgcccggctaattttgtatttttagtagagatgaggtttctgcctgttggtcagcctggtcttgaactcccgacctcaggtgatctgtcctccctggcctcccaaggtgctgagattacaggaatgagccagcatgcccagcctaaatctgtttcttataagtatcatcatatgaggttttgtctttgctccttacatagtagtgttcacttttttgttttccaccaaaggagtcaccaagggaaaccagatgaaactgtgttcattctttattaactttaagcactttaaatgcccctacttcccatacatactgaagcatactaaaattctttaaataaagataaacgatcctaataaatcagcaaaaaaagaaaatcggcctcgttggcaacattcggtggagatagttgcgtgcctacgttttttccttttactttttaaanctttnccctctcctttnnncccccctctccctcttccttnactctacctct

SEQ ID NO: 4060 - DNA, 502 bp, Homo sapiens
aaataaaagtaattttgggtggcacagggaagcaaacgtaaacatgttatacatgaaagaactggatttttgtgggctttgcacttttgttataattccacaaatgaagcaaactgatgaatttaccaaaatatttcagagctcatctacgtacacaatttaaagagctaaagaaaacacattcatatttttaaaaaattctgtcaaaaagcctgtttaaaagttatagtttgtgaagccaccaatttccctaaaaccgaagattctacattaaccttttgagtttggacgatcacgcagtaccgattttctaggtaatcttcacccagctgctgttgctcaaacagcccctcattttatcagactagttctaccaagcaacacaaaaagtgctccacacaaatattataccccccagatagtttaacacagtaagaattcctttgtagttatttttatgctttcactccagatattctattttgctttaaaaaaaaaaaaa

SEQ ID NO: 4061 - DNA, 769 bp, Homo sapiens
ctaggagcagcagcccaaagcttctggaggagagaacgagggaggaggaagcgtctgggcatgagagcagcaggagttgaggttacagagctgtcgaaatctctcctgcctggaccaaagacaagtcacaagacccagtcagattcaaggacaggagaactccactctacctcccctagcaaagaattgttggccattgtgaatccaccacaacactcaccattttcaatctggtggtgcagagatgtaggaggatgaattgcatctgtcttccaagagagttacaaatgcagcagaatatcaggctgggaggcagaaagcgagcgttcctgacagtggctccacggaatagccggcacatgctgaaccacagcctctctgcggaggcagatggagcacagatgaaagcttcaagaagccagaaatgatgtttgccttctcacatggtatttggcacacagcaggtgctcagtaaacatcccacacaaagaggaagggataggtgggaaaaaggggaaaatggatattaatgatactaatactatctgcgagagagagagagagaaatttcgaggacagactgagagctcatagtctagaaggcaatagagccaggttcctggattctgcccagggtctaagtttgccagggtggctaaccctacttcaaaacccccaatatgaaaaactggtgtccaatcctaaaccatcgtgacggggaacaaacaggcaggcgtggtagctttgaatctcttgccctaacggaggt

SEQ ID NO: 4062 - DNA, 598 bp, Homo sapiens
tttttttttttttttttttttttttccaggacaaaacctgtattctacctttactctttctgatttcaccatagctgagcttgggttgctgacaatgtctttcagcaaagtgggttgagttctcagataatgtttattttatcaacatggtttttgttgctgtcattaagaatggactggaatttcccagtggtaaaacagcaaacctgggagaggaaaagagcccgtttcgcaggtgcaggtgtttgttgcaagctctgtagagatctcggcttgtgctggcaccgtaatcgaactgttggaaagagggtgcagcagactcacactccagggtccccagcacagcaggaggctgttggcattgacatcactctccagcatggccagagggctgcaatttggtggggccagcccaggtcccttggaagacgctttatcaaagtatttaactttaatcaaatatccactaaaataaaagcaaatcctttacttctgggtgcgaagatccgatatgacacaggtgtcaaatttcaatcccaatgaaaatcccaatagaatttcattaaacttgaaaacagtcattctaagaatatctagg

SEQ ID NO: 4063 - DNA, 621 bp, Homo sapiens
gtaacctttaaaaggtttcaaaaaaaaggaaccccccaaaaatgttttttttgggggcaaaattgggggaaaatttccttggggcagaaaaaaacgaaaaaaaatgtttttaaacatttaaatggcaacgtttttttggtttttaaaccaagaggggaaaaaaaaaataggggccaaattttttttttttttgccattaaccccaaggtttaatattttaaaatttggttgaaaaaataggaggtttaaaaatggcctccttttttaaaaaaaaaataacaccagtttttcccccttaaaaattttttagaaaacaacccccccaccgtttttattttttaaaaaaagggggtttttaatttttaaggggggaaaaaaggtttttgtggcacttttaaacctcccccccccgcttttttttttaaaggggaaggttttgtataagaaaggaaaatttttcccaattttttccatagtgttggtattttttccccggggccgtgggggaaaaaagaaaatactctcttgcctttttaagaatcaaaggggcttaggaaacacactgtggaggtttttttcccctctttccggcttataataaaataattttgggggggaaaa

SEQ ID NO: 4064 - DNA, 807 bp, Homo sapiens
cctaggtaaacttggatagcgtggttagtatggacaacagcaaataacttcgagaaaagggaacatttgggatcaagtcttctccacataataccacgtgttttgatacatttatttttgttttttaattgactaactggcatgttgtcttagtgatgagagaaatatgtcaagtattcatgcttttgttttattttatcaacttgtttaatgcctcaaggcaccatttgatgtttaagaaacaaggagggtaatgaatgaacgaatgaggaaatgaatggaaggatgaggaagatataaagtgacttgacttgcatttggcttattttctttatttgctatttaggaataataatattatggggatatcctgaaagaaaattggtgaataggtgtaagaagtgttgttctgataataaatcattatttttattactacttctacacctgctagtatgtgtctcacccaagtacctagaaactgtttttgccattgccatgaaaccaggaaattttattaaggtcatgggcagatcatcaattctgaattaagttttcacaaacacttttttcaaaaatctagataaataaaatctgttaacttgaactgcaacccaatattactgatgtatttccctttaaaatctttctggaaatttgtcaaatccccttagatttcatataaccttcgacataatttcaatgtaactcattaaagacagattttcctttttcctcacagagaaaaataccgttttttaaaaacggcgctcgaccctttaatgttaataagcattcccacaacag

SEQ ID NO: 4065 - DNA, 1300 bp, Homo sapiens
gaaatttagacatatacatgcacaggcagaagaccacatgaagacagagggagaagccactcagctaaaggccggggaaagagtcctcagaagaaaccaaccctgcaaatacctggatcttgatcttgggcttctagcgtcaagaactataaggaagtcaattcctgctgtttaagccatccagtctatggaaccctgttatggcagccctagaggactaatacacaagtgggaaacctcatccttagattccaactgccatgtcttctcccctttaatacagactcttctgcccagattttcttcctagactagcctcatctcagggcatgctgaagatattaaaaaggctcagctgcaaactatcatgagtgagttctctcactgttatagaaatgaatgcctcagagtaatgacaaagatggagccctttgattcaggtccaggcatccagacataggacaagtccagatgggacataggagagtgagctggatctgagacttggggaccattttgagttttctgatggaacatgcgctcaggcagagctatagcaccaaggtgggcaccatctgtgaatttttttgaacgacaacaacaaaaaaaacctatttatttgcaacaaaacctggtctcatcattaagctatagcacaggagtagaaaggagttacactgcaagcaccatttatttcaagggacacggtccttggatgccaaagacaacaagcccatctccctcagagacccatgtccaaatccaaactgaatacatgaaacaggcaagcccagaataaagtcagatccaggccttagcaggtttcacccttatcccatagtccttccttcacagccctctactcccctgtacccccagtcaggccaacttctagcctctgagccaccagggagctgtttttgaggggtagttgatagggatttaagcatcacataaggaaaatactctgaactctattgttcagagtattgtttggctctgtgtccccactcagatctcaccttgaattgtaataatcgccatgtgtcaagggcaggacaaggtggagataattgaatcatgagggtggtttcccccacactgttctcatgatagtgagttctcatgagatctgatggttttatatgaggcttccctctttactcagttctcattctccttcctgccaccatgggtttacttccccttccaccatgagtgtatgtttcctgaggcctcccagccatgctgaactgggagtcaattaaacctctttcctttatgaattaaaagaaaaaag

SEQ ID NO: 4066 - DNA, 776 bp, Homo sapiens
cctagagctctcatctagaagtcttgtagtcctcagcacgatcttctcaatctggtttgggagaaacaccaacatataccagcacaacaaaatcccagtacttttgatcatcccaatggctgcatcaagtattccctgtgagacctgtaaggctttgtccttgacatgcacagctgagtcgttaccaaagagccaaggagaatcctgaagcactcttctggagatacctcctattaatgcccgctttctcttatatgcaccaccacacatattctaactacttcagcaagattgcatgttatctctgcctcttcagctcagcaagactgcagctggctgcatgagttccaccttcctaagccacggtctggaaaaatgttcctaagaaggttgccagggtgagagtgctgatcacttgatttgcttctttgagttccaggatcacagtcctgttttgttgtctaatagctttgtaaaaagagggcttatgttcatacattcggttcagttttaaaattctatacaatgggaaagtaagtttcatgagagtttatttacaggtgaatttagtaagggttgccacatggacaaaaactgatcaatgttagagtatttcctaatgaaattttaaaattcaaagtgtattttaaatacacttgtgtttggaaaaccaaaagcccaaacttatttgaatgtcgaatattttattcttttttaccttttggacacgaaaaagacttgaataattgtatgactaaactaatttccattcttat

SEQ ID NO: 4067 - DNA, 1054 bp, Homo sapiens
ccttgaactctcatctagaagtctttgagtcctcagcaagatcttctcaatctggtttgggagaaacaccaacatataccagcacaacaaaatcccagtacttttgatcatcccaatggctgcatcaagtattccctgtgagacctgtaaggctttgtccttgacatgcacagctgagtcgttaccaaagagccaaggagaatcctgaagcactcttctggagatacctcctaataatgcccgctttctcttatatgcaccaccacacatattctaactacttcagcaagattgcatgttatctctgcctcttcagctcagcaagactgcagctggctgcatgagttccaccttcctaagccacggtctggaaaaatgttcctaagaaggttgccagggtgagagtgctgctcacttgatttgcttctttgagttccaggatcacagtcctgttttgttgtctaatagctttttaaaaagagggcttatgttcatacattcggttcagttttaaaattctttacaatgggaaagtaagtttcatgagagtttatttacagggtgaatttagtaagggtagccacatggacaaaaactgtacaatgttagagtatttcctaaagaaaattttaaaatttttaaagtgtattttaaatacactttttgtttggaaaaccaaaaaagcccaaaccttattttaaatgggtgaattttttattcctttccttaccttttggacaaaaaaaagaccttgattaattccatgacttatactacattcccattcttcattccattcatatgtagtttattattatattggaacacattgttagaaaactcaaatgctcaaccctattgtgaataagttagactaaaatcactttttctctgataaaaatgaaattaaagatacaatacttatctttctgtaaccaccacttaatattattttcatatttttgagatattagtaagattatatcatacactgaaataaaatattttatttgaatgacaatagcaatataataaaaactttataaatggaaaa

SEQ ID NO: 4068 - DNA, 1134 bp, Homo sapiens
  misc_feature (1)...(1134): n = A,T,C or G
gggaccctggctccctgactcactagtagagtgacctcaggcaagatgtctaacctcattgagtccctgttgcccctctgggaaatgggaactaacaagaccttactcagctccatgtgaataaatgcgataaggggggccaaatgcctcacacaattcaacaaagaggatcctgtgatcatccagatgagagaagatcggggtgaacccaggtggtagcagtggagagcatgaagagtggtccgctgtgaggttatggctggaaagcagagccaatatgatttcctgacggctgagctataagataccttctcagatccaggaagcaagatatggcctaaatcaatcttaatgacctagtgaccatctacccctgtgtgatgcagntcagcacacatgaaccangaggtgaagtggcaaagggggctgtctgctanggcttctccagtggcaccatgggaccctggggacacagaatgggaatgatgaaactccctacccaacacaagaatgatgaaaacttcccctggtccaacaacaaccagattagagggaccctggtcttggttccatgctcccacaggcccatcacggatcagcacattgtcagaagctttaaaaagctgcattatctttgtcctaaaaatttcaagtaaagaaattggactgaagaaaataaacagacanctacatgaaaatgttgatctcagcattatttatggtggtgagaaatggaaaacaacaatagaaaattagttaaataaataatggtatatccttatgagggaatactacatagctattaaacatcatgttggaggaaaaattaatggaacggggaaacgatcgtgatagattaaggttgcaaaacaatgtgtgtaatgtgctccaaattatggtgggagagggtagtggtgaggattaggattttacatagaaacaatactggaaagaaaatcaaaaggttaggagaaactacctctccatggcaaaattatgggttctttttcttgttctctgtgttatcttaggtttcctaaattttctgttgtttatatgcattattgtcataatcagaagaaaaccacattaaacaaaaacataataaaggttataaaattttcaaagtataaa

SEQ ID NO: 4069 - DNA, 460 bp, Homo sapiens
cttgttgtaacatcggtaaagcttagctgatctatcacaatggccggcgtgcctgagcatgccatagacagtctgaacgtgctccctgatccatcacaggcgtgttgagtctctatcccgacgctacaccacacatgttagattctggaccgtgcacataataggcggatcgttcaaactgtatgaactattgctaagctcagtaattctcaagatgtgcaacgagtggaaatgtaattaatatatggggggagaacctaagcatagcaccataacacctaatttttgatgatgtgaaatacttaaagttctccctttttattttctggtgaaaggtgcgtattatacaaacctctactaacttcttgggcttctgaataaaggaaaggactacctaatgacagtaatagcttgactgctgaagaattatgtcaattaataaaaattgcttcataggaaa

SEQ ID NO: 4070 - DNA, 797 bp, Homo sapiens
  misc_feature (1)...(797): n = A,T,C or G
ctaggtgtggcaggcaggcctgttatgaccaattccaagtccctcttgttgctactgaagcatgtttgagacctgcgaggaggaggaggcctctatcagagcaaagaatttggagctgcttccaatctgaaacttccttagcgttgtaaaaagcacccttcattcgaaatcgctcagtgcctggactcagagaaagtgggagagttaccaaggctcggcccccaaggcacagtgagaagaaaccgaggcaatgccaagaacaccccgacctcatgagcttcaaagaagctgctgctgcagttcccggttctgaggcacctccaagaccactctcatccaaactctcaaaacactccccttgggtgagctgtcccttaaaaggaacagggctgggccttcacaaaggctcctgtgagacttctaccccctatgggtctggtagcaccaagggatttctcatgctatgaccacagacatcatcaagagggtagagagaccaagtggccagtgaattggcacacatgaagattctttgtgatctgtaaagaatgtgcaaaatcctgcaacaaactggtggaataatctgacataagaagaggtggatggtacagaagaaccataaattatagccagcctttattgactgtntgctcatgccctaaaaaaaatcggctcgtggctagcggggacttgcggcgtcccttaggagggtatcataactcgtactgactcctggctcgggtgggnnnnnnnnnnnnngttcggtgggggagcggttcactactcaaaggcgaata

SEQ ID NO: 4071 - DNA, 774 bp, Homo sapiens
cctagggaactctgaagcttccaattatactaatactcatacccacttcaatgaaaaatgcctgaaagacagactgctggaaccggcagtgacaacaaacaccaggtaaagaacaaaaagaagaaagagcaagagaagtccatttgctgaagacaaaggaaaggttttcccgtaggtgtcctctggaggtgacaagacaggtctgaacagctctgtgatcatgggccaatgagaaaacggtgtggacaaatccttctgttgccttttttccccccaaatatgttagaattttataaatagatcatctcgaatttctcaaagaatttgtgagctgggaattactattactgctttgttctccttagaagtgaagttcaatttatttgtgtttctaatttaccaaaggccttttaattattcatacccattttaaaatatgtatgtagatatttggggaaattagaagtacagttctcttctttctgcatgactacttcataagccttatggaaagtcacagaaagtaagaagataaagtcattttgaaaagtcaaagtaatattctttataagaaaagatctgattaattttaaagtgacaatcacaaactaaccattgtatttctgcagccaaaccaacccaggcctaggttacaagaaaaactctccagggttcttatgtgggccattatttgggtgagagcgctcaccactgaacgatagggcccatgataccttctctgaaattccaaaggcatgggacgtaaccattggg

SEQ ID NO: 4072 - DNA, 779 bp, Homo sapiens
ctagcatggaggagcaatctcagatctgttatgaagaccttcgaagttcttcattctttctcactttgccatcatgtggcctctggacactgtggtcagtcatttgaaaattgactttaattttaaacaaaggcctgtgcctcccacccaggaggtgggagggtgaattttatgtttaaatgaagaagtgaattatgtaagaagagtatacgaccttcccttccctttcaagcataagtccaaatagactctcaggaatgaagatttgtgaagacatcagataggaattttgactcatttaaactttgatgcttagttatgttgctggagaaaagatacttatgttttgctcatctaacttcattgtgcccagcgtcattttgacatgtcatttcctatctcccatttgccttcggtcctcaatgcatgtctttgagtgacttcttatctgaaattttgctactggtatcctaggaaagcttttgttggatactctcattttaaacttctcctctccccagatacctcctatatttccatattgtgtgcaaaggatgggcagaaaagaaagtgcttgaaagatttcaaattttcagaaagggaacaacgaaggccctctcttgctctcatacctcgttttgctcaagaagctgggctgtaacaattcaggtttttcccttgttttcctctcattgcatgtttaccctgcaatatttggctcattgacatcaatcatgggttttgaagatagctagttttattcctctccagcaaagatt

SEQ ID NO: 4073 - DNA, 780 bp, Homo sapiens
  misc_feature (1)...(780): n = A,T,C or G
cctgtatgcaaccgagtacctttgttaaaggtcacgctctcgccacatggagctatctcatctaagtgattcctgatgccaaagaatatgaaaatatttaagtaaaaacaaaatgatgcattttgagaagaacaaagtgtgcactcaacggctggaaaggaaataagtgcatttctgcaaagatcaagataagctggatgaagtagtgtgcatttgtaatactattgcaagactcctcccacaattattctaatctgaacacagttatcaggattacaaaatgtgttccattttagtgtaaagatgtgtatcatttgtaattgtgtgtgacctgactgtgatgatggaagtgtaagaaattgaagagttctaaggctttcaaaaacactcagtcaaaaatttaaaatcttaaatgtgtatgtcacccccaccaaaaacaaaagagaagaaaaagaatagaaagaattatccagtgtcagcttccaatccctagtacatacatatataatagaaaagggccaagaaaaatatgcatcttgatttggagagaggctaatattatgcacactgtaagagaagccattntggaaattcacgaaagtactgctccaccccagttgagttatttagaattgtgtctcaagtgaaagctgatggattcatctgctttggctgaattaaacttatcattagtctagctagcatttcagcatgatattgcaagcacttctcattgctaaaaataaataaccaaagtttaacggaatcagctaggggaag

SEQ ID NO: 4074 - DNA, 531 bp, Homo sapiens
  misc_feature (1)...(531): n = A,T,C or G
ctagggaatcaagttgacttatttagccaataaagccccttgggaaagctggcctcatgcattgtctacagagtccttgtatagagttcctgaccagtgacaattcaccccttatttctgcacccgggccaggctgctcttacctctcaaccctgttacccactggttctcagtatgcgcctgagatcccagggaaggtgcttggaatagatctgagtattctgcctgagacaggacttggagtgactctgatggagtcttgctatgttgcccaggctagtctcaaattcctggcctcaagtgatcctcctgtctcagccctccaaagcactggaattacaggaacaaactcagcgcaagaagacagcttcaactccctatgacttcgtccctgaccagtcagcactcctggctccctggcctcccccaacctgccaagttgtcctgaaaaaccctgctccccgaatgcttggggagactgatttgagtcataataaaactctggtctcccaccnnanaaaaaaaaaaaaa

SEQ ID NO: 4075 - DNA, 557 bp, Homo sapiens
ctagctgtggcagaaggagcagggtcatcaaaagccactccattcttctggaagctgcagagaaagggaacccagaaacatggggtgccagcaaaaaggggagattctaaatcttggaaaaaagaacaaaaggaagaaaggaaggaaggaaggaaggaaggacagaagaaaggagggaaggaagaaaggaagaaagaaagaaagaaaaagaaagaaagaaaaagaaggaaagaaagaaagaaagagagaaagaaagaaagaaaagaaaagaaagaaagaaagagaagaaactgcttatcatctctgagatagcttatgcatccatgaccctgcattctgatgcacagctgacgctgcccagacctgtaatctggctcaaacagttctgcaaccctacccagaaatagaagacagcaagaaaaactcactccaacttgaccgatcagcactccccacttcgtgagcccctacccaccaaattatccttaaaaactttagtccccgagtttttcaggagactgatttgattaataataaaacttctgtatcctgcaaaa

SEQ ID NO: 4076 - DNA, 724 bp, Homo sapiens
agcagacaagaccatggtcgagtaatagactccatataggggggcagatcagcacctttcattggtgctgtgaacagaaagtccttgatttcctcaattttcggaggcatggcgacaaggcacgcagggagcaggcgcggaccgggacagcgtgcggcgaccgggaaaaacaggacagaaaaagacagacagcttttaaagctcctggattaaccctagaggctacccctaaatggagataagccatttatacagagaggtgttcctgctcgcttcagcaggtttgagaagctctggactaaccaccaaaagactaggaaaaatttgccagggctagtattttgggcatccctgtttaacccttctcaggagattcccaggcctgggatcatatcatacacaagtcgccatgactcaggaggtggatgtttctgggaagacctgcaaaggaggatgacacttgcacccttcaagtcttcagaatgcctagaaaacactcaggacgcatttcactgaccaacctagtgtgaacctggaggtgtctctacgcgtttgtggttttgatcatcctgagagaggacctgaacggcctcttcacacccagtttcaccaaccacacaaccgtattctggtttatctctgcatctttggtgtttcctaatttctatttatgcttgcttgttgtatgagtaggtaaaataaatccttaattaattaaaggaaa

SEQ ID NO: 4077 - DNA, 656 bp, Homo sapiens
aaaaaggtaaacatttttatgggtttttaatacccacataattgaacaactggggggcctactgtctacaaaatgactttccacaaatattttgttgagcacagaccccaaaggggaaaaagtttttatgggaccacttttcaaacagacggaagccacgatttggactcacagcctgaacataagtgctgaaggccgggcgggggccttgaaggggggggacgcccccaactgggcaaaaaccaccttgttccccaggctcgggggactcttcccttagttaaccaaaaacacaggctgagctgcccaatcgtggggctctacctgctagggaactgcaaagagggggaaaccgcagcatgggttcccatccaaccctgagtcgggatcagtttccccaaccacaccaaccagcctttgcaggcaaaattgtgataacccacccccaacaaacagatttcttgcgctctttgttggaacggggaaaagattgtcattgatatgacctcgtttgggccaagaccttgggcacccccccgtgaggtctccggtcttgaatatacccggggtccctcaatatacttatgggtatgcttggagattcctttgtacacccgggtgaagccatggtgtttagtaacagtctctttgggcgg

SEQ ID NO: 4078 - DNA, 779 bp, Homo sapiens
ctaggttttcctgggagggcttgtcttaatcaggtgagccctttaaatggattgggaccctcatggaggtcagatgtgttctactgctgaccttgaaaatgtaatctgcaatgtgaacgtgttgatggagggggccaaatgccaaggacctgagggggcaccgtgggatctgagagtagtccgcagctaataactagcaagaaaatgaagcccaacacttagccacaagaaactgaattatgctaacaactatttgagctttgaagaggatcctgagcaccagaaagtaatgtcgcatagcaaccacgttgattgcatccttgcaagacctcgtgatgaccactcaattaattcatgcccagattcatgcccattgaaactgtgatagtacatgtatgttgttttacattatttaggttttggtgattgttatgtggccatatgcaactaatacagactgtaacactcggtacaatccacatcccctacctatagaacaaccctggctttattcattgttcttatcatagtaaccttcccattatatccttgatttaaggaaaaaaaaaaatcattcttcaaaagaattccaattatgttgtgaagaatatgtcatatacaaatgtcttgtaaattaccaatctgagagggaaatattctcttcatttaaacatagacataattttaataaatcaattatactttttaactctcaaacaggcccaatctattgatattttgctcacagggaatagtattgtttaacaatggcaccttac

SEQ ID NO: 4079 - DNA, 839 bp, Homo sapiens
ttctatactacggtagactacacctataaccaaccacaccgcgaaatttaggcctgctacataagacttattgccacagagcattctaaggggcttattcttcagtgacattattgttttcattgttctcattattttgtctaactattctacccattctggataggacttttggcttatcaaaattacttcattatagcagaaattgaaaatctgtgtgagttttttgccactccgatcaaagtcagagactacttcaagaagaagcaaatggtaaatagttccaattgaagctgaaatgttaagctgactaaagaatatccattaaaaagtgtcacggaggtcatggtctttaacaaaaactgataatgaatgtggaatgctgtgggacaaagccatgttaaagtatgttattgaatattaaacattaactctgataatgtttggaatgcattatgcattccagtgactaaatgaaagcacgtgcggagaatgaagttggctattgtgggcataagtacataagtagtttctttgccttcctcctcttcactaatttccccctagggcttgatgagtgattaaatctaataattgagtttggaagagaaaataaacatgagctaaccaatacacaatgcattgcagctgactatagtaattgaaaagctacgttgactctacatgcatcccgattttggataactgaaaatgtaaagtgatgtgggtcttttgaatcaataaagtaaagttttatagaccacttttctcagggtgagcttgatcatgaataaagggctaattaagcttcaattttgctactctttgggcctctaaat

SEQ ID NO: 4080 - DNA, 468 bp, Homo sapiens
gaaagtaattaccgaagtatttaacacataaaacaacaaacacgagcagcttcggtttatcgaaagataacttacaaatggacaatggccagaccatgtgtaacaataaaactccgatggacaatctctggcagccagcccagaacgatcaggatttgttcaatgactgcgagctagcttcccccttttttaaccctcttacctgcttccaactcaagactaacaacagaatgccaaagacactgctccccaaagcaattacgtaagatgcctcactgcttgttagtgcacctcctgcttcaatgtgccaacaacctccaatcagaagatagcagaagccttcttttccccgcttataaagcttttttactcccctgcctgtctttgagactttgctaaattccaaggatggtggctgatcctcttgctttatcatgctctgaataaattgcttgtttgttctcgaaa

SEQ ID NO: 4081 - DNA, 762 bp, Homo sapiens
cttggccagctctccttctcttcttctgggttctgctattacctgaaggatgttcagagtacctgcttggaattccagaacatggagaatcactggagaagtatacttggaacattcccaacttggattgatgatggatgattagagtgatgtgtattctgattgccctgactggatcagtacacatcatgtgtttgcatcaaaatatcacatgtaccccataaatctgtacaactattacatattcagaaaatttaaaaaattaaaaaagaaattccaattttcttcatttagaacaccaccaatatataccatataacatcattcgcagactataaatatttttcaacactagaaaatgtgtttatattctatgcctattgagtcatagctctctattctactgaaccatacttgcatatgtccagaattactgttttcctgtcacatgaagatagtactggactaattaattgtgtgaatttatgtcccttgccttcagtcacatgtttcatacttagccattctctgactatgtaaagctatctcagctcggagctcctacttactttagtagttctcttaaatgaccttataagaacttctgatgtcggtcaacattacttattggttcccctttactgataaactctcttgtccttagaaaattggcattacctgtaggatttttcgttttcatgaaggtaatcacacctttttcagcctcaaaatcttgatattttttattgttacaccacccac

SEQ ID NO: 4082 - DNA, 823 bp, Homo sapiens
tctattatctatctattatttttgtattataacaaagcaacagaaagtgaggtttctcgcctgaaccctcagatgtgccttggacaaaggatgaatccattgaataacttctaacacagctgctataaagacagggttttgaagaggtaattaaggttaagtgaggtcataaaggtgggatcctaatttgatagaattggaggctgtataagaagaggaagagatcgctctctctttccctctctgcttacacacaaaggagagatcatgtgaacacacagcaagatggcaaccaccaacaagccaagagaagagcttcagaataaaatctaccttgttgtcaccttggtattgaacttcccagcctccagaaatgtgagaaagaaatttcatttgtttaagccacttggtctatggtatcttgctatggcaacccagctgattaagacaaactttgacatcaagaaatagggtgctgctatgaataatacctaaaaaatctggaagtgtcttcacttcttgataataaaggctagaagagttctgagttgcatgaaagaaatatatgcggttctgatgaagtcttatgttagaaatgaggatcatgtcagtgtacactggaagagaatcaatccttcttataaggcagcaaagaacttgggctgaatagcgttcctagtgctttggggaacctatgagcaataaaattagatgtttagctgaggaggcctctgagcacagtgttgaaaggggggcttaatccctcttgattgctatggtaaaatgtctgaggagagagaggaattgaaaaacacactggcaa

SEQ ID NO: 4083 - DNA, 869 bp, Homo sapiens
cccggcgtccctacatttataccacactttaaacacctactcctttaagctcacatcctgtagtttcctttgatagactgccggagaaggtgaggaagaaagccctgcctggaaagcaacagtgaaccaccagtgtcagcaacgtgaagcttgctgcaaggcctgcagtcatgatgaacccagcagcttctagttcatcccagtggccctgagactatttatcctgtgacttcacatgcgctttgaagttttgttgtgatcttcgctgagtctgtgcggaaatcacaggccggactttagattttttactttccaccacgtgacttaaagttctgctcacttgaggaaagggctgataatcctgtgctccatcactgatggaatataaattaacatctccatctctcactcaatccaagtgtccatcaatggtagattggataaagaaaatgtggtacaatacacaccatggaatactatgcagccataaaaagaaacgagatcacgtcctttctaggaacatggatggagctggaaaccattatcctcagcaaactaacaaaggaagagaaaaccaaaccccacatgttctcatttataagtgggagctgaacaatgagaacacgtggacacagggaggagaacaacacacactggggcctgtcacggggcggggtgaggggagggagagcattaggaaaaacagctaatacatgctaggcttgatatctaggcgatgggttggtaggtgcagcaaaccaccatggcacacatttacctatgtaacaaacctgcacatcctgcacatgtaccctgaaacttagaaataaaaatttttcaaaagggaaaaaaaaaaaaaaaaaaaaaaa

SEQ ID NO: 4084 - DNA, 843 bp, Homo sapiens
aggtctgttttctctagaaaaaatattttttattatttccatcatcttatctgggagatgaaatcatatcaaatttgtggaaactcttctagtgagaggcctgcatgtgagatatggaaggcagagcagaatttttccagacagaaaaaggaagatatgaatgccgacctcagcatgggaccttttcatctcttctgcaaactcccctagaaatttcttaagtcactcctaaaggcagctgtgaccattggccaaaactttcctgcagtactgaaactaatggcaaaaactaaaaaagagtttcaatgttctctgaccatctctcttttaacacttttgagtgttgcataaacatctaatttcctgtgtttaatattttctagattgaaatgtagagtggtttcttaatactagataaaatcctggctaatactgttattttagaagtggttccaggaaaaacatctgcacaaacataaacctagtatttgctatcaacttagttaattttgaagacaacgatgattacatcatcagacaaaaattggttataagtttctatcatttagttaaaatcgggtatgtgaattataatgtctatttcactggaataccccccctatataaagaaagtaaatgagtgatcatgtggctgctgaaatggagtatcacaataggagtcatgattcttagggtttggggaggactgtctgttttgtattacacacaaaagtcttacacagacaatggaatgttcagccctttcacccgggcctcaaagcaagcctggaaaaataaagattcggcctcgtcggcctcagcggtggagctctgccgccggaa

SEQ ID NO: 4085 - DNA, 494 bp, Homo sapiens
agctgttgaaggccaacggaagagatttggatcatacagtacctaagacttacgatggaactgaacttcttcattaagcaagttaaaaatcaattagcaatcagttgatttagttaaaaatggtcaagtcagtgtgtgcatatagccaatgtgttaaatcaggtcctcaccatcttttgtgtttgtaaatgaatggaaaacctttcaactgcctatccaagttcattcttcatctcctcgagttcatcatccatactgctgcccccataaaaatgtgatcaaaatataaatttgatctcaccatttccttgattcaaatcttcagaaggcttcgtatcacctacaagacaaaattgggaaccttcagcaaggtgtttaaggtgctgcctcactggactcagttctgctttttcccatcgctccttactctccatcctgctgcaacataactgtaaatacacaaggcatgtaaaataatgcatggataaaacctc

SEQ ID NO: 4086 - DNA, 743 bp, Homo sapiens
taggagaacaatgactgatgttgcagattgcttgaaagttttcatgactggagcactcaacaaatggtacaagtacaatcatgatttgccagcacggataattgtgtaccagtgctggtgtgaggggattggtcacgctgaaaacacttattgaatatgaagtcccacagctgctgagcagtgtggcagaatccagctcaaataccagctcaagactgtcggtgattgtggtcaggaagaagtgcatgccacgattctttaccgaaatgaaccggactgtgcagaaccccccacttggcactgttggggattcagaagcagcacgtaacgaatggggtgactggttatctgatcagtcatgtggactgccggggaactgataatcctacctactataatgtgatgtatgatgaccgcgggtggaagcccgaccatctgcttagactcacgtggggcacgcgccacctgtactgcagcgggtctcaccgttttacttggacgtttccctttagcgctactcttgttattatgatctttatttctatttaattttatgctcttctactctttgtgccgtggtagactagtgctatatacagttgtggacctaatatggggaggtgtctatgtgtgtagtgagtgtgtactttggccgcgtttgttagacactgtattccttgttgtctatgtgtgatttagttgtccttgtagttattggattattaataatcactttatgattt

SEQ ID NO: 4087 - DNA, 757 bp, Homo sapiens
caagaaatggtacacataactggccaccgtccaagctccttagaatagaagttcatgggaggaagcatccacatgtgcactcacatcttcagaacgctgcgcctcctgcccccaaacacactgacctctgccttttcaaaggcaaaatttgatccattaatgttccccagtgttggtttcataaagcgtttggatgggcccttcttcacaaatgaataaaaatgagtaaagtcctcagaatcaaaggaaagccaggactggcttccacaagcacgaggcaacccacagagtccatctgcagccaaaccatgcaacagacccagccacagcttagaggctggcaacaagtctgcctgcaggatccgccaaggaaccagatgctgttgcttccaaagcttggcatcagggcccctgattgccatccaacaaagaggaaaaataggaatgatataatgtggtgggataaaacacatcccacctcaaccttttttattactcactgaaaaaaaatatggaagatatttatgggaaagtaccaatgtttttggaaatattgtacatacattagctacaacaccatttttgccaaataggaaatatatttaaattatgcaggctgcgtctgtctaaaaataaattgtcatcttttctgatcaatgtatatgtccaggatatggaaatgactctgctgattgaggatgctgtcaaccagtgcacttgtaagttaccaggaagtaaagttgtgaagaagtcaaaa

SEQ ID NO: 4088 - DNA, 808 bp, Homo sapiens
  misc_feature (1)...(808): n = A,T,C or G
ctacctcccaacaattgaaggtggttagaagcccctcttgtctcagaatcttcatatgcaaataaacatgcctatatggtaccaaagaatgccatgtcccagtaattcctgacagtgttgaacttcatctgatctctgtgctactgaaaaagagtgatggttaagaaatctcccatctttttgtgttcctggaaataacttactacaaagaaccacccttcctaatatgaataagacgaaactcaaggatggccccttgtttacctaagacgacgctagacacagaacttccacgttcacattatcatatcacaaatgattggctgagctgtttgcctccattgatcaatctgtgcaaagtgcccgtcaaattgacctgaccaatctttaagcagcctctctccttcctccaggccccagaacttcattttgcttctaagcttaagcaagcgccaaaatgccgaacaactctcgtacacagccaacccctcctgagagctggctgactgtagggaaaataatttcctgattgactgtccaatcatacttcctgcttagccgcctctccaacactgtgttctttccagctttgtttactcttgcctataaaatgaaaagccctttctgcctaatctttgcagatcttgtcactggtgtattctccctattgcaataatcttttagaataaagtctttgcttattttaaaaaaaaaaaatcggcctcgtggcaatcagcggggagtttccgacaagncngnccctctctttttcccttttcctctctccccccccccccttttctccccc

SEQ ID NO: 4089 - DNA, 183 bp, Homo sapiens
cctagatgggcttccccaaggatttattgacattgctacttgagtgtgaacagttacctggaaatactgatgatgacatattaccttatttgaacaagttttcctttattgagtaccaagccatgtaatggtaacttggactttaataaaagggaaatgagtttgaactgaaaaaaaaaaaaa

SEQ ID NO: 4090 - DNA, 299 bp, Homo sapiens
cagatgctgtcatccctctggacacatcacgcctctcctccagatcctagcctcttgggggaggtctttcatcatttggacacactgaggaggctccagaaggaaacagtgtgcagcatttggaccctgcggtgaagttgctgggtcaaagctggatctgccgtttcccgattcctcctgatgacttctcatgtgatgttggctggatattcatcgtttatttgttccaagtttctgtactaaactatatgggccagttctcaattaaaatcagctgtcatatggcaaaaaaaaaaaaa

SEQ ID NO: 4091 - DNA, 334 bp, Homo sapiens
tttgagattccaggggacctaatattgagatgaaccaggcatggagaccaagctgcaaaattccagaaatgacctccaggttgttagtctacaacccagccatcgtcaagataacattagactgcgttccaggtggaccatgactcaagatagccaccagaccaaggcacggacacctagcacccagcaccactcctgcatgcctcccactctaagttcccctttataaacacctctccacagtcgaaagtttgaaatcgtcttttaagggcatgagcttggccattcccagatcttggcatttgaataaagtagctctctgttcatcacaaaa

SEQ ID NO: 4092 - DNA, 1032 bp, Homo sapiens
tggacttaataaaggaaaataaaaagcactgtacgtgtgtgggagagagagcaagagagagatagctatgaaaggattttactgtcttactgtcacccaagctggaatgcggtagctggatcatagctcactgcagcctcaaactactgggctcaggagatcctcctgcctctacctcctgagcagctaggactacaggcatgcacaacgaatctctggacctcaagtgatcctcctgccttgacctcccaaagcactgggattataggtttctcagtgaactatgaagcaaggtcatcagctgaaggtgaagatgtggtatggaggcatggaggcttaaggagatgccatatgaaatagtccttgggcagtggagaaatgaatacagcaggaaagattgctgggcagcatgcagggcttcctccattctttcttgcattaattgtagatgcagtgatgaagacaatagcaaccttgcaatcacaccaaaacaaatgtgaaaacaaaagcttcatatgaatcaacagaaaaaaactttaatttctttcatgttttggagccattctacctttcctttactaacttctgacttcatgatatgtgaaaaaaatcactattttattaatccttaatagtcaggtatcagttttatgtgctcttaaactatcctaacctatgcttcacgtttggacttatttgttagatgaaggggagtcactgaagtttttgaagacaaatgcgacgtgactagtactgagatttagaagattactctaatgtggcagatggattttcccaaagtatacattacctctatcccttgataacactttccttggcttagcatcaaaagccacttactaccgaatgtagaagctattaacagctcgtgccaagaaggaaaggtattcaatcaaaactcattgaaaaatgttgttatcaggctggtggtttctgctgggaaattattaggtgaatgcagcggtgtcaaagattgtttgaaaacaaaatgctattagccttaaatttata

SEQ ID NO: 4093 - DNA, 763 bp, Homo sapiens
cttgagtaacccaggttaagtgagacggtgcatgcacgttgaaccagagagacttcatggcatcctccagcccaaggtggcttccggtccgaggtggggtcggttcgcgcgaggagcgcacagcagaggacatgggctgtgcgctcagaggaggagctggctgtccctggaggacgtccttctgagtcagtagagcaagaactacaaggcagtttgcctggaattgaagccagagccgaccaaaacatttgattacaaagcagttaaacaagaagggcggtttaccgaagcaggagtgacacaggacctaaagaatgaactcagggaagtgagagaagagctcaaggagaaaatggaggagataaaacagataaaggatctaatggacaaggattttgataaacttcacgaatttgtggaaattatgaaggaaatgcagaaagatatggatgagaagatggacattttaataaatacacagaagaactataagcttccccttagaagagcaccaaaggagcagcaggaactcaggctgatgggaaagactcacagagaaccacagctcaggcccaagaaaatggatggagccagtggagtcaatggagcaccctgtgctcttcacaagaagacgatggcaccacaaaaaacaaaacagggctcactggatccccttcatcactgtgggacctgctgcgagaaatgtatgttgtgtgctctaaagaacaactacaatcgggggaacatttcttaagaggcctca

SEQ ID NO: 4094 - DNA, 1015 bp, Homo sapiens
aaatgttgcggaaggggcaggaaaagatggaatccaaacctcaagtgttggtgctcctcttgaacagggagagaaacaccctcttactgcggagagaggaacagcagcttggacagccgatgcaagaacaggaaatgggatcctaaacctttctggctgattttagatggctgcaggaggacagaacgtttaagtcctaggagataaaatcaacaacttaaacgactttgagcaacttcactcccttccaatctcaagtctgtgtacttccaacattacaatttatgcgaattgccactttcaagtattgtaacttctataatggaaagaaagaaaaaagaaagcagctacagtagccacattctggattgccttccactcaaccaacccagtcagatgccccgctggtctctgagatgcttgcacacctgtgttccaactagctgggctgctgttgtcccatccttgtagagctcctggatgctgacatgcacctactttgttggactcacaggcatggacttcagcagctgaatggtgtgcttagtgtgaaggatattaacacagaggtgtgcagtgggcagaagggccctgcacacagccagatcctcctgccagctgaggacaccagacgagttggcaagaaagcccatgccacgtctaaagccctgatggtgccaggacgatgttctccaggactcaccagctgcccttcctacatctggctggagcatcgcaaacacttatctgaacatatccagcttacatgggtgaaggacttggaggactatgctaatggcattcacagtctgggtatatttccacatcaatacccatgaagccctcaatttaggtttcccaagaactggttgtgcttttgctaaacgcgcttatgctgcttctactcgatattggtattaattcagataagccaataacagcggtaataaatactgaatgagtgaaaaaaaaaaaatcggcctcgtggcatcagcggtggagctttgccgaccag

SEQ ID NO: 4095 - DNA, 808 bp, Homo sapiens
tcataaatggaagagtggatgaagcagtctctctgggttttctggattgctggataggtggagacctgacaaatttcaaaggctgctacctgactaaccaactgcctattcaggatattccaacctgaggtattcaaagactccatcaccagagagaaagttagattgtcacttctggggagtcttctgccctgcatatatcccatattctttcagataaatgaaattagcttgcctgggtattacacgtgtttatgccatactactattaatactcctaagagaagacctatcttgacttaacactagcaattttgacaaaataatgcacaaatgtatatcaccataacttaacgatgaatagtatattatctagagtaaagtggcctatataaaagcaatgaaggcttcctgtaccttctacactgaaatgtctaaaatgactaacataccttcttttttattttacaataatgcccaaaatgctacactcgctaccccacttctctttatacactggtaggctcgaaaaaagataaccttgaatcatttaccaccccaggcctttgaaatttcgcaatcccgtattcctattattcactaactataccccttttgtccttaaatctttaaaaccattcaatacaaagaaatgtcttaaaggatataaatccatcctccttatatatactaaagacgacctccctcgctcttaataagtttattcccctcataacaaattataatcagttcgagtgaaagcccataaacaacccccaagactataccatatatgagaataccacag

SEQ ID NO: 4096 - DNA, 840 bp, Homo sapiens
tagaacgcaccgctcccccgcaacaaccaaggacaatccacacaccaactttaaacgtaacctctctcatccctttctggagtgcacaggcagaatctcagctcactacaaccacctcctacctaactgaagagatcctcccatctcaagagtcctgactggctggaactacagagtgccttctgagtgtcgataacattggcaggattttgtaccctgacactgcagattttactccaacagctcttgccatgtgagatgtctgctccccattcgccttccaccatgattgcaggcttcctgagattctcaccagaagcagacaccagcaccgcatttgtacagcctgcagagatgtgagccaattagacctcttttctttataaattacccagcctcaaatatttttatagcaacacaaacagcctaacatatggtgattaaagtaagatggaataaactaaaaaatctacactgtatgtaaaaaacgtgcattaagcaaacatacctaacggtattaacatttagagaacactaacttcccaacagtctcattccactattcatacgctattcctagaatcccttccacgcctttctgtaggtacataaagtcgccctacttaggcctcgagcgcgggaaccttagaggcccgctccattaaggggcgtacacaaaagaccctcctttacatgatttgatggaatcgcacctgacaccctcacgcaacacgcttttattcactaacaaggcgacatacggctatcatcacatacttggccccgacggaatgtagttgggagataagcccacaagggcagggtgtgtatatagccgtt

SEQ ID NO: 4097 - DNA, 822 bp, Homo sapiens
gtagattggcctctaccttgttgtccaggctcgtctcaaactcccaggctcaggccatcctcctgcctcagcctcccaaagtgctgggaatacaaggtgtgagccaccatgcctcgccctgaaacattctctaggacaactgccacaatcttcaacttatgagatcttcttcacaaaaagatgctgtttaagaaaaaactaaaggaacataacaaaaagatgaaatatgtggatcttagttcagacaggcatcaaaggacatattgaggggaactaagggaatttgatttagatgggtattagataatattaagaaaggttaatacattttattagatatgatcctgtttattttggctatggaagaagatattcttttttatggaagcatcctgaaatatttagaagtgaactattacctggtataaaattcatattaaaatattttagcatagacaatgagacgcaaatgtgtatatgttagttttaatctaccccttaagcatgatcaggttgccctaactgggaatgcttgatgccaactatagctaggcagattgttatttcaaaggccacacttcaaggaacttaatggtaagcacttcacctatccttatcttcaaaccaacaccagacttttattaatttagcataattaccacacctcgaatcggctttttaacagacattatcggatggcctccgaaccccagggcaattccccaaggggttactttccgagacaacacttcgtagaagtatgagttcgggtagaattaatttgagggtcttacaccttaagttaaaagggtgtaaattacg

SEQ ID NO: 4098 - DNA, 1015 bp, Homo sapiens
ttttgaaatagttgaagagatatattctgacccaaatatgagtgaccaatggcctgtgacacagccccaggagatcctgagaacgtgtgctcaaggttattgagctagattttggttttatacattttagggagacatgagacatcaagcaatacatgtgatatgtacattggtttggtccagaaaggtggcacaactcgaagaggtgggcttccaggtcataggtggattcaaagacttcctgattggttattggttgaaagagttaagtaagtacctacagacctggactcagtagaagggagtgtctgggttaagttaaggggtgtggagaccaaggttgtatcatgcatatgaagcctccaggaaaccaggcttccaaagctcttatccggacctaaaaatatgcctggatccaggaaaaaactttggaaagggaaggggatgctttgcagaccagattttccccacaaaagtgaggtttgcagggccatttcaaataatgtcaaatatgtatattaatatttaggggtaaaatggtttaatttctttcagggccctctgtcatgtgatgctatactagagccaggatagaacttggtgtcttattgctacaatgagtctgtttagtcagtcctcagatttttgttttaatgttaatgctggtcagttgtgcctgaatttcaaagggggagagggcataataaggcatatccaacccccacttcccatcacagtctgaactgtttctcaggttaactttggaatgcctttggctgagaggaggggtccgttcagttggttgtggggcctagaattttacttttggtttccaagttgaatgggtctggacatgggacgctgcactggaatcagatctgggtcctagtcccagccccggaaccagtgcagaacttgcggcttgaggtcaatggttgctctgcccaaactagccttgtgtccgcccctgaggtcctgctactgtctttaccgctctcttccctctacacgtacc

SEQ ID NO: 4099 - DNA, 700 bp, Homo sapiens
tttttttttttttcgcttttaatctatttattaatgaagactcaaagataaagcacagattcacaaaaaaatcccaaagagacatttttttagttcttcataatgatgacatcaacgaaatgaagattcacagaaaaaggtgacagacagtaaataaaggctgggagtacatttatatacttactgaatgccgccttttttgaaatgtatcccctctcttctgggaaaagctcaaatttgaagaatgaagaattatgcctcaaaattctgttccattatgtttccacctttactcaaactctccatgatggccttatttcgaagaatatcctctccactgaggtgttctcttcttttccttgattctaaaacaagtccattcaccaggtaaaagtctgccaaaaagtttcctactctttctgttttatcttcccgaaaaagccatcctgtctgggcacgcgtgaaagaaattgattttgttgataaagttgcagagtaaatatcactgctcattaaaatatccacctcttcttctgtttccatctctgattcctcatgatgtattcgctgataaactttttgttcattgtctaatactacaaaagattcagagggcgccgcatccccattgaaaatgaagcttagatcccctcgttggcacttcatgtcagtaaagactatgagagttggtcacgcctag

SEQ ID NO: 4100 - DNA, 662 bp, Homo sapiens
cctggcaggaccttcaggagctattctaggaaaagacattgttatcaccagagatgacacctccctgcattctgttgcccctaaagatcttccaatgggacaagatgtggaggtgaaagacagtgacattgataattctgaccctgttgtaggcctaggctaatgtgtctgtgtgtctgagtttttaacaaaaaagctttaaaaatgaaaataaaataaaaatagaaaaagcttgtaaattaagatattagtcagttttcacaatcctacaaagaacttccctgagactgggtaatgtataaaggaaagaggtttaattgactcacagttctgcatggctgggtaggcgtcaggaaacttataattatgccagaagagaaagcaggcaccttcttcacaagacagcaggagagagaagaacgaagcaaaggggggaaaacccccttataaagccatcagatttcatgagaactcactatcacaagaacagcatgggggaaaccgcccccatgatccaatcacctccctccctcgacacatggggattagaggtccatctctgcacacgtggggattacaatttgagatgagatttgggtgggaacaagagccaaaccgtaccagatataagaaataaaacatttttgtgcaactgtaaaaag

SEQ ID NO: 4101 - DNA, 123 bp, Homo sapiens
ccacaagaaggcatctgtctgcaatgccaggagagagccctcaccagacactgaccctgccagaccctgatccaatcttcagaactgcaagaaataaatttttattgtttaaaaaaaaaaaaa

SEQ ID NO: 4102 - DNA, 783 bp, Homo sapiens
ctgatgagtaaaccaggctgagtaaaagctgcgtgacttggacaagccgtaagacaaatgagcagcaggagccaagacctgtcctcacctcttctgactgtaagcccagcatcacaccaacctagaccttgggaggctaagcacttggaggattcttccaaagagaagcagaaacctactttccctacaggcctcaatgagctacatgaaacccattgacatagtttggctgcgtcctcacccaaatctcatcttgaactgtagctcccataattcccatgtgttgtgggagggacctggcgggagataattgaatcatggaggtcgtttcccccatactgtccttgtgatagtgaataagtctcaagaggtctgatggttttataaggggtttcccctttcacttggctctcattctctcttgtctgctgccatgtaaggcatcccttgctcttccaccatgattgtgtggtctccccagccatgtggaactgtaagtccattaaacttcttttctttataaattacccagtctcgggtatgtctttatcagcagcatgaaaacaaactaatacacccattaaaaagttaagaatgtattggtacaggttattttgttcaaaaaatttgtttaacattcattcatatggaatccttaaacttgatgtggaaactgaagtgtaatctcacaggtttcaaattttttagttttcagttttcaggtgtaccttttaatactaggaatattggtagattataccccatcaacacaagtttttggtg

SEQ ID NO: 4103 - DNA, 773 bp, Homo sapiens
ccttggcggcacagctccaccgctttagccaacgagaccgattttttttttttgccacggaagaaggctttattcaggtctgcagccaaggagatgggagctgaagctcaaatccgtcttcgggattgactaaaattagggtttatatagcagggaagaaatgtaactatctaagggaaaacaggaactccataggggtaaagaagccatcatgatgaatgaggggcctggtgtctcattgtctggatgtgatgatctggtgaattccagttctttcatactttttgagaggcctggggctcctttcattttgggccgggcgcagtggttcgtgcctgtaatcccagcactttgggaggctgaggtgggcggatttcctcgctgtattttttttatttatttcttatttttgtttgtcctttgttttttatatattctatttatatccaccagcggcacccaatctcttatggccctctgtgtaggttagtctcctctctttcttttttcttttttttttattacgctcgttctttgcattccgcttcccgtatagtctatactttctcacttctatttccttgctttcccttcttcatctcattttctgattgaattacattctaattttttctatcccactgagtatttttggccgttcttgactctctagtcttttagttttgtttccttcttctcttacattatttccaaattcctcgtttttttttctttagtctagtctaattctatttcttccatcgatgcgtgat

SEQ ID NO: 4104 - DNA, 983 bp, Homo sapiens
gctaggaagccccaactcagttgcttgaactaagtaaaaatgaacagaataagattaggaccttcgaggaactcactatcaactaacgataaaccctgtgataaaagcctggggaaacagcaagagagaggcccagaagagaccttgggaggtcagagaagacttcatagagaagatttcagccagaagttccttaaaggcaggaggtggaccagaggggcatgaaagaatactcacatttcgggaactgcagatagtgtgttaaacacacttgagcataaggaagtggctgcagattgagctaaccctggcctgatcatggaaactgtttgatgccagtggttctccaagtgtggtccctggaccagcagcattgacaccatctgggaacttttcagatgtgcaaattctcaggcctcatctcaaacctactgaatcagaaaccgagcatggagccatacagtctattttcaaagttctccagtgattccattgcatgctaaatctcgagaaccactggtctaagccattctcaagtgtttggacatcatttgttggaggatggaaagccacagaagggtctaatgaaatggaaaaaccatataggcgtagcaagtaaaatccttaattaagtagtcaatatggagtcctaagattgtttcaagatgctttaaaaatataaggttacaggattgatccattatttacatctctaacttctaaaacagctgtctctcttgctgttaccaaaatatagcaagagacttttggccataactaacacctgacggcattcctgcctcagccacaaacatacaaaggtatacctttcattcacaagaaatgctctgataggaacccagacaacatatacaccaatgaaaccaggaaataacacctctgggaatcaagaaaaaagcagttgctttgttattgtgttagtcctttctcactttgctaataaagacacaccaaaaacttgg

SEQ ID NO: 4105 - DNA, 759 bp, Homo sapiens
aggactagctttgcctcagatgaaactttggacttggacgtttgagttaatgctggaatgagttaagactttgggagactgctgggaaggcatgattgtgttttgaaatgtaagaaggacatgagatttgggaggggctggggtagaatgatatggtttggttctatgttcccaaccaaatctcatgttgaattgtgatcctgagtgttggaggtgggacctggtggaagataatggtatcatgggggcagtttctaatggtttagcaccatccctccagtcctgtctcatgatggaattctcacaagacctggttgtttgaaagtgtatagcacctttccctttgctctctctcttctgctccagccacgtaggacatgctgtcttccctctcatgttctgcaggattgtaagtttctgtggcctcccaagccatgcttcccatatagcctgcagaaccatgagccaattaaacttctttttttaataaattacccagtctcagatagctctttatagcaatgtgagaacagattaacatacaaacagttgaccatatgtatgatagtattcctgtcatacagagcaagaaatatcatgaaactaaaaattgaaaaataaaatctgttatttgtgacttaccaatttgccttaactgatcatcaggaggttaaaagtgattgatttaaaatttgtttgacatcttaaagaagttaagaggaatttgtttctaaatattttccataaatgtgatggata

SEQ ID NO: 4106 - DNA, 407 bp, Homo sapiens
atttcaagtgcagaatcaaagacatataaccataataaaatgcaaaatcacaagccctcagaatcagaagggatgtcaaggaaaatgccttccctctctccacctctctgaatgcagaacactgaagcttctgtgcatctggtgagcacgtggtacagaattgcaagtttcatgagccctgattaacttctcatagaggctggctgtgttagacttttgctaaggccaagagttttattttgttctatcctatttcattattataaaaatctggagagttgcttattattatgaactcctgtttgaagatatggaaatgaggaaaatgaagacctatggtacttttttaaaagtgatactataaataaggaataaaatgtgaagttgtgtggttaaaaaaaaaaaaa

SEQ ID NO: 4107 - DNA, 707 bp, Homo sapiens
ggaagagaagaagagaggaagggagaagaatcatgaaaataaagtagaagcttaggaaggaatgaagttagaaaagaaaaagagaggaagagagcaaagaggaggaaaacagaagacaaaaggaggagcagacaggtgtttttcaacgaagtgctaaatttttcctggctgattccaagaggaaaccttcaggtacatatgtgagtctccccaccactagaactcttaagtggctgctgttatggaaggtcaggctcataatcactgcatattaagtccttaacagcaatgtctggctcttcattaatctgtaaacttactgatttacccgagagatgtctttgtttttctcggcgttttttcatctacttctcaccctggtgccaacgcaatttccagaaaatgaaacaatgattagtttatgctattgcatattaagtttggttttctctgtatttacattgcatgtttcaaaggttgacttaatcagctgtgagttgttatgcagttagtcagagtggaattcccacagattttttcccccaatgtatcacatgacaataagagagctagacacaccttgtgtagttttaacaagtcttcgcagttttacttaatttgtttcccttcccttttacccctgaggctcccaaagcaaatgaaccattcaggagcataaaacaaggggaattagtttagacttcaat

SEQ ID NO: 4108 - DNA, 644 bp, Homo sapiens
  misc_feature (1)...(644): n = A,T,C or G
atcttcatctcctgatgcctagataacattttcatctcaaatggaggatgcaagaaaagatgagtgaagatcgtacttgggatagagggaagggaggaattgaactcagctctgcaccaagcggacctaatagacatctacagaactctccaccccaaatcaacagaatgtacattcttctcagcaccacatcgcactttttccaaaactaaccacatagttggaagtaaagcactcctcagcaaacgtaaaagaacaaaaattataacaaactgtctctcagaccacagtgcaatcaaactagaactcaggattaagaaacacactcaaaaccgctcaactacatggaaactgaacaacctgctcctgaatgactactgggtacattctgnaaattaaggcagaaatcaagaaattctttgaaactagtgaaaacaaagatacaacataccagagtgtctgggacacagccagaacaatgtcaagaggaaagtttgtagcattanacacctacatcaaaatgttagaaaaatctcaaattaacaaagtaacatcacctctagaggatgtagaaaaaacaagagcaaaccaacccaaaagctagcagaagaaaaaaaataaccaaaatcagagctgagctgaat

SEQ ID NO: 4109 - DNA, 228 bp, Homo sapiens
tcgccacattgacacagaaatggtaaagaaaacctcgttcactgagaagacagacgctaatccacaaacccagagcaagaccttaatgaatgtggcgatgcagcagatgcctggaggagaaggtggtcgggaagaagttacatccacaagcacagtttcacgtgtctctagtctgtctccagataggttaatttggggatcttcaaaatttgaagatcacttggaaaa

SEQ ID NO: 4110 - DNA, 552 bp, Homo sapiens
  misc_feature (1)...(552): n = A,T,C or G
acaatgcaatgcaatgacatcatttcattatatggaatgttggaaatatgcaaatagaaaggtcagcagaagaaaccactgcagaaagaagcttggtcaggacagcacagcaggaaacagattcaacatccttgtctccgacctgtgtttgcctatgaacccatcctattcaccatattgaggtctgatcctaccagcaccaaaagagtgaactctcaagaaacatttcccttggaattgaggaaacagcaatcagagcaacagcagcaatgaatgaaggaagaaccagtgcccagactatgccagaaaaccaaacanatggctctcagcaaatgagccaaaacatgtcctgcaatgtatattttatgtgtgggcagggacaatttcaggcacatttaccttgcatcctgagtgcctggcacagacttctctcttgagaatcatgcttagatctaaaagaggaaccgcagaagagtgtcagtgataatgaaaggatgatgaaccatatggaattcctgaattactaaaagcagacgagcaagattttcaaat

SEQ ID NO: 4111 - DNA, 616 bp, Homo sapiens
  misc_feature (1)...(616): n = A,T,C or G
attttctttgagtttggatactcaaggaggaatttattgtgtgggaccttatgaaagagacattggacaacaccacggacaacattcttatgctgcacttttgcagtgatttaatgactgattaaatggactgcgcaagccttgatcttgaggaaagaaaggatgagtgtgtaacatccagccacagcctcataaagatgtttcttttcaggaccaaatcgaacattcctttctttgccttcttaacacaggtgcagtgttgggactgtagaggaaggattagttaacaagtcctctggattctctctcacaaatatcaggggttttcagggagccattgattgttgctggattgcagtcaggtcccgaatttttctgcccgttctgagctgcttcatagaagagccgggtatgctgctggccagatgcaaaggaggctcctaccagtgtgtcattatagggtcatgtcttttgctcttttcaggaggcgcatactcttcacagatgcatcagctgaaaaatgcctataaagaaccttaaatcttccntgtcactntgttgtgatttgattgagatatgtgaattccatcccagtgaaaatggnaaancattattt

SEQ ID NO: 4112 - DNA, 543 bp, Homo sapiens
  misc_feature (1)...(543): n = A,T,C or G
tggcctgtcccaacaggaactcacatgggttgagaaaaaaaatttttccttcctgacagtttttggcaatgcagatggtactttctgggataccccatccactctggaacctgcagatgaaatcctagcaaaactggcagaagctggtaaaagaaagattcatggaaagcactctgacaaatacaggcttctgataacttcaagatcataccatttggccagaaatgcctcttattagatcaccatatagaggcctaactttgatgagagctcacctgcaatatctcctgaaatgagacacaactgcttaattgaattgacctattctcagcactaagacaatgatttgatatggggcaatgtacttaaatttgttcagctgcacttgttccaatntangttttcctcttcctttgccaatccctgatctcacaatctctaatccaaatctcttcaaagctaccaacttggagagttctaagccaccattttgagttactttgtgttgtggtttctcctgcattgtgtgctgcacgtattaat

SEQ ID NO: 4113 - DNA, 155 bp, Homo sapiens
attcacctgtctgttttgtcaacactggagccgctgctgacaaagactggttaataccaattggccatgccactttttccactttggttgttcagtgcctcattcaaggtagatgctagttctaatgagctttaatatgtgaattaaaaaaaaat

SEQ ID NO: 4114 - DNA, 870 bp, Homo sapiens
  misc_feature (1)...(870): n = A,T,C or G
cttctggtcaatcaaaatgaagcttctcctttgggcctgcattgtatgtgttgcttttgcaaggaagagacgggtccccttcattggtgaggatgacaatgacgatggtcacccacttcatccatctctgaatattccttatggcatacggaatttaccacctcctctttattatcgcccagtgaatacagttccccagttaccctgggaatacttacactgacacagggttaccttcgtatccctggattctaacttctcctggattcccctatgtctatcacatccgtggttttcccttagctactcagttgaatgttcctcctctccctcctaggggtttcccgtttgccctccttcaaggtttttttcagcagctgcagcacccgctgcccacctattgcagctgagcctgctgcagctgcccctnttacagccacacctgtagcagctgagccttgctgcaggggccccctgttgcagctgaacctgctgcanaagcacctgttggagctgaacctgctgcagaggcacctgttgcagctgagcctgctgcagaggcacctgttggggtggagccagctgcagaggaaccttcaccagctgagcctgctacagccaagcctgctgccccagaacctcacccttctccctctcttgaacaggcaaatcagtgaaattctctagaagagtaccatgggttcatttctatactgatgcagaaataagtgaaatctacaaaagttttctttcctttccaaagactatttcattctgttgtattcagagtattcatctcactacattgatttgtttgtggtagtttttccttggacttaatttatattgaaaaaacattgataattaaat

SEQ ID NO: 4115 - DNA, 849 bp, Homo sapiens
  misc_feature (1)...(849): n = A,T,C or G
ctgtgatccagcagacccaacggagcctgaagtgtctgtggcagagagggatgctgcatggggcctttgctgaattgtagtgaaggcctttaggattttggaggaaggccttgccatcatcccagatgactactctcctgttgagagaaagctcantgttgtcctgtcactgggttntaatagaagctggccacctgaccatggaccacctacttgctgtgtgacctgagctgcccagcataagctggggacgctgacccaccactctacaacactgggggtgcacagctaccctccatcctcaaacagaagcaacagagcgtgaccagtgctgagcaggtcctggagacacaagtaaagtcacacnaggcagtggcctannagcccatgggccccacttgcagcctcactgccttctttcccaaacctgcacctgtggcctnatggggagatcccttaggatccgttgacagaggaaganaagactgggcctgaagttacagatggntcttgccgcatgcaggcagcacacaggagtggatgctggcagctccaagcccctgtnaggtgtccccaaaggacaacggtcaacggaaatccccccagggcanagctccaacagtgcccatggatgttctntttaattcatcttgttntttcatgngtgtgtgtgtgtgtgtgtgtgtgcgcgnacatgtacgtgtgtgtgtaganagagaganataattatcgtcttctatttagaatanattgcctttaatgttttatttcctagtcatgtcaaatatttgtgttgtaagcaaccagnatctgaatttgccccataaatgcatatttatttattcaaat

SEQ ID NO: 4116 - DNA, 670 bp, Homo sapiens
  misc_feature (1)...(670): n = A,T,C or G
tctctttaattaatccaccgcttacaggaaaacaaaggcaacaagaagaatgaggaagaggaggaagaagagagggaggagcagaggagaaaaggaagaaggaggagaaaaagaaggacatgcacaaaagcaacgaggtcatttcatgaaagtcaaattttgctataaatttggccaaagaagtggctgctcacaggaaatgggaacataaataagggtaaggcacaacagccactggtctaaacttgcagcacgcagacaggctggagtgaagttggaggaataaatgttgaactccaagttgcccccagagttctcaggcctcctctggctttcttcccatttcggaagcgctggactattgttattatcattatttaaaatgcttttcaagaccaagaggtatgaacagggctgttccacaagcagccccactttctttntaatttgctcactcagtcctgaataacttttcagagggctccagacaccgcagtatgacagctaaaccaaggcgcatcggatgcgatggaattgcgcccttttcatgccaaagctggcttatctttgatattgagggagctaatcaatgttaaatgcttggctctttcacaggacatgaccagacctaagctgcgtcctcctgcgggattcaccagagcgctgctca

SEQ ID NO: 4117 - DNA, 1180 bp, Homo sapiens
  misc_feature (1)...(1180): n = A,T,C or G
atttgacggtcctgtcatccccagaactgtgtatgttactgatcctgcctgtattcaaagctgttattaagtggagtcttttagattttagagaaatgataatggctccaaagatgacagaaagtggcagctggtgacaaaaaaaaatcccttgataagacgacaacagtaaatcaaactaccgccactttttcgtttcatgtttgttaataccacctcgccttttgaagtttaaagcaaggttcaaaaaagccaggtgctgaatcataatattaaagcaaggaaggagctccatgaaagcgaggaggtctgagggggggaggcaacaaacacagctttcaactgccttttgtcggcctttctgcagatgtcaccagtggttatcccaacaaaggttggcttgnacanggccttggctnatcccgcgctgggnttnaagtgtccaatcaaangaaggaccaagttagntcctggcattgtccttgtaaaagagccaagcnttnaccattgattaagttcctcaatatccaaagatagagccagctttgtgcatcgaaaaggcctttggcaaggttgcttgtagaagcaattccatggcatccgatgcgcttggtttagctgtcaatactgcggtgtctggagccctctgaaaagtattcaggatgagtgagcaaattaaaaagaaataacacgttcccctgaaagggtggggctgcttgtggaacagccctgttcatacctcttggtcttgaaaagcattttaaataatgataataacaatagtccagcgcttccgaaatggtgagttacagcaagctaggaagaaagccagaggaggcctgagaactctgggggcaacttggagttcaacatttattcctccaacttcactccagcctgtctgcgtcccatgtggccttcagggctgcaagtttagaccagtggctgttgtgccttacccttatttatgttcccatttcctgtgagcagccacttctttggccaaatttagggtggaaaaatgattatagcaaaatttgactttcatgaaatgacctcgttgcttttgtgcatgtccttctttttctcctccttcttccttttctctgtttctctttctcctcctgctcctccctctcttcttcctcctcttcctcattcttcttgttgcctttgtttt

SEQ ID NO: 4118 - DNA, 600 bp, Homo sapiens
ctaggaagggagggcacctgtccccttactctgacctgaagccttgtaagattatcagcatgcagccgggcgcagtggctcatgcctgtgatcctagcactttgggaggccaaggcgggcagatcacgaggtcaagagatcgagaccatcctggccaacatggtgaaatcccgtctctactaaaaatacagatgggcgtggtggcacgtacctgtagtcccagctactcaggaggttgaggcaggaagatcacttgaacctgggaagcagaggttgcagtgagccgagattgcaccactgcactccagcctggcaacagagcgagactctgtatcaaaaaaaaaaaaaaaaaaaaagattatcagcgtgactgttcctcactcaagttcccaccaatgtgggagaaccagacatcctgattctgaattatttttgcccacgttatttcccaggactgagttgagtagttacaggcagatgtttaggcattgggtcacatggatgtggactgttatgctacctttgacttattctgtttatttatttaagtacatagaattggattaattatagtccttgcttcataaaaaaaaaaaaaaa

SEQ ID NO: 4119 - DNA, 760 bp, Homo sapiens
ttcttgaccctttatctgttgaccaagctaaggcagaaaccagccaaattctggatttaatcttgagcagcaaaaaagatcagcttttgaagtggatctgcttttattcttggcaaaagttcagcggagaccaaccagagtggtgacaaagttcttcaacatcaagccaaatgtaatacaaggaattacggatagtgcttaatctaaaataaagaaattccacatctccctaaaaagctattggcttcaagaatgaaaacaaaagaagcatatttgtctcaatccaaacacagacaccagaaagacaaaccaggagtatacagcaaagtagcttgcaggaaaatacattgaaaaatgtaattgtgcataaatcatgcacaaagtagaaaccacaaattctgtatttggcaaggcttcggttcctttgcataattctttcattttcatcttgctgcttccattctcttttcatcaaaaaaagctacataaaacaaagacattaactgtatgcaattaaaatgagaaaatagctgaaaggaatgtattgatattatgttaaaatctataccataagtattcttgcattgttaagcatctaatttttcatgtggtgacttcagcatctcaagtctctctaacatcttgaaagctttttttttaaggcaacttcatttagagggaacaaactatggtaccaccaagttgacacaaattataactatttcccaccgaaagagtaactcaagaaaacctccagcag

SEQ ID NO: 4120 - DNA, 287 bp, Homo sapiens
gcgtcttaggctagagtcggatggatctgattaaagaggaagaaagctagctacaaaacgatcagtgagtacctctctttctacatgtagtgctgccgctgggaagaaatcggtcatcatgaatattcattggacaccaccaagtgctacaccagactgagatggagaaggagaaagagaaatggtccatcaaattagaagaaaagcccttttcatgatttatgaaaaagagaactattaaaccttatgcactacaaaaaaaaaaaaaaatggtctttttggcctca

SEQ ID NO: 4121 - DNA, 516 bp, Homo sapiens
gtggcggttgttcatgtctactgtgtacacgtttagttacactacgagcccttgactatgtgaccaattttcgggattggatttgacagtatcatatttacttctgtggcccaattaatgaggaagttcaacactgggggaggctcatttagtgaaatgaacgcatgtttcatcaatatttcaaggaaagccccatctggcatggaccaggagggtttgacttgtgctggagctgaaagatcttttcaaggcaaccaagtcaagcaagattggctgagatctagagaagcccagccagatggcagttgaagagacagtgggagataaatgctgtcaagtttgaatcagagtaagctggttgctgcataatgtcagaggaagttcattgcatgggagaaccctatgtgcagaagtcctcctttatccatgattacactttctgttatttcagttatctgaggtcaatgggagtccaaaaatattaaatgagaaattccagaagcaaaaaaaaaaaaa

SEQ ID NO: 4122 - DNA, 839 bp, Homo sapiens
  misc_feature (1)...(839): n = A,T,C or G
gggaacagaaatgaactgaattcaagaaacagaagggccaaggaaagaagtccatttgaatgtatcaacatgcaggggggaaccactgaaaggagtggctacccacccatcaagagctggcaattcgctgctattaaccgtgactgtgattcccagtccgcctggcagttcctgagaaaggcctgcaatgtctcatatgcagtaaaagctgtaagatgcaccctggccagcacactggacctgatggatgtacaatcctctggaacagtagtggattgagcacacttgcgattgaagcagggagaggaggcccagacccctacaaagggcctgctgatttaacggtcgctttacagggtctttgggagtgtatgaccattttttgaaacatggagatttgattgaaaacaacgacattaacaacaggcagttttgaagtagcaaagcgatccagagtagataatcattaccccatctttccgaagccaggttaattacaagttaaagagtcatcagacctggatttaaatcctctacccttttcttatggttaactccttggggctgactctaagcctcaattggcttcatctggtaaagggggaattattggtatcctctttaccagaatggttggaaggggtaaaataaaagtcatttaaggggtaataggcaaattaaatgcctttttactgtgggaaaaaagnacaaaatgaggcaagaaaagatcatcgagatagagacactgggtgttgcgctctttggacccaagggggtgagcttgtgatgcgcggtccctgtgagggggggtaattaatgaacctctttaatgaattctt

SEQ ID NO: 4123 - DNA, 969 bp, Homo sapiens
ctggcttccttcatgcggtgttttattcctcagaaccaagatggataaggatccacactctagtggatcctgtccactgctccattccctccacaaccctcccacagagactaagttctggggggcagtatcagaacacagtgctggggacagtactggtgagcccttgagtgtgaactcaggagtcagaatgccagaactttgaatcccagctctgctgctgagctaggtggatgctcctgggcaagttacctaagtgctctgtgccttatttcttccatgtgtaaaatgaggatgataaattacctactttatagagttgtggagattaaattagtgaataccattcaagctcttacaaatacctgacacataggaagccctcaatgagtgtgaagagaatattattaatacttgttctcttggcttcctgacaaaatccatttatctctatgtcagatgctacataaaatattccaactgcatgctcagagtcagacttaaatcaccaaaatccagttaacttatgtcacaataaactaacctgctgaattgaatgttatgtcaatttttaagcaattgtgattaatcataattttggggcatcatttatcagcaaaaaaaataatgttcttagaattgtgccacagcactctctattatgtgcctgaacaaattagctagagctttatataatgggcagagatatttgttgttttcctatagagaaacctgaacactcattgaatttttacaaatgaataattggatttattttaacaagataacgttaccatacataattactttggataatcctctttgtaattgtaatgccatcagtgagatatcagtttcttggggttttgtttgcttgcttttcccatgacccaaggaggaaatgctcccaagaaaactctatctaaataaatgtggcagctggattaaagaaaataaaaaaaaaaaaaa

SEQ ID NO: 4124 - DNA, 646 bp, Homo sapiens
tttgatcactcgtcaaactactttctggagaaaaaagtctgaaaatccattatgatgaggaatggatgactgaaggaatcaccatgagatacaggagtagtggcatcatagtggagaaaatggtgacattacaagatggtggctattggctggaaaaaaggacacagagcaccaaagcctgtgctaactctggaggacgtaaaacactagagagtcatgtctgccaacgttgggcaagaattcccagagaccactgggaatcatgaagacctgactttcactctggatttcacccaagcgcaactaagtttctcacgatatgtatgaagactggagaaatcaaggctgacgttgacatgatgggtgcatattaggtagaccaactacttccaaaagtgctgatggttgctggggaagagagaatgggatctctgatgaggagctatgagatctaccctttggtctctcctcttccattcttgttctgccactgactcagtgtatggcctgggaaatgtcatttttgctctcttagccttgggttcttcatatgagacagggcaggtgggatgtaaaatagaacagcagttctaaatcttttgatttataaatacttgaactttttaaaaaaaaaaaaaaaaaaaaa

SEQ ID NO: 4125 - DNA, 1159 bp, Homo sapiens
tctaggtgagcaatctgaagtacagtacaaattaaatgaaatgtttttaagaaagacaaatgaaactaacaaatggtaatccagcaccagcatcactgtatatttgtattgtcagcagatttagctactatggaaaatctttgaagaatctttctcaacatgatttttgatatacacatgctctaatttattgtgggtatattcaacagagtagaattgctgagtcatagggtgtctgcctgttcagtttttgttgacactacaaaataactaatgtaattgtgccaatttacttatctaccaacaatgtatgaaagttgtgattatccatatctctaccaaaacatgagagtatattttctttcaattcaaagtgtaattgaacttaaaataaataaatataattaaaactccattttggtaggtattataatccatggatggattacttttaaaaatttcattttttatttgttgctgacgcataaaatttatttcttttaaaaaatattggacggtcacagtggctcatgcctgtaatctcagcactttgggaggctgaggcaggcggatcacctgaggtcaggagttcgagaccagcctgaccaacatggagaaaacccatctctactaaaaatacaaaattagctgggagtggtggcgcaagacctgtaattccagatactcgggaggctgaggcaggagaatcgcttgaaccctgtaggcagaggttgtgttgaaccaagattgtgccattgcactccaggctgggcaaaaaagagcaaaactctgaaaaaaaaaaaaaaattgaccttgtttgcagtaaacttgctgaactcactttttaactgtaattttttttttctgtaaatactgttgggtagttctatatataataatgccatttgtaagtatttaatttaatgccattttccaactataaggagcgtttctagtttgtatttattgattttaagctcaattgtttgatgattagaaaacacattctgtataattttagccatgtgggggacatgttgatacgtccgtgaaaacccagcatttggtaaattattttatatgttccatccatgtacctgaaaagaataaacttcatagttgttggatacatcattttaaaagaaaaaaaaaaaaaaaa

SEQ ID NO: 4126 - DNA, 622 bp, Homo sapiens
tctctctctgcactacgcagcagctgcctgaggatggggaggagtggcattagcaattcgagactgtcttttttacctctacaatgcctcttgcagcgatatgaaattaaaaccagcttttgtcaccaacacaaacttctgcagccttggtcactgaggcaatcacaggcatcactgatgaggatgatagctgaagaaactgcaactgcataaagatcacatcactgaatctacccagaactacagccaatgcatgatacccacttgacaacctaggacctctctacaagaaaaagtctttctctatgaaagataattcataaaattttaaaaagtaactcttctactagatgcacagatattaatgtaggaacccaaaaaccataaaaagcaaggaaatatgacaccttcagaggattatgtctctaatcaaagaccctgaagtgaaagatatttataaaatgcccgaaaagaaattcaaaataatgctcttaaggaaactcagtgaaatacaagataatacaggtagacaattcaataaaatatggaagacaatccttgatctgattgtgaaattcaataaagagaaagataccataaaacaggaaaaaaaaaaaaaaaa

SEQ ID NO: 4127 - DNA, 781 bp, Homo sapiens
cagatgaagacgctaaaattcagagctcaacacatggcatagtcaagacttgaactcaagtcatcaaactccaaagtctatgctcaaccacagtgccctcctgccttctctgctataatacagtccactggaccttcacatgtcaaaatgcagattccccaaatccatctgctcttgcagatggccaaaaatgtccatatattgtcttggtttcacctttgttgtgatgtttctcctcactctgtgcatcctgtgaatgtgtcaaaacaatttgggacatgcatggctatgtatgtgggtgcttttgtgcatgtatgcatgagtgtgtggatgtgtgtgtgtatgcaggtgtacacttgtgcatatgcaagtgtacataggtgcatgtgtgtatctgtgagcacatgcatgtatgtgtgggtaagagttcatgcatgtgaatttgcacctgtgtgcctggtgagcgcatatgtctgtgaatgtatgcatgtagatttgcgcgcctgtgatcccttgctacatttcacagactacagttctgctaggttatatgagaaccccagttatataatcgctacctcgatcccccttctttcgaacctcagtaacccgatgacgcagatagcttacctaacgcaacaccccttggttcccaccccccgcttctatcattattatttactcccttaccccattgatctcaacaactgttatttatatcacgctcatgaagccgaaacgtgactaaatggtatcttcttgtgtataataattaaaccct

SEQ ID NO: 4128 - DNA, 747 bp, Homo sapiens
ctgacatcacccgacccacccttgctgaggccccagactatcctaagtccaaccctgcaatcataacatcaacctcacatcgtgatgctaagtgtgtggggagcgaagtggtggctgtttgcaagagtggccacagtaccactgtgtaatgagtggggtcattcccctccacatccctgtgtgctaggatgcatttacctttttatcagaaatcgcagtggtggaaaacatataatttgggaaataagattatgaggatctaaggcccagctctgctacttacacaactctgaagttctaaatactcatttaaaaataaaaatctgttatatgggaataaaacatctacttcaacaactttcaaggaataagtgaggtaacatatgcacaagtgtttcatatagaattccagccactgttagatgttattaccccaaatagataattacgaaaggtatgactatactgtttttgttaatattaatacatctgggtaccatacttttaaattttataggctggatttcagtaacaccatattagaagtctctgctttatttttaccatcttcttgaatttttgtgtattaaaatatgttaaaactcagtgctaaatgtcaatcttgaaatacctttagtcattttacttgttgaaatgtaacagcaaataatttcttgcaaaaagcaataggtagtgctatttgctcacagtgattataacttttggttttgccttcttaatgtgtaa

SEQ ID NO: 4129 - DNA, 628 bp, Homo sapiens
atcctgagggcaggaatcctgtcttctttatcccctgctatattctcagctccttgaaaggtgcctgcagttactgtcacagcccagattatgccacggaaccattgtggtgaggactctgtggtctccacccctgaacactggatgaaagtcactcctctcctgaaactggtttctgcagccactaccagaatggagtctcccctctctgggcaggagcatctgattggctgagctgaggtcacatgccaggcagcatcagacctttcctgtagaggccaatgatgcctgcctcccactcagacacagaagttccctcctgccctttctcagtcagggtacccgcactcccgacatcacatcatcctgctttgtgtcaccggctttccataatttctgacactaattttcagttattagtgtcaccttcctcagaggtgccttccctaaccacttgtctggagtagccaagagtaattgcgttgtttgtcgttactttcaatggcaaaaaccatagttacgtttgcatcaagcgaatacttttgcctgttctggaactcattcatgctctgaaacatttgttattcatataaatggaatcatacggccacaaaaaaaaaaaaaaaaa

SEQ ID NO: 4130 - DNA, 588 bp, Homo sapiens
cttgagctgcaaagataatgtattggaaaacattctcctctttaatatcctaagatgctaccattggtcatttgtttctttgtgaacgaggcttccctactgtattttgggattgaaatgataatgggatacttagggtaaagtcttcccattattatttttcttctagtgaaggaattttattttctgtggtatttaattttactttagaatttaaataggtctaccacactgcagtaaaaatgcatagataacagaattaatcaaaataacttggaagaataaaatgtggcataaaatcttaacatagctgagagttttaagttattctgtagaggagggtgaggaaaaaaaacggttttggaaaattaccataaaacattgaaagtaaaataaggaatgtttttgatatagcttcaaggaataatcacatgtttttacttacagtaagatttcataaattcttatttcattacaatactgtattttataaaaaaaaaactgaacaccacacaaatatctgtaacttaaaaaatattcgttgttacccgagctttagtactataatatttagcaaaaaaaaaaaaa

SEQ ID NO: 4131 - DNA, 354 bp, Homo sapiens
ctagattcccattatcaggcatgctgcatggctgctcatcttcagattgaagaggcttcaatgataaatctacggactgactacttgtagcattaattgttcatacattccaagtgaggatattttaaaataacacatatacacacaagcacactcttaaaaatcgtcttaggtttttcataatgtaaaattctaaagccattttcatcaatgacctctgattttcttgcgtctctgacggcaattttgaattgttgtaatatcatgtgccacatcataaggcaagagaagctttgaaacaaagacctgttttcagtgatataaattgagttattgtgcttaaaaaaaaaaaaa

SEQ ID NO: 4132 - DNA, 1116 bp, Homo sapiens
tgcaaaagggcctcctcttactgagcagatgtatatgaccccgtgcttctccgattcatactaaacttcagagaaactccgggaaaggttccttctgtatttatggatgagaattatgtgaagcctttacaaccatcgtagttcatatctccagagagaggtataatttgcagtgaagtgcacaaatcagtgaaattttacgtatgcaacctttatcactcaccacccaaaccagagtggtgtcttcccaacaccccagggcctctagtccttttccagcgttgcctgaggacacaaactactgatggctgcatccacatgactgacttcaaacacagcacgctgcaggagaatagccggatacgcgcgtggaaagtgggtggctccaccaccctgctgttcaggttttctttctgaaagttcttttggctttattatggaatagaggttacagaaaggcaaaagctttggccgtagcgggtgggaagatcttccttaccctggaggaggaagtagggtctccgtaatgtatgtgtggtactcagggctcccggcagcctgaagccagagtgtgtcctcaccctgccccgggtcagccctgtgacctggagggagcatctgaaaagctctgggcctcggattcctcatctgtgaaatggggatgctaacagtgctacctcctctggttggtttgtggcagaggacacatgaggcaacctgtgtaaaatgcttggagggtggccagtgtagttaccatggagattgactggtaccgtcttccacatcctgtgttgactaagcgcgcacaccagaatacagttccaaacgattatcaaacatgaatacaattcagaaaataaacatgcagcaaaacttgccataaagattgcatgaaactatcactttaagaaaaatacattaaaaattaccttaaataccgaaaagtacttttgtaagtaaggatcagtccaataaatttaacctgtatttgaatcagtgtaaaacaacttggtttataattttgtcttcatcgagtgggggtgacttttgtagcttctgtcactgctgcctggagtatagaattaaacacctttttgcagaaaaaaaaaaaaaaaa

SEQ ID NO: 4133 - DNA, 373 bp, Homo sapiens
gcgtcgattcaagtccaccttataagtagttcacacctattgcctgtaagaaaaaaaactgaggaaatatataatgatgtttgaaatcgtgcttctccaattccaatgggcatataaatcactgaggatcttgtcagaaggcaaactgattcaaaaatataataatatttccaccctggtgcttcaacaaagcatggtgctgagcatgaggacgtcttgtgaccccaggtgaagacagcctacgcggaaaggaaggaaactgtaggattgaaacagtggatgagctacaggagtggctatgaacaaccctcagtgataatactctcttgcttacagccagccccaaataaacaaacctttagttattataaaa

SEQ ID NO: 4134 - DNA, 521 bp, Homo sapiens
tgaagctcttcatacctttatgaagtcatcctgtaccacgcaaggtgtgcatatacgttgttttatctctgcatttatcgagaaagtaaatacatctaggcaaacaatgggatggtaaaagtatctcctgtgaaagaataaagaaaagaggggtgcactgagcagccccatacgcaggaagtagaaacagaaatgtacagacacttgatcaactttgcagctttacctacatttgccttaatgaaaaggagattatttttcttattttctgtattttttgttttcttgttttctgttttctgtattgttcaaaaggagtgaaaaaaactggtgtgtgcaactaatgtaagataaaaataaaatttgtattagtctatttagtagacatgtcaatcaatctacttcctgtccactatttttatcttggtatttattataaaaaaaaccatgtttttgcaaccgttaaaaaaaagaaaaaaaaatggcctcgttggctacagcggtggagctttgcgccaaaa

SEQ ID NO: 4135 - DNA, 163 bp, Homo sapiens
cccaccctggttgccctggcaccaatcaggacccacttcctcccttctgaagccagtaaaaatcctggactcagccagacatgggcagatgttgggatgacctgcctgtggagaggaggttctcacttccccttttctgacacctgcactgctcctcattaaa

SEQ ID NO: 4136 - DNA, 1469 bp, Homo sapiens
agaacagctcgccacccttgttttaggcagaccaaagatgtatggatgctgcagttcagctatgaatctctgtgtctagacttgaatgaggaggaatttggacttggatggcaggactagaacatctttaaaggctcttccaactctgcatttcaaggatttaaaaattcagcattatatatgttttttttctcataaataaagtatatgaggtaggacccggatagcagatgtggacttgtaacaaatcttggagtgcaatagggagagaaaggagttgcattacaagtatggactaggaatatttttatacatggataaggagaggcttgtatgcctgtgactgtgagtcatgaactgatataaatgggagtgtgaagatactcaatggttttaagcttggaatttttcaagtggttgtgccaagaactacaaagcaacaagttcttgattctctgctgaagccaagcatgatccaaaggcaaaaactttctcatagtccacagtcaatatggctactacaggatacaatgaaaactcttagggacagtgattgttcttccaagacccatctgctgacgctgatgtgaagaggcatttcgtatacctaacctgacgaacatcgaacatcgtaatttagcctagcctattttaaacaagctcagaatacttacattagcctacaattcggtaaaaatcctctaacatagagcctattttatgataaagtgttaaatatctcatgtaatttatggaatattgtactgaaagtgaaaaacagaatggttgcatgggtaccatcataaagtagaagaatcatacttcaaaccatctgcaaccatctgtagtctcgagcactcatcataggactgtttgtactctatgacactcatcccaagctagtatgattacttgtttgtgaatggacttttcaaaagtatctccataacttattctttgaatgcccagcacccaacctaggctcagggacactgggctttaagtaatgtttaccaatgaatgaatgaatgaccaaaggccaaataattgattcaaaagactctttatataaaagcaccatggaaaagtgttgttaccaagattgttttctataagtcaattttatgtaaaataattatttcctccaatataacacagggaggattccctttagacaatagccatgcatgtcatagatttttctttcttaccagactccaaagacatctagtcacttctattggcactgattggtctattaaggatgtctcaagtggatgggtgtccttaaaataatgttttcctctcagctggttgggaggctgaggtgggaggatcacttgagcccagggagattgaggctgcagtgaactgtgatcgtgccactgcactccagcctgggtgacagaatgagatcttctctcaaataaataaataaatagtgttttctcattggtttacatcataaa

SEQ ID NO: 4137 - DNA, 1296 bp, Homo sapiens
cagactcgctcagacacagtgattttgaaaccttggatgaagaggactgagctacaaaatagaaagagccttgaaacacattccagaaacacttaacaggagaatcaccaatcaggaacgcctagattggactttatgtgagtgaaaaaaaatatatatatatataatttttgaaccattacacatttcatattgaaagtgaagaactgctgaacgtaagacattttacgacattggttttagtggctgggcattaaacaacgaggaaatggatactacaggctggaaagatagagattcatgatatccagaagcaaaacgcatggtaaagctgcctccaaggagaacttgaaagaaccacagaacctgtagcatcagtggaagtgactggaaaaaataagactgactgcttttagcaagctatcacaagagacaaatgtgcttaggaaagaatggactggtttgcaaacagaaataaaggggataaagaaaggctagaaatgtggttcctcaaaggactggaaaagttgactgcttttaaactttagggaatagaagataaccctggggaaaaaagacttctagcaacaaaggggccataggggtgactgtatgtcccagtttgaccaggaatagtcatggtttataactgttgcttctgcctaaatattaatagtattaatacaacttattttgagccaaataaacagattacaagtatggccttcctactcaaagtctaagtgcctttaagttagctggccaggtaagagaagagaaaaaggcatatcataatatagttatccactgctgtgtcacaaaccaccctaagcttaatagtttaaaacaaccttttatctactcatgatttttatgcaattgagaagaagcttggtgaggatgtcttgtctctgccccgcaaggaatctcttagctgtatttacctggatcactattcaccataagggtcaaggaagcaaagaaataaatgaggcctagccgggcacggtggctcacgcctgtaatcccagcactttgggaagccaaggcgggcagaacacaaggtcaggagaccaagaccattctggctaacatggtgaaaccccatctctactaaaaatacaaaaaattagccgggcgtggtggcgtgcacctgtagtcccagctactcaggaggctgaggcaggagaatggcctgtacctgggaggcagagcttgcagtgagccgagatcacgccactgcactccagcctgggcaacagagtgagaccctgtctcaaaaaaaaaaaaaaaaaa

SEQ ID NO: 4138 - DNA, 804 bp, Homo sapiens
ctgggtttgactgacggcaatgttgaattttgactttgactgagcttgaaacgtgcttgttttctcttctaagctgaggcccatttgcacaacgagcaaaaagacaagagactaagttagagacccagatggagtggacatcttgccatctgtcccgaagctgcaactttcctgattctccttgctttcatcaatgaatggcactaccattgtcctcatacaggaatatggatacctattcctgaagattcatcctttgctattcctcccaaataaggctagacattttcacttctggttacagtatcatatttcagggtgcattcagatgtagatttccaacctgtcctgaacaacatattaacattactctagtacaggcctacaatctccatatgcatctcaactcctctttctgccactgcaatgcagtgcccatggcctatagttacctatgtgggctaagtactatgctaagtgttttatatgggtcttttcatttgatgcaaacaatgatgctaagaggtaggcactctttttataccagtttccaggtactttgctcatggtcacatagctagaggaactgggatttgaatcaagatatttgcatttatcattccaattcttcaccacttcctgtgtccttgccttttgccatgtgactttgtagttcccctatgaagaggtggaatccattttcctaccccttgattctaagctcagccatgtgacttgctttggccaatgggatgataatggatgatataaacagaagcttttaagtaaaaaaaaaaaaaaaaa

SEQ ID NO: 4139 - DNA, 872 bp, Homo sapiens
ggtgtattctgttcccagaagatgaaagacaaataatgaggcccaaatcccaacggaaacctgacttcattgattaggccaaatgtgtttcagaattattggtttttaacccccaagctgacatcttaccactcactgagcaagggtatgcagataaataagatacaaagcatgctgttcaggaaactgtgaggaaggagctacctcctagcagatgccttgctaagtataaccacctatagcttctactcaactgatctacgttcaagatagatgctgctgctgctgctgctgctgctaatgacctattaaaaacagactctgaaattccaagaagctaagcctacctttgccctgtccccagctacttgggaagctcttataagaaccagcttagaaataaatgctgcatttaagagacttccgaagcaagctcctgttcctcgatgttggtgccagaatcaagctcactcttctaggcctttggaacctgggcataaagcattcagagactaataagagaatgcaacatgtcttttctgatgctctctccttcaaagctctcagataagtcaccaccaaacatctgaggaggaaggaggtggaggtgacagttcatcatgcatctgtggcttacacacaagaaaccatcagttttccctcttctaacagcttatttccttctttacagtggtttctgactccttctgcaagatcacacccagacatccccaacacaatcaccaggatggctgagaaaatgaaccaagactgccaaaacctaacatgatattgatgagccacttccacccctccccaacctgtgtgaagtcaaaaattaaaaatagtcttccccaaaaaaaaaaaaaaaa

SEQ ID NO: 4140 - DNA, 797 bp, Homo sapiens
ccttcaggtggacgaagcctgctctttggctcttgcattctgcatgcctgcagactcaataccatgtggacaccaccgaggctggtcacttgtaccttctgaagcggtggccaaaaagcagtgcaggcatatgactgaagaagacaaatgttgtgaagtttgtctaattgtttcgtaacttcgaggccagacagaatatgagattaaggaaatggatcccattgattcttcatttttttctgcgggcaaatccaaaattcttcttgaattttattcttccctctacttacaatggaaaaatgccctgtcaaatccaagttgaatccttgcagttttgttctatatcatatatcttccatcatttactcaaaagatttcactcctacagttattacctttggaatttacgtttaagtatagtatcaaaaagagatatttaattttcccatggataaaagcaatcttccaataagtacaaaggcctttttttttggatattagctctgtctcaacattctatttgtgtacatatgtaaccatcagcattcttttaattattggtttacaaaatgcatataacccaagttgcaaagtgtgtacgttgatcaaaattggctttcgtattttatattttttattcaagatcaaatttaggatgagcttatccattatattacaggcatatttttgaaaatattagttttgatgggttttattaaccttgggaaagattatgtatttcataaagaggcaaaaaatagtttaaaggtggggtgtggttataaacttatttgaag

SEQ ID NO: 4141 - DNA, 468 bp, Homo sapiens
ttttacttgagtccaacattccaacacaaggaaggcaggtttttcctgcttccatgatgatggaaggaatcaaacttgacttatgaagccaataaagcccttggaaaagctggccttatgttttgtgtacacaatccctgtacggggttcctgacctgtgatgcacattctgattgcctcctttggaaaggcttattagaaactcagaagaatgcaaccatttgtccctcacctacctgtgatctggaagcccctctccttgcttgaagttgtcccccactttctggacagaaccaacgtacttcttacacatattgattaatgtctcatgactccctaaaatgtataaaacaaagctgtgccctaattacctttggcatatgtcatcaggactttctgagtttgtgtgcacatcctcaaccttggcaaaataaactttctaaattaagaaaaaaaaaaaaaaaaaaa

SEQ ID NO: 4142 - DNA, 860 bp, Homo sapiens
ttaaattatttttcatacatttataaacaaaaacaccttctcagtggcaccaaagaagcatcatagatcaccgtgggacattcactgaggaacagatcaaagcccactttctttgcaggttcattcataattccagtatatgggatctgacagttctgtgacatttgaattaagagcccaggtctcaacattgagaagttctcagcagctacaggtcaaaggaggtctccaggctggaaactactcctttgaaagagaagaccttcattcttcacctccggctgtgagttgtcattccttcttcccccaatccctgctaagataagactctgcagtatgcaatgggatgcatgcttgttaaaagaaggaaaaacctttcaaaatacccttactctgctttccacagcactttgctcatagggaatctctagttcaatcccagttcccggagtaagccctggaggaggttaaactctggaaggaaggcatgggctcaggctcactttactggggaccatgggtcccctgagacacagtgacctgtagtggacagctgccagtcctcccaccaaactgcacaggacccccaaagcaggtcctgagccttcttccctgagacctttcatccatctcttaaactgaagaccttgatgctttccccccaagttaaaatgaggcggggattttaaacattccggaacaactgcaaggattaatcatctgtaccattctaaatacccacctaccatttgggcacaaaaaattttatttgtgacactccctgccagtagaaaaggggccttttgcactttcttttgtgattaagattttgttcttattttttgacgggcatttcgaat

SEQ ID NO: 4143 - DNA, 329 bp, Homo sapiens
aaaacaaagcagtccatggagcagttacacacactcatctattaagtttgctgtcttatatgagggaaattcatggtaccccaaaacaattaccatagtaacattaaatatcactgatcagagaccaccataatgatacaataatgatgaaagagtttgaaatacttcaagaattaccaaaatgtggcacaaagaccctccagaagcacatgctgttgaaaaaatgacaatttacttgctcgatgcagggttgcaacaaaccttcaatttgttttttttgcattatctatgaagcacaataaagtgaagtaaaattaaaaaaaaaaaaa

SEQ ID NO: 4144 - DNA, 796 bp, Homo sapiens
aagggtctactctgttgctgaggctgtagtgaagtggcagaatcatagctctctgcaaccttgcactcctgggctcaagcaatcctgatacctcagcctctcgagtagctgggactataggaatacgccactgtacctggcactccatatttttctaaatgtttgtttcagatgatgttctacccataacgtactcactcagtaccacaaattactatttgatattttgttttcacattaaaattgtctttatgaaaaacaaatagaactgagttttgtcaagtcttaaaagtgatctctagaatgcctctgtattccatttgcaaatatgtactaccaagactttattttgagaatcgtactatgaaagcctttacatgcggttgtcaaagcggtaaatgaaataggatgtgcagaaaaagaaaacataataatagtaataataataataacaacagctcaaagagaggtctggtcttcgtttttagttacttggaagtaacttctaaacacttggaattttgagagtgattggaatgtctttgttattcatggaaatccccttgtaccacatctgataattaatgcccatgagatgactcagaaaggagcaagccatgccagaaagacaaaacgtccaattgtaggttttgctagtttgggagttggggccaaggaaatcaccctcacttccagaattgggtgctagagaacagctaaatggggggatgctggttccattattctgcttatgaaggaaccccataaaatccctaccccctaagacttgatgagt

SEQ ID NO: 4145 - DNA, 393 bp, Homo sapiens
tcaaggaacacattgttccctcaaaaaacagaccggcagctgagagaggatggcaatcctgatggatgagaaaaagaacagagctgtggacacctgagagaagactataggacttcaaacatcaacccatttcagttctgatgtcagcaaggagagaactggccccctgggccaaccgtttggttgacacacagaaggccaactggatttaaggattcaatatggactgcctcaaatataaagggacacatttgctacatggtccagagacttgtgttcctggcccagaatctccttgtcctatcaattgttggaaagacactgcctgcatttgcccttttgcctctctctgttctgtacttgcactatcaaataaaaacaatttctaatgga

SEQ ID NO: 4146 - DNA, 861 bp, Homo sapiens
agaatagggcggggaatggataatttgtcgcacagacgaaacttcactgggatcttgtctgactgttgtcctcacacgacagatgaaatctggacacacagagacaccagggatgttcacacagaggaggcgaggtgaggatgcagtgagaaggcagccatctgcgaatgaaagagagcggcctcaagagacaccagccctgctgacaccttgatcttggacttccagcctccagaactaagccatggacattgggtgtgatcgatctctacatggagctggggggggccagacagtgattttatacacaagaatagggaggtagatttgaccactgcacagaggccttttctagatcaaaattcaatgagttcttggcctttcagtaatcgttgaaatcacaaccccacagtgctccttccttccctttttggtggaggtggagcatgaacgtccgcctctgggaacgagcctgtgtaatggcttactcaggagctgctgaaccacaacacagatacccctcgagctcataggatctggtaacccaccccgagccacttgaaatcttgaatcataatggggcgaccttctcttcccaagctgggggcattacgctgggcacaacacaaaactggctggcctttaaggcgccccgtcgaaatgggcttatctcccccatattcttagaggacggattatacgtaaaaacaaagaagacactggccgtgtcggcctcgggggcgagccctgccccgccctgccctcgggcggggtggtatggatgagccctccttccggccccgctgactctgagcctcaccgtgggtaggcagcttccccgcactaaacggcgaatcaacg

SEQ ID NO: 4147 - DNA, 646 bp, Homo sapiens
ataggttggaaacactctttttgtagaatctacgaagcaacattttggagcccattgaagcctatagtgaaaaaccgaatatcccacgataaaaactagaagcaagctatctgtgaaaatgcgttgcagtgcgtggatttatctcacagagttaaaccttagttttgattcagcaggttggatacactctttttgtgcaatctacaaggggacattttggagtctaatgaggcttatagtgaaaaaccaaatgtcacacgataaaaactacaaagaagctatgtctaaaaatgctttgtgatgtgtgattttgtctcacagagtttaacctttcttgtgattcagtgggttggaaacgctctctttctacaatctattgggatacatttcagagcaaactgtggcatatactgaaaaaccaattatcccatgacaaaaactaggcaaaagctatcggtgaaaatgctttgtgatgtgtggatttatctcataaatttaaatctttgtatttattcagcaggtttggaacacttttttgtagactatacgaagggacatttcacacttatggaatcctatagtaaaaaagcaaatatttcatgataaaaacaataaaaatttatctctgaaaaaaaaaaaaaaaaaa

SEQ ID NO: 4148 - DNA, 363 bp, Homo sapiens
gcgacgggaggtgctattggacgagccaagggccgggcaaggacttcagaggacgcttccctgttttccaggagatcttgaactcccaggctcctcctaccttggcctccctagtgctgagattacagacacccacaacaggtgaaggagagaaagcagtcccacagacacccttctctgctggaaagtccttcctatctgactccagtcccacttgctggaggagttcccctcattttgtttctgagacagccttcttctgtgtaacaactattcagagacttgaaatctgcctctctggtttcttctgtctttgcaaatgtcacattaaagagaacaaggtaacttggaaaaaaaaaaaaa

SEQ ID NO: 4149 - DNA, 715 bp, Homo sapiens
caggaataatcggatgaaagggagagtggtatcgaagaaaatgtatacgagggcagaagggaaaaacgcatgtggaaaaaacgatataattagggagatgggatcaaataatatgttaatagtagcacgattgatttactcacattttctaaacaagtgttaatgataaataaatagcattgtcgtccgagaactgaccagccttggctcgagtttttcgactcaatataggatgacgggtgttcagatgaaatttaagtggtgatagaaagaaaaccaagttgaaattatgagtaaatagcatcagaaagaccgaaactagatcccgtggcccaatagagaattaggggtgaggcgagagccaagaaggaaaagcctcgattaagaagggggacctaagagaagcagggtatgctataatgaatgcccataaaggcattcccttaaaagtgtgggcatgagtggtaatctagatatggtacagttgacatcaggtatatggcggcagtcagaaattcaactttgtccatcagctctatgcacaacaggaaagatggtgaccatccaggcttatctaaggtccaagtgtaacatcacaaacacagtaattacacccagccaaagaaaagcatacctgaatccaagagagtatttacactggcttcagggatgaggaaataaaggagtaagtgattaggaaaaaaaaaaaaaaaaa

SEQ ID NO: 4150 - DNA, 855 bp, Homo sapiens
ctagctggaggcactgagaagggttcaagcttgtattctccagatgcaagggtgcaaataaagcccgatttccactggcagctattataaccaggagaggatcctgcctttggctaaggccagcggaaaggaaggcaaatggagagacacaaagagcctgaatctttgagccatcactcagttgcgatcaaactgcctggaacccaccccaccccgatcgcctgctcggacaaaaataactgaagctcccattgttcaaaccagcttgtgtcatggtttctgatgtttataactaagaccaattcaaacaatacaatattttaaatctttattattttttaaggaaacaatagcttaagggtaaaaactcatctctaattgtaaaaaaaaattatctctaattgtaggcttttgaagttagggtcggtcagtatttttagatagaatctttcaaaactcaggagagagactcagcttatttcatgtgtatgatgaggatgtctcctttattctttttcctgctatcacacttatgccaggctttctttcaaaacttgactcacccagctccttgtctttgaagccttcttttaattcttctcccacattccccaaaaccaaagtcaattctctccctcagtgccctcatgtgtataaattgcatatcgtatggcatttttttcatggtctgtaagactcccaatttcccaagggcgagggtacctgtcattttcttctgtatctacagggaccatcacatgaaaaagacctcccataagggtgttaaggatgggattgtggccccacccccaaaatcatgggttgaagccctcaccctcgatgtgaccatatttg

SEQ ID NO: 4151 - DNA, 396 bp, Homo sapiens
gccttcccttcctctctcacttgctctctttggtgaagccagctgccatgttgtgaactgccctagagaagttgatgtggccaggataggagggagggctctgccaaccagctgataaagagctgagaacctcggtccaacaaacttccagaaattgattccttgccaacaaccatgtgagtgatcttggaggtggatcctcccctgttcaaaccctgagatgaatgcaagcctggccagcaccttgattacaaccttgtgagacctgagaccctggcccagcctgtgacttcctgagccagaggaccctgggcacacctaaactgtgcctggatttctgagtcatggaaactgtgatcataaatgtttcttgttttaaaaaaaaaaaaaaaaaaa

SEQ ID NO: 4152 - DNA, 234 bp, Homo sapiens
ctcagagagaatgaactaaaagaaaaacaataaaggaaaatcagtagacgatggagagcatcttgatgacctattgggaatgtacatggtgtgtgaagagaggggattattattatgtgcaagatatgaaaaaatgtggctgggaaataaaagagagtaaagaccaaaagatgggaagaacaaaaatgtcacgaataaaatgtcatgttttatttaggtgcaaaaaaaaaaaaa

SEQ ID NO: 4153 - DNA, 780 bp, Homo sapiens
ctaggaaggatttgatgccctggttccctttattcccatcctggtttccaactataacccaaaggaatttgaaagttgtattcagtattatttggaaaacaattggcttcaacatgagaaagctcctacagaagaagggaaaaaagagctgctgttcctaagtaacgcgaacccctcgctgctggagcggcactgtgcctacctctaagccaagatcacagcatgtgaggaagacagtggacatctgctttatgctggacccagtaagatgaggaagtcgggcagtacacaggaagaggagccaggcccttgtacctatgggattggacaggactgcagttggctctggacctgcattaaaatgggtttcactgtgaatgcgtgacaataagatattcccttgttcctaaaactttatatcagtttattggatgtggtttttcacatttaagatgattatggctcttttcctaaaaaataaaatatctttctaaagtgttgtgttagattaataatatgggaggagtctttagattggccaaattgcatttctctgatattcctcttgttgcaggtcagaagagatcaattctacagaaatttccagtggttctgttgaggctttatggaattcagcatgtcaaaattcacaggctggctgggcacagtggctcatgcctgtaatcccagcactttggagcccaaggcgggcagactgcttgagttcaagagtttgcaaccaggcttggcaaaatggtgaaaacctgtctttactaaaaa

SEQ ID NO: 4154 - DNA, 1112 bp, Homo sapiens
cagggagcataactttcgcatctcagtccttctccatttcctgaggcttcttcaggctctggtgtgtggtccaccctggagaatgtctcgctctcctctcgagaggaacgtggctgcggctctgcgtggaccgtttggcagaggctcatatgctggatccactggttggttcacggggttcattcctgtctgttgatcttctacctagtggctccatcactcattcaaggtaggaccagtgaagtcaccaacgttcactgtcagattgtctatttctccctttagttctgtcgttttttacgttgtgtattttggggctctggtgttaggcgatgtgtgtccatatatttctccctttaattctgtccgtttttactttgcatattttgggctctggtgttgggtgatatgtgtccatatttgttacgtcttgggagagattgacctttttgtttttataaaatgtccttttggtgtctcaaacaacgaccttttggcttaaagtctattttgtctgcattcagccacccgatgtccctattgattattggttacacgggttcgtcttttttccacctttcccccgtgggactctgacgcgtctctgctggggggagcccatcgccgccccggcgtctctctccgctgcggggagcccatcgccgccccggcgtctctctccgctgcggggagcccatcgcggctctggcgtctctctccgctgcggggagcccatcgccgccccggcgtctctctccgctgtgggaagcgcatcgccgccccggcatctctctccgctgcgggaagcccatctctgggctgcgctgcttcctgttctgccgccctttgctttctggccgcgattccactgaatgtgatcactgaaaaggtgggatttgcgtccactgttttaccagttgttttctctatggcttgtatctgttttgtttctttactcttcttttactgcctacttttatgttaaacagatatttcatttatacaattttaattattttgatgtttcttttactcctttttaatttacttgctcagtggttgttctggagaatgtaattaaaatcgtatcttaaaaaaaaaaaaaaaaaaaa

SEQ ID NO: 4155 - DNA, 766 bp, Homo sapiens
taggcaccatggcaaaactcccagtcctcaacaaatgcagccaatggcgtttgctaatgccagcaggcctggccctgtccaactgtggtctcctccctcagctgggcctgcagcagcatccggcaaccctgctgctcctagttcagctcttgctcccatcctcctcaaagaccacactccacatcctcagactctgacaagcaggccaacccagtggtgtgctggcagatgcttaacaacaggctctagaggaggaattcagggaccccgaatggagggactggctggagccttggcagaggacataaattgtgaagatttcatggacatttatcagtttccaaataatactttcataatttcttactcctgtctttattttaatctcttaatcctgttatcttcgtaaattgaggatgtacgtcacctcaggatcactgtgatgattgtgtttactgtacaaattgattgtaaaacatgtgtgtttgaacaatatgaaatcagtgcaccttgaaaaagaacagaataacagtgattttagggaacaagggaagacaaccataaggtctgactgcctgtagggtcaggcaaaaagagccatatttttcatcttgcagagagcctataaatgggtgtgcaagtaggagagatatcgctaaattcttttcctagcaagaaatattaatattaagaccttaggaaaatacttgcatcccttgggggaggtctataaatggccactctgggagtgtctatcttaagtgtt

SEQ ID NO: 4156 - DNA, 788 bp, Homo sapiens
  misc_feature (1)...(788): n = A,T,C or G
gggcgcgcgcgaggggggggcggaggggggaggggggggccttcacaaatacagagaacctccttgtaaggaccgtgcactaactgattgtgccactggagctccatggaacccatacataaagcacacctcttctcttctccttggcatccaacctgctggctctacaactacttttaacaatgagtcaaggctgtacctgtcaagatggaaattcaaaatcaacatcggaagctgtttattttggttatgatcctaaccctgggcctctgtctctgtattcataactgatttaatgaccgaaaaaatgaatgaatggttcacattaccattgactattctgttactatgttctagggaactgtgtcatgctctttttttcttgctgattttatccccttgtagttgccttcgcacatcccctaaactaacgcacctgaatcaactccacatcatccaacattgtgcctattttgctctcanatgtggatctgttcttttccctatcctttaatgaggggatatagagccgcctagattgttgtctttgnctggaggctttgtgagcattattccagaggaattataagtgtataatgtctgatttttcttttgttactaggcactggagactnagcagtcgttatttccctacaaaatcatcagggtaattaccagtacccctcaatatttatagaaacaattcagtttttcaatttttctgcatctttataagaagtactaaagttcattatatgatcaaatagggtctattcccataaaaaata

SEQ ID NO: 4157 - DNA, 876 bp, Homo sapiens
acaccaacccaaccacccccccccagagaaaaaacagacccgggccctgaccgatacacacatccacccctctacttaaaataaaacacccccttccccccacggatcaacaataaccctcaccccctcttgatctcgggctgaaaaaaacagagggagccatagacaattcaactaacaaccttcaaaaacgcacagcctcaccaccactatcttaagtcagcccggactaatcaccccctgccctttattctgtctgtccccatacaccccaaactcaaaggttgtccttaataacccatacactgatccccataaaaaaaatacatactaactaacctgcacccaatctcccatattcctaacccttacactcgaaattctcgaatatcgacccccctatctgccaacccttaagctatctctaacttttattcaactcctagcctctataaacttaaaactttaagccctctaaacctaccctttcatttccctaaaaaaaacttccctttaattggcccccctcttaaaatcacctaccccccctcctccccctctttacaccacactcacccaacccataccctcccccccccctttacctctcacggcaatctcttcccatctcacacggccgtttcatacaaaaccccctatcaatcgaacttactttatcaatccaccaagacccatcttaacctcaatgcgcggcattcgcccacccgtactgcactacgctacctcacccctatgcaataacgtatcacggtgtgttacgacgcgtgtcatacaccgcaccccgcccttccggccgttatccaaaatcccagccaatcctaaaaagacgactatctaagaattacacacccccca

SEQ ID NO: 4158 - DNA, 790 bp, Homo sapiens
tagtgggacaatttttcaagtcattcagtccgatgctgctgggacttactgcactgacctgcaatcaagactgtcaatgctcaatcaaaaccaacaaagagcataatggctaagcaaaagcaaaattgtcaataccttattattgcaataaaatatgctaagaatttcgcattgaatttcccagactgcattattgaaatgtttgctaattttcaagacaatttaccagaaactgctgaagaggaacttaatgaaactgtggctgaagttaaatttaaaataatccaatgcacttctcaaaggaagattactccccagctgtcaaacagctttgatggtacctgatactaagagaactctcaaaacctaacttcgatttattctaacattgacttgctggaaaagcatctcacagacctcaacaactttaaaggaacttaaaacgttagattgtgggcagggaaaagagcaggcacacgttttgtcagagaattggaagtgaattttcttaaggaaaaaacagtaattagttttaaaactcatattgtaaattataatcattatattatactcttggattccagtttaaccataatgctctcacactctaattatgatacattgctatttcaatggtgtattggttaacattgagcaattacaatcatgcattcctttatccctccaggcatcatttattgatgcttgctgagatacaaatgcatgctacattctaagatggatatcactatatatgggtgtaccaatgcacaattaattaggttggggc

SEQ ID NO: 4159 - DNA, 737 bp, Homo sapiens
  misc_feature (1)...(737): n = A,T,C or G
gctagtaaacaagaacaaaaattgaaacaaaacctatggctggtgaggaaaattgacttcctggcaaagtgatatcaggaaacccatttgtctgcaaaaggaaacaactctatctgcatggcaaagatgtctgctgtaaccacaggaaaagagtcaagggaatgtccatgtatgggttctgcaatgctacagaagaatatttccttttgctcttttatttttacctatatctagcttatacactataaaattggttccatgactaaaatgagtcacatctaaattctactacaaaatgagtccattcttgcacatcttctgataccaattataacatttggtggaagtccaaattggcaaacgtgttttttcttcccagtaaccttttgtgccacgttgaatttaaagagcatttatcttctgaaatctgctaaagttcctcaaggcaggaaaaaaaaaagattgtactcttattccagaaaggaaacccctaaagtgaaaagaaccaacagaagaatcaggatgaattccttaattcctgccagtgtgccatttaacaaattggttgaaatctgggaataattatttgcattatgtttgatgtggctaaaatttttacttcttaatagatgttcttgataagcataaaaaaaaattgttctttttgncctaaattgtggagcttttgtggccgctttccctttaatgagggtttattcatgatcctgactaactgt

SEQ ID NO: 4160 - DNA, 629 bp, Homo sapiens
gtagaatgcaatggcatgaccacagttcattgcagcctcgacctcccaggctcaagtgatcctcccacctctgcctcttaagtacttgggactacaggcacacatcaccactcccagctaatatttttatttttgtagagacagaggtctcactatgttgcccaagctggtctcaaactcatagacccaggtaatcttcctgatatgaacaggagacggggaaatactggaaagttatttattttgtttgatttatttacctgccaaaagccccaccctcaagcctggaaacccgaggccccaaatgggaacaggcattcctgttttcgtgcccaaatgttgcatcttggcccgccacaccccacatcctgtacccatataaaccccgaatccctgggtccatgaggagatgagcagaagagccaaagaactgaagaacggcatggcagagaaggagcatctgaatatctagaggagtccagctggggacagttggagaggagttctgccacgggactgctgaactccaagggaagatcatccttccactccgtccccgttccagctccccatccatcctgctgagagccacctgcaccactcaataaaacccccatattcaccacaaa

SEQ ID NO: 4161 - DNA, 752 bp, Homo sapiens
ttaggctcaccctgcaggaatcccagtgaatatattgccaccatcttggagctcagtgccctcttagtgtaatggcaccagcagatctgcctgtgcacggacttcctgtactacctcactcctgaggggagatgcttctgcagggcctatgacctggtgcacaactttagacaccatcatcctggagcagcacctcaccctcacttgccggggtgttgatgacttcctcaaggctaaggccacattcaagattttggacttcagtgatgcatttttgctgagcaagtgcaagggcgctgtccaacctctggtgctgaagcagccgagagacccaagcctgccactcaggatatgacagcacagccagtggcctctactggatcctgtacaacctcagaagacacctagacactggagtgctgccaccacgtggtgcaagagttctgagggaccgcaattctgaagacattgaatgctgcttcctgctccctccatggacctgcacagaattgtcccatgtttctgttcgtttgggcaccactgaggaaggaagcatgaaggacgcagagccattttgcaaaccctggtcagaatgaaacattccttgggaactcgggccatgagaagcatccttcctgaccacctgactgcggaaacatccttatcgcatcctcccgggcgaaggcccaacagcctgactgcaggaacatccttgccatatcctgccgggcagcaagctctgccgcccagaa

SEQ ID NO: 4162 - DNA, 745 bp, Homo sapiens
ctcaggatgggaatgattttaaggagccctaccaagagatgaagtttttcatacctcagctaatcatgatcaaacttgaagtcagtgaacccattattgtcttcaatccatcttttgatggctgctgggaattaatacgtgactctttcctggaaattattaagaactctaatgggatccccaaggtggaatctgtcctgttcccagagctgaaaggatataatctgctccctggaactgttaacgcagatgaaaaacttgtttctgattttttgattcaaactttcaaggtatttcagaaaaatcaagttggcccctgcaaatatttaaatgtctacaaaaagtatgttgacttattggataacacggcagagcaaaacatcgctgcgttcctgaaagaaaatcatgacattgatgattttgtgacgaagatcaatgccataaagaaacggaggaatgaaattgcatccatgaacatcaccgtgcctttaaccatgtactgctttgatgctacggacctaaataatggactctgagagcgagctcaaaatcttaaagaccatatgattcaattacaagtggatgttaaccgaaacaccaatgcgcatatttgagatcaattcgatcacatttcggtacaagttatggaggttactgacaacactatggaactgggtttcctcattgtatggctaatgaaatgcaaggctgtgacagaataaaaacttaagaggtttagtataat

SEQ ID NO: 4163 - DNA, 190 bp, Homo sapiens
ttgtactaaatcacgcgcgcttccgcgggtcggacacaacaccagtggctagcccagcctttcagctctgtaacttcataccatgcctgaaatgtgattcctctgactaaaatgacctttgtaacattatctacttacttaatttttaaaaatgatcaaattaaaatatattacaataaaaaaaaaaaaa

SEQ ID NO: 4164 - DNA, 782 bp, Homo sapiens
agattctaaaggttgagaacgttgggtgtgatgtgacaattcattttgcaccagcgctgctgtcaaggccttcacccagatgtctgtgttgaggtcccagacttcagaaaaatgagagaacacgtcgaccaggatgacagagagaaatcccaaagccatatgtgaaagttaatttctccactggccaggcagcaggagtctgagagcctcgatttaacagcttgaatttgaattgaataaagcctcaaccagctgcaacaaaaagtgaaagatttctgaaaagtaacactgataattgtggataaattcattgtgctaattaatcttactctaacagtaaagtaatttgattcaagtatcttccactgaatagggcaacataatggacagtgaaatatacaccttcgactggtaaagattataaattaaaattttgatttgtgtttcctttgctttcaacttttagtataacccatggagattaaattggtcattagaaggcacactacatacagtttggtacctgaatacaacgacaaacagacatacataattttaaaaaatttttcagtatcccactgcctaatttctttttctctgcaagaaaattgtagttttcaaagcatttgattttgcaatgacttataactaaataataagccaatcttagaatgtgtcttttagtgaacatatgttctcattcatgttggcaaatatgtaaggatgaaatgttggttgtcaagtatacatatattcagctttagtaggtactgcctataatt

SEQ ID NO: 4165 - DNA, 521 bp, Homo sapiens
gagaaagatcattagcctgaggtcacggggctgactgagcagatgctcaataaatgcttgctaatgacgctgggcccaggacctgtgggaggatgacatgtcaggtccatgaaccgcgtgcaaagcaagctgatacttcccagaaaagcaaatgaagataagtgcctggttcctagctataagtggaataaagcaaactcctcttattgttactcttaatttattcttggttcagaaacagaagaaatccaaggaatggcttcctgctttaatgaggaaaaattaagatcagacccaaataagtgaacatgacctgagacaaatgttctacaaacaaggaaaagaaaaactcttttatgacaaattaactctgagtatgaggcctaattctacacataaaaatatataaatacataaaaaatactaaaagtaaccatccagaaaagagaaatgaagacaaaaaggcaaagatgtgataaatgtagaaataaaaatcaacttataaaacaaaaaaaaaaaaa

SEQ ID NO: 4166 - DNA, 792 bp, Homo sapiens
ctagtatacgcggttgatgaactatggtcatctggaacactggctgaaatgaagaatggaaaatgttagctttccaggcctccttaggccaagaaggcatactggagagatatggcagcagagtcacacaagcaaggcagctggatttgtgacaatgagagaagcgcggggtcaaagaacatagagtgttttgagaacagtgtctccagatgagagggaagagaactgagcaggaagctaaagaactggcgccagaaaaccactcccaggatgcctacttttcatgctgcgtgttttcatgtcaatacctcttcctgtggctttaagattggaactatttaaaaaatgtcactgtcaattacatgcaaaccttattgtggttagtctgttgaaaaggaattgatgactatgaaaatgtgatgtttatacataaacattttacatagaagtcagaattctgagaatgtatttatagcccttgaagatgggacaattaaatcagagcttttgaggtttagaagtacagaaaaaaacttactttttttccttgaaacattttctcctttgatctttctttcctccccgtatctattatatttgggtagttggtaaacagtgttgtggaagacttacctttaaaaagtacccaacatcctaaatttattttctaaaagtggtagacctatctttcattttgttggatctgtacttttaaattaaccattatttaacttataatttggtgttaaacaattttaaaatgagttccccattttatggtacaagttagca

SEQ ID NO: 4167 - DNA, 452 bp, Homo sapiens
agttagagttcttgaattgcaagcaacagaaccaagtctggcaaacccaaggaaaatgaattcactggagagacatggaagccacatcgtgaaatggagaaccccagaaagagctggagaagggacaagaatgagagctgcttggagctgcagcaatgacagaaagagactaagcatgccaagtccacggtgttgtgaaagcactcaataaagattcattcttcccccttctgtctcaagctccctttcaccaaattcttcatccattccaacacatactgtgcgcctactttgtgcaaagcacattgagcagtatgaagaatgtaaaaatgaataactcagtccctgccaaaaagtcagccatgccctcacccagggtattattttatgttgttgagaaatacccaaatgaatcattcatctctgaaataaatggctaatgtcaaaacaaa

SEQ ID NO: 4168 - DNA, 778 bp, Homo sapiens
  misc_feature (1)...(778): n = A,T,C or G
ctgacagaaacccgggagaagtttcctttccctaaatatacctgcaattttcaagtccttttaatacacgcctttaaatgaaagggttgagtatacaagaatatcaataagttccaattgaagagcggattcttttgcaattcaggcatgtgccggcgataacgggcgagttggcatgaagagaggcagagatggattaattatgcagagaacatggaaattctgcttatcatcggctagcaaaggagcccggctcacataatcagcaaacgaagggagaggaaaaaataacaatgcaatggcaccttccagcccatcatcaggattttttctacccccttgtaattaaaaaataacatacacttatagccctatctcctgtgcaggcaaggagtggatgtccacaaaataattgcactgggatattagagctggcgacacgggctgtccattccggcttgctctcctgctcaccctctctttctcttttggcctctcaggcactttgcttctgaacccagtccaaatcagagagacgtctcaggtgacattcaagctcggtttccaaaaatcccaaattggtaccctatcatgatccatgcanacatacatacatatatgataaatatttggagggctgactctagaggaggctttggaactgatcacctgtggactatctggtcagtttcattttttatgaaacatgtccaaatagccttcatttttgcaagtggctggattaaatggtggctgtgcacggctgtgctatcttcca

SEQ ID NO: 4169 - DNA, 296 bp, Homo sapiens
ctagaacaagctgacagagcataggagcatgttatctgggcctctgtattgcaggagctcgctcagaaaaatgaagaaagacgagaaaatgctctgtcattcagcaagaaagcagacggaagcttagaatcacagcttatttaaaaggacagcttataaatatgatgtgtctataattttactatttcattttcctcatttatagaaaaattaaagaaaatctcatgagaatttcatcacagatggttaactgcaataaatttatattgaataatttgaaaagaaaaaaaaaaaaa

SEQ ID NO: 4170 - DNA, 212 bp, Homo sapiens
cttggctgaagccaaaggcatgatcaaagctcatggcagcctcaagttcctgggttcaaatgatcctctcacctcagccttgcaagtagagcactatcttctcagaggatttgatgcatgaacactgtagatgattgaattgagcttcactggatgatagcatgtgtttgcgtttcctcttataactcatgatattacaattttatccttca

SEQ ID NO: 4171 - DNA, 469 bp, Homo sapiens
ctagataatgaagatattataccattatatgctcttgaatctgtctcattgtgacttggcgaagaggcagtgaatctgccaaaaagaagtagagcagctgtgaagatgccaacacaattgagtactctttctctacatatttctaaatatggcaatttattggacacttatgagcatggaatgacaatggggtcaatttaaccatacggcaatgctgagacaccttcattatgacctttccctggtataagttatgtgataatgaatgcatgtttagtcacacactgtaggtacagatgggaaaaaagaaagcataaaatataaaacatgatgtccaggtttcaaataagaattctaaaatgttatttaattaatgaaatgaaaatactttactttagaaaaagaatattgaatctctttgatgtataaaatgtatatttcaaattaaaaattcaaaagaaacataaaa

SEQ ID NO: 4172 - DNA, 776 bp, Homo sapiens
ctaggttgtgcatatggggtgggtaaatgagaaactccaaggagctgactcctctcaaaccttcagacccaagttcctagcaccgaagggcccgtccttctacgttttcagcactcctccgagctaagatattcatgccagctcatctcagaggtattgaaagactcggaggaggtggctggcaccgcatgtacccaacctggaccacgtaccactgacactggagatgcatgaaggggctgaggtgtcggaggacttccatggacccatatcactccatgtgttacctgtgaggcctgtttaccagttggccttttatggaactcagggattcttcaaaccctaatgggcagatcctaattcaataaccattgaaaagcaagggttcaaaacagacaggtttcatggccgtgggtcttcacgggagttatgtcctgccttgggatgctccgagtgctggtagcatccaactcatctcagcaaggcccggctggtaaactgatcgcagcgtcacaaagtgtccctggaattgctaacgtgcgtaaactcctttgtagcttgtagtgcacttctgtccattatataatttgattcttgagacaaccgaaggcccctcattttagtgatgagtggcaagagcacacaatatcagagctccatcttgatacatcgtaactgttttatcatggagacctattgtgatattaatcgataactaaaaataggtattttcatcttagcaacacatggaacagacacattcacttgcttttttt

SEQ ID NO: 4173 - DNA, 525 bp, Homo sapiens
  misc_feature (1)...(525): n = A,T,C or G
cctaggcacaacagtgaggtggctttcagggggctttccnaggccgaagattttatatgcatggaggcctgggcctctaaggtcatataatgatataaatggttctgaggagattgtctattggaacagccactgtccccgttggatgcctacagggcccaagaggagaagactctgacagcagttggccatacagtcccttctcagagtgatcgctgatagtgaaccccagcatctctgtgatgtgtctgagtcatttccccagccaacctagcatgctggttggaaggatacaagatccattcctactctgggtgcccacagacctaaaccaccctcatcccctgtttcaagattacacagacacattcaaggaagtctttctttgaagaaggctgccatctttggacttgaggtcagtgcagaccttattcactatccctctgcccttgattcagctggctgagagaagaaaccatcagcttgaatgttttcttagccttgagaagcaaacaaatgggaaaa

SEQ ID NO: 4174 - DNA, 390 bp, Homo sapiens
ctggtccagcctgaccaggcgcagactctgcgcgcgcggagcagcgcgcgatcctggggatgcaggggtcatcccggaggtctcggcctcgggcggtgggcctctcgccggcagcagggggcgctgcagaacctcggtccccatcctggagaaccacctccccggctcagccggtctgcgccgcccgccaccatccgaccccaagttctctacctagttctgagcgttcttcctaaaaaagacagtaaaccctgcggcactcccagtgttacgtgacagaaaaaatacagagcatctcaccctgtgaaaccgatcaccctctttttatcttctctgcgcctcgcactgattaaaagctgtctccaagattggaaattaaaaaaaaaaaaa

SEQ ID NO: 4175 - DNA, 818 bp, Homo sapiens
cctgttgcagaatgctttgggaataggtcgtgagcggcgtggaggaggaagtcgatctgaaatgcttgaggaggtggagaagaaaagccagagagagcggagagaccttgggaagagacggctggagaagccagacgtgagaatccagcgccccgctgccacctcggccacacggaggcatttcgcggagcctcggttccctcattagaaaaaccgaggggttgaactgcttcgtttttgaagttccttccagctctaaaatgtcttagttgtatgcaagccaaaataaacaaaaaatggtatcactttatgcatatgctcttctaaatatcccagtgggaaagcacgaagcctgtgttacagctcgctgcttcagagatgccagttcacaagtcgttctttaatctcggggacattatctgaattcctgatgaaagtgagtcgtagttgtgtaggggccagggtgtgtatgtgtgagaagacagagaaagagcaggagagcgagagatagagagagagagagatacagccacgatttgtcctcctcatattttgactatgatccctgactacaagagagcaccgctagcaacactatttcattcatgatctggtttactttggaatttttcaagcctttacaatatattaggggttaaacatttccaaaacattggcttttccaatttctttttaccaaggacggaaaaattatcttgaccccacatgaacccattctaactgatctcttcacttttttttttcttaatcccacgctccagaaacatgcatgttctttgttgcaatctcgattttaa

SEQ ID NO: 4176 - DNA, 419 bp, Homo sapiens
cagatggagtctccctctgtcacccacgctggagtgcagcagcctgattctggctcactacaacctccgcctcccaggttcaagtgattctcctgcctcagcctccggagtagccaggactacagatgtgcaccaccacatccagctaatttttgtatttttagtagatacaaggtttcaccatgttggccaggcggtcatgaactcctgacctcaagcagtccacccacctcggcctcccaaagtgctgggattacaggcgtgagccaccgtgcccagcctgatctttgttatggttatgtaagatgttatcattgggggaaattgaatgaaggctacactggacctctctgtactaatttttttgcaacttcctgtacatctacaatcatttcaaaataaaacaacaacaaccaaaa

SEQ ID NO: 4177 - DNA, 769 bp, Homo sapiens
tagtattttaccaaagtggctccagctcctacagcgaggattcaaacactggaaaatgctagaaacgctattgggtagttttcgaatacggtaacatgcaggatccttaacaagttaacggccctacaaagaagtgcgtgtcacaactgccaattgaaggactcaatttgcttccaaaacttgctatttttttggaagacccctcacagggtttatatatagcatgttatgtatataaatattaatacttattttatttggaagaatgacttcacccttagcagcagaggggctacagatccacacttacaaggccttgcccacctggcagccagaccactcggcctgcacggcttccctgccacacgccttcaccctcattcccgaaaacgccagcctcaacttactcacgctcttgcttgcgacttgtcattggtggactcctctgaaccagtgatgtctctatgttgactataacgtttccgaattatgatacttttctgtattttctcaaaatgttttggccatttttcctcagatttgtaattcggaaaaataccaatttcccaaggaatgccaggaacaacttctcacatggaaagccaaatctccaggagtaaaagaagtcttcagactcccattccacaattctctcacctacaggagttctggttggtgagatgggaggacttgcatggaacctactaaaggaaagtgtcaaaacactggcttggccgggcgcggtgggtaatgcctgtaatcccggaat

SEQ ID NO: 4178 - DNA, 824 bp, Homo sapiens
agggccctctgaccattatgggctgttaatatctgagacagaacaaagacatcaggaatatgatccatacacttcagacagcttcttcattgcatgaaaatggagccaaacaagcaaagatctggtatgacctcagctttgttcctggaatcaccttctgcccagttcacacattcctggcatgtctttcattctcttggggaagagagcaagtggagttgccaggttactgttgatgaagggcaatttttagaagcagaaagtcagcatcctgtgctggatgattcatcttgccctctggggcatgctctgaatgttaaacagtaactatttgttggtgattaatctgttggattttgctcaacccctattcgagtgtccatgatggatagatcacttttttctttacactacttgtcaagtataaaacagatggataacatttcccttccgactgattcagaaaaatatgttttttgggattaaactgtaaaaacaaaatgtatgtttactaggattaggtgaatagtaaggctgaactttcaactttctaaatcaccccttacaatatgaaatttcccccctaaccctgaaagttttggaatttgagaaacgggaccgagaaatgggggatccccatttttcacccttttcctcctctttgctcagcagacccttgatttaatgcccagggcaggacagacttattctttccaaaggaattattatgccatctggaccagcccttaacttttctcatttataaaaagggagaattttgttctttaccccattgggaggggaacgtggaaccttcctttgtt

SEQ ID NO: 4179 - DNA, 481 bp, Homo sapiens
cctagaaccatctgctggaatgataaaatgatttggaaaaattcagagaaaatacacagaagagaatatgctgacacatacatgtgtaaaaatctctctttgggagcaaggctggccagattaaggaggaagagaaaagctatagaatctggcccagtatctattgctttaatacaaagaattcaaaatcccagggagatagctctttacagaattggggatttaaagtgcaggagttattgacttattggactatcctgaaacaactgtctgttggaaatgcttttctatatcaaatgtcttaaaattaaagcttcatccatttctaaaagcaagccaaaattgatttctttaattcagtacttttatatgacttaaaatattttttctggctataaaatataaaattatatgcttacgttaatgaacattaaaagtagttgtaaataaaaaaaaaaaatcgggcctccgctggcctcac

SEQ ID NO: 4180 - DNA, 639 bp, Homo sapiens
actgccaccctgggcagctggtttcgttcgtgggcagccactagtgaggagagctcttcagctccttcttccctaagctctttggctcctggaagattgcaacccctgcaaacaagcttgttaaggtcttaaacatgaatcagagacatcagcaaaggccaaatggggcatcctgcaatctttagcgtggaccacaagaagctattttttcactatagatctttaaaatacaggactcctggcacatggccaaatggtaaataccagctcgaatgccatcctgagatcagatatcaggacaagagcaagagaatgagttacctgggtctttctcatcaactctgacttgacagaacaaggcaggcaagattagagatgagcaccaccttcctggcactgtaaccttttcattcaggctccattagacaatggaggatgaagtgacttctctgctggggcccagaatccatcagaatcgatgactaggaataattatcacccccctctggccagctcggcttccgcctggacttcgccggcccgcctgaatcttttatccctcttttcggccccaaaaccactacatctacttcgtcgcgaacaaaaacactgggacctcgtccccccaccccggagtca

SEQ ID NO: 4181 - DNA, 804 bp, Homo sapiens
cctaggtactggaaggaatagagataatgagagcctggaactagagtctggtggttataccagaagaggaagccaacactgcagatggcagagttaagaggagagaaacggaattgtgatgacttccttgagtccataaatccacacaaagtcagttattcccttgcacattttatttacactgattacactgagccactttttgctaaagccagtttgagtggggttacctaatacctgcaaacagcagaacgaccattggcatggagattctggaagaagccaccatccagtcctaatatgcaggtaaaggcataaagagtgggcagatcatggggcaggtgagcccacatcaccgggaagtctttgtgggatcaacaggctgtatagcaacactgatgggaagcccaagcatgggcagctctgataccgagctggggccagggaagggtggccagaattcacccagaaaaagcagtccaatggtgaggctgggcctggccattgggtctgttcaacacagaggacaaccaaacagaaagacaggcatagacagctgaacactactgcagtgaaaccaccgagcatgaagaggacacatcacagaggaaactcttcctcttccaggagtaccttgaaccttggatccttttctacctcccaggccactgagttcctggacatttatccttataaaaccctaccaatgaattcaacatcagtcagtgaggggattaaagacagttctgccactttgttattatatgaatccttatgaataaataactcggaatggaagaatat

SEQ ID NO: 4182 - DNA, 357 bp, Homo sapiens
tgataagtggttctccaagaatgatccccagactagctgcatgagcatcagctgtcatgcagaaattaagattctcattccaaaggagtcctacctcatacctggaaggaagaaatgctacaacagagaggccaagaagaatctcaacagacaagccttgctggttttcctcacttaggccactatcattagagcactctcttttcattcaagcacaattctatcactgcccattctcattaaacctaagcataaaaatgcagttctcccctgtattgtcaggacttcattcagaaaggctcctgtgtcatcttaatctttaattaaataaatctgtaatgctgaaaaaaaaaaaaa

SEQ ID NO: 4183 - DNA, 958 bp, Homo sapiens
tggaataagatgtcttacacctgcagtgcccacaagcatgatgctataatgagtcacctgcctgtggttactctgagtctccttttatgaagcatcaggtacttgctcctccagggcctcctgcctgctgttactctaagcctcctacctctacgaagtatcgggtgcctgctcctctacgccctcctgcctctaagaagcatcgggtacctgctcctccagggcctcctgcctgctgttactctaagcttcctgcctctaccgctcatcaggtacctgctcctccacgtcctactgcctccatgatgcatcaggtacctgctcctccagggcctcctgcctgctgttactctaagccttccacctgtatgaggcatcaggcacctgctcctcccggttctcctgcctggagatgcccatcgtgacttcaccacccaagtagaaattcacacaattgtattccctttaaactcttcctaatgattcacttgatatgaaagtttaattattgatgcatgtcaatcttttagtactatattttctcctaatgccaaagtccaagagaataagggcattaaaaaacataaaaattttagaagggtttctcaaatgtaaacaaaaggatctatataatcccattctaaaaattctagctggattcctgttacttttctatgaccatttttccataggaatgtatatgtatataacacaatcctatgtcgaagaaaacaccatatcgtaagcctacttcttttcaacgtcgaacggccaactatcggatattaacctttcctcaacatggacaaaattataccaaaacattctatttcaccacggtcatcaaactcccgatcccgaccggccaaactaagctacaatctctcgctacacccacacagcaataacaaatcttcccccctggccacatccgcagaaactaagcacacaccccagg

SEQ ID NO: 4184 - DNA, 286 bp, Homo sapiens
tgagaggacgaaggccctgaggtccaagacattgaaacctgacaggtcagtcatgcgtgtactccaacagctgcaggtaggggccaggcaagatgtccacactgccgtggcttcaaaggcatcctatcccaaggggtgaactgaaggacagcctggagcttcctggagaccagagggcccctccaccctacctggagcaacgccagagcctggactatttcctgcagcacttctcccctgccctgctctattttatcttttttaataaagatgactcctgataaaa

SEQ ID NO: 4185 - DNA, 792 bp, Homo sapiens
ccaggggtacttgggccaacgctcagactacgaagcggattctgtgagtacacgtgggagccatggaacctgcttacgcatccggaagcaagactagagggctgaaacgtaccgccctctgaaggaaccaacgttgttgacagcttgaattcattactagcagccttccagcaccgtgacaagaatacattttcgaagatacagcgcccctgattggggccttccgtactacgtcccaagggagggttatgctgcagacattgttttaccaacgaccgaattctgataacaggaagaaataacgcaggcctctacaacgttatagcactcttggactactctgcgcttacggaggaaatagagcacaataaaattccttttctaaccgggcctgactctgtagctcacggctggagtgcagatggcatgatcttggctcactgcaggctctgctctaccaggttcaagcataggtatgctgcctcagcctcccaaggagctgagcatacagacaggcaccatcatgcccggatagtgttatgactgatagtatagacagagtttcaccattggcgctcgggctggatctgacctcctgacctcaattgatcggggcgtcattgactaatatagtgctatgacttacatgcgctagccccacggctgggtgcaaatgtattatttcagtagagggagtgatgcgagcattccttaaatgttgagcgctacgaaaacctaacatgggaacgtaaggcaggtggagtccatctctttaaaaagaacaaaatgcgg

SEQ ID NO: 4186 - DNA, 771 bp, Homo sapiens
  misc_feature (1)...(771): n = A,T,C or G
aggccctgcctcagcgggaccctcctcacacaacttcttcttcttcgatggcatgaaggggaatgggattgtggagtgccttggccccaagtgaactcaagatttggcagccccagagatgccaactgcagcatgcccacctgtattccctgtccccttccttcatgaaggcatctccaggcaaggaaaactgaagtcattggcccgatacaaaacatttcctgcaacgaaggaggtggtgccgacgtgctgcttcccatcaccagcagctgctcgacaaggggcgcagggtggctgtctttgttccagcactgttcaggctgcctgtcatcccgggcctgccagctcccctgagtgatgagcacttccaagcacccctctgccctttctctgtccttatgctgtcccggcctcgccagccctctggggcattgtgggagatgcctgccaggaatgagcaagctctgttgctcgggagcctcttgtcaccttcttggacttattccccacctgataccttatagagaaaagtgtgaattcaggtggagagtaggcccaggccccatgaggcaccagtggaagcacagctccaagttcagacaggtgcccttagagaggtaaaccatgacaggncaatgcatttcctctggagtttgagaccctgacaacaacaggtggcatctggtgtgctgttcttgagttttcgtttaggattagccgagttccagctgggttttggggagaaggagatgctaccaagtcttggatgtt

SEQ ID NO: 4187 - DNA, 378 bp, Homo sapiens
atgtagttcactggactgggaagaaagggatatattttacaagctccactcaacttttaacctttgccagctgaaattttgagcaagttgcttaatctccgtgggcttcactacaaaagggaattgggtaaaaactatttttaaaaaatagtagtggcacaagttaatagtcaatttttattgagtactacatactatacggcaggcaccaatctaaatgctatgcatccgatttgcttctcctaacaatcccttagggtaggtatcattattacccttttgcagatgagaagacagtaaactaacacatcctgtataaatggtttgaaataaatacaaaaataaatttttgtttggtatgtctcaaaaaaaaaaaaa

SEQ ID NO: 4188 - DNA, 205 bp, Homo sapiens
atggactgtggaaccagactgcttggcctcatatcctgactctgccacttattagctttaagaccttggccagatttcctaattgctgtgtgtctagtgtcctcatctggaaagtggagataatgatattctattgtacagggttgttgtgatgattacatcagtaataaagcacttagaacagtgtctgacaaaaaaaaaaaaa

SEQ ID NO: 4189 - DNA, 490 bp, Homo sapiens
cggttgctgcttctatggaagtcttgaatccctcaaagtcatccatgagagttggaatcaacgtccttcaaactcctgttaatgtggacattttgaccaccttccatgaatcatcacgaatgttcttaatggcaactagaatgagatggcctgaaacttggttgtttcaaagaaagctgttggcccatctccccacttcacctgactcccattcccacacaggcaacccaacacattcaaggtcatgtcggaacagctaacctgacagggtgggatgcggcctactgctctgaagactcgaaatgctgacggcaccctattagctttctgttcacttcagtcaacttccttctcatggtctatcctcttccatatcgtgatgccttccttccatgtatcatccatcttacatcattatgtatatcacactaagtgtcaataaagtgttcacgcagcagtctgccctattagactatgaaaaaaaaaaaaa

SEQ ID NO: 4190 - DNA, 128 bp, Homo sapiens
cttggcccctgtctttaagcaatgcacgactgtgtaactatctgctagatgactccagcctgctccagaggaacttggaaaaggaaatcaccttgatattctatccagcggctgcaaaaaaaaaaaaa

SEQ ID NO: 4191 - DNA, 853 bp, Homo sapiens
cttagatgaaaccgctgattctaatattcacacagaactgcaaggtggaccctaagcaaccaaaacaatcttgaaaaaggaaaatcaagtgggaggactctccctttctgatttcaaaacttactacaaagccacagtaatcaaaacagtgtggtattggaataaggacagacatatacagcaatgaaatagaatcgagagtcctaaaataaacccatggatctatggtcaattgattttcatcaatggtgccaagatcactcaatgggaagaaagaatagtttcttcaacaaagggtactggaacaaacggatatctataaacaaaagaatgaaactggactccaacttcacatcatatataaaaattaactcgaaatgaccaaatgtcagagctaaaactataaaactcttagaagaaaacataggagcaaatatctgtgaccttggatttagcaatggattcttagatactgacactaaaagcataagcaaccaaaaaaacaagatccattatacttcattaaaattgaaaacatttgtgtataacacactatcaagaagtgaaaagacaacctacagaattagaagagaatatttgcaaatcataattctgataagggtctagtatccagaacatataaacaactcttagaacccaacaacagaaacaactacttcaaaaatgggcaaaggacttgaataaagattgttccaactacggtatacgaatggccaacaggcacatgaaaagatcctcaatatcattagtcattagagaaatgtaaatcaaaaccacaatgaccctacctcacaccaactacaatggatataagcaaaaaaaaaaaaaaaaa

SEQ ID NO: 4192 - DNA, 734 bp, Homo sapiens
  misc_feature (1)...(734): n = A,T,C or G
atgtacacagaagagagagtcagaagaggagaaggcaatgtgaagaaggaggcagagactggagcaatggggctacaagccaaagaacgctgaccaatgccctgggcctccagaactgtgaaagaataattttctgttgttgtaagttgccaactttgagggcatttttgtggcagctacaggaagtaaaaatatggatggtcaacttcaacatcaacagtggtacatcaaattgatataatcttgataatgtgtttggagaacagcacttcacctcatctaaacatccataaccatagtctaaccatgatctacaccccaactaaattcagtttgagggacattttacaatatatctggtcagtacttcccgatattgtgaaaggcatcaaaaattaggaaaatctcaggaattgtcacagaccagaggatgccgtggaggcacgacggagactaaatgtagtgtgatattctccatggaatcctgaaacacagaaaggacattaggggaacgctaatgaactccaaactaagncttgcagttactaattaataagggtatgaaatggcttcattagctgtgacaaatggaccatagtaatgagagatggtaacatcaggggaaactgactgtggagcggatggcaactctgtactaccattgcaacttttatgtaaatttaaaactcttctaaaaataaattatctaaaagtagcagtcaaaaaaaaaaaaa

SEQ ID NO: 4193 - DNA, 731 bp, Homo sapiens
atactaaaccaagaagaagtcaaattcatgaatagacaaataacgagttctgaaattgaggcagtcattaatagcctaccaacaaaaaatagcccagcaccagacaaattcagagctgaactctaccagaaatacgaagaggagctgataccattgcttctgaaactattccaaacaacagaaaaggagggactcctccctaactcattttatgaacaaagcatcatcctgataccaaaactggaaagagaaacaacgaagaaagataacttcaggccaacatccctgacgaacattgatgcaaaaatcctcaacaaaatactggcaaaccaaatgtagcagcacatcaaaaaatttacctgccatgatcaagtcagcttcatccctaggatgcaaggctggttcaaatcaatacatttcttaatagtattaaatcacataatttcaatctccccttagtcttctacataaataatttaaacttgttcaactacagagtcaaagttatgtgaatgatgtttgctaagatttgaaaataatgccttctgtcagtgagtagaaaactgcctcaggactttcaaaagctattcggttttgcctacttgattgtaaaccattctaacaacactcaaaacttgatgcacttgtaagtttgcttgtcaaagataaattaagccagatactacttaaaaaaaaaaaaatcggcctcgtggcctcagcggggagctctc

SEQ ID NO: 4194 - DNA, 312 bp, Homo sapiens
agggagtataagttctgctgtgaagctgatgtcagcaaactctacaactttgatcttcataaggttatgcttttgaaattaatgggacagctgtatatgaaatcaaaatcaatttactattttccacaatggagaaagaatgaattatccaatataaagtgtggagcactataacggctgcaatctcatctcactattcttatgttttttaataaactgttcatgctttattcttgtagtttatgacatcaaagggactcttctgtaaaattacagcaataaatttcaccttatgctggaaaaaaaaaaaaa

SEQ ID NO: 4195 - DNA, 440 bp, Homo sapiens
atgtgcgattcaagaaaatattgtgttactatgacttgtcagctgttacagtttattacacgctgcatcctccattctcacctgatcctggcctattcccagagatctattagcgatgggattttaacgagtgacataaggaagagggcgctacagtttttatggaagttcaggattcacgaggattgtggaaaagtacaacacaagactttttttcaacagtgaaagacggggggaaaaggaatgaataaaatgttcggattttcggatgttaaatgattgaaacagtttctatttaaatgcaaatttgactttttaaaagatgggactaccagtaactgcaccctaaatggtaaaatgaaaatcaatttgaaatatgggatgaataaagtatatgtggactttctgggaatcattttttattatgaaaaaaaaaaaaa

SEQ ID NO: 4196 - DNA, 993 bp, Homo sapiens
tttttttttttttttttccaaaggtcaaaaatttttttaatttttatttttctgctttttaactgtatccccagtgcccccaactttgctatgaagaccaaggcactgtggaattgtgtgtctgcgtttggaaagtcagcttgtgcctaaatggattttgaagatatcaggcattctaggattgagactgataattccttttgttacaacaggcaagagtaagagccaataaataaaagaatgctacattttaattttcaaagatatgatttttttacatttcatatctcaaatcaggatgtatcttggaatcaatagtatgttccatgtgaattgccagtgtttaaaaaaaattgttgatggtaaatcagataacaattgctcttggtaactgatggcatctttagataagatgacatacggtattttaatagtgtgtaatatgttttaggtttgtaatttattaattcattttacttttctgcggctgatgatgtagttgcctggtgatttatttccatttgagcattcagaggttgaaggggaactcattagccaagtaagtgcatatccatctcagtcagtgaatggtactcacagcatcaaacaactacagctttcttcctagactatctaatgtatttgtaattgtcattttttggaaaattgtatttaacatgtttaggctatattgccacatttaaaaatcatcaactactttgtcaacttcagtatggtaaaattaagtttaaaggtcacctttatatctttatgtgtcctttatatcttattctcttatttttacagttatttaaattccaaatataccctgattgtaaatggggtaaagaaggatgactcatttgaagaatcagataacaaaggggtcccgaaaatcttggtttgacttggaatgacttttgatggccccttgcaatctccctctcaaagattgacagtagaaacagcttgggtgacttagttacatccagc

SEQ ID NO: 4197 - DNA, 352 bp, Homo sapiens
gtgtgagtgcactcgaaacatcccctgtttgtagaagcgtatgattctctcccacaaaactatgagctatttgggaagaagaattctgcctggctgctcttttttttcccctagaaatgagaagtggatcacgcaaggttctgcataacagtttgacgaatgcttgagattggccagcaatgcaagcctcagcaccagagtgtggaatcgtagaatgttagaactggaaaggatttcagcaacatctcaaactgctctgtacaatatgttagcccctagctacatgtggctatttaggaataaatcaaaattaactgaaattaaaagaagttgaaagtcaaaaaaaaaaaaa

SEQ ID NO: 4198 - DNA, 451 bp, Homo sapiens
taacaaaggctcaagaagattaaggaatcggcagatgtgggatgtgcaatttccctatggctcggtagatgatcaagttaaacaggcacgctattatgaaaaaccaccaataaaatgggagaaagacataactgctgctgtatgtggagactgcacctcagccttaatttgacttgccgagcaagaacaaatggacagcacaccgggtgcttgtttagttaccgcggcacatgattatgaggtttccagaaggcatcttcttcacatgtgagatcactcagacttcagcacttggcaatcagatacaaacatgtgcaagttgaactagaaattgtttgaaaaagctaatgatcttgctctagattttttttttaattagaagactatatgtgttcaactgaaattgaataaatgaaatctgatttgggacatttcaaaaaaaaaaaaaaaa

SEQ ID NO: 4199 - DNA, 752 bp, Homo sapiens
tttttttttttttttttttgcagtcacaaaccttctctttttatttgatacttttgtttttttgatctgatctttaaaacttttactcattccaggttataaactcaaattattcaaacttctactagatatgtctatgagttcaatcattatgcaaaagtaaaattaaccacttctgacttaaatttatggttatgttattaaagagctttttgattccaggactctgtctctcatttaaatgaagacttttttccctgcctttgttaggcttgggctggaagcaaaatgcagtctagtctctcatttccgtgaacccattatctcctgatttctgtttatgggcatttatcaaggaggattgctacatagagggtattggtggcaaatgtccaagctcctagaacttctgctttctgaccttcctgatatctaggaatgttacagagattagatttcactcctaatcttcctttatcatcactgtcttttggaggcttgtgggcccatagagcgacaagtatgggccaactgtgatgagatccatggaccccgaaaaaggctgttggtggtttcaacaccgttttttttcccccagataataaggtgtgattcgccaacattggtattactgtaacccccccttggagcaccgtataagattttctccccaggactccgtcaggaaataggctttggtgggcggcgaatgcaagttacactgggggtttggaatattgaattattttcta

SEQ ID NO: 4200 - DNA, 277 bp, Homo sapiens
tttttttttttttttttgacttcctaatctatttatattaacgggtccgggtgcgctgatacaatatcaaacacacatcacttctctgttaaatggactgcttactactgttacacaaagatctacatactgtgagagagaccatctaaggataataataacctggggtactaccattattcttcctctttttataacaaaaggcggtgtgcacaatcctgtataatgaaggttagatctctacttcttttcttcaaagaaacttttctgtgctttg

SEQ ID NO: 4201 - DNA, 397 bp, Homo sapiens
cctgatgcttgcagccactcaattacatcacatagctgtctgaggctctagaaggtgctctgctgctaaaaggagcattataaagagtgtttgaatacctccatgggaacagaaaagcaatgtgtgtggaaggatattcaacaatgtgttgttggaagaccaagtgcattttgctgaaaacctccataacaagaacagagacttggaagaagagattcaaagaggataaatatatattaaatagattcaactgcttatttgggaagatctttactatactagatactgttttactttgtcttaacatatgtattacactgattcaacttcttatcataaatggaatatggttgttttttctgtcaataaatagatccatgcttcaaaaaaaaaaaaa

SEQ ID NO: 4202 - DNA, 841 bp, Homo sapiens
tagagagaaagagagacctttttctcctcagggaacaaagaatgtccttcatctcctgactcccaaccaaccagcccagagcacagatctctgccaagggctacctgaatatcaagataatttcctgcccttatccctacaagactgaaaatggaagacctattatatctgccaagaattgaatcttgatcacttaaacatatttctcattcaaacactgagaagaggagacgttttgaacacttgtgagctcctggccttggtgtgactgtctccacttgggcagcagggaacaaacgtgagccaccggcccccactcagaagagtagcacagctcagcatatactgaaagtcacacatcatcaacagtcatgggcttttgtgtttaaagactgtaagtcatgtttataaattaaagaaaatgatacgagctaaaagtagggtagtattaatttgtgttaattatgaaaataattttgataactaattaaagtagaaaactatacttagagcttttcgtattagatggcatctacttagttgagtgatctcagccagagcaatttatttgagacaaagggcttttaagtatatatccaattgtgtttctttatatacattatttgaatcaaaaaacaacgtgttagtatatcaatgaaggaatagtttatttaatacaagccctagtttgaaatttaatctaccaactttggaacccatatcccaaaatgatataaaccccactttttgaaacaagttgtataattaacaagaaaagttgtaaaaaccccaaagcctaaaatccattcctacgtggaaggcctggttacaaactccacat

SEQ ID NO: 4203 - DNA, 790 bp, Homo sapiens
caggctgagatgctgtttctaacaaacctcccgatgctgctgatgctgcatatctgaagaccacactttgagaagcaaggatctaggagttgtttgttattcatggaataaatatatttcccatcatgttccagctgctctggttaaacaagccactattgtcttttccagaaagatttctctgactccagctcccctttgggtgctcctttttctaaactgtaattgattaataattcaccatttatttcatgtgtggagcagggatagtggtgcttgcctgatgtgcattccttacaaacacctacctgggcatcggggacacagtgtcccctcaaacaatctctgctgattaactggaagataacactagcttacatttttggaggacataccatgtgccgggtacctagctaagtgttttacatgcattgtctccctcattcagctactactgtcctcatttcacagatgaacaaacaaaggccgatctgccttgtcgacctctgcccaccaccataatccacaggggtactgcccgctagggggcattttggaaatttgcaggtactttcattggtcatcacaatgatgggaggagggggccactgacatttagttgggggtggccccagatgcaggagattggtctgtgtcccacatggctttcatttgtcagacctgacctttgcttcagttgaaatgtgcatcgaattacggcggaactctaactctgttttacatataaacacaaaatgtctttgcattttgtgaatacacacaggaattc

SEQ ID NO: 4204 - DNA, 461 bp, Homo sapiens
atgctctttaaaatttcctgcaagcattcctgcgtgtcccctgaagagttcccactggtactgatgtgtgaggctgtcttagtgaccacttcctccattcttgcggtgacttcatttctggctccatgtgagctatatcccaatctctgtgaagcctgatgaatgtgcaatttcactgatgccgcctccgatgagatattttgtcaaggtctgctgaagtcatgccgtgctcatatggtgctttgctgaagctgccaaaactccaatatggctggtgccctcccctgctgatagcccagcgcccgcagtagagcactggcattttatattctcagctgcagtcacagtggagaaaaaaaatggtctcacctgtgtagttctctgctaaatgtaccttgttagcagttatgaaagctgcaacacatgcaagacaaataaaaaataaagcgcgatgctggccg

SEQ ID NO: 4205 - DNA, 771 bp, Homo sapiens
tttttttttttttttttgtctacaaactattctttatctgaagagtagggacaaagaactgaaacctgcctacattaagaactggttgattaacaactaaaaaaacagtgttcctgaggaacactatctgcatagagcgcacccccatctttaatcatttgtaacacacacaattcttatcggttcaacatgactgtaggggggatacatttatcccagaaaaagatttgtaacaaaactagtggcataaacttattcctgacaaaaagtcttataacatatagcatgaattttaatagcctagtggacaaaaagatcaagaagtaaagaatttagcccgggagaataacgctagaggttcccacatattttccctctcatgtttaaacagaagagtttaaggccttaccacactctggaaaagcgcgactttgaaatttggcgggggcacacgaatcaccctttctcatgtttctcgccggtttagatggcggccctgataccgctaccgggcatgtggtaacaagtggacttttttaattccgaaacaaacaattttgcgaattgatggtcaggtaaccagagaaattgggaactctcgagggaagagcccaccctgagacggcgtccgttttctactggcctgcgaagaggggagaacgcggcccagtcgattgccaaagggatcacctgtgcgcacatgcgccttcttacacccgccactttgctcttgggaaggtgcgcattgggtggaggagctcgagtcggtgg

SEQ ID NO: 4206 - DNA, 502 bp, Homo sapiens
ctagagttgctcttctacaagtgatgtcaactgcgaataagcaaagagtttcagaggttgccagattgtcacagacgactttggagaacccagtttcattcccaaggctgctatcaataaatcttgctgacggccctcttgttttgatttgtgaactgcagccctattagttttcctccctgaccaagactctttggatggcattttggaattcacaaggaaagaaaacctatagtggtctatgtctgtcgatgatatctattcagctaacacatgagcattctgctaggcagcacagaaccctaacctacagagagctgcagagaaacaccacggagaggtggaggaggaggatgaagcacttcttaaacagaggtcgactaaccagcaaattcttctttcttcctttttttttcttaaagggatctatattctagcttctaaaaacttgagtctgaacagaaataaaaagaaagagtcgatgctaacatacaaaacaaaa

SEQ ID NO: 4207 - DNA, 693 bp, Homo sapiens
ctaggccctgaaagatcctggaagcattgaaatcatctttatcaaacacatttggaattcacattactgaatctcagctgacacttcattgctatttggaaatattgtattcaacctttatttattctacatctcattcttcagataacaatgtgctactttccactttccacacacatatgcttaattaattttgtctatccaaaaattacagaagtataaaaggcattttgtttacaatatgtattaatgtttatatttgttataaaaacaaattgaagcaataaagtttagttactttttaaagcatatccaaggtaatcatcccacttaaaattaaaagtactgcaggtaattgaacattaatattttctctttttttaaatgacacgtctattctaaacagtctcaggaaatgtttccaaacttgtgtcaggtttttttttactgttgccataatcaacaggtcccgttgcctttattttctatttaattgcttctgcttattgaacattatattaatcttcctaaactgatatttttataattttattcctcagctgctctcaatgcctgagttcaactattttaggtccactttccacttatctttttgaggcttttctgccttttcctcccaaaacaactgtatgtaccaataaaattattcttggacaaacaaaaaaaaaaaaa

SEQ ID NO: 4208 - DNA, 202 bp, Homo sapiens
ctagatttgctgcccatggtaatggaagacaaatacctgcagaagaacataatcaaaactcaaaggaaagtaaggaggagcaagttttttaaaaggaatacagtttgcaatcctcttgttactaattcttgttgataattgattttgtgcttaaatctcacaagaataaacagtttttagcaatgctttaaaaaaaaaaaaa

SEQ ID NO: 4209 - DNA, 329 bp, Homo sapiens
cctaggtgcctaaaccctatattgaaggctacagagaggactacattgagacttggcaaagtcctatagaagttttgttttcttatggtaaactaatacaacatatagcattgacacaaaggatgcactaaaggatggacacaaatgaaagaactgagacatgaatttgttcttaagaaaattattctccattctttgggaagtcaactgaataggatgaagaaactgctctatgttatcaagtttttaaattttgtatttacttatttacttttgttgttacttaaatcaactttaaaataaaataaaatttatatatgagtacaaaa

SEQ ID NO: 4210 - DNA, 743 bp, Homo sapiens
ttagagaccagtgacctattgaagtggtgcctctggctcagtcggcctcagtcttccgctgggactcagacctgctccggaagccatcctagaatccctgggaagggctccctttattcctggaccgccattgatgacacacaacctttgaccctgatcaatgcatcctcctcccaagcagtgcagacaggagcagctctctcagcacccagaggaagcgcgggtattcggctctgacctctcaccctgcccctaacctcactgataatcgagttttccattcgtactcactagcaggctctctacgcaaagaaacaagccccccttactctgtctttaccgagatgaaaccacgagcggagtctgttcagccaacaccagcatccggtaccggaacacacaagaggatcggatctgggtcccggctccccgattccatcctgggcctcccagcacctcccatgccgctaggacagagcacctgactcagacagcattcgtttctcctagtgtggcacttgaagagagaactgtgtctctttgaaaaatgttcatgttgcagagcaatttaaaacacacacctccttccaagtgcccttccataaaagcctgctttccagaagcccctggaatcctaaaaaccgaatcaaagacattttaaaatgaactttctctacctccctttgaatctttgtaagatctcttattgtagaataaaagaagcttccacaaaaaaaaaaaaa

SEQ ID NO: 4211 - DNA, 433 bp, Homo sapiens
ttcgtatggaaaactacaagaagacctgtgacctgtgatttgggaaacctgaatttaggaagtctggactctcatccctgacactagctagcagctgaatttaggagagtcacttaaactatttgtttctttgttttcttatttgtttgaaatgtgtgttttttctcataaccctgcttttaaataagtctataaatgcagggacactggtgttatgtcttatttttctctgtttcccatgtggcttagtagtaaatactaaaagttcaattcaagttctttcaaataattaagctcacagataaaataagaatttccaccaaactactaagatttctttaatatataaatattgctttagaaagtattgattttagaacaatttttatgggaataaaataaatagctaataaatctggaatttgttttaaaa

SEQ ID NO: 4212 - DNA, 786 bp, Homo sapiens
cttcagggtcactcacttttgggggaatccaactgccatgttgtaagaatactcagactagcctatggagagttccatgtggcaagggctaagccctcccaacgacaggcagcatgaacttgccggctgtgtaagtaagccaacctgcaagcagatcctccagctctaatcaagtcttcagatgactacagttgcagccagcatcttgactgctacctcatgagataccctgagccaggactacctgtcaagaactctggagggtctatgattttactgtaattgccagctaatatgttagcctgccctatatttatggattatagcagaagacacaagattcctgggtcagagccaaataagtttttattcacagcagtaacaatagccagagagttagcatgttctcacacatgttcaaatcccacttcccataggcaccacagaggaccaggtgacacctcgtacaatgaattgcattataagagaggaatcttgagcctaggaaacctaatattttatactggacagtaaagatggctatccttggttcagggaagagatcttatagccatcttccaaggcagatcactatacaaatatctttgaaaagatagccttgaataaaggtcatcagtggcttgggtctcaatacatgtagaaatgagagggattcatggagagtcctctctcaacctttcaccagctaagcatttctaaattcctgacccacaaaacactgggaggatattggtcatctgcgttgaatgagagggttaacggaat

SEQ ID NO: 4213 - DNA, 251 bp, Homo sapiens
cctagaattcacatgtgaatcctctgaccagggccctttttggttgctacagtgttcctgtagtagactcatctcattatttgcgatagtatcaaccttgattttctacaggtgaagaatgtcatgaccttaatgaattcgggaagtaagcaaagaatgtctaaaattaagaatttgttttttaagacttctatttctaagaatattattaaattttataaacatttgagatagtcttaaaaaaaaaaaaa

SEQ ID NO: 4214 - DNA, 793 bp, Homo sapiens
  misc_feature (1)...(793): n = A,T,C or G
cttaattctaaatgcaaatgaaggagtcactcatcaaaggcttctatggctaaacttcatgactctatactaaacaggaatctaaccaagaaactcacagctgctcttgagaagatgccctgctaaaccactaagacaaaaatcactttttatgacctcacccagtatttgatagaaagagattagcagcttgcctgtaatctactctcttcatttactgggagattctctgcaaagagaagtgacccaatcaaaattccttgccaaatacattgttggtatgttgtggtggacgtatctgcatatagaatgctttagcaagataaccctggtctcttgagaattgcttatggagaagaaacccgaaatccatcgattcatggaggatgactttataagaaatatgatgtgacctgaaactgggacaggatacaacgaaattgtgtgaatgaacaggctacttatgtgcaagttatggctgcattcgttgtttacatgtattgatagttgaatgcagaccagaatttgctctattgggagaagaaaggaccctgtaagtttttggtttattttattcatatctctatgtgttattaatgtaacgctctcagacattgtgcacttttgcagatttggggatttcatagctaatttcggcgatcatgcctaactcccgatattttatattatccgcgtagcgaacggtcctgtagttatcnacattgattaatagttggcgcattcttttcggtttgtttcctaatgtattggccacatccccaaattctgtctt

SEQ ID NO: 4215 - DNA, 356 bp, Homo sapiens
ggtgggctgcccattagccttccatacttccaagccttttctttttcattcccactgcagaaaagcatgtccatctcttgtttttttggaagagagtcatctcttccaaatcctgttcatcacagtgttctcctctgcattagaagactggaaatgttcctgcagccattcccatctgttgtccatgttaatcactgtgggtttcaagattctctccaccacccacaagcaggctttatccttctttcagtgcatacctaatttcactgctgccctgaaataaatgtactctgtacaaaccacctggatccatatatatatgtacgtccttaggttttaaattcttgggtgtaaaa

SEQ ID NO: 4216 - DNA, 467 bp, Homo sapiens
gctacggattcatttatcttctctcttctacagtgttcccaagagaactacacaaacaatgactgaatgaagagcaaataattattacattaacaattgtctaagtactctattttctaatgcaagaccatcttccacaggaagcccttcattgacctgctcagatgaactcagctatgtgacctgcaagtttattcttccacttattatacttactttatcactatttgttcagtgacttccccaggagcaattaaagcagaaaccatgcatgtcttatttgttcagtattctgtcctaatatcttagcaagtatatgtcatagagctactatttattgattcttaactagtataagagttagatgtctaaaatgtgactccacctacatgacacaaacccccccagttcactcatttattcagtcattaaataaatatttcagatatgtcaatatctgccaggaa

SEQ ID NO: 4217 - DNA, 429 bp, Homo sapiens
ctagacttgacattactcccctgatctagaatcctttggactgaggaagaaatcaagccattctgaggaaggatctgcaatatcatgagatggagtcttgctgtgttgcccagtctggtggtcaaactttcagcctcaagcaatcttctttcttctgcctctggaagctctggaattacaggcatgagctgctgcacccagtccctattcacatacttgtaactttatctatctgtcttttcagctagtatttataatggttggtaatagatatatcaccactcttttaaaaaatggtcatttgaaatctaagaatactttagaattaatctcaatttggcaagtgttaatgtgagtggttttgttgttccttatactgctatacattttcactaaaaacaaacaatccaggacctaaaaaaaaaaaaa

SEQ ID NO: 4218 - DNA, 347 bp, Homo sapiens
agagatggagtcttgctgtgttgcccagtctggtggtcaagctttcagcctcaagcaatcttctttcttctgcctctggaagctctggaattacaggcatgagctgctgcacccagtccccattcatatacttgtaactttatctatctgtcttttcagctagtatttataatggttggtaatagatatatcaccactcttttaaaaaaaatggtcatttgaaatctaagaatactttagaattaatctcaatttggcaagtgttaatgtgagtggttttgttgttccttatactgctatacattttcattaaaaacaaacaatccaggaccttaaaaaaaaaaaaa

SEQ ID NO: 4219 - DNA, 342 bp, Homo sapiens
agagatggagtcttgctgtgttgcccagtctggtggtcaaactttcagcctcaagcaatcttctttcttctgcctctggaagctctggaattacaggcatgagctgctgcacccagtccctattcatatacttgtaactttatctatctgtcttttcagctagtatttataatgattggtaatagatatatcaccactctattaaaaaaaatggtcatttgaaatctaagaatactttagaattaatctcaatttggcaagtgttaatgtgagtggtcttgttgttccttatactgctatacattttcattaaaaacaaacaatccaggaaaaaaaaaaaaa

SEQ ID NO: 4220 - DNA, 198 bp, Homo sapiens
cagaagaggaaattcaacacacagagatactaaggatgcacacagacagaggaaaaaatcacgtgaggatacagcaagaaggtggccatctgcgagtcatggcgacaagcctaagaagaagaaaaacctgaaggcaccttgagcctggacttctaacctccagagcgaaataaaattcccttgtttaaactacccaaa

SEQ ID NO: 4221 - DNA, 371 bp, Homo sapiens
agagatgtcatggctaccaagtactatgaaactggttcacggaactcttccatgaaagctatcctcactactttggaacaatggatccctgaagaaatgattgattccaggactgaagcacagggatagtacaacagtaccagaatgcaaggatggggacatgttagaagagcaacaaaagccggcttgaatggaatcctgttggtcaaatcaagggcaatttgagcttcaaaataaataaataatgattgttataatgggaaactatgagtccctactgttacaaaaatgtatgacaattttctcaaataaattttctagaatagaaaataaaaaatttcctaaataaatgaattcaagttcgatgaaaa

SEQ ID NO: 4222 - DNA, 1373 bp, Homo sapiens
tcaggacttagaactttggactgcctttgaatttaaacaagtgttgggagcttaaccaagcactggaaagtagagctaccacccctcaccgtaccgctcagaactggctaaccacaaagaagacgtttcctgctcaaatacctgatcaccacacctactcacccaatgctctggtacccagctttttcttttcctgtttacctcggtattaaagaaaagcctttctgcctgaactcggagatgcttgtagatattacagtcggagtgcactccctattgcaatacccgcttctattgcagcagtcttttcaaatacaatttcttcttccctaagtttggattttttttttttttcacctgaaaatcatcaccattttcattgattgccaagctttctctcatctctacattctacagtttttggttctgacagcctttttctgccatactaccccagttacaaatctaactacagaagcatctcaggggcaggatgattttgtcaccatgaaaaactgtgtaaattgacatgctagagacatggataaccctggaaaactaaagcagcgaatggttcaaaatttacagattcaactttctaaagcaatgattttttgactgacttttaaaaaattggctgcgtgtatatctcctaatgctttccctcccccttgccctcaccccacgacaggccccgatatggggatgtcccccttcctgtggccacgttatgcacatgtaccccagaacttaaagtttaatattaataaaaaaaatgggctgtgcttttacacagtctgaagacaatctgaaaattgaagttggcttgaaatttatattggattagctatgcttttctgctacaatcagccactagcctcaccaccaccatgaacgatgatgcatgttttcaattttacgcctctattccttgcctgagaatgtttccatataacttgttattgtttgacttggggacttaataatccaaaaggaacaagtagaagcaccatgttgtcatgaaaatatctctagggtaggagtcacgagacctgggctctaatattggcgtgccatttatttatggtgatccttggtggacacttaaactcttctgagcttccatttcgttagaataattaatcttactccatattttaaggacattacttgtttcacatatgtatcttatatcttcaatagactgagagttgcctcagagactctatagtaccctaactgcttaaaatagcaataaacatttaatttaatagttgttcaataaatacctatgagagtgtgacttgatgtgtatcactgtaagcaatactaaaataaattccacaaataattcaaaaaaaaaaaaaaaaaaa

SEQ ID NO: 4223 - DNA, 720 bp, Homo sapiens
tagctgaaacacaaccgcaaagaacacaggggcttggtttgcctcctttgtctgcaagtgatttacaggagaagattttaagctctgctgttggcctgaaagtttctctgcaatcttactccagatttccccaggactgctccttccctactttcaaaactgctgggttctgtacgtcaagggataatgctaggcagcatatttaacttcatgctttcacaatgagaatgtctgtgcctttgctgtcagcttcactgctgaaacactctgcaccacattactcacaaccctgtgctttatcaaagcagctcgacataacaatcctcactatatacaagttaatcccagtatggcccaaattatcaaggaagccctctataaaacagcaggattcatttcacaaacatctcctctgagaaatgttaattctctatttaaggtctatggtaataaactacaagaggattgagagtggttttggaaataacaaataacactgttagccttttcctatgactgcaacaccaggagtatgtaattaggttatttctaagaaaccagaggtgctcaggccattctgatgtgctttgagcatgaaatcttactaattttccaaggtaccaaaaatacttagcttatttccgcttcatgcaactgtaatttttaagatgacagattgtaataaaacactggctttcatgaatcaaaaaaaaaaaaaaa

SEQ ID NO: 4224 - DNA, 1100 bp, Homo sapiens
  misc_feature (1)...(1100): n = A,T,C or G
cagagattccgactcgcttcaatctcaaggggactctctgaagtttggacttctacttcccctcaaaggaaggcagtgtggacacctttttcctcttgtatttaagggtggcctgatataatgggagattaccaaatatctgagaaggataaactatatcagatgcttcctatgtaccacttcagaatcccttggcctcatctgtcttcaggggaatcagccacttgttccagttcctgttgcctctgtagacatcaactttaggtggacttttaaaacttcttacaggcaaaagtcaagccacaaagtcctagcttatgcccacactatcacttgctgcttcctgccccaaaactttcgtgttgacactaaagcatgaaacatcacaggccatgctcagtaccaacacatgccaattcaaaagtgcagaaaatttatggccactgagacaaatcttggaccggtgggagataggagccagtgcataaataatttttccttcattctccagatacactatcctaaaatagcttttatatggattatcacaataaaggcacatgaggatgaaataatttgtcatggtttagtgcccaagcaacgggcaatttcggggatgctttattggatcatctctcttttcttgcctcactattgctttacgttcactactgccccctggggtactgaagaaagagaacacaaacgtctgcctcagactgtgctttccagaaacccaggctaagacgagtaaagaatatattaacatactatgtcaaatggatacacaaaaaattttgagttaaaactacaggtgatgtcaacatggcagatcaaagaatagacaagaagaaagtgagaaggctgaggtttcatctggttcagatgggagatttggtattgataatcctcacaaaactggtagaaaaaaanctatgaatatgggtcttaataaannttatagtaaaccttaagaataattaaaaatnntatatacctacttccccagaagaaagntaatatctagccaantgtaaatgaggggaaatttaaaattacactgaaataaagtgtagtaaattttaaaaaaaaaaaaaaaa

SEQ ID NO: 4225 - DNA, 1307 bp, Homo sapiens
tagaagggtctgctgcccaaactgcagtgcagtagtatgatcacggttcacaacaggcttgaccccccacactgaattgatcctcccacttcagcctccagaatagctgggactacagatacagagggtttccactatgctgtccaggctggtcttgaacttctgggctcaagcaatcctctgagttgggctcccaaagtgctaggatcacagatccaggtgggattcctgagactacagcaccctggactttttcactctcatgtcagtccacactcagcctccagcaattcatcaaagttaccatttaagtgttcctaccaattttggctctatcaacttgtgctccagttcagatagttttcttgctcttatcagcattgataagatgaagtaaatcagatgtgagagaaagcacgggaacccatcatctgtgcctcagcgaccgattgttctcctctggctgtgctcatcttgccagtctgctggctcacaaaggccccagctttgatgacagtctgactgtttgacaaagccagttgcagatgctcttcatggagacagcagattacagacaataccatgctaaagaaatgctatcatctagccatgtatacactgaaagttatctcagtgtatacatgggatatgcttctttcaagaagacacagaaatgaggcaactgtggaatgaatgacaggcatctatttattccagttacaaattttccctgagaaagacgaaatttatcagcaccagcttaagtaacaattgtatattgatgtgaaagttctattgattcaattttttagatgtagctggagaggctaattatgcattgcagcagccaaatattcacttttcccccagaacactttcagcttttgaaagtgagcagcaataatataatcacgctgttaactttcaaggatgcgatacaaatctcaaaaacacactttgatcttgttatccctgtgacttaggaagagattctgatttcacttttgtgaatacctatggccattagattccattttaacaaatttagctaaaagtaatctttactactagatacatatggtttcaggttaccatgaggtacaaacttcttctctttacaatttgaaattatactatcagaattcagcaaatgactttgttgatgtcagaagaatacactttgagttttatcctcatgtttctatcgggacactgcacactggtcaagtctctctgtctcagcagccctggaaacatcaaataaaatgacatctctgtccagtcacattttaaaaaaaaaaaaaaaa

SEQ ID NO: 4226 - DNA, 922 bp, Homo sapiens
gagagctttctagaacagtgagcctagaggcgccctctaatttacccgagggtttataaggtacaaggataaaatttaagaagagaggactacagatcactttaacgccaaagggaattgtagtgaagcatggatgttttcccattaaggacccatgactctacacttcaatatttctgcagggctcacagttcactgagagggtcccggagagcaaagcacccggcctcccatccgcccagtgtcttgcagcgtcatcttcatttccaccaaaaggtcacggatacattgctgctttcgcacccagcacgttttagacagatgcctgcaccaagctcgtttctcagtatccagtgcgtggaaagaggatggtcacacctgccctttacgtcacgaagaagaggttatgaggcttcacataatctataaatatacgtggttactattgatgtgtaaagcttatcaactctgagagagcgaatttgtagagccctaattctgcagcgaaggcaagtctgtgattttgaaaatggggaagattggaatctgccctcttcagacttaaaacaggggatcttaatcaggctcctctttcctggtggatgaaggtggggaaaggcacgattctatagaccaagcctggctggatctgtcgtctttcattcaggcttcaaagtactggtcatgccaagtttcatgtggaaggacggtagagcctgataaacctgcccttggccgtcctcggagagattgactaggcctgtggtcaacgctttaagtatcttgttctgcactgatctcatcctttggtctaacctagagatctacaactcaacaaatgtcatcatcggtgttccccggatgagaaaaatcagtggcttacatgttcatagctacttgaacaggaaaaaaaaaaaaaaaa

SEQ ID NO: 4227 - DNA, 788 bp, Homo sapiens
agcgaagtctgagacctcagggaggtaccttcatgacccattattggccactgcaagtcttgaagacggacatacccttacaaaaggcataagggtattgcatggatcttcctactgggctgtaggctgtgctccaatttactagtaaatggaactctgggtagtagggtcctcttctctttgcaccatcctgagtccatgggcttgacctctacccctccatctcctgcctgtgtaagatccaaaagtccagcctaattctcctttcctacatccacagcaaatgctcctgccttagattattttaggactgtgattcctctcctggagcatgatgccaatcagacttgtgtaattatttagtatatgatttgctcttttattggattagaggcttctttagggcagggattatattggactaatttctctttcatgtgaagaaccaagcataggacctagctcatgcttagtactcagtggctaggtactaaatggttataactattaacttaattgttataatagttaattgttgtaatagttaagactgtaactaccaatgaccacatgctcatgatctgccttgtaccatgctaagtgctttacataacatcatctggccgccttacatcagttctgtaaggaaagcattaccatccctcttaagaggaaaactggaagcttaaagaaattattgacgtggtcaaggcccgagagcaaggaataggtcaagttggcattttaattccgtctccattcaattgaagagattggtgggtgacccg

SEQ ID NO: 4228 - DNA, 1255 bp, Homo sapiens
  misc_feature (1)...(1255): n = A,T,C or G
cctgggttctcaggatgtctttggaggccattcttcagatgaccacactagtcaagatgggtaaacatctctgttgtcccaggacatcccattctgctccaactgcatcaggatacagccagcaactcctgcagacactgaggctctggttcctgtcaagacagtgtctgttcttaaacttcctatcaagagaatcatgcaatacttactcttatgcctgggttttttttcccgaccatatttttcagattgtgttgttgtgtgcaattcctttatattgctcagtagtattctgctgtatgtatgattgtatcatctttttaaaatctgttttcagattgatgggtacttggattggttaagtctttggcaattatgagtaaagctactacaaacattcttgtacaagtatttttgtggatggttatttttatacttttggggtagatatcagtgcagtaaaagagtcatagagtaggtgtatttttaccttaatgagaaaatgcccgtttccaaagtgcttgcaagttctatggcccttcctgagcatctgtgagtgtttaaggtgctttgcaaccacctcgacaatcaggtgtggtgaaattttttatctgagcaaatggtatccactatgcaaagtgcaatcagctgacattaattacattaccctcatatctaatatgtttgatattttaatgttcttattgaacacaaatatattctttagtggaatatatgtataagtcaatgagtcatttgtatttatttatttttgtttgttggagctctatatgttctttacagaaatgttttgcatgatatgtgtattatgaatattttctctaagcctgttttgcttttgtgttgtcttaatgatctgttttaaatagaagaatttttaactttgatacagcttaatttttcaatttgttccttaggtaaatgcctcatttcgttctctgtaagaatcttttgcctactccaaggttgccagaatattctcctatgttttcttttagaagcttaatagtgatagcttatattttgtattaatctatgaaccataatttacatgtgtaatgagaagtagggatacaggttgctttttctccacgttctctttcagttactccagcaccgtctaaaagaaaatatacctttctccatttaacttctctagatcttttgtcagagttaaatttacctcnccatgtgggtgtctaaaaaaaaagaaaaatggcctcgtggccacagc

SEQ ID NO: 4229 - DNA, 561 bp, Homo sapiens
cttgtaaaatcgctgagagcattctgtttttaatgtgtcctgttctcaaggaaaactattttatcagagcctaactgacagtttttgccagtgcttcaccaacctaagggacaagaaatactcaactccagcccctgctggccttcttatctcacctaagggtgaacaaaataggtggcaaaaaaaaaaaatctactttcataatgtataaagatcagtatagaatcatggatttaaccacacttggaaagcaaataaaactaaaagtagtcacattattacatgttatcatcattaatattattatggaatttaggtgttgatatggtttggctgtgtccccacccaaatctcgccttgaattgtaataattcccacatgtcaagatctgatggatttataaatgggagttcctctgcatgagctctcttccctgctgtcatgtaagatgtgcctttgcttctgctttaccttccaccatgattgtgaagcctccccagccatgtggaactgtgagtccattaaacttctttccctaaattaaaaaaaaaaaaaaaaaaa

SEQ ID NO: 4230 - DNA, 1179 bp, Homo sapiens
ctaggtgggtcttggcagctggtgagcaggcgtgcatggaccacagacctttaggagattatctgctaatcatggcctggacatgagcactcaagaggtgttgcctgaagaatgagatgcttttttatgatgcagtaaaagagaggaaatcgccttggcctcttgccttgtcctgtgctaaatgggggcaccaggtaccagaaatattaagatgctcaaggtcatacatacaactggtaagtagcagagtcaggaatcaacttcaggctggtttatgcttttagccaccgcacatctgcctctcatcatttatcattgtaaaggtaggtatcttggttctccctccttccaacaccatgcttcctcttaacacatgtaggaagacccttttgcctttatttcactctctcccaggctccttcccatgggagggatggcttattggtgggtgccatggcaagaatgtgaaattcattggtccatccccttacaatagatggaggtgatgggtggcttccctcggtgctgttgagtctctgcaattgtcaggctgagaagctctgtgatcctccattcaagtggctccatgaggatctgtcctgcagacccaagccctccttcaatcaggccccatctagactagaaaggcaggttttgactctcattctggtgctagttgtgttcaccctccttcttagctgataggacccccaatattgcatctcaaatcctaggtctatttctcagaatctggatgggaaaagcagaaaccagttagctctgcaatgcaccaacaacttccatctcaagagttcaagccccattcctgggcgactccatgaagtctgtccttccgacaggttcccatgccctagtattccccaaaggccaagagaaatgtttttaccaatgtgtcccgcatgatccctgctcagccagccccttgctcagggcactgtccactcccgggttcagtccagctgtttcttaactccagcctaacactatacagatgcattctctccagagccccttgcccccaagtctagactttagttctgacttaattcttcaacacttagtaagaacaggcagaactaaatgtttagcagaatcttggtgaggaattgagaataatcagaaaacaaaacatggataaaggaaaaaaaaaaaaaaaaa

SEQ ID NO: 4231 - DNA, 1186 bp, Homo sapiens
ggccccttagcctggtgaaagaggacataaagtcagtagtgtttgcattactcaaaattttgtttttaaaaggagctagtcaacaaatgccccatggacctccaccagcctctccatttcagatatcaaaaaggacagcagtgtgctccaccaggattttttgcaagcaacactggtggccctgatgctctgaaacaacttcccgacatctacctcatgatgagtgcctgaaaaacaaaagcctgcagtgggaaccaggatccaaattttcttccaggagaaaactctccaactcctgggccactggaagcctagccacacttggggagcactaatgttgttctgaggaatgtggacatttacatatcccttctggggtttaaataccatgatgtagaagggtgggaaaatgcctgcaagggaacagagaggcattggcaaaggtgccccttccctgagcccacggtggcacacttcattagttgttaaagactaaaactacctttctcattgttaaaaatgatgcatgtgcatatgtggtttgtttttatgtgaattgcatctatgtatttttgagtatttgcatgtctatcgcttgtatagttggctgggtcttgtattgcaagactcattatcagctcaagagaactaataattcaattttaaggaatttttacaagctttttgatcagtagttgcgaatcagccatcttagggacatttacatgatggaaaagaccaaattctatgaatcaccaaacactaaagataaggttgttttgtcttcttggagagtccccatttattaattttgctcattattttacagatgaagaaattgggttctaaaagttatattgacatccttacagtcacatacatagataagggcacagaagctaaccatttaatactatccctaaacctgggtcagaggtttcaacggggacaactgagttagatcatctatgaaattctaagtcattgactcttttgttccctcaatgtcagttcataccagtaacaatgagcccttctgataacatgttgcagtaaaaggacccagggctccttgcggccatggttaattctagaactgagacaagtaatgtagaaattgggcctgaagtagtaccagaaaataaggactaacgaaacaaaaagccaaaaaaaaaaaaaaaaaaaa

SEQ ID NO: 4232 - DNA, 892 bp, Homo sapiens
cctagagcattctaggaacagtgcatccatcactgccatccgaccacccccagaggacacctcgcccctctgcagtccctgctgccagctccctggccccgaagatgctgcctttgctggatgtctcggaatggagcccggccttttgcatccagcttctcccttgcagtgggatgtttagtcctgtgcctgtgtcagttctgtcttccttctcaccacagaacagcattcccacatggttttccaaaacctgtgctttgtggacctagagctccgaagcttgagttctagaatgttctcagcaggcctctatctatctcatgatagaggatggaaaccagccgtccagaagaagagagagttgggccgaggaggactccagggctcagccatgaggagatctgggcggtggtctcctcttcctcgcggcctctgcccatccactgcccggccctgacatcacgaacgtggcaggccagcctcttccatcacgaacaggccagtcgagaagacaagacattcagaggtggggtcagtgttggggcccggtcacgcctctgccttctcagggtgcaaagttgtcttcttgatgagctgaggacaaaggttctggtgtcccctcagtgccctggcgggaggtactcatggcaaccacccttgccttggagcctcagcacgttttcaggaaaaagccgcgctctcccaggaatacaacgggggcttcccaagcccagctctccctggcactcggatggacggcggccttcactggaggactgaacctcaacggtgtggccctgagactctgggtgggaaggaaggagctggggccagggacatcctgctttgacaagaatccatttattgtgttatcaatacaaattgggaggtt

SEQ ID NO: 4233 - DNA, 665 bp, Homo sapiens
agtccaaattgtttacctgagcacctggccatccagaataaatgctaaattttccagtcttctttgtggacttgcggctaagttctggcaaactgaagagtgcaatttctgcattgtatctgtaaagggaatacacaggctttgccatttctccatttctccatttcatttgacagaatactgacaggattgtgaactaaccaggaaatatggaagagagtaatacttccaagacagtggagcaagataaaagaacattggatgtcgacaccacgctgcaaaccatcttgactgactttgtaaaagagaggtccaccagtctggactgacaaggaaaagaaaagagaaacatatctattcttgtttgaaccacacagccatttggggtttttttgggcatgcaatctaactatattctaactgatacagtgactaaaaatgatgttcaacgacatgacaaagtttcagtatattttagattcaaatggcagatcacaagccatttgtatagggcaatcattgttaaaaatggacacctgtctcttcctctatctccccctacctccttcctgcctctgtgggtggatatattgggcatgtagaaaaatgccaggaaagaagttatataaaatggtaaaaatttggatttgtgaaaaaaaaaaaaa

SEQ ID NO: 4234 - DNA, 616 bp, Homo sapiens
  misc_feature (1)...(616): n = A,T,C or G
agaaacaggctctactatgttgctcagacttggtttcgaactcctgacctcaatgatccccccacctcaactgctgagtagctgggattacaggcatgaaccaccaagcccaacaagaatattttaatatgtttaacggaattcagaactctttaactgtgataaaaaactatgcttttctttgactctaaatatgttacttgaaatatcattaacgtgaagttgtttttatgattgtactgagtatttatcacaagccatttatatcgtcaactcagctcttagatcgcaaatttacaggatggctagaagacctgcacgaaatgtctgtggacagacaaggagtttgccagtcttcataggtatgggacctatgaatttggattatgtagcattttgctgcaacccgatgattatcaaaattttttctggttgtgagtttccgagagttttatgcaagactctgcttaataattgtagctccatcctctctctctctctcaagagaatacattgaaatacacaagtgtgggattaagcttatttttatggataagactaattgttctctagcttaattaaaatgaaatatantatntnannaaaaaaaaaaaaa

SEQ ID NO: 4235 - DNA, 844 bp, Homo sapiens
tagagagacttacttgaaggtcgatgttttctcttgctgattccatctcgctgccctcaagtcccttcacacgcaccgggtgccgggaacagactgcgtgggctcctccaggctccgccgtctgagtctctgctgctttcttcgggtgggagagagcacacagctggcgggacagacctgccattcatccctctgatgtgggatgcccgtcttggctgcagcctctgggggaggtgtgcacctgcacacacgtgtgagtgtatgtgtgtgcacatgtgtgtgctccaggaggtggcacatggcacgctgataggtgaccttttgagttggtagtgacagcatcattttcaccagtggctccagtgaccttccagtcccagcggagccatctgaggtcacccagcctgctttgagctagtagctttatgactggcaaagaaatcctgcatgtttatcaagcaaattgaaaaacagcctgaggacaacgctatctgacttcaccgctgggtccagtccccagtcgccacgggtggagtgacctccagcacagtctcaatactgaggcagagggatttccgttgttctttgctttgttccctatatccctaaaagttttaaaaaaaattgtagtttacctaataggctccaaagcataggctttgttctgcaaagtgagtgaacaatacgtttttactgacggattgtttgattccttcaactcctcccttgattagccatagagggagcagggagtagttgtaccttcgaagcttgtttatgcaaacagtggtattctccctacttttaaaataaaattaccaggagggaaaaaaaaaaaaaaaaa

SEQ ID NO: 4236 - DNA, 348 bp, Homo sapiens
tttgctgttctaaaagtttttcaaaagaatgcatggttcttataaaattaggatattttgaccctaaaaactgagatgaaatatagattaaagtaacacctaggacattagtacatatttttaaaatgctgaatgaataaataaacagagcaatgacattcaaagctgtcaacttttatatgagcacttgttccaggaaaataagggttcttatatttctttattgaacaagaaaagaaaaaagaacaagaaacatcttcttttggaagacggtccctttgggagactgatgaatcctctggagcccttctcagaatagtgtttttaaaggcatagaacaaaacaggg

SEQ ID NO: 4237 - DNA, 911 bp, Homo sapiens
  misc_feature (1)...(911): n = A,T,C or G
tgctaccttaagaatcaggattggagtccggagtgctggctccagagcctgtacttcccacatgggatgcatgctacatcgtgtcccaaaggtccaggctgtaggagatggagacacttgggttccagctttgctttcagctgtgggatcctgggaaagtcgcttggcttctctgtgcctcgatttcctcatctgcagaagggggatcctaacagccaccacctcatagtgttgcacagtgacttcatgagcgaatgaagcagaggcagattacctgaacaggggacagttcctgggcttgctggcagagtctctcctcttctctgcctaagggctccggcccacctcatggcagcctgcactgccttcctgtctctctttgggatggttcaaagggtgcattctatgcagctccccagtggaaatccaaggggactgaactgggggggttgaagtgcttgctggttttcttccttactctggtccctctctccctctncatacttctgcttctgaggatcatgatcaattccaaaataaaccacttacatctatgtccctgtttcaagctttgctttgaagctttgttttggaaaacccacatcaagaaaatgacatatataaactatttagcccactgcctggcaggctgtataagaagaagaaaaataagaacactagcagcaggctcagtgcagtggctcacacctgtaatcccagcactttgggaggccgaggtgggaggatcacttgagctcaggagttcaagaccagctgagcaacatagcccaaaatacaaaaattagccgggcatggtggcacatgcctgtagtcccagctatttgggagtctgaggtgggaggacctcttgagcccgggaggtcaagactctccagcctggatgacacagt

SEQ ID NO: 4238 - DNA, 642 bp, Homo sapiens
agtcggggtgtcatcatgttgcccagggttggtctcaaatccccaggctcaacctatctacccgcctgggcctctcaaagtgctgggagtgcagactagttgtgctacaggactggaaagaagtcaggtggtagcagagatttcaactagaagtgactgcagcgatccacatggaaggtgaccggaaagaaggtgaggggtgatgagaagacacttcacttggagacaagtatgtgttagagaactcaaggtgaggccttctgtcactgaaattcaaagctcaaatggatttgagagacaatttaagctaaaatttccagcccagggcactaatttgggaatgagggctctaacttctttggaaactttttggggatccctcccctactgcgactaggaagacttcaatctcagaaagaccagaaccagaattcttatggaccctaagctgcaaatggaactagaggtcacttctgtgtccagtgctttatttccaggaaccatcatcaagaacagttcctaaaatatgattggctcatttgttctcactaacatcttgggatttcatgatcatgaaaaaaaatcatttcatgattttttaaaaatccaagtggatgatctactcttcagcatgaatgcaat

SEQ ID NO: 4239 - DNA, 456 bp, Homo sapiens
tgagggcccttgtgtgctgagacttcttctcacatgagccactagcttagatcctgaacctatttccagagtgctcattacaggtgctttggaaggaggtccgagctttggaataggagactgaagttctggcttgaattttggctttgccccgagtagctgtgtgacactgcacaggttaattaacttctctgagtttccattcctgcatctgtaaaacaggaatcacaaacaggatgccaacagagggatgagctcaggcctcagagtcggacaaagctgcattcagatgccagctctgcagattgctagcttcggaatcccaccagagcctccgtggatgggagagccgatatctgccttctggagttcttgtagaaagtaaaagagatgatgtatgtaccatgcctggcacatggttaggcactgaggaaatgtttttgaagactacaaaat

SEQ ID NO: 4240 - DNA, 629 bp, Homo sapiens
caccacctcttatatggaaggcatacatgagaaccaaaataaaaactacaatccctcactcaagaagtttaaaatgaagtgaatggacaattgtgagaagaaatgctattgatcttccaaagttgtatgttcgatagtgaatattgtatgtttaaagtaaccttgcaaaatgtgtcatgtcaaatgtaataaattgtatgttctgacgaaggaatggaatgccagatctaaggaactgaaatttatctgggcactggacagtcgttttatatttttgaggagaaaagccattttagtattccttgaatatgtgtagtttcttaaatacaatatatatgtagcatgtaagtactgaatttagaatggaaaaatacctttacaattgccttgttctatcctcttgttagacaaggaggacatgcaagctcagataagtgaaaattacttgcctggatctgatagggcctgaattctacattttctaaatttaaactccctggtagattgtcattgaactgaatgtctattaactcccaaatcagtacttcgtcagatctttgtgacccaatattgattcattatcttatttgccaaataaataacagtttaagcacaaaaaaaaaaaaaaa

SEQ ID NO: 4241 - DNA, 733 bp, Homo sapiens
gtagtttcctcccacctcaatactaatttcaacaaatcttggaaggagatgagttacctgcacatattttctcagttgaaccagaagtccttatgtatttttcaagtctagactgtggtttttaaacttttccaactgtgagttaccatgggaaagctgatgtttgcgtaaagccgccaactccacctggcacctgaccctggaggggtgttgtggtgaaactcaatcacgccacctttgtctacctgactcatgcattttgtgtaatagagaagaaatgacaagttgtaaactctttcagtgaagataagcctatctgggacccatttttttcatctgaatttaaaccaagagaaagaggaatccaatggttcactttgagaaaactggaaatcctgaggcagtaagataaaagtatgaatctgccacagtaagtggctgagtgagaagccaagaggaagctgtacttgggtgtaactggatcagattttctggaattcaagggagaagccgagatacttccctcacagaaattgttcttcaacaatagaaaaagcataacagacattatgagagagaacttcatgataaaataagctattaatttgactaactcagaaatccatagcatttttcagaaattatagttatatttaaattctgtacgtcccttgaagaatattgaccatgcaaagatcagaataaactatgttcatccaaaaaaaaaaaaaaa

SEQ ID NO: 4242 - DNA, 940 bp, Homo sapiens
cagaattttgatctccaaatgcaagaagggttgtgctggcttcacaattaatgacctaattttgccgcactgcatgatgctccccaacgttgatctgactcggaggcaagtctgttcaacatgatgtcagcaagaattattttgacagctgccagcgcagtaacacagactcaaaaagttttcattttagtatgtggtgttccagaatattggtgtgatgtatacatgccaacggacaatcagacagtagcataacgttcaagagaactcacaaggaaaagtgatcacaacaattaaacaaagcatcagttttctcagtgaacaataggagataaacccaagcacacaaaaatatcccctcgaatttcaaatgggaataaaagaatcaaaggcgtattcttcctcttgatggtctccggtattgcattacagtcagaagagtgattctagaccacatgaaatgctttccctgatccatggagtattggctgttgacaggtcctacttagtcagaggagagcgcctctgtggatgggctacagttttcattcacaagactgatggtctagcgtcagattccatgataaacttcgcttgaagcacggtcttggtgttttctaacagccggtattagataaacattcggtatctgcatttcagagtggtaacgcaaggataaatcaaatagcaaattaaatttaggtatgccatctgctgcctttattttatgaattccagcccataggacaatgactgggcatgaatgtctaagccattgtcttttatggtcagatttactacaaacattggacaaatgttcatccaagctgttggtcttcttggaaagagtaaaattcagcaaaagtgaatttttttttagttgttgtaagttttttgttttaataaaaataaaccacaacagaagaaaaaaaaaaaaaaa

SEQ ID NO: 4243 - DNA, 628 bp, Homo sapiens
cctagggcacctggttttgtgtagatacaactcagggaatatctccacactgcatccgccatgatcacctgtgagcacctcctcctgaaacccgtcttcacgtcaccttttaccaggccgaccctacctttctccatctgctaagaagtgcagctctaccactggaagcatccacttcggtctcactcccatccctagtgctaaatgactctctaagagagaatgtcagcacagttttgacagaagcactctaaaactcctggatattccagaaaaattaactctgggcaaaagaacattggcatcaaagtaaagctcaatttatacaccatagcaatttttgatagctataaacctgacacgcaaatagaatattttatggcataacactacgtttacattaaagtgctttttaatagaatatgtaatttagaaatataaaagtgcatcttaattgcccacaaatgagactttaaagtacttagaagtatcaagaatataaaatccaagtaattagatgaactatgctgtgaaaactaacacttaattcaaatgtcaataattaaataaagaataacggtagcattaaaacaaaactctgtaaactgtgaaaaaaaaaaaaaaaaaa

SEQ ID NO: 4244 - DNA, 921 bp, Homo sapiens
actaggtccagccttttctgaaggatgaggttctgatacctttgtcttaccgaatggaggatgtcgctccctgcaggatatcttacagaccagcagcaagaaaattaactgcagcagtggaaaaaatatgactgtagatgggacttcaaagcagcttaatttccaacaaattagccattagtaaaagactatgctctcattaggagaccaaaggctaactcagaattactagtcagccatgattttatcttcttctgaccaattttaatcacttctatcagtggtaatagctgtacccacaaatgaggtggataattaaaattatagtatgtaccattatctgaggattattatgtactaggcatcttgctaagtactttatgtgcattgctaaatttctgttacaagatggttagttggtattaacaatcccactttatagatgcaaaagctgtattaaaatgttgcacaacttacttgagctcactcattttataagggaaaagctgagatttgaatccagctctctggacaccacattctgtcctctttacctttgtgctatactctgtaccttaaattcagatgagttgttcatcttgattacatttttaatatttaatacgtacaaaagaatatctttcatgcaatttagcagtttaagatatatatgactaaatttatatctttaagtctttatacttcatgactttttgctttttgtaatccaacttttctgcaaacattgtaacagagtaatgaaatctcagataattagctgtgttagcatcctggaaaatacagctgaacgtcatggttttggtggaaaaaaaaaagagctaggcataaagttctgctagagagttcaatgatgcttgaaaaataaagaatagtaccattagaaaaacaaaaaaaaaaaaa

SEQ ID NO: 4245 - DNA, 345 bp, Homo sapiens
tatttttctcgcctttcatcttgtttaaactccaactcacaaacctcttgcagaatgaaaaacattttaaagctacataaaggcactggagatcgacttaaaaaagacggaaaatggggaaggagtggcctgatcttgaaagaagagaaccacactgggaagaaaaggagctctcttgaaaaaagaaatgtcttggtatttacccatctggatgctgcttgaaaataaattgtcctccaaagaacagaaatacagtatgttttctctcagttcactggcttatgaatgactttttgttgttgttgttgtttgttaatacacactataatgtcaaaaaaaaaaaaa

SEQ ID NO: 4246 - DNA, 827 bp, Homo sapiens
actaggtgtttatggctataagtttccctctgagcactgctctgaagttttggaatgttgtgcttttgtcttcattcatctcaaggcaatagttattttgcattgctaccaattaccaacaacttacggaggtatgaaatggatcaaaggctacaatcagataccttggaagggtatgctctacacaatgcatagttttccactggaaatattcagtaatgttttctgctaattccaaatttcctcctactatgacatggaaaataaaaagagaaaaactaacaggtgcggatgagaacagaactcataggatgcaactccaccgctaataacactgcacactaagatgacgaaagatttatgtacccacatgtgccccatgattaaagcacccactgaatctcacaggaactacgcaagcaggaccaccaaccgaacacgctaatacctatccacaacacctaatctagtcactgaaatcccactttcactactcatcaccgtaccggccgcctttccatgcatattcgaactttcatcccttgattctttattttataccaaaccttcccatttacacctcttatcattatcctccaatgactaagatattatacccactcaacgctacgcaatccgattctccgcaaatcaacctacatcaacaaaactatgcgaaaattaaccacaatgaaaactcactaattcaccgcactacaccctattccctactaacttattcatttcacatacaatcacatactattcaccaacatccttcgcaaacaccatacctccgtttccctctcttactcatacttacactg

SEQ ID NO: 4247 - DNA, 264 bp, Homo sapiens
ctagggaactactgtactgaagatttgggggcaaaagaggaccacatctgcaactaactggagatggttcataagatgatgcacacacactcaagcatatcgagagagaaaggggcagaggacacagaaggccctgagtttaatgtacatgttttgggggattaggaagaagagcccctgataattcatccttcattattctcgcaacttttctctaaatctgaaattatattaaaatataaagttagaagaaaaaaaaaaaaa

SEQ ID NO: 4248 - DNA, 375 bp, Homo sapiens
gctcttgtcgccaggctggagtgcagtggcatgacctcggctcactgcaacctccttctcccggattcaagcgattctcctgcctcagcctcccaagtagctgggattacaggaactatgtactgaagatttgggggcaaaagaggaccacatctgcaactaactggagatggttcagaagatgatgcacacacactcaagcatatcgagagagaaaggggcagaggacacagaaggccctgagtttaatgtgcatgttttggggaatttggaagaagagcccctgataattcatccttcattattcttgcaacttttctctaaatctgaaattatattaaaatataaagttagaagaaaacatgaagagtaaaa

SEQ ID NO: 4249 - DNA, 891 bp, Homo sapiens
attgcagcagagtacaagaagtttgaaactagcacaagttggttcatgatgtttaaggaaagaagccatctccacaacttaaaaggtgaatcagcaagtgctgatgaagaagctgcaacaaattatccagatctagctaagaacattggtgaaggtggctatactaaacaacagattttcaatgcagacataatagcattctatcggaagaagatgccatgtagtactttcatagctagaaaggaaaagtctattcctgtcttcactgtacgtgtatacctaacaaaggctacctacagctggatgatcaaggttactgttgacagtgattagtcacattgatactatgtaccctcgatattatgtaatgagaaaggcacttgacctctgttggcttcttctagaacaaattatcccagtgcaatcatgagacaagcatcagaaaaatctaagagacattcggcaaaatatctggccagtacttctcaaaactgtcaagatcatgaaaagcaaggaaaatctgagcaactcatagccaaaatgctcttaaggagacatgactactagatgtaatgtgtcctactagatgagatccaggaacagaaaaaagacattaggtaaaaactaaggaatctgaatacttcatgagcttcagttaataataatataatgttattggtttattaattataaacatttactatttaaagtaaggtactaatattaggtttgggtctctttgtactgtcttcacaacattattgtaaatctaaaagttttctaaaatagaaagtttattaaacatccttttagtcatgtgtagtaatgcaatctgaaattgatcaccctttctataaaaatagtctgacatttcaaaaaaaaaaaaaaaaa

SEQ ID NO: 4250 - DNA, 883 bp, Homo sapiens
ctaggtggtcggaagatgctaacaccttggctaactacctaacccataactgcatgtggacagataaagcaaattattgcctatttcaagtattaatatgcgacagtttccatagacacctgattatccctatgccataatacatgcttcagaggttatttgaacaccatcatctacatagcgaattcttagtttctaattcaatttttataattctgaagtcatttcttattcattgatatatattttatgcactcatctactgaaatttaaaaaatattgaatttatattttatcttgatgtggaactgagcttttcacatttattcaagaagatcatattttaatatcaattggaggagctaatttggaagttgaaagataattaaatttcaaataagaagccctttgcttgcagcattctcaggagattatatatcctcctcaaatatgatatttaaaaaattttaaaaataatttacatttgtagtgtgtttacagttaaaaattacctttacatggagctcattttatatcaaaacaaccttggtaggaattattaaaatggttttacaagtgaggaggctgaagctcagagattaccttgctcaaggccaacctgtcccatcgcgcaggacatcaaccctgtattctgcttctgctgcatctcagctatcaagaaaacatgaccataacaggccagtgctccgaaacagaaattgatcagaggctggaagtctccacccctttactactatatctcctcacattgcctggagaaactgcccgggtcgggtgtgagcgcatggtgtttgcaacctcctcctcagagcctttaataaatggaattgtcacttttcacaccagcaaaaaaaaaaaaaaa

SEQ ID NO: 4251 - DNA, 660 bp, Homo sapiens
ctcaggagaagcgagggagacactgtcggtgagattgaatggcactgccaccaccagaggaataactggaaaaggaagcaggagggcacttgggtacaagggaaatgataagaaaagtataaagccacaggagcagaatgttacctcctttctgtcctcctctttgttcttatggcccagttgtcttcctcttgaccccgtctttgcattgcatgggaaatagtacaactttgagtcatccccacctgggctaagatgtgatagctgacattgactagaagtacaaccttgactatattatgtaatatctctgagcccatgaataatgggtatggttgtccctggagtctgggataactaggacaatgccaggcatgtaggttccagccatatagaccattgaatctgatgaaagatatacccctactgaaatgcactgaatatttttgaacacctaccatttctaagaggatatgatttgaaagccagtataggaagatttgatgcaaatctgattgttgcatggggccttggagaatatcctggaaaagcatatacctttgatcctgggttatgatttcaattagatttttcctactatgtcaaatggtgatataaagtcaaataaaacattataacatgaaaaaaaaaaaaaaaaaa

SEQ ID NO: 4252 - DNA, 432 bp, Homo sapiens
ctttactagtagaattgtaccattttgcatactatcctacaccatgtgtcaaaagaggcgaagaaaatgccacggcttgtattacctgacaaggccactgttttgaagctcaacggcgttgctaccaacagggacttttcctataatgtaacggaatgaatcaatagatttgtttgcgtcatttgtcaaaacttcaggtctaaataataatattccataatataataaagacagcatgccaataagaagtaaacatggggatttataatatttaaaaattacataaatagttttgacaggaattaatgttttaaaaccacagactggttgtgtatccatgtatatgtaaacccacagaagggaatgctttgcaaagcactgcataaaataataaaattattgattaaatgaaaaaactcaaaaaaaaaaaaa

SEQ ID NO: 4253 - DNA, 779 bp, Homo sapiens
ggccgaccaccaaacataccaccacccagcaaaaaaaaacaaagaaaagaccttagctgcttacacctgaaagatatgaagacatcatccctcctgtggagatctactctctgctggcactctgcgcatgcgccagcagagcctttgggacttgttcaaaagctttcattaaacttaaatctttagagacccttagctcagaacaaaaacaaccagtatgaagaccttgctttagaaattttcaccaaacacacttcaaaagataacagaaaacctgaattggcaagccttatggaaggtggagaagggaaactgccaacatgcgttgccacaggaagcccaatcactgagtatcaattctggatgtgcagtgtacgcaaacacggtgtccttgctcaggaaataagccactacagcttctgccccttatgccatagtccagtgggataaaggaatgataaactgtatataactgtaaaatatatgtagcatatatacatggctatatgctgtatatgtaataaggtttatttctgtgagttttgtatgaaaatcagcctcattatttatagttgaatttttgcacaaaatatatgctaataaaataatttttatggcaatacaactgtgaaataataaggccgattttcatataaatgtatgaaaatcaaccatgttttctctcaccctctctcttttgtttatcttgtttttggttacatgataccatggaaatattccaaataaattttttttctcacagaaaaaaaaaaaaaaaa

SEQ ID NO: 4254 - DNA, 777 bp, Homo sapiens
tgctgcgaattacactgttttctgcttttctggattttcccaaagatccgctaaatcctaaacttcatcttggtctgaagaagggcaagtcctctctccagctcttcatttgctgactctcactgatgcaagaagaatgaagtctcttacctgccttctcctaggacatcctgggagaaactgtgactgctggtgtgttctcaaaactcaccaacatgattctccttgtggttatatgactctagaaagggaatttaaataaaatgataacaattaacagatacttttatgtaaacaaccggtagtgaccactatactagttggtttgtatttaccaaattccatgtctgaggccaagaatttatctctaaatcctctgggataaaaatccagcgtctcatcttttcttctgccacctggcaaaacattgcaggaaggtacttgatactttccgttgctgccccctcctccccttcaatctctggctttgacaagcctggaatgaaaatcatctcgacgccggggcttatcgctaaccgagaatgcgtgggtacgcaaaaagcactggccctgcgtacctacgggatacagttactgtgaggaggcgccatcgagctacggccataaccccacctctctcacgaccagcccatcaagctcccatcgcgagacgtcggtgctccgtatcacctaagggggcacacaaactccaccagacgcacgtccaaccacctcccccaataccctaaatacctccgaccccacaccgcactccaa

SEQ ID NO: 4255 - DNA, 359 bp, Homo sapiens
gatgttgatgcctccaggaggaacctgacctgggataagagcaaggagcttgtctgcagaggacagcatgggaaggccatcgaggaactgactcgcctcactctcgccaaccagtgtcggctctcttccccatctgcatgtgctcaggtacaaaaagattagccgggcatggtggcaggtgcctgtagtcccagctactcgggaggctgaggcaggagaatggtgtgaacctgggaggcggagctggcagcgagctgagatcgcgccactgcactccagcctgggcgacaaagcaagactccgtctcaaaaaaaaaaataaaataaaaataaataataataataataaaaaaaaaaaaa

SEQ ID NO: 4256 - DNA, 407 bp, Homo sapiens
actagctttatatctgtttttttcttatgaagcttcttctggttggaaacttgtcaaatttcatcagctttatgaaaacccaaccacagcaaccatacaggctggcacaaggtttgctctaaagaggaagagatctaggtggggctgaagacgtatcacttccctttggagagtgccctgccacaggcaaggacaatctttcatctctcatagaggaaaacataagggaggaggcgccttccagtaaatatcctcagttgagttttcatattatatataatatattcaaggagacaaccacccaatttccctccctggattccaagccttgagatataactaatatttaggttttgcgttgcagagtgccctgataataaagaacaaattctataaaaaaaaaaaaa

SEQ ID NO: 4257 - DNA, 432 bp, Homo sapiens
cactaggctgagaagctggattctctttgactacaggctgaattcttgatggagaacagttttgagacttgactgtagaaaaagcaataaccagttgtccaagtatgatttggaactaaacttgaagaggataagcacaggagctgctgtggagagtttgggagcccaaacagtcaagtggctttgcagcaccgctcgagaggcaatgaggttgatcgaagacggcaggtggtaactccgagcctttgagcagggagccctagagacttgtgggaggagggaaaggaggctggagaaaataaaagctctcagccgcacttctctgtaaaggacatctttcattgctgatcctaacactgtcctctctctctctctctctctccctctcatctcaatgcctctaataaactcacttatttaaaaaaaaaaaaa

SEQ ID NO: 4258 - DNA, 545 bp, Homo sapiens
cagttttgttcctacaacaaaggaaatcatagcactcaagttcaatgtgatgcagtgcaactctgatctaactacactgaaacaaagagtcagaaccaaggggactgcctgaatttgctccccttgatccgcctggttaatgccacatgcagaaaatatgttatcgctcatgccacatgtaccgcagcatcaaagggcacaaaatcggatgattgggaactttgtctctcatcagcttctttggaggtggacaggcctataagaccttgtctgcatgcacctcacacagactcaatagacggcacaatggaaattaacaagccctgaaagaaatgttggctccaataattaacgaagtcctgggaaacagagttatttttttttgagaggggaaacttctaaatacaacgagttaaaatccaccatggatgtaggatggtgaatgaatgtacatattattgcttccacgggaaatgttttactgcctgaaagcagaaattataaagtattgcatcaataataaaaaaataacaactttcaacaaa

SEQ ID NO: 4259 - DNA, 209 bp, Homo sapiens
ttcaccttgcttgcccttctgccttccccatgtgaggatacagtgttcctcccctccggaggatgcagcaacatagcaccatcttggaagcagatggcagccctcaccagacaactaaacctgccaacaccttgatcttggacttctcagcctccagaactaaataaaatttagcttatgagaaataaagttccattctttgtaaatta

SEQ ID NO: 4260 - DNA, 796 bp, Homo sapiens
cctagacggagctctcactctgtcatccaggctatagcgcaatggcaagatcttggctcactgcaacctccacatccccagttcaaggaattctcctgcctcagcctcccaagtagctgggattacaggagatggagatcagaggatgttgatttcagaaacgacctagaggcgtatcttcctctgatgttcgcaccagactgtaaaaggaaccagactgaaacttccaaagttccatttacactgcttggctgattcccatatgtggtattactgaggatggaatatcttattctgtgataaagattctccagcgaattgtacagttgtggaggttttcaatggaggccaaataggacaaggccaagatcagtgggtgggaattagtctggttttaatttttcttcatgggagtaagtgcacagaatataaatcaccctgcctctcagaaggtgagtattaaagtgttaaaatactgggatgtggaagaaaaccacctgtgaagaaaaatattgatcatctgtgcgaccttgaacaaataacataaactttctttgcctcagtttctttatctgcagaagattggcaatattcttgcctattcgtggaattggtatgcaacttaaccaatagtaccctgtgatgtgattacaacagggcttggcacattaataatatatttttaagtgcgctttaattctaccaaaaaaactctactatgcccctatactctcctggcctcgctggagaacttccaaactgctatattcacctttgccagtttaatctttggcct

SEQ ID NO: 4261 - DNA, 780 bp, Homo sapiens
  misc_feature (1)...(780): n = A,T,C or G
atggctaagagaggaaaggccatgtaagacacagcaagaaaatggtcaaactagcaagagaggcctcaccagataccaacactgacagcactttgatcttggacttctaacctccagagctgcctttggactcagactggaactgtaacttggctttcctgggtctgcagttgagcttgccaacccaacctaaaggctcataggcagaaggaacttgcttgtctcagatgagactttgaacttggacttcaagttaatactggaatgaattaacgctctggagaattgttgggaaggtatgattgtgttttgaaatgtgagagggacatgagacttgggaaggtctgtggcagaataatatggtttgtctccatgtccccactcaaatctcatgttgaattgtaattcccagtgtttgaggaggggcccggtgggatgtgattgaatcatgggggcaaacctccccctcgctgttcgcgtgatagagttctcatgagatctggtggtttgaaaatgtgtagcacctccccgttctctctcttcctcctgctctgaccatgtgaagaccatgtctgtttcttcttcaacttccaccataattgtaagtttcctgaggcctccccagaagcagaaacctgtacagcccacagaacgtgagctgattaaacctcttttctttgtaaattgcccaggcttggttatgtctttactgcagtgtgggaatggactaatacagcatgcatatgaatagttntcnaattcctcttgtattgatttcaa

SEQ ID NO: 4262 - DNA, 778 bp, Homo sapiens
taggctaagagaggaaaggccatgtaagacacagcaagaaaatggtcaaactagcaagagaggcctcaccagataccaacactgacagcactttgatcttggacttctaacctccagagctattttgggctggggcatcagcttcttcctgccttccaactccaactgtggcatcagctcttcttgaatctcaagactgccagccttcaaactgaaactatacattgactctcttggttctcaggcctttggactcagactggaactgtaacttggctttcctgggtctgcagttgagcttgccaacccaacctaaaggtactgaaacttcccaagctccataattgtgtaagccaattcctcataataaatatcttccttgctctctctctgtatatatacacacacattttatcagttctgtttctctggaaagccctagctgttacaagagataataattgttgaaatagctattctaattatgtacattatttgctttctggaaatgatattgattcttatgtggtaagagtcagtattacaaaacaatgcaaagtctccatttattcatgccattcaggtttctttgttggttttatgtttttcttttttatttagatgcagatgttaatttttaaagttattaaaacaaattaaacacacatgcctatatggtcaattactatattaagtaaaaatataaatctgtgaatctatatcaatttatatgaggcttcagacctgaaaataaggcacttaaaattattgctgaaaa

SEQ ID NO: 4263 - DNA, 1387 bp, Homo sapiens
caggctaagagaggaaaggccatgtaagcacacagcaagaaaatggtcaaactagcaagagaggcctcaccagataccaacactgacagcactttgatcttggacttctaacctccagagctattttgggctggggcatcagcttcttcctgccttccaactccaactgtggcatcagctcttcttgaatctcaagactgccagccttcaaactgaaactatacattgactctcttggttctcaggcctttggactcagactggaactgtaacttggctttcctgggtctgcagttgagcttgccaacccaacctaaagcctgagagcttataaattctgaaggcctcgtcacagtggatcctggtagtactaagttggctttggatcacctatcaaaacctaatgaaagttgtatttattcttatcttattttgtccatgaaagtcagttagagacctctcctccaaaacttctgtcaaacagaaattgcagacttttcacacatgctattggacatgactgggcatttggttgggggccaagatatgaggtatacatgcaaagcctttgaacaactttatccaactcatggttttttcactcaaaacttaagactttgcttttcctaggttagatccctgcttcatacatatgttcttactataatgacattttacgtaatactctacatggcaaaatttcaacaagtataatttataattacaaagattattttggggtttgggaaaatttttatatgaaaaaatgttcatttagtagataacttagaacaaaaaaggaacaaaattagtaacatctttatgtattttgattggtataaagaagcttccaaaaaatatcagattctaaaactgcttgctagccatgttccatgaatttgtgaaattcttagctggtctctaaatatacagaactgtctctaaaataggagcattgagttgtttaatcatcatcatcaacaacaacatcatcatcatcatcatcatctggagtcagacctgagtttgactcctagcccttccagtcatcaagtctgtaatgatgaagtaatatctgacactatgtgccaagctctgtgagataagcacaccacatatgtaatctcaggtaatcagctcacaaattctctttgtcagacagaaaaacagaaacttaaaaggaaatacatttttcacgtttctaaataaccaagtcttccacatgaaggaatttggaggattgtgtgaaactagaaatacatctgacaatttttacagtcatatatatggaaaacaatgttaactgttagacaaatttcttagaaaacaaacttcagtgccagaaagaaaatgtaaaatcagccacagacagtgaaaaaaaaaaaaa

SEQ ID NO: 4264 - DNA, 285 bp, Homo sapiens
aaccctaaatctgtgttgctgagtctgctgtttgcatgcaggaatgtgaaggactgctcaagttggagatacaaattgaagccagccccagttcaaaactgttacaaatggagtctgtaggcatgaggggctgactatataactcagagttctccagtactttactttaataaagaacacaatctttattaaaggataagtaataaaaatgtgttgatgtgcaacttatggatctattattaaaactcaacagtcaaaaaaaaaaaatttgtctcgttggcctca

SEQ ID NO: 4265 - DNA, 799 bp, Homo sapiens
ctggattttgaaaaagcaagctgacataaatcctataatcacaaggaaatgagttttaccaacaaccagagaaagcttggaagcagattctttctacgtagagcctccagatgagaaccagctaagtcatgcctggacttctgacccacagaaactgaggataataaatgttttaagccaccaagtttgcgataatttgttacaaagcatagaaagctaacacagatgacttgaattctaaattccatgtaaaattttataacctttctctttatgtattcagataaacaatattccttacacacatttgaaaacatatcaatataagacagctaaatattttttaaagttacaacgtaatacaaatagaagatatataagaaagcaaaatcaaattatgttttcctttcagaattataaaacccccacctagcaatgctaggctcctgacataaattactgaaaaatagtcagtaatgaattttaaagccaaaacagaaagtcttagtccctttctaccaaaaaggtatttaacacatcttaaaacaaaaatcgagtaacccggggaggataaaataaattctgcgtcacaccaaaggaagaatgaaaaattgtttggtttgcagaaaaatcattcaaaaccatttcaatcccttggctcataatcatgcaaacttaaggagatctttcatcctacccggttagatgaagtccttcatttttaaaaggggattgcgctacatacccgaaatttatacttccctggtcaaaacaatacaacttacacttctcatagttt

SEQ ID NO: 4266 - DNA, 370 bp, Homo sapiens
ccctgggtcaacgccttgttcatccacagtgtctcagcaggtagtgtgtgcctggcacaaagttggcattccccatttagaagctggtggagaagccctaagaacgaagggaccccaacgacctgacctgcttcaacagcatccagcacagacacgtattctcccaaacacttcctgatgacatcagtggtgctggagttttgctaaaggttttcatattttgcaacaattattcaaaaattactactctaagagggtgtgatctgtcactgagaaaagagcctcctggttactctgagctgcctgtttatagccatgtatttatgtacaacatttgcatgacaataaaatgaggaaacggtccctaaaa

SEQ ID NO: 4267 - DNA, 697 bp, Homo sapiens
ttttttttttttttttttttcttttttttttttttttttttttttttttttcttttttttttttttttttttttttttttttttttttttttggaaaagcaaaactttttttttccctgaccttttggggaaaaaaaagcgggctttattcccccccttttcccgccgggaacctaaccaaaaaggggaaatttttggttcatttccccccaaaaaaccgggggaaaacaaaacccttttttgtttccccccccaggggggagcaacggaacctttactttaatttttttaaaaaaaggttccttttacaaaacatttggggcccccccaaaaattttttccggggggaatttccccgcctcagtctttgaaaaatttttttaaaacttcccccaaattcctggttttaattagggaaaactggctcgttaaaaaaccccccctctccccccatggtccggtttttgccatgaaaattctaatttccccggccccaaaagggcaagggggcctttacctattccaccccccctcccgcggcccgggggtataaataatgggccgggcgggagaaaaaaaacgggcggccccccaaggggggcgccccacaccggcatgccgtgtaccctgggccggataaaacctccacccttcagagtcggggggcagttgggccggcgactggatagcttcacgt

SEQ ID NO: 4268 - DNA, 575 bp, Homo sapiens
ctagggagcacacagctgggagcgtcggctcaacccgtgttctcagcactttgggaggctgaggtgggcagatggcttgaacccaggagtttgagaccagcctgggcaatagagtgagactgcatctttacaaaaaaagaaagaaagaaaaaaaaacaaaacagagcaatgcatcccatagagcactagctcatttgcacacactcacggccaatgaactttcatcttcgagtcttgagctgagatgcttctttgtcgtccaagggggatttttggccacttccaagtccagaggagtcccatagctccatatgccataaatcccatggactccaagccttatcagtgcttgtagactgctgagcctggattttgacattgaccccaaagggaaagtgtggctaacggtgtgtataaatccagcatgaaacgtgatgtacaaccagaactacattctatgaggcatgtgctggaaggaccattctttgatttttgactcagttcttagatgtaaagcttataaatcatgactgtgtaataaaatgagataattttgctcacgaaaaaaaaaaaaa

SEQ ID NO: 4269 - DNA, 1118 bp, Homo sapiens
ctaggatacctgaggagactggtctgggcaaaccacaggataagaggatccagggatcctctcccctttctatgattccgatgctgctgattgtctttgccgaggaacaggaaggaagacaaatgcccccaactactgcttcattctggaagaagtgttggaagtcaatggaaggtagagggagctgctcggagggaaacctgagaactgtttctgaaggaattttatcagtctttcggcagagtctgaccactgctttcctacctcccctgcttgatcctgctggatagactcagagagccaagccaacacaaaggagctcaagcacaattcctttccttcttattttgttagcccagtcggggagcccagtaatctctaaagggagttgaaaaagtaagggtttaccttttggccaaggcttaaatttctcaaatgtgttacgccaacacaatactcagttacatgtgtatatttccaaagtgtcaaagttatttaatgtggtaccaaggtttttggatctgaaaaattaaaaaaaaaaagagtagatggtaggtcaaggggttcaagccccgactcagactaaacggtgcacagaaagcctagacacaacctagacacatgcacagtggctcatgcatgtaatccccacactttgggaggccaaggtgggtggatcacctgaggtcgggatttcgagaccaacctgaccaacatggtgacattccatctctactaaagatacaaaactggctgggcatggtggtgtatgcctgtaatcccagctacttaggaggctgaagcaggagaatcaattgaaccccggaggttcactgatcactgctgtagcacaggcatgggcagagaccaaggcatactggcttcctcatcagaacatatcataatccgcagataatgctggcttctatgagttggaagactgtgaaacattgagactgcaataattgatccacttaaactttttattaaagtctgaaaagattcggcaattattattactgtggttgtacatcaggtcattcttaactagattttgtaaaagtcaaactcttaaaagactaaaataataaacagctacatttactcgattagcaaaa

SEQ ID NO: 4270 - DNA, 854 bp, Homo sapiens
gaatattccgatggggatggagactatgtgatgagctgttgccgtaatgatgagactctgactaaaggcataatacggtggataacctgttgtaaaacacaggatttctgcaattccttctcaaagccattaacaattacacagtgtgagactggagtcaaattgtcttgccacctcctccttttccccaggattatccctgttctcctcttcaaggtctgtatttatcctggactaaagcgttcctcaagcatcacctggggaagtcagctcccttgactttgtctggcacacatcccacacaacatcatttccttaagcctgtttccaaccgccacctccaatagtatgcatagaacttgtttctgggttttacaaatcactttgtgatgcagaaccatatgatttctcagacaatgaacatggatgtcgtccacactctcacaaaagatgagagaactcgaccccgtgcgaaagccgagacattcttcagccagctttgctgatgaatcctttcgtccttgctattactaacccttttataatgtcacatctcgcaggcttccactccattacacccagctatctcaccttcccccactttatatctctataacacctctagccatccccttggaaactcctcgcatttctccagatgatacacctcctattttgcctccgattcttttgtagccatacgaaaccattaacgagaactcaattgacctaatagatctgacaatgtcttcactccacataatcaagaatgacctaacatcaactgcgcctttagtcccacatcctacacctctgaacgcacttaggttatgtgactaatatacgcttactat

SEQ ID NO: 4271 - DNA, 573 bp, Homo sapiens
agtcaaagtctctttctgcaagcaacttggaaaaccatgtttgaaaatatcatccatgaaaatttccccagccttgctagagaggccaacattcaatttcaggaaatgcagacaacccctgcaagacactatacaagatgaccatccccaagacacatagtcttcagattcttcaaggtagaaatgaaagaaaaaaatctaaaggcagctagagagaagggtcagctcatctacaacaggaactccatcaggaaacagcagagctttcagcagaaattttacaagccagaagagattgggggcctataatcagcattcataaagaaaagaaattcgagcccagaatttcatatccagccaaactaagcttcataagtgaaggagaaataagattcttttcagacaagcaaatgctaagggaattcattaccaccagacctgccttaaaagaggtccttaagggagtgctaactttggaaataaaagaccattactggccaccacaaagacacacttaagcacatagaccattgacactgtaaagcaactacacaataaagtgcgatcggccag

SEQ ID NO: 4272 - DNA, 1011 bp, Homo sapiens
tttttttttttttttttttttttttttttttttttttttttttttttttttttttcttttttttttttttttttttttggcaaatttggcccttctttttaataaaagcccataaaaaatttcaaaaatagagggggcaggaggaaaaaacctttttaataagggtagccccaaagttaaaatctttggaaagctcatgaggcagggtttaagggcccatcatttgtcctggccttttttaaggccctgagggtttccataaacatgtgtttttgcaaagggggccccatttaaggctttaataccttttttttttataaaaacctttttaccaagttgtttaaccttcagggttcacaaaatctggattcccccttagtagctaggaaagacttttaggggaaggagagattcaggttgatttcccaggataagaaggagcttgccatgctggatgtgggacaacagttcaggtgggttgaaggaccgtttaaaatttctgaagctggaaattgccttcccaatcagaggacgtgagcatggagtagttggggaatggagagaaaggtagtaggtaaagttggagaaattagcgggaataaaagtgaagggccatgtagccatattagggagttgggttgtagcaaagtggtatgtaaaaccactggagtgttctaagcaagagaatgacatgctcagatatatgttattaaaagattactcagactccaaaggaagaactgatctggggttaaggcatgattagagaaaggaggctcttgtagtaaaggtgagagaagatggtggtttggatcaggctggtggcagtgcattacagagcaaagtggacagatttaagataccgattagactttgaaatcattggactagctgatgagttggatgtagggagctgggaaaatattcaaagatgacttgagcaacttttcagacttgagccactgggttgatggtggtgcaactatcatccagggggaggaaacgcctagg

SEQ ID NO: 4273 - DNA, 885 bp, Homo sapiens
ctaggctccacgtgtttttctcataaaaaaaagcaagcatgggaaaggttgtatctgatgccagtttcatttgatgacagagagaccagaggactgccagtggtagtccaccaggttcttctgatctggacgtttcaccttcactgtgccacactgggcccctactgtgtctcctgcaaaggctctacggactggctttctcctggccacattgtgggccacaggactctgtgcagaagctggagaatgagaaaggtagaacaggcaggacattctaactcctcagagagttctcaggcagatcacgaggtcaggagatcaagaccatcctggctaacacggtgaaaccccgtctccactaaaaatacaaaaaaattagccaggcgtggtggtgggcgcctgtagtcccagctacctgagcagctgggattataggcatgtgatatcacgtccagctaattcatatcttaggtatttaaaaagctattttgactcactcctgtcctaactgccagaaattgagatattgtaagaaagaactgttaaaaaaaataataattcttcttttctattcctgtatattactgtatattatcagtttgttcaacatattgaaaaattttaacaaaattttatctcagttgtgtctaggatacacaaagaaataaattctagcaccaaagtaaatatttatgaaaatatagtactaaaaataatctagtcattagtacatagatagatttgtctaacttgaaatatatcaggataaattacatttgtatttaaaatatcaatgtttatttttaagtaccaattgtaatgaaaataaaaggcttcataaaaaaaaaaatcgtctcgctggaacagcggtgagcgttgcgacag

SEQ ID NO: 4274 - DNA, 399 bp, Homo sapiens
tttcatctgttttaggcaagagggcaaagccagttcctgtaactctcccttagctgaaagcttctactctgttaatagtagacagtgttgacttcctgtagctggctacagggtgcaatgagaagctggccatctgcaacccagaagagggtcctcacaagaacccaaccatgctggcatcttgatttcagacttatagcctccaaaactgtgagatatcaatttctgttgtttataagccatccagtctatggtactttgatagcagcctgaactaagacaatgtgcactagaaaaatatgtccagcatcaaccttttcatattatggatatttttgtgtaggtgaagttcaatataaagtaaactttaaataaagctattacatgaataactgaaaa

SEQ ID NO: 4275 - DNA, 790 bp, Homo sapiens
caggtgacaatggcccagaaagcaagagaaactccaaagcatcaacaccaaaatggaaatcaagataagaatccaaaacagagggtggcaaaagcaaggagccagcagaaggggcagagcccggaggccacagtgtatgatgggagagacctctggctgagcctgtgaggaaagggctgagaaagggtctaacaccaggtctcaactctagtttaatggatgatatgtgaattgctggcaaaaatattaagtattagtattttattaatagattttatatattcaccaaaaaacttagtaatagtcccaacccatctgccagtcatatactttaaatgcctcacatagatggatggcaatgaactgagcagaccaaaattttctgtcctaatttaactcaggcctggcatctgggtagggtctatgtggaggattagcgcattataaacctatgttgtttttgcctgttccctcaactggagccatgctctttacatcccatccaactttgaaacctggatgccctttcctttctcagaccaccccagtcccagtggaacaagctgaagcactccaactcaatggaaccgctgctttaaacaactctcaagacactattcataataagcctggagttctttggggtactttattcctttctttcagagatattcacatgtgctcttttcacttttgcaaacttttctgtaaagatcgcttacctcttttttacttcatttaagcatttgaaaattcatggtcatgtacatcttcggatattctcttgttt

SEQ ID NO: 4276 - DNA, 615 bp, Homo sapiens
cctaggtttactggacagcatttattttccaataaaaaccccactctattaaacagaaggacacccagccaattgtgccagctcagaagcttgtctccatcagaagtgcattaataacccactcaagcgaagtgtatgacttgctagtttgggcaggtcataggtcagaagatatctgctcttagagaaataatatatacagcaatcgtctgataaaccagccaaagaccaacattacagagcagtggcactgtggaggggtcctccagaaagcatggccaaaatagaatattccttccactcatcgcagaaagtctgagtgatgtgagttaagacagcaaaatattttcacaagcattcccaccggtcagaagccaactccactttgcaacctgaatcctatattattatttgggaatgactgtttagcatcagtgattcccaagaagaaggtgataagtcagtaggatgggaagggcaggggccctgaagtcagagtcctgagttcaaatcccagctccagcacttgctagctgtgtgcccctgattagatcatgtatgcggaccggatgcacatacacaaaatattcaataaataccagccctctcctaaaa

SEQ ID NO: 4277 - DNA, 374 bp, Homo sapiens
ctaggaaccctgccagcgttcccagaagccgcaggaccccagagatgttcccagctgcatgatcccgggcatcagctgagggcaagtcatcctctctaaggctttgagttgtgcaggctccttggctgcctcagcacctccctcaaagcaaagtcctcccaccttggagttcagcccatcaagccttccacctacccagctgcctcagtcaccatcagagtccatgtctgaatatcaccaccactggctggattgttctgaatattctctaatctaacctcattcccacccatctccatcctcccaaattattccaaaatgtccctttgcaattcatagttcatcatcaataaagtcccagtgtatcttcaaaa

SEQ ID NO: 4278 - DNA, 452 bp, Homo sapiens
tacagatttacctgagaacaactcccctataacgttcttgctttgaagaagctctgcttctaaaacccactgggttctatgggagctgaacaaggaagagaagaaaagtacagacatttgtatttcaagatgccttcctgccatagcatttagaatacactggcaaacagcctggcataaagtatgcatgctgtgcatgttatctgtatgcttttaaaattattgagtgattttcagcagcagcatttgctggtgcagatttcattaccacagatttcttctttgtctggtgagctctgacctcctcaaagttaacctgctctatagccccaatctctttccctacatagatatccagtggcctgggccatggttccctttaaagtttctcccaaggaccttggtggcatttgtactaatggaactcctggagaccatactatttccgcaat

SEQ ID NO: 4279 - DNA, 738 bp, Homo sapiens
  misc_feature (1)...(738): n = A,T,C or G
ggttcctgttgagattaaagtaaatgcatttaccagcatacatgtcatggaagactgactctgcaccatgctctgtgacaaaaggcttcaagattaaaccggtttgcccttctaccgtgaaggtgagccgtgaagtctattgcccagggattggggacgtttgtattaaagaaggttttggagtacagaagcaggaagatgtgttgtggagatgctgttggcagaaacaactggccttgactaaacaaaccaagagttcctacaggagcagaggcaaccgggtgaaggctgacgcccttgcacaggcttgggcagctcttctccacatgtccacgtggctcacttccttacctacttcagggctctgctcacacgtcacctcctcaagaaggccttccccaactaccctgtcctcactcccaccccttacccctgcattccctgtccctctcactctgctgtggtttatcctacctgacatagaacaggtttatctccctgttgtctagcaggcttttatccagttctgctttgctggactgtattaagtaagtctcaagtcctggggtttatcactcagcatgggtgggacacacgaaaatgggattttcctgttccccttcagcacttttcttgtggataccacatttccccatgtgcatattctatttccatctgactcttaccttgggcagaactattttctcaaagcatgaggttnttgaccgaaaaatctat

SEQ ID NO: 4280 - DNA, 810 bp, Homo sapiens
tagatgtgagtcctatgagaggtgatttggtcatgaaggtggaaccctaataaatggaattagtgtcattataagaagagacacagggagacaatctctttttccaccatgtgaagacacattgagaaggtggctgtctgcaaaccacgaagaggacactcaacaggaatcaaatccaccagtaccttgatcttggacttcccagcctccagaactgtgagaaaccaaagtctgttgttcaagccacatagtttatggtattctgttttagcagcctcaagtaagacactaatcctccttcattccaaaatactaaaccccacaaaaagcttctcctaattccactatttcttttcatggttcagcattttccaagtcactcaaaagccaaaactgagagctgcctcagccttctccctctgtcttgcttcccataaccaacaccaaacgtagcacctcttttccattcccaattccactgcccttgctcaaggactcttttactttgttcctggatttctataatcatcttttaacccatattcttagaataagcatttaatttaaaaaaaattaatcattcaatacataggcacacattataaaaatatgaagtatataatatggacaattatagtcccccttatgacttaagtctcactcctggcccaaaaataattttccaagttaatatgcatctgaacaatagaaacactcaagtgcctactatgggcccaggcgctattaaaagcaatttaaatagattaatttatttaattttcacatcatacccccctaaggggcatgtaa

SEQ ID NO: 4281 - DNA, 1040 bp, Homo sapiens
agcttgaatgcagactgatggctggagttgcagtggtcatctggcaaccgtgaggcaaactttagagtggaaaatgtgtgctaagaaggacaaagcagcgagacagaaggagcatgggacttggatgacttcatgggcttgacatgccactagtggattgcctacctctgcctgcaaaagacagaaaataatctcccaatttatttaagccactctttatttagtgtcgattgctagtagctgaacacaattcctaaagcattcactaacatccatgtggtagcatcatcttatcttcaatacccttcttcagatgatgctagtgtgaaccttacatggaatattttgaaccactgagttagggcattgtgtctcagtcaatctctccctccacttccaaacatagtgcctgataaatagtaggtgctcggttaaaatggattgaccattcatgagcctggctaagtcttgagccatgctaactctcacacaccaatcttcaatttggccaggctagctaaatcgaagaactatagccattgtggttccttgaacacagtgagcaaacgtttacttcactttgaagggtagtagagtccaaaaccatcacaaaggtatttaataaagagccaatgaaaacatcagattaagacaactcagaaaaggcgatgatgatagagaagaaattattgctggtaaatttaagtttagcctaaagctgccacctgatatatctttaagttcagcctaacggcatctcctcacagagtgacctgtacctacctggaatgggaaaacaaactataacctactctggtgccaaccaccgagttttggctaatcacaggcagcaaactgttcaaatcgtgtgtgtaaccaatctggctgtttctgtacctcgctttctttttgctgcctgtaaatcttcttcttccacacattcggagcaccggagactctctgaacctattctggcttcctgaactgtgaatagttctttgatcaattaaactctgttaaactgaaaaaaaaaaaaaaaa

SEQ ID NO: 4282 - DNA, 836 bp, Homo sapiens
ccccaaacgcttgcctcgcttccaccaccacacaaattcagcttcagttttgtctcctgtatcacaattaaattctcagttctgatcatttagtctttaaaggatgctttgagcctgcgcttgcacatgcatcattcagtcgacattcaggtgagagagacagcatgatgctcattaatgccccagcaagtttttgcactactaagtgcctcctattcttcaagtaaaacctatagaaactggaaaatcactttgcgccactctctttattcaagtcgagccctttctacaacacgatactgtattcttgccgcccccaaacctctctagtgagcgagctgaacgaccgttcggcccgtagaacccaggccaccaccaccccccctcaccaagccttacaccaccccgtagtccgtcctccctccgaaccaccgcccagccacccacggcccgacgctgctcccccggccaccaacgccccactcttcccccccgatccgcccatcgagcattccgagtcgtcttcaccccaatgctccctcgacggtcttccccccccatttactgtcccaccccgcccacgctccccccccatcacgcctccctcccagcaccgccctccccctcctagcttcccccccccccctacccacccgccaacacatcgcccctgccgcccctcacgcgcgcgcgtcaccacttccctcgatcattagccccaccacttattacctactcccccctagcagacccactctatacccacatccacggaccgctcacttctcatctccacccccaatctgctcccccgccctctcctgcgcacccacgcg

SEQ ID NO: 4283 - DNA, 569 bp, Homo sapiens
ctaggtctctatctcgctgattctacctctgatcaaaccttgaagaaaatgacaccagccatctgcctatacttttataaatgagtgccacctaaggctaccacccatcatctctgtgacctcacgccttatctccgcatggaagtctaataattgttgttcctgcctaacaggatatctacagaggactttgtgttaagagctgggacctggagaataggaatgtgattatgcagattttgtttccgcgaagtgccatttaaaaacaatcagtacacaaaaaggcatcaatatggaaaatatacatgatactaagttaataaagatgtgagttacaaagtagcacacctcacttataaactacattggaaaggactgggaagaagtagaggaatatcgaatttaaataatgggaaaaataagtaatagtttttacttttcaaaatataaaatgctactttatgttactttataaattttaagaatgcctttaagaaaataatacataatttataggccacccaaatcaaataaataaatcaaggatttttgtaacaaaaaaaaaaaaa

SEQ ID NO: 4284 - DNA, 789 bp, Homo sapiens
atgggtgactaaccaggacatcctggaaagtttcttcctctctgcctcacccatcccactcgctccatcctcaaagcggacactcagatgctggggcttcggccccagtgtgtgaccccacgggaggtttgcagagtcctcaggttgcgtcacagccagcgttgatgagcatcatcctgtcttccaagaaggcaggtcagtcacccaagaatgagccagagctgcttctgtaaatcacgagattctgtgacccagattaacatggaaggagaaaccagcagctgctgccgccgtaggcacaagtcagcaacttcagtccttctgaggctggcccttcatggccatgggctgccctttccctttggggtaatttgaggcaatgaaagtttttattccctttggttgtattttctagacatgttttaatgtagctgaaatcatatgaagtgtccaattttataccctgctttttttaaacggaagattatgacatagttttttttctatgctattataaggtggttacaaacatttcttttaccgcttgttaaatgctatcgcactactgcgatatgccaattctgctcctgtgaaaaattacgaagatatttcttgttgaataaaaatgctgggctaactatttttcacgccccttcttattcgagcttggcactgtccacgatactttctgcttcttttcgcctgcgcttctctactagtttgtccagctcgatcatagttctcttctcccttaatgaccgcctgtcgtcttaacaacatcgttccctt

SEQ ID NO: 4285 - DNA, 793 bp, Homo sapiens
aggtataagactgaaattcatggtcacctcttgaagatcaaacagtaaaagaaggtgaaacagcaacttttgtttgtgaactttctcatgaaaaaatgcatgtagtctggttcaaaaatgatgccaaactccatacaagcagaacagtactcatctcttctgagggcaagactcacaaattggaaatgaaagaagtgacattggatgatatatctcagataaaagctcatgtcaaggagctgagctccacagcacagctgaaggtcttaggtaaatgtaaccaagtataaccagatagccagtttctgaatcatgggagtggggagatcacctgaggtcaggagttggagaacagcctggcctgaacatggcgaaaccccgtctctactaaaaatacaaaaaaattagctggacgtggtggcgtgcacctgtagtcccagctacgtgggaggctgagacgagaatcgcttgaactcgggctgcggaggttggtggtgagctgagatcacgccactgcactccagcctgggcgacagagcgagactcccgttttattaaaaaaaaaaagaaaaaaaaaaaagggccaccctttctttccccaaagcacaatacaggggattacccccattttcagactagggtatttcggggaaactcccagctctgggggttttaaaaatagggaaaagcttctttttccttcccttttttttttaccctaaaaaattgtatttttaataaaaactgttcccggtgccctagggcccccttaattcttaagtcctgaatattt

SEQ ID NO: 4286 - DNA, 1163 bp, Homo sapiens
aggtaccacttgggagcctggggattgcagtgcacagtctgctacttccacctctgatgtccacacatgctacctggaggcccaaggattggcgtgatgctgctgctgtctttctgaacaccatgcacaccgcccagggtcctgaagacctgcctgcatgcccagtccactgctgccactgccagaaatttagcaagctgtctgaaggcacgaggattggcctgcccagaactactaccaccagtgcccatatataacatttgagtgtccaaggattggcatgccaggcccaccaacacctgaagacaagcccccctgatgttcctgccttcagcaatgcctcaatttcagcttccactaataagcatagcctaaaccactgagaaactcataaacactactgatgcagattatagttgaggaaattacacagagattacactactgtgcacactcagattcaaagggaaagcactttaagcaacttacactataaatgaacccatagaaaaagtcttctacaaaagccaatgcatggcattggaaagagtgactgttatacctgatgccccaatatcaatgaagggccgcaagaaccataaaaaagcaaggaaacatgccaactctaaaggaacacaataattctccagcaagagatacctatgaaaaggaaatctataaaaggcctgcaaaagaaactgaaacaatgattttttaaagaaacttagtgagatacaagagaacacagataataatacagagaaatcagaaaaacaatttacaaactaagtgagaaactcaaaaaagagatatataccataagaaaggaccactggaactgaataactcgaggaatgcaataaaaagtgcaaatgggaacatcaaaactagactagatgaagcagaagaaataatttctgagcttgaagacagatcttttgaaataacttagactaaaaaagaaaagaataggaaagagtaaaatctacatgagatatggaatactataaaggtaccaaatatatgaatttggggtgttccagaaggagaagagaagggcaaaagcatagaaactttatttaatcaaataatagctaaacattttacgagtcttgcaagagatatagaaaatggatacagaaagctcaaaaaaaaaaaaaaaa

SEQ ID NO: 4287 - DNA, 796 bp, Homo sapiens
ccagatgagaaaaaccagaacatgatacagtttcctgtaacacctctggtaactaagccttaaactggacatggatgttgctccatggactacaacctctcttgttttcactgcaccagtgacactattaggccaaacatatttctggctatttttattacttcggaaatgttcatctggtgactcagcaaaaacactaattatctcatcttctttccccattttggagagggacaaattgagaattgaccattcaagaaagatataataataaaatagaaataaaagtgcataaggattttcttcattttctagagccctttcatgacaaaatgttttcaattaaagatgagttaaatcaaaagaatggaagaaattaaacgagacgcttattttttaacacctgctaacaggtgctaaaatctgtttgaattctctgaatgatgatttctgtagccaaaatctcattatcataaaacccaagatcaaaaagactgtgaaatactgaggctgatttagttttcaaatgcaaagcagcagctggattaaagcaaaaggctactggaagaacctggagagacacaactgacatctttagtcatcgggtgcactctcagacaatgaacagactgattggacatacagaaatggggaaaattcatcatgttcttattctaataagtttcatttcaggaaactgatgaacggcaagttgcagcaggttattcttttactcagcaaagaaaatacagaggtgattgatacctggaggacctaggtagaaacaaaatgcttt

SEQ ID NO: 4288 - DNA, 403 bp, Homo sapiens
tagatggagttttgctcttgttgcccaggctggaacacaatggcacgatctcagctcaccgcaacctccacctccccggttcaagcgattctcctggctgagcctcccaaattgctgggattacaggcgcccaccaccaggcccggctaattttttgtatttttagtagagacggggttttgccacattggacaggctggtctcaaactcctgacctcaggtgatccacttgcctcggcctcccaaagtgctgggattactggcatgagccaccgcgcccggccaggaataagtattttagaactggttttccaatctttcatttcataatgttcataaactaccttctgaattgtatctacaattaaaaatcacaatctccattaaccgaaaaaaaaaaaaa

SEQ ID NO: 4289 - DNA, 287 bp, Homo sapiens
ctagatgtcaagttgaaaggatgtactggaatctttgatgatcaaactgatggaacagatgatcagttctcatcctccaaagttgtgactgtagatggtgtaggggactgagctgaatatgtattgcacccagtagtttaaattctgagctcttgagagaagagactgggtgcattttgttcaatcttctatcctggatgcctactagatatctagcatgaagtaagcatttaatgaatattggttgaatgaataaatactatgtaagtgaaagaaaaaaaaaaaaa

SEQ ID NO: 4290 - DNA, 784 bp, Homo sapiens
ggcctcctgagctgaatgacataccatcccccacgagtcatccacgtgtccttctccaactcatcagcaaattgtgccggctctttaccatcacaaccaccctaaatctgatgacatttcatcacctccatggccccaccctaggaagtccaagccacactcatctctagtctggaccactgggcaacacagaactccacctgtcccccagtcacctcccagtcacctgtgtgtgctgcagccagaaggatggtttcaaagactcacaaaatcactcctttccctgcttaaaactcccggaggcttcccatgatatgcagaataaaagccaaaatctgtataagggcctacaaagtcctatataatctgactcctggctattttcccactcattctttcctctctccacctccttcactcggtcctggcaagccactccaaactttcgcctctcctgtctgcctgggctgcatttctccccaccaggtcctcttttctggctctcttgtttcactcaggtccccctgcccacttcttacctctgcagaaagacttcttcagaacgtcgatctgaaaaaaccatcctgccgctgtctattcctttcccctgtcttagtttttatattacttggcactatctggcatttttggttgttgcctgtctgtccccctgtctgggatgtgggctccctgggggaaggggtgtgatctgccatgttcattactgtaggaccatgcctgaaacagtgcgcacaaagctgtgacagcacaaggactcatgagc

SEQ ID NO: 4291 - DNA, 896 bp, Homo sapiens
caaatagctatgcctcccaggctgaactcgaacttctagactcgagcaattctcatgcctcatcctcccaagtggctgagactataggcatgccaccacacccagctcttttgatgtaatttttatcccatcaaagttctgtcatcttgcttttaaaaaattatcacatgcattctctcttgttattgagcctccttctacaacaggctgtctaatgtgtttttgcatttttattgtatggagaaactatacctcatgcaaaactctctcattgaaagcattcacatagttcccaatatttctttattatacagatggccctgggctcacagtggtttgagttatgatttttctagtttatgattggcatattgggatattaaatgtattttcaactttcaatatttttgacttgccatgggtttttcgggacataaccccatcgtaagttgaggctcatctgtaaacagttttgaaaagaacatcctttgggatttttaaacctcagggccctctggaagctgtaggctaatgggactggcccacagctttcctactctacttcattaccacactgggtttcaaagaatcagctggtatagacaggaaatacaacttacatatttttttcttataaggtttcaatgttatctcctcctgctgctgcttctctctctgccataaaacttattttaaagacatggaaaattatatgcacttgagttaaatacaaaaccacaagtgactatagcttgataagtggtctttgggaaatttatgagccaaaatctgtgtcataaattgatagcactccagctaacaaaagattgacaataaaacttactgtaaataaaaccatctaaatcttgagtatgaataaaaaaaaaaaaaaaaaa

SEQ ID NO: 4292 - DNA, 812 bp, Homo sapiens
taggtgatgactcttctgaatttcacctgaatgtggaaaacttccctagtctctggatgagatttaccaggctccaccaacaatcacccagtatactgtaggatgcaagatctatttcccgttactcttagaaaaattgcagaagtaatatttgaatgcattatttttataaaaacttagctcctggatgtttcttcattgtttcaatcctgaataatagtccagaagagaggacgaggagagtttgccaggccatgtcttccagagcctgctgtgtcctcagtcactgccagtgacagggtgagatgggctgcactgtaggcagggagcagtgatgctctctgtgggaggattcagggcatctgggagttgggtgtgagaatgatgggaggtgacagtgaaggggatgcaacagaattccacacgggaaaggggaagagatccgtatcgaccgttttctcttctctaaaaaagaatgactttggctcttgatcagggcaaggtacaccctcaacccaaagcccaaggttccctgtcactctgactaacagtggtgaagggtgtcagggacccactggatgggactagctgatattctaatggctcagcaacctgcacttttgtaggaatatgcaattctttctcctactctccctacacctgcctattcagctggctaagacctattcatattttttggtgcgagttaaatatcacttcctcaggtgtgccttccctggcagctatatataattggggtcccctggtggtcttatctgcaaaactcttgtcttcctatttttacagaataa

SEQ ID NO: 4293 - DNA, 639 bp, Homo sapiens
gagttatgagaaataagtagattatataattttcgacggagggtcgtactactcaacttattggatacactggctgtaagaaaaaagaagaatgtccaatgccaacactattgttaacattatataaaaggtactaaccaagagaaatataagagaatgaaaatgagagttaaaaacgtacctaggcataactaaaacaaaaaaaaaaagtgcaagacccatgtgaagaaaccattgtaaatgctactgaaggacaaaaatgaagacttgaattaatgggaaaacctacctcggactagaagacccaacatcataaagaggataatttgtttgaaattatctcatacatcttttatacagccctcccaaaaattacaatgagtttttgtgttgtttttgtttattttgctttttctcattttaagaactagacaagataattgaaaaatttgtatggaaaaaaaacatacctacaataatatccaagaaaaccctgatatagaaaagcaatagaggtagattggctctaacatattaaaatttattctaaattcgtaattattaatagtatgttaatatcacattaataccaatagactaataaaatattataacaaatccaaaaaaaaaaaaaaaaaa

SEQ ID NO: 4294 - DNA, 756 bp, Homo sapiens
atagacggagtctcgctttgtcgtccaggctggagtgcaatggcttggctcactgcaagctccgcctcctgggttcccaccattctcctgcctcagcctcctgagtagctgggacttcaggcacctgccaccacgcccggctaattttttgtatttttagtagagatggggtttcaccgtgttagccaggatggtctcgatctcctgacctcgtgatcttcccaccttggcctcccaaagtgctgggattacaggtgtgagccaccgtgcccggccagattatcttcattttataaatttcatagccaatattttcctaaagcacatattttaaagttattcagtataacatatattttagctcactttaatgtttaataaaattaacattatgattattaattacaagttaaaattattgatctaataaattcagtgtactagactatgcaagaggtcaaaccttaaagagaaaagaaatgagaacatgagaaaaggtgtgtttctacacaaactaagattattcacatcattctatattgattaatgtcaacattattacattgctcatatcaattctattttgacaataattctgaactcattattttagtttgggctaaattatattaaagatattcaggttttattgctgtaaaatactttcaacctatatatgctatatatttttgtgtatcattgaaaaattaataataaaagtatatgtaattatgtcaaataaaaaaaaaaaaaaaa

SEQ ID NO: 4295 - DNA, 802 bp, Homo sapiens
aggtataggagggaggcaggagcagatgtggctgcagaagagtagaaagcaatgtgaccacagaaacagagattggagtcatacagctaccagccgagaacaccggcaggcagctgccagaagatggaagaggcaaggaacagattctccccaagaccagaaggatccaatcctgatgacaccttgattttattcctatataacacattttgaatttatacttaattgtaattgttctggtttccagaactgtaaaaacaaaacaaacaaaaaaacccaaaaaacatttctattgtcttaagccacaaggtttgtgctaatttgttacattggcaatagataactaatacatgcatatttaaaacttcttggaattttaagcctaataaatgtccattatacattaataaaaaaaaaaataacatttttccttccttatttgttcatgtgctatatttcgcatattataacatagaagccaatattatgtttcgtgtctgttttctgttttaacccctttatttttcgattttgcgtggttcttcatgtttcctgaaggtgtgcgctacagataggcggcctccggcaggagaggggacgaaagtgcgtagcgttagttgtagtttcactttgtatgatgcgctaaatctagatcgccgtaaccttctatactatgcgcgcatatgcttcctttcttgcattgagtggtgttaaagctaatctatatattggtgacccttccattgttgtaatagcttcgctcccgggtctatagtaattgtttggtgatcgtgaagtagaa

SEQ ID NO: 4296 - DNA, 873 bp, Homo sapiens
cttagatggcatctcgctgtgctgtctaggcagaccttgaacttctggacttaagcgatagatcctccacctcagcctcttgagtatttgggactacaggcacgtgtcactgcacccagcttgacctatgttttaataggatttctcactgtaatgttgagaaagattgtaccattatttttaatagtgagaaattagaaacatcataaatggccacaaaggatggactgggtacacacatttgaatacatatatgtgatgaaatgtcacttggttatacacttatgatataatactgagtgaaaaatagaatataaaattatatgtttataatacaattggaacaaattaaagataacagcagtaggataagaacaagctatgggtattcttctcacttgcttttccctgtgcatgcttttaatactttgttttaaaacaaagtaacccatgcttattatacaaacttgaacaattatgaatcataatgtaaaaattaataaaatcctatcatttccttcaattccatacttctagaattaactaatgttaaaattgatgtgtgttcgtcaacaactatcttgtgtccttctaggaataaatatatacaaacataattcatgaatatgtatatatgttctgaatatgtataaatattaataatgccgaagcgtacgcctgatcctaagtacggggggttcccgcgcgtgcccgcccttgcggctcgcccgcgctccgacgctgactgccgtgacccctccatgttctccctcgattcaccccccattccaccaatgtacacaccccattcgactcgttcatggggattctcctacttatttcccgccgtccccaccacacttattactccca

SEQ ID NO: 4297 - DNA, 162 bp, Homo sapiens
tctaggatattctgtgatcaaacatggaatataaaaatcctctgtattatataacattctttggctccatagttttataaacaattgtgcattttacttgcttacctgaaaatatattatcaagttaaaaaataaaaacatcaatgatcaaaaaaaaaaaaa

SEQ ID NO: 4298 - DNA, 389 bp, Homo sapiens
gtgcattgattttcaatgggaaagaagattgaagggcaaaaatgacagaagcttggaagaacagaatatccagagactgttacaacatgccccatagtttagcaacaattatcagtgatgttagtgataatcttgatattgcatatctgtaaaatgttatggtcaaacaagttatgggacatttacattttatttccatcaaaagaagattcgtgcatgggaaattcacagatccataatctgttgctttcattgaaagacaatttaactctacaggataaactgttggaactggcaattgaataattgacgaattttgaaaatacagaatcatttgcttcattttgaataaaagtgaaagatggaaatcctgacaaaaaaaaaaaaaa

SEQ ID NO: 4299 - DNA, 773 bp, Homo sapiens
cttagatgaagtcccgctctgtcgtccaggctggagtgcaatggcaagatcaatctcagctcagtgcaaccttcacctcccgggttcaagcaatcctcctgcctcagactcccaagttgctgggattacagaggaagagactttccgacagccaacatttccattcctactattttggaacaaccagaacactgaaaatttggtacgaaaagcttttcttacgataaagagataacatttccttaagaacagttgctgaaacttcagctggggaacttatcaaataaagaaaccacctcatttcagactatgggctgaatccaataaagtcaaacccaacgcctcccaggaatttagaattacacagttgttgatcaagtggagagaaaagaatgtgaatttgttttttcaagattctctaacaccatatgaactgtggctgccttttctttaaatcatataatggaaaaaaacaaacttctagaaaaagatatgtatcatctcctccaagtggtgactggtccctgctcaatgtgttgtggtttaccttgccttgaacccaaaacaatcccttgtcctcacagagccctggggatgtctggtggcagcaggaggctggattcctattctaagttgcttccaacaaattgtattccgtctacatctgtgcaagttaagtgtgttagtactgacgtggcatggatttgttaatcattttaatgtttgatagactgataatacataatgttaatgttaaaaaaaaaaaaaaaaaa

SEQ ID NO: 4300 - DNA, 1025 bp, Homo sapiens
ctagaacttgcaataccttcaaattacaggctgtttaacagacccaaaaagtcaaatgtcctaaaccacggtttgtatgaaaaaaggacatcatctactgaatactaaggtatacaacgctggtgaaagccaaaaagccactccaaattaagggacagtaactgacaagaaatcagaaataattcttcagaatttgggcctttggactctgatccaagaagaaacagttttcattgcaaactttgtttatataaatctcatttagcttctaaggggactcatgaaaaacaaaaacataaaatttatagtagattgaaatggaaaaattaactctcacctttgaggacaagacttttacacaaatagaagatcaggattggaatggaaaggagacttatgaaatttctgatcttgaaaagcctctaacaaatgtttgccatgaattttctaggacttcttataagaaatgaaatgccaagcacagagaaaaaggctgaaggaacacgtaatagaacaagaacacgctagagaataacacataacagaacaagaacacgctagagaatacagagtacacaagcagagagcctagagaggcagcaagaattgacaggaagtgctgagttccaacctgcggtggctgtgtggtgctgaaccgatactctccttgtttgtctcggttgaacacaactttccgaaggaccatgtcaaggaagaagttctgagagatattccagtgagttaagaattaataatgactaagtcattttttattaatgtgcacctttttaaaaaatcacacatgctgcataattgatgaaaaggatattttgattttcatatatggaatttcagttaatactgccaaatgatcaagaatgataggacttttgtaacaaatacaaatcatcataaaattcttgataaaatgagacttctaaattttccatgaaatatggcttttgtataaataggtctttcccatattaaaatgatgcttatgtaatttgaaaaaaaaaaaaaaa

SEQ ID NO: 4301 - DNA, 397 bp, Homo sapiens
atattttaacataaattaaagatctaggtaagcaaggttttccagaacccctcaccagcagacttctacttgcatctcactactacaacaacgatgtcacatggccatccctcgctgcaagcaaatatggaagagctagtgaatgtttcaagcggatggcaatgaggagaaggatcagaatggctgttggatccacccctcttcagttttgccataatctgtaactattaataaggagcctccttcctagtcaggttgacccaaatctctggaaagcctactgcacttttcaaaagcatagtcaatatgctttcatatttggaaactttaaaaatggataatatgtataaagaaaattaaacttaatatctacttgatgtctggaaaaaaaaaaaaa

SEQ ID NO: 4302 - DNA, 785 bp, Homo sapiens
tcaccattagctgtcagagttggaaagttgcagaaatcacaggaaaccacaagtgaccaccaataacatttgtgacactgagtcaggtgcaaaactgcaaaccacctggaggcagctgcaaacctcacatccactgagactacacttctgcacattcttgccaaaagatcaacaatatcatgtctacctcccttctacctttgccctaacctggaaacactctggcaagggattttgggaatgtgctcccaggcatctagtccctggaatacaggggaggaacacagaaggggcatggtgttgtgttgccaacagcctagcgcaagcagagatgaatgaggaatttcattctaccatatttaacttttcaacttccactttttcctctgtaccgtcaaggtttccctgaagccacaagctgctcactagatggaacattgcactctgggtacacagacatgggttggatactcacagtagtgtgaccttgggcaaatcattcagccttgacttcctttggtcaaatgaagagagagagaaaaacaaaaacccaaagacctactttgggaatgttgtgaagagaataagatagtgcatgctaaatgtttaataaattctaacatgccacaaaaattggaaagtataactatgtaaacaaattaggtctggcttatttttccgactccaaaggatagcaatgcttatctccagggaatacctctacctgtcaatctcatctttgacttccttttatctggccttcattaaaaaaaaaaagctttttt

SEQ ID NO: 4303 - DNA, 244 bp, Homo sapiens
gtagtaatgacaagactagcatttgctaatcaaatgaaatgtaaagaacaacaatgaagaataaaaacctacaacaagatgatactctaatcagaggacatggaaatggaagaaagtgtgtgctatgagatgttagcatatatttcctttgtttataaagccaaataggattaggcttccagaatttttggaaagaaaattaaatcaacggaattctaaaaaaaaatttttaaaaaaaaaaaaa

SEQ ID NO: 4304 - DNA, 839 bp, Homo sapiens
ttaagtctcttatcaccatttagcatcatattttacttcagcactttgtatctgtggggctcctttgacctttaccactttgggaatttctttaaattatttttcaaagggcaattaatttaaaagtgcccaggggagttccctcacaaggaatttaaaaaaataattcctttaaccaattttaaaatggcaaaggaatttttgtcagtttacagtttatgagaggaatgctttaccccccataacccaaagggcaggtgcattttttaaatgtggttgactcaacaactaagcctgtaagagtgtctcaatctacagccacttgaagagagtactccttctgtaaaataaactagttaaaagcatcaggcagaggggacaatgaatgctttaaccactttaaggaatttcatctcaaatttgaacccttaccaagagatagtagtgaaaaactttatgtcttagtgaagatttttaatgaacatttaatatcaaaggcagcactttcagcagtatatcacttgctttaaaaccattccagggcaatggctgaaacactgcttcagagtgaaatcatgctacttggtgtttggcatcagttttctgaatatgagattttgtttcaaagggcagtgctcttcatgaatctcttctgctctaaccaccaagtatggaaagattgtctggaagccacctatattgaatgcctgaggtaagtgacaaagccagaaatcaaactgaggcttccaaatccagaccgcatgctctctccaagaggcgcgccaggctatctgaaatttgggggaaataaaacagtgatagattaatggcaacaaaca

SEQ ID NO: 4305 - DNA, 637 bp, Homo sapiens
tagagaacgttgctgtggagaagaaaaatagagtgtgagcagaagaaaatgaaaatggattagacaccaaactgctgacaggctttgcagcttttcaggagtgggctgctaagtagcttctttgggcattttgtgggtgtggagaaaacaatgacaggtggcggctagtgtaagaacaggaaactaggaagagctcatttctcgaaaggaaccgcctgcaatgacttcaacaattagacgtgtattgggtttatatcactcctgttttaaatgcatatagtgtatcagtcatctatgctgcagtatgaattgtaataattagactattccagtgttctctgatcccaaactaagatcagtgcaatgagaacttaggagctttgagtagaaatatgaaaaaagggcataagaaactttgagtggtgtccatagcagcattattcataacaaccgaaatgtggaaatgacccaaatgtcccttaactgatgaataaataagtggtatatccacacaaatggaatattatttggcaataaaaatatatgaagttctgatatatgctagaacatggatgaactttgaaaacattatgctaaataaaagtcagacacaaaaggtcaaaaaaaaaaaaaaaaa

SEQ ID NO: 4306 - DNA, 252 bp, Homo sapiens
ctttttgtaatctactcatttatatcaagttgaagagagatttccctgaacacagaagaaggagggcttatgaagattcttttttctttattttctcttttgttttggtaagtggccttaaggaatctataattcttcaaattccatggaagagaaacttaactaaaacattcagcatatttcttccagtgatttcccaagtcatctgctattttgctaataaatatcttatcactttgaaaaaaaaaaaaa

SEQ ID NO: 4307 - DNA, 810 bp, Homo sapiens
ctagggtgcactcattaccctgtctcctcacaatgtgaaataaactccatgaggatagagatttcatctgtcttgtttggccctgaatgacagtgtgtgaaacagagtttggtgaagaaaaattgccctcagggtttctctcagacaatcgtgtccaaagcaagcctcacactggaagcatccacacactgggatcagcaggaagaaaaaaaaagtgcaaactgaagtagagagagaaaacagaaaacccagagttccagaacacaacattctgggtccccgtccaagaaggacaaacagtctcctcagctctaggtcaaagagcttctctgtagtgcaaggactaatgcttctaatgatatgcctgagtcagtattaattttaaaattctgttcaacaagtttctttgagaggccttgggaagctgttattcgattttactctaagcataattggagtaaaatactttttgaaataatgcctcagttattgggaatagccacctgtatatatcaaattattactgctttgtattactgatcacttcatggcatatatacaagactttaacttcatgatgctgctctataccaacatcacattacaagtactattactgaatattactgtaattgttagaatataaattttattgatattttaacagaccactgattatggcataaaagtatttgttcagttggtctcacatatggatgatcttaattgtagagctcttagacatagagatatatcttcacagcaatagtaataaaggattgattttatctactaaaaaaaaaaaaaaaa

SEQ ID NO: 4308 - DNA, 778 bp, Homo sapiens
tgccaagacaattgatggagcatgaaaatctcgggctaataatagtatatgaaagaagaacagaaagtgtgtgccaaggtgtgacccactgagagaaccctggagacaagagtgtacagataatgtatcacgtaattctagattttgtcatgaattccatgatgtattaaaataattatttcaggatattattgtcccattggcttcaaaggataatgcagaaaaactaagagcctcagaatttttttaaagaaaatcaaattagctaccacattaaaagtctatttttatttcattgttgatattttccaagaaaaaatatatttctaaaatcttcggaatccatttgtgtgttaccttttaaaacataggaaaaaggtaaaataggccatcagctgaaaaacacttgtctctcctgcagtgcgataatctactcacatgaaaatataatgagccactttaagaatcatcacacacatctcttgcagtttggcccatcgttgggaatttgccaggaagaaagctgcctatcatctggtctttgggaccccatgtgatattttccccgattccgaaaacccaccaatctcattcactgagagaatagtccaatgatgtgtcctttgtgaacctctctccctaaccaccaacacccttcccagcaaaaaaaacaaaaaaatgggcctccttgccctcagcgggggactcttcaccccctttccctcagtgcgggtctatttcccatcccgccacctgactctcctccccttggcctttt

SEQ ID NO: 4309 - DNA, 291 bp, Homo sapiens
  misc_feature (1)...(291): n = A,T,C or G
gggtctcactctgttgccaggctggnatgcagcggcgcgatctcggctcactgcaacctccacctcctgggttcaagcgattctcctgcctcagcctcccaagtagctgggattacagggagaagatgcctcctgagaaataaacctgtcttccttcagcacacgttaccccattgaccagccatggttgtttcccatcttcactaaagttgttctgaatgtggtaatgtgatttcctaagcaaagtatacgttcttccgtgcattaaaggaggcatgacacatgacagaa

SEQ ID NO: 4310 - DNA, 270 bp, Homo sapiens
actttcaagccccagtgagcaaagagggaacctcacttttacacgaggtgacctttgcacaggcagccatcgatgctctgaagatacaaagagagcccctccatcaggtcatcttcctaactcaactcagccacaggagtaagaaaatacatcaagctcaatgcaaactgtgagctcagaaaatctggttactaattttatttcctgtctttgatgatctgtctctgggataaagctcttgatatttctgtgccatgaaaaaaaaaaaaa

SEQ ID NO: 4311 - DNA, 937 bp, Homo sapiens
aatgagcatcagagatcaccccaaacagacaacctcttggaactgtggaagatgggggatacccaagggtgagacacctgcctgccttcccaccccacctggcctcaagcagtacctgattacatcaggactgagctgcttggcctgcagaggaagcgggaagcagtcagatgcaaggcacccaggttagaattcaaatgctgcaggcaccggggtctgcatgacaggacggcccagtttacgctgtagctgaggaaactgaggcaaagaggacgaggaaagctgcccacaatcaccctgctatggcccaggactgcagttcagatcccaggacttccaggctggtgctttttccaccacggaaaatattaaagactaaataaactacaaacattactttaaaaaaaaaacaaactaacaaataataaaaataagaaaataaaacacactaaactacaaaaaaaaaacaaccacccaatataatatcaactctattaaaaaaccagatttaagtctatttcgccttcctttccttttagttgtaggtcttctatacaccttttattcacttcgccgtactcttttttctctcgcccttctccttcacactcctgatctttatccgccccacacagatactcatagtgaccttcaaagcactataatttctctctttatttcgtttccactcctactctcaatttcccatgacacccctatctctctcctcggcctagatgagtgcgcgattctattctccttctcgcctatctgcttttcccttatgcttcatcatacacccatctactctcttcttactttaataatatgcattatcacctataatttttcccgcgttatctgttatatcttcgttcatctcgttcgaaatctctttattaccgtcacacggagatctcgaaacaccacccccgcg

SEQ ID NO: 4312 - DNA, 811 bp, Homo sapiens
cagctcagatgctagaggagtgggaagaaagaggcagcgagccgacaacagcccaggacccagtgtctgcttcctgtccccttacttggttttaagagcctactgggaacaagaaggaatgaagtttgttcctgttgtgagacccaaatgtgcagagcaccatgctaaggaaaagttagagtcctgcgcccatcgcttcttctctgtgacctagaaggatgtgacaggaaggtaaaggacagtacctgcatgtcagcgctgtcgcacactctgagaagggcagtgggagcccagtgaagtcaacctggaaacatctgtgcacatcagggcaggacgggggcccagggcctgagagaaagaaacccgactgctggcagatgtctccaatttcattactactccacgttgccaggcccatggtgatgtcctcacatttagctgcagcctgccgtggccaggcataggttggcagcatcactcagcggggtgccttctagtggaacatgggtgcacccagagccttgcccttcctgctcagccttagccctcagtggctgcagaaggcaggaagaccctccagggctggcagtgtgctgtcatcaggacacgggcttgcagcttccaagtcccgctctgcctttatcatgtgcctggccttggtcaagttactcctctccaagcctgctccttcatgtatatggggggagtagagtaatgggatcgatttcatacacatgattgttgcttggattaaaatgaggttattttgaaagcacattataaactataaaataaaaaaaaaaaaaaaaaa

SEQ ID NO: 4313 - DNA, 541 bp, Homo sapiens
agagcattgccctaaagataagaagaagaagaaaaaaaaagcatccaaacttgaagaacagctttgatcagctcataatgcacagtgaagacaataatttaagggtgaatcagagtgcagcaaagtgattccaatgaaacctgatgctggctaattacttctctatagatggcagtgttcagtttactgagcatctgtgcatgacagaatttgggacactgtgggtggtacaattccaagatatctacacaatctgaaaagcaaaatattccaactacaagtatcattttattaggtgaaataaactatgtatacaaaaatctcattttgtaattaaaccataggccacactgtagagccccaaaaaccacacctgtttggataaaagcaaacaaatcataccatggaagctgtacctgtttggaacggggcttagaacaaaagggtttagaagacagatgctactgtgatgctgcaaaagattatttacctcccagattttaggtgtgaagctgtaataaagttaatacaactctttaaa

SEQ ID NO: 4314 - DNA, 508 bp, Homo sapiens
cctgatggacaggcctcagaaaacttacaatcatggtggaagatgaatgggaagaaaggcataacctacatggcagcagaagagagaaagaaagggaggggcaaagtgtcacactctaaaaccatcagctcctgtgagagctcactgtcaaaagaacagcaagagagaaatctgcccccatgatccaatcatgtcccaccaggcctctcctctgacacatgggaattgcaactcaaggtgagattttggtggagacacagagccaaaccatatcactctgcaactgagaaagaaacctgagaactgcatctggaagaccctttggccctgaggcttgcctgtgccttctttcttctactatactataccctgtatctgtattaaatccttttgtgaggagaccctgaaatcttgtgaattctttcaaatatgtgattatatatgatcaatgcaaaaaagacattaaagttggaaaaatttaatgtttggttgtataaaaaaaaaaaaa

SEQ ID NO: 4315 - DNA, 759 bp, Homo sapiens
ttttttttttttttttctttttttttttttttttttttttttttttttttttttttttttttttttttttttttttttttttttttttttttttttttttttggggggaaccaacagaaaagggttttttttttgggagggggccctttttttctatttttccttcccattaaaaaaaaattaacccggtcccttttggggggggggataaaaccttttttttaaaaacatttttttttaagaaaaacctttaccccaccctaaaaaaaaagggggggggggggggggggtttttcctaaacccttaaatcgcctggggaaagattattttaaaaggaccccctggtcttttcccctgaaaaaaggattttttccccccctttttaaaatcctttttgcaaacaccccccctcggctaagagggccccccctctaaaaaattccgggcccgccttgggggaaaaaacacaccaacctcctcccgcggggttacaacacacgcgccccctcttgggcaaaccccccctcccccctccaagagcgccgcctccccccccccgcgttcttctttcttctcccgcccccgtcccacgtccgggactacccacccacatcgccctcctcacctccaccgcaaggcccatcaactgcggaccacccaaaaatgtgtgcccgccgcgcgccttctcccccaccgaccagaactctcacatcccacccgctggcagtccccacccggccgcacaaaccaaccctatt

SEQ ID NO: 4316 - DNA, 743 bp, Homo sapiens
cagatcctgtaaagaatatgctcccatcttctgcaactaaaagggcgtgagagccatcgtgtcaactgagaagtgtactatctttggagattttgtaattggtagctcaacccattttcctgctgaaggtccaccttgtttgattccaagactctggtatttgccagtgtaatatatcttatgtattaaaaaaaaaaaaggaattatggtactttttggaatagtgcatcaggtttcacatgaggaaaaaaaaggacatcaatattttattgaaaaataaaattcacataaaaacaaactcttttttacactattcagcttctgggagctgagcaagaaatacacatattttgccaagaagacacagttcataatagctttttcatatcttttatccattaagtttcctgtcttctataggcacaattcacagcaccctaaaataattacaacagtaacatcaaagataacagatcaccataacagatataataataataaagaagtctgaaatatttcgagaattacccaagtgtgacacagagacacaaagtgagcacaggcggttagaaaaacgatgccaacagacttgctcaactcagggttgtcacaaacctccaatttgtaaaaagagcaattatttgtgaagtgtaacaaaactaagcacaataaaatgaggcatgcctgtactgttccctacatggataaaattttatcttattaaaaataaaaaaaaaaagaaa

SEQ ID NO: 4317 - DNA, 431 bp, Homo sapiens
gctggaatgctgggaaaaaatcaaaacaccctcattttacagatggagaaattggctcagagaggtgaagtggcttcctgagatcacacagtgaatatgtgaccaaggaggacctgaaaccaacccacccaacatcaaagcctgtgcgctttccaccaggctgaggtgtccacccctgtggtcagtgtgtgtctcagtgtgggacaaaggaaaaaccatgcagctttggaggtctccaaacctcccagtttaggataaacccctcaattatgcttgaagttggaccagcttttgaaacctctactggacattcttttcccatcaagttccttgaaatgtctctttaaaatacatctaggaaaagccactctcattagccagagtctgactttattttcctaataaacagacctccagtaagacaaaaggaa

SEQ ID NO: 4318 - DNA, 361 bp, Homo sapiens
cctagggttggctcaaggagaaccctatgattgaaagccctcgactccacctcatccaactagatggatgcaagctccacatcttccttcctctgttgtcttgctctttaaagccaggaataccccttatcagctagttagctctatccatccagagttctatttactgtatccagtgttttagggtgagaatacttctgtcctgtctcattttctagtagtagatgtgtgtatcttttttcccaataaattattgccttcatagcaggaagtgtccatacaaaacatccgagttactttatacataagatctctggatgtgaataaaaataaaaagttcctgtcagtaaaaaaaaaaaaa

SEQ ID NO: 4319 - DNA, 516 bp, Homo sapiens
ttccttggaaaagtcaaaagtagatgaggagcaactgaacatggaaaggaaaccagggacaccttaagagccaaccttcttttcagagaggtgccaacaactactagcaacactattgcactacatcatatttccaggtaaaatgggaacagagaatgtgaaaatctattctggggagcagcgtttcacaaataaaaacttaaaaggaaatagaaaaaaaatcaattagaaaatactgttattgcaacaaaagccaaaattgacaaatgggatctaattaaactaaagagcttctgcacagcagaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaaaaaaaaaaa

SEQ ID NO: 4320 - DNA, 276 bp, Homo sapiens
cctggctttagcttcaggacaagtaatatgaaagaaatggcccatggccaggatatacagaagcccaagatcctgttgtttatattcagaagtccacaagaagatgtgatattctcagtatctaggtcttctgtaaaatagcaattcaaattttgaggaacactatgctataagatagttattgcttgtgttctgtgcaaattccaataacatttcgtgtgtgtgtgcacatgtgtgaaattaaagttttattttgcatatctaaaaaaaaaaaaa

SEQ ID NO: 4321 - DNA, 410 bp, Homo sapiens
ctaggtgcagcctatggggaagttctttggacaagcagctgatgcttgctcgagtcaccatgtgaggtgggcatggactgggacaaggacagatggactctgaagccctctaaaaatcctaagacaacacagcacagactttggaattgggcaggtctggactccaatgtctacccttccccggtgaccctgagaaggcaccatagctttcccagccttggcttccccatctgtaatatgcacatggtagaactgtttggtggaataaatgagaaggcaccatagctctcctagcctcggtttccccatctataatatgcacatggtagaactgtttggcagaataaacgaggtgatacatataacgggtttagcaaataataaacatggaacacgcaaaaaaaaaaaaa

SEQ ID NO: 4322 - DNA, 765 bp, Homo sapiens
cctgatcagatctccaagaacaccatcatcaccagtcaactatgagtccagagaatggatcaaatatactcctctgtgaagcccttgaacttggtttgctttgcctggaattatcttcattcaaatatccttgtttacattccttgattccattaaggtttatactcatattcatggcataaaaataaattataatccaatatcaacttttgaaagatccttccaagagaattgtcaaatccatatatgtattatgtatgtgtgggtgtgtgtgtgtgtgcgcgcgcgcttgatcatgcatatgtgtgcgtgtgtatcagccagctagattgtcattacaggctacatatcccgtcgcactaatttaataaagcgatttaaatactaaaatacttactttatatccttaacaacgatcaatgtttgatgattgtactttagagtttcttatgggattgtcttcgcggttaactattagtcggctgtttaatgtctttcgggcataacattgtcatgtctatttattgattcgcttggattattctgacgctcttctatccttcaccttttctgcctcataattaccaagcttcgggcgtataattctctattgttgatgttcttttgccgcacccctattttgttaggggctagatgccacgatatcattttccaggtttgtgttatttatgggcattttagttgtgcggtgtctcatattgtcgggttgttgagtacgtatgcgttgcgcctggtcttccttag

SEQ ID NO: 4323 - DNA, 372 bp, Homo sapiens
  misc_feature (1)...(372): n = A,T,C or G
ctaggtgtgaaagaactgcactgcacttcttaaaagaatcagatacagccatatctatgaacccgaggagatgtctactttcaagcataaaaacaagctgcagagtgatatgtacaccatgataccatttaaaaacaaaaacaaagtcttacaaataatagctatgtttggaaaaggagggagaaagccataaaagtatacatcccaagctgatagcactggtnactcaagaggatgggaatgggaggaggtggagggaaggttattatctttctttacatatatttggattgtttcacttcttaaagtacatacttgtttttcgtgacttcagaaaacattaaggacatttaaaaaataaaaaaaaaaaaa

SEQ ID NO: 4324 - DNA, 710 bp, Homo sapiens
tttttttttttttttttatgaatgtctctttttattaggctcagaatttttaaggaaagaaaatggaaggaagatgatgctattttcttcttcgctgtatcttcaagttcagttactataatttaatagattcacttaaaagggggttggcaaagaaacctccttggaaatgtatcagtatcaaccggaaaagcttctgctctttcttaaagagaattccatttatgttagaagaaaaaaaaaagcaaagcaggatagttaggtctgtaatcagttttcaaattacagaagatgttgtccattgttgcaaaatggggctctgacaagaagtcaatcaggtgtatttgctgcatcgattagcacttcagtatgaaggaaaaggtgaggctttaccaaggcctgctctccagggactacataagctcctgcactcagaagcatcagtttcactcagatattttactctgtttgccttcccaaagcaagcagtggattcactgaggtcctccatattaaaaagaagttgagaacccttctgtttggagtgagactaaaatcagagtgagatgagttgaagcggcaagacctggtggtcatgacaaggacttctgaattcagaccatctgggttccatttcaggctctgccacttaatcatcaccatgttgcttaactttgtaagctgtaccttttttttctttctctatcaag

SEQ ID NO: 4325 - DNA, 452 bp, Homo sapiens
tttttttttttttttttaccacatagtaccatttataaaattaaaagacatgtatataacacaatacgtattttataagaatacaaacagaacatcaaacatgttagagtggcaatctatggggaggagaacaagagtgggaaatgaggataacgggaaataaatagataacaagagaggcttgcacacagcaatgagaactatatgccatgaactgaacagcatcatacctccaccctctgcacagaggtccaactacaaaaacaatgaccccaaatcttagagcagggagattgtaatggactgctccagttacagagccagggcctggacttgaacccaggtgtcttgcacctgccccagagcagcaccaggagtccgtgggtcttgaggacctctgtgtatttgtcaattttcttctccacgttcttctcggcctgtttccgtagcct

SEQ ID NO: 4326 - DNA, 540 bp, Homo sapiens
caatcttgaagatcagacagaaaaccagcctatgaatcaaagaagaaaatcaaaatcagacttcataactgcttcagtaacccttggcaacagacaacacactggattttggcgaataacactaaaatttttgctggtgaggtcttcagaaactggatagatgtgaaaccaccagaacagaagtggagcgggcatggtatccgtttcttcaatttgtagttttatagtcaaaaactggcatgtatatacttaattggtaacatgtaagtcacgtgcctctatcccaactctaagagagggtaagaacttaatttctggcttctaccttgggaaggatcaggcttataagctggaaaattagcccacatacacagggatattcaaagcttctaggcagtcaaaatactggcaaggggaaaaacagacatgaaaaaacctttttttctcttccagaactaaaagaaatttaattttttgtaaaacactgtttgtgggctttccatagaagtaaaagagtcttgggaggagggaccacagaga

SEQ ID NO: 4327 - DNA, 715 bp, Homo sapiens
gctgggcttcagtttaacttccactgttttttctggaatggaccactgaaggaagttgacaaaagtgagagataaagctcatcttttctagctgaatggatgctcaggagctggagacacatcttggtatctgccttacaatctttttcaagcaaattatttttatcccctttcgccctctttaatatgacatggcttcttgatgctttagctcagcctgctcaacctattctgaatgcatgccagattggcaatgtccctgttagaatgtggcccagaagtaatataatcatctaggttggtttgaacagtgcagagtatggggagaatatatcattttctgtggtgtggatactatatatatcatattgtagcctaacaatatgttgatgtttttagcagcctgcatttaactaaacttgtacttgtgatggtaaggcctttgctttgaattgctatttctggctgaccaacatggttccagggaacatataatcacagacactctggggaccagaaatgtagatagtgtaggcaatactgatatgaaggtagttatcctcttcttcctgtggaatactaattcctgcatatatttctgtaaacccattcccttttacattgctttatcatttatgccattaggatacatttacatgatgctaaaaacatgcaaaataaaaaaatcaaggcaaactaaaaaaaaaaaaaaaaa

SEQ ID NO: 4328 - DNA, 1269 bp, Homo sapiens
ctttgggcaccttggccacagctaagagtttcctcaggactccgaaatcagtggttactgacatctcttcaccaactaagcagtcaaccttgattgaaattaacaccatttaaagataaaaacctgatatgcctatcttaggagaaagttgttatatgcatttgtttctggattggatttgcccctgctgttttaaagtgttctcaaatgttctgctcatgacccttctcatcaaagatgtggtttaagaacataaatcaatgaggttgtgtgatatggagaactgcctctggtaaccacaaacatgttcccattgaggagcgggaagaagttcatgtcatcttctacttacctaaaggggtgcgtaattcacagtgataaacaatagcaaacttgaatttgtttttgaatactgatatcaaccaaatataagttccttctataataaaaatgtgtttaaatgataatgaaatttggatatcatctatatcacctagaatattttgagctgcaaataaaaaatgacaagtgattcacagcaaaaatattcattttatatataacaactctgttgccttcaggattaaaaatttaagcaagccattagggatccaaatatttcccaatttttatactctcctattctcaggcagagtccctcatggtggcaatatggctaccactattccagtgatcacatccatcataagaatatccaatgcaagaaaagcacgtctcttcctgtgtgtctcattttaacagcaacaaaaccttctcaagaaccactcaacagatttcactttgcatctcaatgtctaaaactggatcgtataccatgtcttaaattaaactctgataggagaactaggataaccatgttggctaggggaaagggtagaaacctgaacaaaatttgggtttcaccagcaagcaggaagaaggatgtctatttacatctacaaaagatggcataactagaacacaagtagtccatgtgcttacataaagtcagcagaagggccaactattcacctggaattatttggaattatgagaaaaggcttacaaattggcttacaaattaagataaaaatcatgacccatctacaaaaattggctatctttcaataatcttattaaactttgaaattatagttaacactaccatcagactttctgtcattcagtttttatttatggaaaactattatggtctcaaaatcaatttttaaacaagatataaatggatttataaaaaaaaaaaaaaaa

SEQ ID NO: 4329 - DNA, 228 bp, Homo sapiens
ggaatatactgccggagcatgatataaaagatacatttaaaaaagtaaatctgagaaaatatggaagctttgacctcaatagtttatattaaacaaagactactaaagtgtggataattgcaaagggcagaaaagcagttataatggccttcatcaatgtttgtcaacaacccatggcaaaacctgttgatgtaataaatgtggcaaagattttgaaaaaaaaaaaaa

SEQ ID NO: 4330 - DNA, 784 bp, Homo sapiens
cgtaggccacccacccagcgagatttagaccacaagttctgtctcatcttctatggattcccacatgagtcagttcagttttggaagactttgctctgctgtttggatgcatgagaagaagcacccccttttctcctgttctcctttgctggatcaagtcatatcttcacatattgtctggaattgctacagctattttgaaacccaaagtgaaagcatcatcaacctgctgaggttagcaaggcagaaagacaaattcatcggtggacctggatctgcgatgacttcatcaaggctctgagccaatcgtggaccacctggcctccagacatcatcttatgtgaaatgatggctgtccttattgtgtaagctatttggtttgagtatgttctgcctatcagctagaagcgtccaactgatgccaatgcttctggtaaaagttgtgattaaagcagataacggtgttagctgacgtgctgataaaatcggaatcagtacatggccaagtcatggatctggtggaaagtattcaaatagatcaatgcatgcttggtgatgctggtgcctgtcatcataaacatccatccaggccatcatgatcacctccgaatggtacaggactaaagtccaattcaggatctacacaccctgcttataataatgccctaacttcctttgaagatgaaacgcatttctctgtgttctttgaactattgtacagaaaaacttccccaggaaactctttgaactcatatttgtatgtttctcattaaacaaaacaaaa

SEQ ID NO: 4331 - DNA, 339 bp, Homo sapiens
cctagccagctcgtggttcactcacttttggagaagctgtgttatgtccagatctaatgagaggctcaccatataatgaagtgaagcttcctcccaagagccatctgaatgagctttgaggaacaccccccggccctgatcaagtcttcagacacttcaggcaggtccaacaactagttgtaactcctcaagaaaacctgagctacacctccctagttaaacctttactggattcctgactctcagaaaatgtgtgagatgataacatctcttgttttaaattgattaattctgcggtgattgttatacaataaaagataaccaataaaaaaaaaaaaa

SEQ ID NO: 4332 - DNA, 269 bp, Homo sapiens
cctgacaagccaagtacggaattgtttcaagagatcaagttgatctacggtataaagagttgaggaagaatggtaaataggacgtggcacagtgaagcctcatgagctgtgttctggggagaattttgaaggtttggcatgtgaagacctccagagctacagttggagaaaagagaagagatgattgagatatgtgctgcgggtttttaattgagttccttctatgtttgaaaaattcaagtaaaaattcaaagacaaaaaaaaaaaaa

SEQ ID NO: 4333 - DNA, 278 bp, Homo sapiens
gacttgtcggcaaagccaagtacgcgattatgtcaagagatcaagttgatctacggtataaagagttgagggagatgggtaaataggaagtggcacagtgaagcctcatgagctgtgttctggggagaattttgaaggtttggcatgtgaagacctccagagctacagttggagaaaagagaagagatgattgagatatgtgctgcgggtttttaattgagttccttctatgtttgaaagattcaagtaaaaattcaaagtctttaaaaaaaaaaaaa

SEQ ID NO: 4334 - DNA, 885 bp, Homo sapiens
gttggtcctgaaacttctttaagtgggttattctggggaggagccaagacggccgaagaggaacagctctggtctacagctcccagtgtgagcgacacagaagacgggtgatttctgcatttccgtctgaagtaccgggttcatctcactagggagtgccagacagtgggcgcagttcttccgagaaaactgaagacatgaaatgattcaacagcctgtgaatctaccccatttggaatcccactaggcctgatctgttttccattgccagtgcattgctgctaaagctgtaacatatcaagcaccctccccaaagtctcaaagaccaccgcagaagaggaaggtgcatgagattgtaagagccagattagggggaggaatgtagaggctgaagcatctccatcttggacgctaatccaccatgtttgcttctgactaacctcagttccaggaaggcctctgaaatgtccggtttatctattattccctgtgtaagggcagttacttaccttgatagagtttggatatttgtcctgcccagatctcatgtcaaatagtagtccccaaggctggaagtggggcctggtaggagatgtttggggcatgggagctgatcccttatggcttggtactgtcttcgcaatagtgagttctttcaaaatctgttcatttaaatgtgtattgcatctcccagccaccacccccatcaattgctcttgcttgtgccatgtgatagtcctgctcccccttcaccttcaaccatgattgtacacttcctgaggcctgcctagaagccaagcagatgccagtaccatgctttctataaagcctgcgaaaccatgagctaattaaacctcttttctttataaatcaaaaaaaaaaaaa

SEQ ID NO: 4335 - DNA, 686 bp, Homo sapiens
ctagttcttcttcaatatctgtaactcttcatatctgggactggcaaacaaccactacaacaaaaccagagtggaggcggagggcaccgtggaggcctctttattacaccatcaccactggataagcccgttggtccacttctgcagagaagtcacctgggctggtcagaccctccccagaagatacttccagcttcatctggagagtaggggcctttctgccagtgtatgggaggatgacatgaggtctgaggatgttatttactcactcaattgtgtctgtgtccccaagtacagagtctctctcttaatcatctccagaagacaagtatctccagtccaccaaggctttggagggggctgagagattaagtgcttcttaaatagctttcaaccaatacagatgtctttagcctccttttactccagcttccagatgatgtctgttgccaccaattcctgggaatttgagagattctatcatgcgaacgggtttgttccttacatctgctaaatctgttacaagaccatctgcttccagcttccaaagtattgtggctgttgcctcctctcttgcttccgtatccttgtgaggcaatgcacttaaaaaaaaaatctctttcctggtattttaatgcaggctgggggggacacaaattagttgcctaccttcaaaaaaaaaaaaa

SEQ ID NO: 4336 - DNA, 441 bp, Homo sapiens
  misc_feature (1)...(441): n = A,T,C or G
tcccgtgagtactcgcatatgtgagtgcaaactaatttgaaaagtnatgtttcagagccaagataattttaaaaataatttaaaaaacacttgacttaaaacacctcatttaaaaaaaaaaaatcattaattttcaacatggtcctaaatttattaaggtcagaaaatctcttcaaaagtcatttattttatgaataacttaaatacaaaatgccttcaattaaactaaaataatacacaaatttatgaaatagctaaaaaattattagaagggtatcaattgaaaagagataaaatctcacgagtaaatttagcatatctgtccagtttttgatcatcaagcatgaacagtccacatattgcttaaaggcatacgtgtatgccccaggcgtcacaatacatgctatttcacgggttgggaagaaaaataaaaccagatgc

SEQ ID NO: 4337 - DNA, 514 bp, Homo sapiens
agcagaggagggacaggatcagattctgcgcccagaggaagactggcttagaggaggtgagtccagaggccaggagaatatcagaggccaggacaagggagacggcggccaaaccagggaagtggcactggagagaaatggatggattcaagagacgttaggcaaatggacagaaaacagaaaccgcgcacgtggtggttggtgagttgaatgcatgcaggagataggggcccaagggagaaccatagggggttgattccaagggtctggtggagcccctgaggggttggagacacccagctggtcagccacacagtctggtattaaatgacacacggctggtcagccacacagaagctgggcagtgtgaatgggtccggtaccgacttcagagtgtgcacctctgtctccccagacagcaacagaaggaccagggaaatttaaaagggagtctatgatgatattgtaatataaaatctctaatgaagatgtgactactagaaaaaagggaaat

SEQ ID NO: 4338 - DNA, 282 bp, Homo sapiens
cactctgcaaaatgcttttcccagatgatcacatttagcactcaagccatggcatgaggtgatgctgatgctgctgatcttgggaccatgctttgaaaaccactgggtggctctcaatcctggcagctcactggactcactggaggaatcttttaagggctgtaatgcctgcacctcaatccagaccaatttaattagaaactctgggtgtgggacgcaaacattgggaggtgtaaaataaaccatcattttcttctcctggaattaccacaggtctataat

SEQ ID NO: 4339 - DNA, 688 bp, Homo sapiens
aaaaaatagtacgacagaaaaaaagacgatatctaatcttccttcgttacacccatgtgaagaccttgcctgattcccctttgccttccaccatgattgtaagtctcagacgaagcctacacagactgcagaactgtggagtgataaaacctcttttctttataagttacccagcctcaggtatacagattatacacactgccttaaagattttttttttaatggtcagcgcaacaaacgaaagtcatagaagagatataagtagagggcaagttcaccctcctgaagaatttgagaatccatcattggcactggaaaatggaacaaaaagtcgacttcaaaggacctagcccacatgaaaatcctcctatcacacaaagctccgatctgctgctctttgaattaagccatacacaccataaatagctctcaccaaattatggattaagtcaaatacatcccgacacaaacgctagaatgcagtaggcaagaactagaacaacagcagccccatgacccgctagataagagcatatcaactgacccagctcgcagacacacacacagctccgttaataactaataaaacctgaagcgtcaactgtctacaaataggccaacaatcttcataaaccataatataaacaaataacatttccataatgattatctttaccaatcacctacg

SEQ ID NO: 4340 - DNA, 757 bp, Homo sapiens
  misc_feature (1)...(757): n = A,T,C or G
ccatgtgaagaccttgcctgattcccctttgccctccaccatgattgtaagtttcctgaagcctcctcctcagacgaagcctacacagcctgcagaactgtggagtgattaaacctcttttctttataagttacccagcctcaggtatacatggcaagcaggggccagattatatacactgccttaaagattatggtctttatcctcagtgcaacaaaataaagtcattgaagagttttaagtagagggctgacatgatgacatgttaggttcagccttctgaagaatttgagaatccatcattgcactggaaaatggaacaaaaagtcgacttcaaaggaccttgcccacaaaagacaccagaatggcatgaaaatgcacctcacagacagagcacccagctgctgtgctttgaagtcagccacacctcccattcattgctgttaccaattgactgactaaatgctgtggcgatactgaagccgtcttantcccggaagacaggctggaatgcaatggtgtgatcttggctcactgcaacctctgcctnctggattcagcgattctcctgcctcacctnccgagtagttgggaatacaggtgcccacaccatgccaggctaagtttgatttttagtagagaggcaggttctacatttttggcgggtgggtctgactctgaccacagcgatcactgctcanctcccaatgctggatacagtgtgagcacgcccagcccccatgtgctatttagaaag

SEQ ID NO: 4341 - DNA, 284 bp, Homo sapiens
tttaaatcaacagtgccaagatgtacacttttgatttttgtgagctaatgacaaaagtagaaaccatcagtatgtaaatgttaataattctctttcaaagtaaacagatcctcatgatctgtacaaattagggttttacaaaagttctattacagaagagtggtgggaagttggtccttcccatggcatcatataacataggctacatgagacatgtgagacttcctgtgcaatttcacagttacatatttactttgagatcagcaatttagttccagcaaaat

SEQ ID NO: 4342 - DNA, 837 bp, Homo sapiens
  misc_feature (1)...(837): n = A,T,C or G
agttcatctcttttcgtcaacaactcctaacacctagctgaaatcaccttacagagaaaaggcttttgaaggacatgaagaaaaagggggcatatgggatgaagaaaaaggaggcatatgggatgttaagtgccagatgaaatttaaacagctaaaatataggtgaggccaaaagagcaccagggtaaacaagaacagtaaaagatagaaaaaaatgaggaaacaaaaacaaatttgcaaattttgaaaacttgctgaggattcaaataactttaaccctgtaattgggttggattgctttaaaatatgctttaaaaatattaccactgtcagagaccagaatatgccacttcaaaatatgactgtaagagaccagaatatgccaccccaaaatacgactgtaggaggccagaatatgccacctcaaatgtgcctctttggcataaggattactttgagctgattattttgagaaccagcagacacagnaaaagctctaaaacagagtagaaggttacccttttataatggaaatttacatttataaagaaaatctctatttgtaatggtgtctccttctctgtaccaggaaaatcaggatgactgtaaatcacaagagagactagtctatggagaaggtactgactttaatctacatagcaaaacttattcttgtctaatgtgcttttcttggtttcctccctgtaactgactttgccaacacccttctttctttgatttagctaaaggtgatatttaggcctgaatctaagccaccactttgaactacacattgctctgggtatctcccacggtatatatgaaatataaatgtta

SEQ ID NO: 4343 - DNA, 205 bp, Homo sapiens
  misc_feature (1)...(205): n = A,T,C or G
ggggaacaggtggngtttgattgtaagagtaagttccttagaggttgaataattttgatgggcagaagtgttctaaagtatgcttttataaacctcatatcacagtaatccattgtttgaaacatggcttaatgcatgttttaggatgggtgaaggaaggagagaagggaaaaagaaaagatgaagaaaggaagaaaaaaagaat

SEQ ID NO: 4344 - DNA, 803 bp, Homo sapiens
ctaggacagagaacattttatatgatgacggctccatcagtttgcagctctgtgcgatatgatcaacagacccctcttggaagaaaaagattgaaaataaatgtttgctgttttatgtcactgagatattacaattgtttgttaccatatgaaaatccagcctttcttggctgttatactctttaaaaatacaagaatattaattaaatttctacaatactttatagttaaaaaacatatttgacatatgttaatgctccccaataatacaacagtgcgtaagatagtcttcttattttcaagtatggacattcacacacagacccattttcttttgtatgatgcttctctattcctcaattgccacttattctaacaccaccaccaataacaacaataacaacaacatcaacaaaaaccaaactggtaaaaatattttaaaataactacaatttttatatttttaaaaagcattatataaaataaaaatgtcgccattaataataggtaaaaatttgattctctagttcaaatatatttccttgggaatattttgaaaacatttttttcttctgccttacattattgtcagacataagactaaacatactaataaaataaagttctatttaggactgaggtatcaatgaaagttttgccaatgtaatcagcatagtatctccttgagtactcaatcaattttgtcaattagattcaagtgctgagtttctggtatggggcaatgaatgtaaacctcagaaaggaactagtccatttttctctcaggttgtgcctgcagaata

SEQ ID NO: 4345 - DNA, 130 bp, Homo sapiens
aggacagagaacattttatatgatgacggctccatcagtttgcagctctgtgcgatatgatcaacagacccctcttggaagaaaaagattgaaaataaatgtttgctgttttatgtcaaaaaaaaaaaaa

(The sequence listing continues in the following parts.)

What is claimed is:

1. An isolated nucleic acid molecule comprising the nucleotide sequence shown in SEQ ID NO: 20904, or a complement thereof.

2. A nucleic acid vector comprising the nucleic acid molecule of claim 1.

3. A host cell containing the vector of claim 2.

4. A method for producing a polypeptide having metalloprotease activity, wherein the polypeptide is encoded by a nucleic acid molecule comprising a nucleotide sequence at least 95% identical to the nucleotide sequence of SEQ ID NO: 20904, the method comprising culturing a recombinant host cell under conditions in which the polypeptide is expressed from the nucleic acid.

5. An isolated nucleic acid molecule comprising a nucleotide sequence which is at least 95% identical to the nucleotide sequence of SEQ ID NO: 20904, wherein the nucleic acid molecule encodes a polypeptide that has metalloprotease activity.

6. The isolated nucleic acid molecule of claim 5, comprising a nucleotide sequence at least 98% identical to the nucleotide sequence of SEQ ID NO: 20904.

7. The isolated nucleic acid molecule of claim 1, further comprising a heterologous nucleotide sequence.

8. An isolated nucleic acid molecule consisting of a nucleotide sequence at least 95% identical to the nucleotide sequence set forth in SEQ ID NO: 20904, wherein the nucleotide sequence encodes a protein having metalloprotease activity.

9. An isolated nucleic acid molecule consisting of a nucleotide sequence at least 98% identical to the nucleotide sequence set forth in SEQ ID NO: 20904, wherein the nucleotide sequence encodes a protein having metalloprotease activity.

10. A nucleic acid vector comprising the nucleic acid molecule of any of claims 5, 8 or 9.

11. A host cell containing the vector of claim 10.

12. An isolated nucleic acid molecule consisting of the nucleotide sequence shown in SEQ ID NO: 20904, or a complement thereof.

13. A method for producing a polypeptide having metalloprotease activity, wherein the polypeptide is encoded by a nucleic acid molecule consisting of a nucleotide sequence at least 95% identical to the nucleotide sequence of SEQ ID NO: 20904, the method comprising culturing a recombinant host cell under conditions in which the polypeptide is expressed from the nucleic acid.

14. The method of claim 4, wherein the polypeptide is encoded by a nucleic acid molecule comprising a nucleotide sequence at least 98% identical to the nucleotide sequence of SEQ ID NO:20904.

15. The isolated nucleic acid molecule of claim 5, further comprising a heterologous nucleotide sequence.

16. The isolated nucleic acid molecule of claim 6, further comprising a heterologous nucleotide sequence.

17. The method of claim 13, wherein the polypeptide is encoded by a nucleic acid molecule consisting of a nucleotide sequence at least 98% identical to the nucleotide sequence of SEQ ID NO: 20904.

18. A host cell containing a recombinant nucleic acid molecule comprising the nucleotide sequence of SEQ ID NO:20904.

19. A host cell containing a recombinant nucleic acid molecule comprising a nucleotide sequence at least 95% identical to the nucleotide sequence of SEQ ID NO:20904.

20. The host cell of claim 19, wherein the nucleotide sequence is at least 98% identical to the nucleotide sequence of SEQ ID NO:20904.

21. The vector of claim 10, wherein the vector is an expression vector.

22. The host cell of claim 11, wherein the host cell is a prokaryotic cell.

23. The host cell of claim 22, wherein the prokaryotic cell is a bacterial cell.

24. The host cell of claim 23, wherein the bacterial cell is *E. coli*.

25. The host cell of claim 11, wherein the host cell is a eukaryotic cell.

26. The host cell of claim 25 wherein the eukaryotic cell is a yeast cell, an insect cell or a mammalian cell.

27. The host cell of claim 26, wherein the mammalian cell is a non-human mammalian cell.

28. The host cell of claim 27, wherein the non-human mammalian cell is selected from a CHO cell or a COS cell.

29. The host cell of claim 4 or 13, wherein the host cell is a prokaryotic cell.

30. The host cell of claim 4 or 13, wherein the host cell is a eukaryotic cell.

31. The eukaryotic cell of claim 30, wherein the eukaryotic cell is a CHO cell or a COS cell.

32. A method of producing a polypeptide encoded by a nucleic acid molecule comprising the nucleotide sequence of SEQ ID NO: 20904, the method comprising culturing a recombinant host cell under conditions in which the polypeptide is expressed from the nucleic acid.

* * * * *